US011851653B2

(12) United States Patent
Cowan et al.

(10) Patent No.: US 11,851,653 B2
(45) Date of Patent: Dec. 26, 2023

(54) MATERIALS AND METHODS FOR TREATMENT OF ALPHA-1 ANTITRYPSIN DEFICIENCY

(71) Applicant: CRISPR THERAPEUTICS AG

(72) Inventors: Chad Albert Cowan, Cambridge, MA (US); Roman Lvovitch Bogorad, Cambridge, MA (US); Jeffrey Li, Cambridge, MA (US); Ante Sven Lundberg, Cambridge, MA (US); Matthias Johannes John, Cambridge, MA (US); Jeffrey William Stebbins, Cambridge, MA (US); Thao Thi Nguyen, Cambridge, MA (US)

(73) Assignee: CRISPR THERAPEUTICS AG, Zug (CH)

( * ) Notice: Subject to any disclaimer, the term of this patent is extended or adjusted under 35 U.S.C. 154(b) by 595 days.

(21) Appl. No.: 15/779,836

(22) PCT Filed: Dec. 1, 2016

(86) PCT No.: PCT/IB2016/001845
§ 371 (c)(1),
(2) Date: May 29, 2018

(87) PCT Pub. No.: WO2017/093804
PCT Pub. Date: Jun. 8, 2017

(65) Prior Publication Data
US 2019/0010490 A1 Jan. 10, 2019

Related U.S. Application Data

(60) Provisional application No. 62/324,056, filed on Apr. 18, 2016, provisional application No. 62/261,661, filed on Dec. 1, 2015.

(51) Int. Cl.
| | | |
|---|---|---|
| *C12N 9/22* | (2006.01) | |
| *C12N 15/11* | (2006.01) | |
| *C12N 15/10* | (2006.01) | |
| *A61K 9/00* | (2006.01) | |
| *A61K 31/7088* | (2006.01) | |
| *A61K 48/00* | (2006.01) | |

(52) U.S. Cl.
CPC .......... *C12N 15/111* (2013.01); *A61K 9/0019* (2013.01); *A61K 31/7088* (2013.01); *C12N 9/22* (2013.01); *C12N 15/102* (2013.01); *A61K 48/00* (2013.01); *C12N 2310/20* (2017.05); *C12N 2320/30* (2013.01); *C12N 2320/32* (2013.01); *C12N 2800/80* (2013.01)

(58) Field of Classification Search
CPC ...................................................... C12N 9/22
See application file for complete search history.

(56) References Cited

U.S. PATENT DOCUMENTS

| | | |
|---|---|---|
| 3,687,808 A | 8/1972 | Merigan, Jr. et al. |
| 4,469,863 A | 9/1984 | Ts et al. |
| 4,476,301 A | 10/1984 | Imbach et al. |
| 4,587,044 A | 5/1986 | Miller et al. |
| 4,605,735 A | 8/1986 | Miyoshi et al. |
| 4,667,025 A | 5/1987 | Miyoshi et al. |
| 4,762,779 A | 8/1988 | Snitman |
| 4,789,737 A | 12/1988 | Miyoshi et al. |
| 4,824,941 A | 4/1989 | Gordon et al. |
| 4,828,979 A | 5/1989 | Klevan et al. |
| 4,835,263 A | 5/1989 | Nguyen et al. |
| 4,845,205 A | 7/1989 | Huynh Dinh et al. |
| 4,876,335 A | 10/1989 | Yamane et al. |
| 4,904,582 A | 2/1990 | Tullis |
| 4,948,882 A | 8/1990 | Ruth |
| 4,958,013 A | 9/1990 | Letsinger |
| 5,023,243 A | 6/1991 | Tullis |
| 5,034,506 A | 7/1991 | Summerton et al. |
| 5,082,830 A | 1/1992 | Brakel et al. |
| 5,109,124 A | 4/1992 | Ramachandran et al. |
| 5,112,963 A | 5/1992 | Pieles et al. |
| 5,118,802 A | 6/1992 | Smith et al. |
| 5,130,302 A | 7/1992 | Spielvogel et al. |
| 5,134,066 A | 7/1992 | Rogers et al. |
| 5,138,045 A | 8/1992 | Cook et al. |
| 5,166,315 A | 11/1992 | Summerton et al. |
| 5,173,414 A | 12/1992 | Lebkowski et al. |
| 5,175,273 A | 12/1992 | Bischofberger et al. |
| 5,177,196 A | 1/1993 | Meyer et al. |

(Continued)

FOREIGN PATENT DOCUMENTS

| | | |
|---|---|---|
| WO | WO1993/007883 | 4/1993 |
| WO | WO1995/013365 | 5/1995 |

(Continued)

OTHER PUBLICATIONS

Smith (The American Society of Gene and Cell Therapy, 23 (3): 570-577, 2015). (Year: 2015).*
Jinek, (Science, 337: 1-7, 2012). (Year: 2012).*
Cory Smith et al., "Efficient and Allele-Specific Genome Editing of Disease Loci in Human iPSCs", Molecular Therapy, Nov. 24, 2014, vol. 23, No. 3, pp. 570-577.
Kosuke Yusa, et al., "Targeted gene correction of [alpha] I-antitrypsin deficiency in induced pluripotent stem cells", Nature, Oct. 12, 2011, vol. 478, No. 7369pp. 391-394.
Andrew Cox, et al., "Simultaneous Disruption of Five SerpinA1 Genes in Mice using CRISPR/Cas9 to Generate the First Animal Model of Alpha-1 Antitryspin Deficiency", Molecular Therapy, May 2015, vol. 23, no. Suppl. 1, p. S133.

(Continued)

*Primary Examiner* — Anoop K Singh
*Assistant Examiner* — David A Montanari
(74) *Attorney, Agent, or Firm* — Sheppard, Mullin, Richter & Hampton LLP

(57) ABSTRACT

The present application provides materials and methods for treating a patient with Alpha-1 antitrypsin deficiency (AATD) both ex vivo and in vivo. In addition, the present application provides materials and methods for editing the SERPINA1 gene in a cell by genome editing.

5 Claims, 5 Drawing Sheets

Specification includes a Sequence Listing.

(56) References Cited

U.S. PATENT DOCUMENTS

| | | |
|---|---|---|
| 5,185,444 A | 2/1993 | Summerton et al. |
| 5,188,897 A | 2/1993 | Suhadolnik et al. |
| 5,214,134 A | 5/1993 | Weis et al. |
| 5,214,136 A | 5/1993 | Lin et al. |
| 5,216,141 A | 6/1993 | Benner |
| 5,218,105 A | 6/1993 | Cook et al. |
| 5,235,033 A | 8/1993 | Summerton et al. |
| 5,245,022 A | 9/1993 | Weis et al. |
| 5,254,469 A | 10/1993 | Warren et al. |
| 5,258,506 A | 11/1993 | Urdea et al. |
| 5,262,536 A | 11/1993 | Hobbs |
| 5,264,423 A | 11/1993 | Cohen et al. |
| 5,264,562 A | 11/1993 | Matteucci et al. |
| 5,264,564 A | 11/1993 | Matteucci et al. |
| 5,272,250 A | 12/1993 | Spielvogel et al. |
| 5,276,019 A | 1/1994 | Cohen et al. |
| 5,278,302 A | 1/1994 | Caruthers et al. |
| 5,286,717 A | 2/1994 | Cohen et al. |
| 5,292,873 A | 3/1994 | Rokita et al. |
| 5,317,098 A | 5/1994 | Shizuya et al. |
| 5,321,131 A | 6/1994 | Agrawal et al. |
| 5,367,066 A | 11/1994 | Urdea et al. |
| 5,371,241 A | 12/1994 | Brush |
| 5,391,723 A | 2/1995 | Priest |
| 5,399,676 A | 3/1995 | Froehler et al. |
| 5,405,938 A | 4/1995 | Summerton et al. |
| 5,405,939 A | 4/1995 | Suhadolnik et al. |
| 5,414,077 A | 5/1995 | Lin et al. |
| 5,416,203 A | 5/1995 | Letsinger |
| 5,432,272 A | 7/1995 | Benner |
| 5,434,257 A | 7/1995 | Matteucci et al. |
| 5,451,463 A | 9/1995 | Nelson et al. |
| 5,453,496 A | 9/1995 | Caruthers et al. |
| 5,455,233 A | 10/1995 | Spielvogel et al. |
| 5,457,187 A | 10/1995 | Gmeiner et al. |
| 5,459,255 A | 10/1995 | Cook et al. |
| 5,466,677 A | 11/1995 | Baxter et al. |
| 5,470,967 A | 11/1995 | Huie et al. |
| 5,476,925 A | 12/1995 | Letsinger et al. |
| 5,484,908 A | 1/1996 | Froehler et al. |
| 5,486,603 A | 1/1996 | Buhr |
| 5,489,677 A | 2/1996 | Sanghvi et al. |
| 5,502,177 A | 3/1996 | Matteucci et al. |
| 5,510,475 A | 4/1996 | Agrawal et al. |
| 5,512,439 A | 4/1996 | Hornes et al. |
| 5,512,667 A | 4/1996 | Reed et al. |
| 5,514,785 A | 5/1996 | Van Ness et al. |
| 5,519,126 A | 5/1996 | Hecht |
| 5,525,465 A | 6/1996 | Haralambidis et al. |
| 5,525,711 A | 6/1996 | Hawkins et al. |
| 5,536,821 A | 7/1996 | Agrawal et al. |
| 5,539,082 A | 7/1996 | Nielsen et al. |
| 5,541,306 A | 7/1996 | Agrawal et al. |
| 5,541,307 A | 7/1996 | Cook et al. |
| 5,541,313 A | 7/1996 | Ruth |
| 5,545,730 A | 8/1996 | Urdea et al. |
| 5,550,111 A | 8/1996 | Suhadolnik et al. |
| 5,552,538 A | 9/1996 | Urdea et al. |
| 5,552,540 A | 9/1996 | Haralambidis et al. |
| 5,561,225 A | 10/1996 | Maddry et al. |
| 5,563,253 A | 10/1996 | Agrawal et al. |
| 5,565,552 A | 10/1996 | Magda et al. |
| 5,567,810 A | 10/1996 | Weis et al. |
| 5,571,799 A | 11/1996 | Tkachuk et al. |
| 5,574,142 A | 11/1996 | Meyer et al. |
| 5,578,717 A | 11/1996 | Urdea et al. |
| 5,578,718 A | 11/1996 | Cook et al. |
| 5,580,731 A | 12/1996 | Chang et al. |
| 5,585,481 A | 12/1996 | Arnold et al. |
| 5,587,361 A | 12/1996 | Cook et al. |
| 5,587,371 A | 12/1996 | Sessler et al. |
| 5,587,469 A | 12/1996 | Cook et al. |
| 5,591,584 A | 1/1997 | Chang et al. |
| 5,595,726 A | 1/1997 | Magda et al. |
| 5,596,086 A | 1/1997 | Matteucci et al. |
| 5,596,091 A | 1/1997 | Switzer |
| 5,597,696 A | 1/1997 | Linn et al. |
| 5,599,923 A | 2/1997 | Sessler et al. |
| 5,599,928 A | 2/1997 | Hemmi et al. |
| 5,602,240 A | 2/1997 | De Mesmaeker et al. |
| 5,608,046 A | 3/1997 | Cook et al. |
| 5,610,289 A | 3/1997 | Cook et al. |
| 5,614,617 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,633,360 A | 5/1997 | Bischofberger et al. |
| 5,658,776 A | 8/1997 | Flotte et al. |
| 5,663,312 A | 9/1997 | Chaturvedula |
| 5,677,437 A | 10/1997 | Teng et al. |
| 5,677,439 A | 10/1997 | Weis et al. |
| 5,681,941 A | 10/1997 | Cook et al. |
| 5,688,941 A | 11/1997 | Cook et al. |
| 5,714,331 A | 2/1998 | Buchardt et al. |
| 5,719,262 A | 2/1998 | Buchardt et al. |
| 5,750,692 A | 5/1998 | Cook et al. |
| 5,763,588 A | 6/1998 | Matteucci et al. |
| 5,786,211 A | 7/1998 | Johnson |
| 5,830,653 A | 11/1998 | Froehler et al. |
| 5,871,982 A | 2/1999 | Wilson et al. |
| 6,005,096 A | 12/1999 | Matteucci et al. |
| 6,258,595 B1 | 7/2001 | Gao et al. |
| 6,287,860 B1 | 9/2001 | Monia et al. |
| 2003/0158403 A1 | 8/2003 | Manoharan et al. |
| 2013/0209426 A1* | 8/2013 | Bradley ................ C12N 15/85  424/93.21 |
| 2014/0068797 A1 | 3/2014 | Doudna et al. |
| 2015/0166984 A1 | 6/2015 | Liu et al. |
| 2020/0216843 A1* | 7/2020 | Shen ........................ C12N 9/22 |

FOREIGN PATENT DOCUMENTS

| | | | |
|---|---|---|---|
| WO | WO1995/013392 | 5/1995 | |
| WO | WO1996/017947 | 6/1996 | |
| WO | WO1997/006243 | 2/1997 | |
| WO | WO1997/008298 | 3/1997 | |
| WO | WO1997/009441 | 3/1997 | |
| WO | WO1997/021825 | 6/1997 | |
| WO | WO1999/011764 | 3/1999 | |
| WO | WO2001/083692 | 11/2001 | |
| WO | WO2013/176772 | 11/2013 | |
| WO | WO-2014204726 A1 * | 12/2014 | ............. C12N 15/63 |
| WO | WO-2015006498 A2 | 1/2015 | |
| WO | WO-2016095931 A2 * | 6/2016 | ........... C12Q 1/6827 |
| WO | WO-2014/204726 A9 | 10/2016 | |
| WO | WO-2017/165862 A1 | 9/2017 | |

OTHER PUBLICATIONS

Borel, et al., "Simultaneous disruption of Five SerpinA1 Genes in Mice using CRISPR/Cas9 to Generate the First Animal Model of Alpha-One Antitrypsin Deficiency, the leading cause of genetic COPD", Poster dated May 1, 2015, URL:https://www.umassmed.edu/globalassets/mueller-lab-for-gene-therapy/images/blog-posts/2015-umms-aat.pdf, 1 page.

Lukasz Swiech et al., "In vivo interrogation of gene function in the mammalian brain using CRISPR-Cas9", Nature Biotechnology, Oct. 19, 2014, vol. 33, No. 1, pp. 102-106.

F. Ann Ran, et al., "In vivo genome editing using *Staphylococcus aureus* Cas9", Nature, Apr. 9, 2015, vol. 520, No. 7546, pp. 186-191.

M. Jinek et al., "A Programmable Dual-RNA-Guided DNA Endonuclease in Adaptive Bacterial Immunity", Science, Aug. 17, 2012, vol. 337, No. 6096, pp. 816-821.

L. Cong, et al., "Multiplex Genome Engineering Using CRISPR/Cas Systems", Science, Feb. 14, 2013, vol. 339, No. 6121, pp. 819-823.

Aboussouan & Stoller, "Detection of alpha-1 antitrypsin deficiency: a review," Respiratory Medicine 2009, 103(3), 335-341.

Angart et al., "Design of siRNA therapeutics from the molecular scale," Pharmaceuticals 2013, 6(4), 440-468.

(56) References Cited

OTHER PUBLICATIONS

Barrett et al., "Reliable generation of induced pluripotent stem cells from human lymphoblastoid cell lines," Stem Cells Translational Medicine 2014, 3(12), 1429-1434.
Bartel, "MicroRNAs: target recognition and regulatory functions," Cell 2009, 136(2), 215-233.
Behlke, "Chemical modification of siRNAs for in vivo use," Oligonucleotides 2008, 18(4), 305-320.
Belfort & Bonocora, "Homing endonucleases: from genetic anomalies to programmable genomic clippers," Homing Endonucleases: Methods and Protocols. Methods in Molecular Biology 2014, 1123, 1-26.
Bjursell et al., "Therapeutic genome editing with CRISPR/Cas9 in a humanized mouse model ameliorates α 1-antitrypsin deficiency phenotype," EBioMedicine 2018, 29, 104-111.
Boch et al., "Breaking the code of DNA binding specificity of TAL-type III effectors," Science 2009, 326(5959), 1509-1512.
Boissel & Scharenberg, "Assembly and characterization of megaTALs for hyperspecific genome engineering applications," Chromosomal Mutagenesis 2015, 171-196.
Boissel et al., "megaTALs: a rare-cleaving nuclease architecture for therapeutic genome engineering," Nucleic Acids Research 2014, 42(4), 2591-2601.
Braasch & Corey, "Novel antisense and peptide nucleic acid strategies for controlling gene expression," Biochemistry 2002, 41(14), 4503-4510.
Bramsen & Kjems, "Development of therapeutic-grade small interfering RNAs by chemical engineering," Frontiers in Genetics 2012, vol. 3, Article 154.
Brinkman et al., "Easy quantitative assessment of genome editing by sequence trace decomposition," Nucleic Acids Research 2014, 42(22), in 8 pages.
Budniatzky & Gepstein, "Concise review: reprogramming strategies for cardiovascular regenerative medicine: from induced pluripotent stem cells to direct reprogramming," Stem Cells Translational Medicine 2014, 3(4), 448-457.
Burnett et al., "Current progress of siRNA/shRNA therapeutics in clinical trials," Biotechnology Journal 2011, 6(9), 1130-1146.
Canver et al., "BCL11A enhancer dissection by Cas9-mediated in situ saturating mutagenesis," Nature 2015, 527(7577), 192-197.
Carter, "Adeno-associated virus vectors," Current Opinion in Biotechnology 1992, 3(5), 533-539.
Ceccaldi et al., "Homologous-recombination-deficient tumours are dependent on Pol θ -mediated repair," Nature 2015, 518(7538), 258-262.
Cekaite et al., "Gene expression analysis in blood cells in response to unmodified and 2'-modified siRNAs reveals TLR-dependent and independent effects," Journal of Molecular Biology 2007, 365(1), 90-108.
Cermak et al., "Efficient design and assembly of custom TALEN and other TAL effector-based constructs for DNA targeting," Nucleic Acids Research 2011, 39(12), in 11 pages.
Cermak et al., "Efficient design and assembly of custom TALENs using the Golden Gate platform," Chromosomal Mutagenesis 2015, 133-159.
Chen et al., "Global microRNA depletion suppresses tumor angiogenesis," Genes & Development 2014, 28(10), 1054-1067.
Chernolovskaya & Zenkova, "Chemical modification of siRNA," Current Opinion in Molecular Therapeutics 2010, 12(2), 158-167.
Cho & Greenberg, "Familiar ends with alternative endings," Nature 2015, 518(7538), 174-175.
Clark et al., "A stable cell line carrying adenovirus-inducible rep and cap genes allows for infectivity titration of adeno-associated virus vectors," Gene Therapy 1996, 3, (12), 1124-1132. Abstract Only.
Cox et al., "Therapeutic genome editing: prospects and challenges," Nature Medicine 2015, 21(2), 121- 131.
Crooke et al., "Pharmacokinetic properties of several novel oligonucleotide analogs in mice," Journal of Pharmacology and Experimental Therapeutics 1996, 277(2), 923-937. Abstract Only.
De Mesmaeker et al., "Antisense oligonucleotides," Accounts of Chemical Research 1995, 28(9), 366-374.
Deltcheva et al., "CRISPR RNA maturation by trans-encoded small RNA and host factor RNase III," Nature 2011, 471(7340), 602-607.
Dreier et al., "Development of zinc finger domains for recognition of the 5'-CNN-3' family DNA sequences and their use in the construction of artificial transcription factors," Journal of Biological Chemistry 2005, 280(42), 35588-35597.
Dreier et al., "Development of zinc finger domains for recognition of the 5'-ANN-3' family of DNA sequences and their use in the construction of artificial transcription factors," Journal of Biological Chemistry 2001, 276(31), 29466-29478.
Dreier et al., "Insights into the molecular recognition of the 5'-GNN-3' family of DNA sequences by zinc finger domains," Journal of Molecular Biology 2000, 303(4), 489-502.
Duan et al., "Differentiation and characterization of metabolically functioning hepatocytes from human embryonic stem cells," Stem Cells 2010, 28(4), 674-686.
Englisch & Gauss, "Chemically modified oligonucleotides as probes and inhibitors," Angewandte Chemie International Edition in English 1991, 30(6), 613-629.
European Patent Office, European Search Report and Opinion dated Dec. 3, 2019 for European Patent Application No. 16838063.2, in 6 pages.
European Patent Office, European Search Report and Opinion dated Feb. 8, 2022 for European Patent Application No. 21185227.2, in 7 pages.
Focosi et al., "Induced pluripotent stem cells in hematology: current and future applications," Blood Cancer Journal 2014, 4(5), in 8 pages.
Fonfara et al., "Phylogeny of Cas9 determines functional exchangeability of dual-RNA and Cas9 among orthologous type II CRISPR-Cas systems," Nucleic Acids Research 2014, 42(4), 2577-2590.
Fucini et al., "Adenosine modification may be preferred for reducing siRNA immune stimulation," Nucleic Acid Therapeutics 2012, 22(3), 205-210.
Gaglione & Messere, "Recent progress in chemically modified siRNAs," Mini Reviews in Medicinal Chemistry 2010, 10(7), 578-595.
Gebeyehu et al., "Novel biotinylated nucleotide-analogs for labeling and colorimetric detection of DNA, " Nucleic Acids Research 1987, 15(11), 4513-4534.
Guilinger et al., "Fusion of catalytically inactive Cas9 to FokI nuclease improves the specificity of genome modification," Nature Biotechnology 2014, 32(6), 577-582.
Hafez & Hausner, "Homing endonucleases: DNA scissors on a mission," Genome 2012, 55(8), 553-569.
Halbert et al., "Transduction by adeno-associated virus vectors in the rabbit airway: efficiency, persistence, and readministration," Journal of Virology 1997, 71(8), 5932-5941.
Heasman, "Morpholino oligos: making sense of antisense?," Developmental Biology 2002, 243(2), 209-214.
Hermonat & Muzyczka, "Use of adeno-associated virus as a mammalian DNA cloning vector: transduction of neomycin resistance into mammalian tissue culture cells," Proceedings of the National Academy of Sciences 1984, 81(20), 6466-6470.
Herranz & Cohen, "MicroRNAs and gene regulatory networks: managing the impact of noise in biological systems," Genes & Development 2010, 24(13), 1339-1344.
Herrera et al., "Isolation and characterization of a stem cell population from adult human liver," Stem Cells 2006, 24(12), 2840-2850.
Hu et al., "Physiological roles of asialoglycoprotein receptors (ASGPRs) variants and recent advances in hepatic-targeted delivery of therapeutic molecules via ASGPRs," Protein and Peptide Letters 2014, 21(10), 1025-1030. Abstract Only.
Huangfu et al., "Induction of pluripotent stem cells by defined factors is greatly improved by small-molecule compounds," Nature Biotechnology 2008, 26(7), 795-797.
International Search Report and Written Opinion dated Jun. 8, 2017 in PCT Patent Application No. PCT/IB2016/001845.

(56) References Cited

OTHER PUBLICATIONS

IP Australia, Examination report No. 1 for standard patent application dated Jan. 13, 2022 for Australian Patent Application No. 2016364667, in 4 pages.
Judge & MacLachlan, "Overcoming the innate immune response to small interfering RNA," Human Gene Therapy 2008, 19(2), 111-124.
Judge et al., "Design of noninflammatory synthetic siRNA mediating potent gene silencing in vivo," Molecular Therapy 2006, 13(3), 494-505.
Kabanov et al., "A new class of antivirals: antisense oligonucleotides combined with a hydrophobic substituent effectively inhibit influenza virus reproduction and synthesis of virus-specific proteins in MDCK cells," FEBS letters 1990, 259(2), 327-330.
Kanasty et al., "Action and reaction: the biological response to siRNA and its delivery vehicles," Molecular Therapy 2012, 20(3), 513-524.
Karikóet al., "Suppression of RNA recognition by Toll-like receptors: the impact of nucleoside modification and the evolutionary origin of RNA," Immunity 2005, 23(2), 165-175.
Kent et al., "Mechanism of microhomology-mediated end-joining promoted by human DNA polymerase θ." Nature Structural & Molecular Biology 2015, 22(3), 230-237.
Kleinstiver et al., "The I-TevI nuclease and linker domains contribute to the specificity of monomeric TALENs," G3: Genes, Genomes, Genetics 2014, 4(6) 1155-1165.
Kole et al., "RNA therapeutics: beyond RNA interference and antisense oligonucleotides," Nature Reviews Drug Discovery 2012, 11(2), 125-140.
Kormann et al., "Expression of therapeutic proteins after delivery of chemically modified mRNA in mice," Nature biotechnology 2011, 29(2), 154-157.
Lacerra et al., "Restoration of hemoglobin A synthesis in erythroid cells from peripheral blood of thalassemic patients," Proceedings of the National Academy of Sciences 2000, 97(17), 9591-9596.
Laughlin et al., "Cloning of infectious adeno-associated virus genomes in bacterial plasmids," Gene 1983, 23(1), 65-73.
Lebkowski et al., "Adeno-associated virus: a vector system for efficient introduction and integration of DNA into a variety of mammalian cell types," Molecular and Cellular Biology, 1988, 3988-3996.
Letsinger et al., "Cholesteryl-conjugated oligonucleotides: synthesis, properties, and activity as inhibitors of replication of human immunodeficiency virus in cell culture," Proceedings of the National Academy of Sciences 1989, 86(17), 6553-6556.
Li et al., "Modularly assembled designer TAL effector nucleases for targeted gene knockout and gene replacement in eukaryotes," Nucleic Acids Research 2011, 39(14), 6315-6325.
Liu et al., "Validated zinc finger protein designs for all 16 Gnn Dna triplet targets," Journal of Biological Chemistry 2002, 277(6), 3850-3856.
Ma et al., "Highly efficient differentiation of functional hepatocytes from human induced pluripotent stem cells," Stem Cells Translational Medicine 2013, 2(6), 409-419.
Ma et al., "Pol III promoters to express small RNAs: delineation of transcription initiation," Molecular Therapy-Nucleic Acids 2014, 3, in 11 pages.
Maherali & Hochedlinger, "Guidelines and techniques for the generation of induced pluripotent stem cells," Cell Stem Cell 2008, 3(6), 595-605.
Mak et al., "The crystal structure of TAL effector PthXo1 bound to its DNA target," Science 2012, 335(6069), 716-719.
Manoharan et al., "Chemical modifications to improve uptake and bioavailability of antisense oligonucleotides," Annals of the New York Academy of Sciences 1992, 660(1), 306-309.
Manoharan et al., "Cholic acid-oligonucleotide conjugates for antisense applications," Bioorganic & Medicinal Chemistry Letters 1994, 4(8), 1053-1060.
Manoharan et al., "Introduction of a lipophilic thioether tether in the minor groove of nucleic acids for antisense applications," Bioorganic & Medicinal Chemistry Letters 1993, 3(12), 2765-2770.
Manoharan et al., "Lipidic nucleic acids, " Tetrahedron Letters 1995, 36(21), 3651-3654.
Manoharan et al., "Oligonucleotide conjugates: alteration of the pharmacokinetic properties of antisense agents," Nucleosides, Nucleotides & Nucleic Acids 1995, 14(3-5), 969-973.
Maresca et al., "Obligate ligation-gated recombination (ObLiGaRe): custom-designed nuclease-mediated targeted integration through nonhomologous end joining," Genome Research 2013, 23(3), 539-546.
Marson et al., "Wnt signaling promotes reprogramming of somatic cells to pluripotency," Cell Stem Cell 2008, 3(2), 132-135.
Martin, "Ein Neuer Zugang Zu 2'—O—Alkylribonucleosiden Und Eigenschaften Deren Oligonucleotide," Helvetica Chimica Acta 1995, 78(2), 486-504.
Mateos-Gomez et al., "Mammalian polymerase θ promotes alternative NHEJ and suppresses recombination," Nature 2015, 518(7538), 254-257.
McLaughlin et al., "Adeno-associated virus general transduction vectors: analysis of proviral structures," Journal of Virology 1988, 62(6), 1963-1973.
Mishra et al., "Improved leishmanicidal effect of phosphorotioate antisense oligonucleotides by LDL-mediated delivery," Biochimica et Biophysica Acta (BBA)-Gene Structure and Expression 1995, 1264(2), 229-237.
Mohanka et al., "A review of augmentation therapy for alpha-1 antitrypsin deficiency," Expert Opinion on Biological Therapy 2012, 12(6), 685-700.
Moscou & Bogdanove, "A simple cipher governs DNA recognition by TAL effectors," Science 2009, 326(5959), 1501-1501.
Muzyczka, "Use of adeno-associated virus as a general transduction vector for mammalian cells," Viral Expression Vectors 1992, 97-129.
Nasevicius & Ekker, "Effective targeted gene 'knockdown' in zebrafish," Nature Genetics 2000, 26(2), 216-220.
Nielsen et al., "Sequence-selective recognition of DNA by strand displacement with a thymine-substituted polyamide," Science 1991, 254(5037), 1497-1500.
Notice of Reasons for Refusal dated Mar. 17, 2021 for Japanese Patent Application No. 2018529170, in 6 pages.
Notice of Reasons for Refusal dated Oct. 30, 2020 for Japanese Patent Application No. 2018529170, in 6 pages.
Notice of Reasons for Refusal dated Sep. 15, 2022 for Japanese Patent Application No. 2021133299, in 12 pages.
Oberhauser & Wagner, "Effective incorporation of 2'-O-methyl-oligoribonuclectides into liposomes and enhanced cell association through modification with thiocholesterol," Nucleic Acids Research 1992, 20(3), 533-538.
Paul et al., "Increased viral titer through concentration of viral harvests from retroviral packaging lines," Human Gene Therapy 1993, 4(5), 609-615.
Peer & Lieberman, "Special delivery: targeted therapy with small RNAs," Gene Therapy 2011, 18(12), 1127-1133.
Perrin et al., "An experimental rabies vaccine produced with a new BHK-21 suspension cell culture process: use of serum-free medium and perfusion-reactor system," Vaccine 1995, 13(13), 1244-1250.
Pittenger et al., "Multilineage potential of adult human mesenchymal stem cells," Science 1999, 284(5411), 143-147.
Posadas & Carthew, "MicroRNAs and their roles in developmental canalization," Current Opinion in Genetics & Development 2014, 27, 1-6.
Saj & Lai, "Control of microRNA biogenesis and transcription by cell signaling pathways," Current Opinion in Genetics & Development 2011, 21(4), 504-510.
Samulski et al., "Cloning of adeno-associated virus into pBR322: rescue of intact virus from the recombinant plasmid in human cells," Proceedings of the National Academy of Sciences 1982, 79(6), 2077-2081.
Samulski et al., "Helper-free stocks of recombinant adeno-associated viruses: normal integration does not require viral gene expression," Journal of Virology 1989, 63(9), 3822-3828.

(56) References Cited

OTHER PUBLICATIONS

Sander & Joung, "CRISPR-Cas systems for editing, regulating and targeting genomes," Nature Biotechnology 2014, 32(4), 347-355.
Sapranauskas et al., "The Streptococcus thermophilus CRISPR/Cas system provides immunity in *Escherichia coli*," Nucleic Acids Research 2011, 39(21), 9275-9282.
Sawitza et al., "Bile acids induce hepatic differentiation of mesenchymal stem cells," Scientific Reports 2015, 5(1), in 15 pages.
Segal et al., "Toward controlling gene expression at will: selection and design of zinc finger domains recognizing each of the 5'-GNN-3' DNA target sequences," Proceedings of the National Academy of Sciences 1999, 96(6), 2758-2763.
Senapathy & Carter, "Molecular cloning of adeno-associated virus variant genomes and generation of infectious virus by recombination in mammalian cells," Journal of Biological Chemistry 1984, 259(7), 4661-4666.
Shea et al., "Synthesis, hybridization properties and antiviral activity of lipid-oligodeoxynucleotide conjugates," Nucleic Acids Research 1990, 18(13), 3777-3783.
Shen et al., "Amelioration of alpha-1 antitrypsin deficiency diseases with genome editing in transgenic mice," Human Gene Therapy 2018, 29(8), 861-873.
Shi et al., "A combined chemical and genetic approach for the generation of induced pluripotent stem cells," Cell Stem Cell 2008, 2(6), 525-528.
Soutschek et al., "Therapeutic silencing of an endogenous gene by systemic administration of modified siRNAs," Nature 2004, 432(7014), 173-178.
Steentoft et al., "Precision genome editing: a small revolution for glycobiology," Glycobiology 2014, 24(8), 663-680.
Stern-Ginossar et al., "Host immune system gene targeting by a viral miRNA," Science 2007, 317(5836), 376-381.
Stoller & Aboussouan, "A review of a 1-antitrypsin deficiency," American Journal of Respiratory and Critical Care Medicine 2012, 185(3), 246-259.
Svinarchuk et al., "Inhibition of HIV proliferation in MT-4 cells by antisense oligonucleotide conjugated to lipophilic groups," Biochimie 1993, 75(1-2), 49-54.
Takahashi & Yamanaka, "Induction of pluripotent stem cells from mouse embryonic and adult fibroblast cultures by defined factors," Cell 2006, 126(4), 663-676.
Takahashi et al., "Induction of pluripotent stem cells from adult human fibroblasts by defined factors," Cell 2007, 131(5), 861-872.
Teckman, "Lack of effect of oral 4-phenylbutyrate on serum alpha-1-antitrypsin in patients with a -1-antitrypsin deficiency: A preliminary study," Journal of Pediatric Gastroenterology and Nutrition 2004, 39(1), 34-37.
Teckman, "Liver disease in alpha-1 antitrypsin deficiency: current understanding and future therapy," COPD: Journal of Chronic Obstructive Pulmonary Disease 2013, 10(sup1), 35-43.

The State Intellectual Property Office of People's Republic of China, the First Office Action dated Nov. 12, 2021 for Chinese Patent Application No. 201680080398.1, in 10 pages.
The State Intellectual Property Office of People's Republic of China, the Second Office Action dated Apr. 8, 2022 for Chinese Patent Application No. 201680080398.1, in 11 pages.
Tratschin et al., "A human parvovirus, adeno-associated virus, as a eucaryotic vector: transient expression and encapsidation of the procaryotic gene for chloramphenicol acetyltransferase," Molecular and Cellular Biology 1984, 4(10), 2072-2081.
Tratschin et al., "Adeno-associated virus vector for high-frequency integration, expression, and rescue of genes in mammalian cells," Molecular and Cellular Biology 1985, 5(11), 3251-3260.
Tsai et al., "Dimeric CRISPR RNA-guided FokI nucleases for highly specific genome editing," Nature Biotechnology 2014, 32(6), 569-576.
Volkov et al., "Selective protection of nuclease-sensitive sites in siRNA prolongs silencing effect," Oligonucleotides 2009, 19(2), 191-202.
Wang et al., "Cyclohexene nucleic acids (CeNA): serum stable oligonucleotides that activate RNase H and increase duplex stability with complementary RNA," Journal of the American Chemical Society 2000, 122(36), 8595-8602.
Wang et al., "Rapid and efficient assembly of transcription activator-like effector genes by User cloning," Journal of Genetics and Genomics 2014, 41(6), 339-347.
Warren et al., "Highly efficient reprogramming to pluripotency and directed differentiation of human cells with synthetic modified mRNA," Cell Stem Cell 2010, 7(5), 618-630.
Weber et al., "A modular cloning system for standardized assembly of multigene constructs," PloS One 2011, 6(2), in 11 pages.
Weber et al., "Methylation of human microRNA genes in normal and neoplastic cells," Cell Cycle 2007, 6(9), 1001-1005.
Wewers & Crystal, "Alpha-1 antitrypsin augmentation therapy," COPD: Journal of Chronic Obstructive Pulmonary Disease 2013, 10(sup1), 64-67.
Wewers et al., "Replacement therapy for alpha1-antitrypsin deficiency associated with emphysema," New England Journal of Medicine 1987, 316(17), 1055-1062.
Whitehead et al., "Silencing or stimulation? siRNA delivery and the immune system," Annual Review of Chemical and Biomolecular Engineering 2011, 2, 77-96.
Winkler, "Oligonucleotide conjugates for therapeutic applications," Therapeutic Delivery 2013, 4(7), 791-809.
Wolfs et al., "MegaTevs: single-chain dual nucleases for efficient gene disruption," Nucleic Acids Research 2014, 42(13), 8816-8829.
Xie et al., "sgRNA design for the CRISPR/Cas9 system and evaluation of its off-target effects," Hereditas 2015, 37(11), 1125-1136.
Zhao et al., "Sequence-specific inhibition of microRNA via CRISPR/CRISPRi system," Scientific Reports 2014, 4(1), 3943.
Office Action dated Jan. 4, 2023 in Canadian Application No. 3,006,618.

\* cited by examiner

MATERIALS AND METHODS FOR TREATMENT OF ALPHA-1 ANTITRYPSIN DEFICIENCY

RELATED APPLICATIONS

This application is a national phase filing under 35 USC § 371 of International PCT Application No. PCT/IB2016/001845, filed Dec. 1, 2016, which claims the benefit and priority of U.S. Provisional Application No. 62/261,661, filed Dec. 1, 2015; and U.S. Provisional Application No. 62/324,056, filed Apr. 18, 2016; the contents of each of which are incorporated herein by reference in their entirety.

FIELD OF THE INVENTION

The present application provides materials and methods for treating a patient with alpha-1 antitrypsin deficiency (AATD) both ex vivo and in vivo. In addition, the present application provides materials and methods for modulating the expression, function, and/or activity of the SERPINA1 gene and/or the alpha-1 antitrypsin (AAT) protein in a cell by genome editing.

INCORPORATION BY REFERENCE OF SEQUENCE LISTING

This application contains a Sequence Listing in computer readable form (filename: CRIS-010_NO1US_SequenceListing_ST25.txt; 13,386 KB in size; created May 29, 2018), which is incorporated herein by reference in its entirety and forms part of the disclosure.

BACKGROUND OF THE INVENTION

Alpha-1 antitrypsin deficiency (AATD) is an autosomal recessive disorder characterized by an increased risk for chronic obstructive pulmonary disease, including, emphysema, airflow obstruction, and/or chronic bronchitis, with evident manifestation in adults by the $4^{th}$-$5^{th}$ decades; liver disease, in a small portion of affected patients, with manifestation as obstructive jaundice; and increased aminotransferase levels in the early period of life. The liver disease in adults can even manifest as fibrosis and cirrhosis in the absence of a history of liver complications during childhood. Patients with AATD also have a higher incidence of hepatocellular carcinoma. (See e.g., Stoller J K, Aboussouan L S, "A review of alpha1-antitrypsin deficiency." Am J Respir Crit Care Med 2012, 185(3):246-259; Teckman J H, "Liver disease in alpha-1 antitrypsin deficiency: current understanding and future therapy." COPD 2013, 10 Suppl 1:35-43; and Stoller J K, et al, "Alpha-1 Antitrypsin Deficiency." In: GeneReviews®. Edited by Pagon R A, et al. Seattle (Wash.); 1993).

The diagnosis of AATD is confirmed by demonstration of a low concentration of alpha-1 antitrypsin (AAT) in serum, followed by detection of a functionally deficient AAT protein or detection of bi-allelic pathogenic variants in SERPINA1, the gene encoding alpha-1 antitrypsin. (See e.g., Aboussouan L S, Stoller J K; "Detection of alpha-1 antitrypsin deficiency: a review." Respir Med 2009, 103(3):335-341). The prevalence of AATD is about 40:100K (Swedish ancestry-50-60:100K). More than 100 variants of the AAT gene (SERPINA1) have been described, but the majority of the patients (at least with the liver phenotype) are homozygous for PI Z (PI, GLU342LYS ON MIA [dbSNP: rs28929474]).

Current therapy for AATD includes: standard therapy for chronic obstructive pulmonary disease, which includes bronchodilators, inhaled corticosteroids, pulmonary rehabilitation, supplemental oxygen, and vaccinations (e.g., influenza and pneumococcal). Specific therapy for AATD, including periodic intravenous infusion of pooled human serum alpha-antitrypsin (augmentation therapy) is also used. (See e.g., Mohanka M, Khemasuwan D, Stoller J K, "A review of augmentation therapy for alpha-1 antitrypsin deficiency." Expert Opin Biol Ther 2012, 12(6):685-700). Individuals with end-stage lung disease often have to undergo lung transplantation. A major treatment for patients with the liver disease is liver transplantation because other approaches, such as conventional therapies (chemical chaperones, stimulation of autophagy, antifibrotic therapy), often have a minimal effect.

Some newer approaches have been tested recently. (See e.g., Wewers M D, et al., "Replacement therapy for alpha 1-antitrypsin deficiency associated with emphysema." N Engl J Med 1987, 316(17):1055-1062; Wewers M D, Crystal R G, "Alpha-1 antitrypsin augmentation therapy." COPD 2013, 10 Suppl 1:64-67; and Teckman J H, "Lack of effect of oral 4-phenylbutyrate on serum alpha-1-antitrypsin in patients with alpha-1-antitrypsin deficiency: a preliminary study." J Pediatr Gastroenterol Nutr 2004, 39(1):34-37). ARC-AAT is a single dose Phase 1 clinical study and ALNY-AAT is a Phase 1 clinical study. Both studies are harnessing the RNA interference approach to reduce the amount of mutant AAT deposited in hepatocytes. However, these approaches do not address the lack of normal AAT in the circulation, and depend upon combination with augmentation therapy. In addition, rAAV1-CB-hAAT is a Phase 2 clinical study that combines downregulation of endogenous AAT with microRNA and simultaneous upregulation of exogenous AAT. (See e.g., Flotte T R, et al., "Phase 2 clinical trial of a recombinant adeno-associated viral vector expressing alpha1-antitrypsin: interim results." Hum Gene Ther 2011, 22(10):1239-1247; Mueller C, et al., "Sustained miRNA-mediated knockdown of mutant AAT with simultaneous augmentation of wild-type AAT has minimal effect on global liver miRNA profiles." Mol Ther 2012, 20(3):590-600).

Genome engineering refers to the strategies and techniques for the targeted, specific modification of the genetic information (genome) of living organisms. Genome engineering is a very active field of research because of the wide range of possible applications, particularly in the areas of human health; the correction of a gene carrying a harmful mutation, for example, or to explore the function of a gene. Early technologies developed to insert a gene into a living cell, such as transgenesis, were often limited by the random nature of the insertion of the new sequence into the genome. The new gene was usually positioned blindly, and may have inactivated or disturbed the functioning of other genes, or even caused severe unwanted effects. Furthermore, these technologies generally offered no degree of reproducibility, as there was no guarantee that the new sequence would be inserted at the same place in two different cells. More recent genome engineering strategies, such as ZFNs, TALENs, HEs and MegaTALs, enable a specific area of the DNA to be modified, thereby increasing the precision of the correction or insertion compared to early technologies, and offering some degree of reproducibility. Despite this, such recent genome engineering strategies have limitations.

Despite efforts from researchers and medical professionals worldwide who have been trying to address AATD, and despite the promise of genome engineering approaches, there still remains a critical need for developing safe and effective treatments for AATD.

Prior approaches addressing AATD have severe limitations, such as limited success and lack of adequate available therapies. The present invention solves these problems by using genome engineering tools to create permanent changes to the genome that can restore the AAT protein activity with a single treatment. Thus, the present invention corrects the underlying genetic defect causing the disease.

SUMMARY OF THE INVENTION

Provided herein are cellular, ex vivo and in vivo methods for creating permanent changes to the genome by inserting, deleting, correcting, or modulating the expression or function of one or more mutations or exons within or near the SERPINA1 gene or other DNA sequences that encode regulatory elements of the SERPINA1 gene or knocking-in SERPINA1 cDNA or minigene into a safe harbor locus by genome editing and restoring alpha-1-antitrypsin (AAT) protein activity, which can be used to treat alpha-1 antitrypsin deficiency (AATD). Also provided herein are components, kits and compositions for performing such methods. Also provided are cells produced by them.

Provided herein is a method for editing a SERPINA1 gene in a human cell by genome editing, the method comprising the step of introducing into the human cell one or more deoxyribonucleic acid (DNA) endonucleases to effect one or more single-strand breaks (SSBs) or one or more double-strand breaks (DSBs) within or near the SERPINA1 gene or other DNA sequences that encode regulatory elements of the SERPINA1 gene that results in at least one of a permanent insertion, deletion, correction, or modulation of expression or function of one or more mutations or exons within or near or affecting the expression or function of the SERPINA1 gene, or within or near a safe harbor locus that results in a permanent insertion of the SERPINA1 gene or minigene, and results in restoration of alpha-1-antitrypsin (AAT) protein activity.

Also provided herein is a method for inserting a SERPINA1 gene in a human cell by genome editing, the method comprising the step of: introducing into the human cell one or more deoxyribonucleic acid (DNA) endonucleases to effect one or more single-strand breaks (SSBs) or double-strand breaks (DSBs) within or near a safe harbor locus that results in a permanent insertion of the SERPINA1 gene or minigene, and results in restoration of alpha-1-antitrypsin (AAT) protein activity.

In one aspect, provided herein is a method for editing the SERPINA1 gene in a human cell by genome editing comprising introducing into the cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene of the cell that results in permanent deletion, insertion, or correction of one or more mutations or exons within or near the SERPINA1 gene, or within or near a safe harbor locus that results in permanent insertion of the SERPINA1 gene or minigene, and restoration of alpha-1-antitrypsin (AAT) protein activity.

In another aspect, provided herein is an ex vivo method for treating a patient with alpha-1 antitrypsin deficiency (AATD) comprising the steps of: creating a patient specific induced pluripotent stem cell (iPSC); editing within or near the SERPINA1 gene of the iPSC or other DNA sequences that encode regulatory elements of the SERPINA1 gene of the iPSC or editing within or near a safe harbor locus of the iPSC; differentiating the genome edited iPSC into a hepatocyte; and implanting the hepatocyte into the patient.

In some embodiments, the step of creating a patient specific induced pluripotent stem cell (iPSC) comprises: isolating a somatic cell from the patient; and introducing a set of pluripotency-associated genes into the somatic cell to induce the cell to become a pluripotent stem cell. In some embodiments, the somatic cell is a fibroblast. In some embodiments, the set of pluripotency-associated genes is one or more of the genes selected from the group consisting of OCT4, SOX2, KLF4, Lin28, NANOG and cMYC.

The step of editing within or near a SERPINA1 gene or other DNA sequences that encode regulatory elements of the SERPINA1 gene of the iPSC or editing within or near a safe harbor locus of the SERPINA1 gene of the iPSC or editing within or near a locus of the first exon of the SERPINA1 gene of the iPSC can comprise introducing into the iPSC one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in a permanent insertion, correction, deletion, or modulation of expression or function of one or more mutations or exons within or near or affecting the expression or function of the SERPINA1 gene or within or near a safe harbor locus that results in a permanent insertion of the SERPINA1 gene results in restoration of AAT protein activity. The safe harbor locus can be selected from the group consisting of: AAVS1 (PPP1R12C), ALB, Angptl3, ApoC3, ASGR2, CCR5, FIX (F9), G6PC, Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of G6PC, exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of editing the SERPINA1 gene of the iPSC comprises introducing into the iPSC one or more deoxyribonucleic acid (DNA) endonucleases to effect one or more double-strand breaks (DSBs) within or near the SERPINA1 gene that results in permanent deletion, insertion, or correction of one or more mutations within or near the SERPINA1 gene and restoration of alpha-1-antitrypsin (AAT) protein activity.

In some embodiments, the step of differentiating the genome edited iPSC into a liver progenitor cell or a hepatocyte comprises one or more of the following: contacting the genome edited iPSC with one or more of activin, B27 supplement, FGF4, HGF, BMP2, BMP4, Oncostatin M, or Dexametason.

In some embodiments, the step of implanting the hepatocyte into the patient comprises implanting the hepatocyte into the patient by transplantation, local injection, or systemic infusion, or combinations thereof.

In another aspect, provided herein is an ex vivo method for treating a patient with alpha-1 antitrypsin deficiency (AATD) comprising the steps of: performing a biopsy of the patients liver; isolating a liver specific progenitor cell or primary hepatocyte; editing within or near the SERPINA1 gene or other DNA sequences that encode regulatory elements of the SERPINA1 gene of the progenitor cell or primary hepatocyte or editing within or near a safe harbor locus of the progenitor cell or primary hepatocyte; and implanting the genome-edited progenitor cell or primary hepatocyte into the patient.

In some embodiments, the step of isolating a liver specific progenitor cell or primary hepatocyte from the patient comprises: perfusion of fresh liver tissues with digestion enzymes, cell differential centrifugation, and cell culturing, or combinations thereof.

In some embodiments, the step of editing within or near the SERPINA1 gene of the progenitor cell or primary hepatocyte or other DNA sequences that encode regulatory elements of the SERPINA1 gene of the progenitor cell or primary hepatocyte or editing within or near a safe harbor locus of the white blood cell of the progenitor cell or primary hepatocyte comprises introducing into the progenitor cell or primary hepatocyte one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent insertion, correction, deletion, or modulation of expression or function of one or more mutations or exons within or near or affecting the expression or function of the SERPINA1 gene or editing within or near a safe harbor locus that results in permanent deletion, insertion, or correction of one or more mutations within or near the SERPINA1 gene and restoration of alpha-1-antitrypsin (AAT) protein activity. The safe harbor locus can be selected from the group consisting of: AAVS1 (PPP1R12C), ALB, Angptl3, ApoC3, ASGR2, CCR5, FIX (F9), G6PC, Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of G6PC, exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of implanting the progenitor cell or primary hepatocyte into the patient comprises implanting the progenitor cell or primary hepatocyte into the patient by transplantation, local injection, or systemic infusion, or combinations thereof.

In an aspect, provided herein is an ex vivo method for treating a patient with alpha-1 antitrypsin deficiency (AATD), the method comprising the steps of: i) isolating a mesenchymal stem cell from the patient; ii) editing within or near a SERPINA1 gene or other DNA sequences that encode regulatory elements of the SERPINA1 gene of the mesenchymal stem cell or editing within or near a safe harbor locus of the SERPINA1 gene of the mesenchymal cell; iii) differentiating the genome-edited mesenchymal stem cell into a hepatocyte; and iv) implanting the hepatocyte into the patient.

In an aspect, provided herein is an ex vivo method for treating a patient with alpha-1 antitrypsin deficiency (AATD) comprising the steps of: performing a biopsy of the patient's bone marrow; isolating a mesenchymal stem cell; editing the SERPINA1 gene of the stem cell; differentiating the stem cell into a hepatocyte; and implanting the hepatocyte into the patient.

The mesenchymal stem cell can be isolated from the patient's bone marrow by performing a biopsy of the patient's bone marrow or the mesenchymal stem cell can be isolated from peripheral blood.

In some embodiments, the step of isolating a mesenchymal stem cell comprises: aspiration of bone marrow and isolation of mesenchymal cells by density centrifugation using Percoll™.

In some embodiments, the step of editing within or near the SERPINA1 gene of the stem cell or other DNA sequences that encode regulatory elements of the SERPINA1 gene of the mesenchymal stem cell comprises introducing into the mesenchymal stem cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent deletion, insertion, correction, or modulation of expression or function of one or more mutations or exons within or near or affecting the expression or function of the SERPINA1 gene or within or near a safe harbor locus that results of one or more mutations within or near the SERPINA1 gene that results in permanent insertion of the SERPINA1 gene or minigene, and restoration of alpha-1-antitrypsin (AAT) protein activity. The safe harbor locus can be selected from the group consisting of: AAVS1 (PPP1R12C), ALB, Angptl3, ApoC3, ASGR2, CCR5, FIX (F9), G6PC, Gys2, HGD, Lp(a), Pcsk9, Serpina1, TF, and TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of G6PC, exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR.

In some embodiments, the step of differentiating the genome-edited mesenchymal stem cell into a hepatocyte comprises one or more of the following to differentiate the genome edited mesenchymal stem cell into a hepatocyte: contacting the genome edited mesenchymal stem cell with one or more of insulin, transferrin, FGF4, HGF, or bile acids.

In some embodiments, the step of implanting the hepatocyte into the patient comprises implanting the hepatocyte into the patient by transplantation, local injection, or systemic infusion, or combinations thereof.

In another aspect, provided herein is an in vivo method for treating a patient with alpha-1 antitrypsin deficiency (AATD) comprising the step of editing the SERPINA1 gene in a cell of the patient, or other DNA sequences that encode regulatory elements of the SERPINA1 gene, or editing within or near a safe harbor locus in a cell of the patient.

In some embodiments, the step of editing the SERPINA1 gene in a cell of the patient comprises introducing into the cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent deletion, insertion, or correction or modulation of one or more mutations or exons within the SERPINA1 gene that results in permanent insertion of the SERPINA1 gene or minigene, and restoration of AAT protein activity.

In some embodiments, the step of editing the SERPINA1 gene in a cell of the patient comprises introducing into the cell one or more deoxyribonucleic acid (DNA) endonucleases to effect one or more double-strand breaks (DSBs) within or near the SERPINA1 gene or DNA sequences that encode regulatory elements of the SERPINA1 gene or editing within or near a safe harbor locus of the SERPINA1 gene that results in permanent deletion, insertion, correction, or correction, or modulation of expression or function of one or more exons within or near or affecting the expression or function of the SERPINA1 gene and restoration of alpha-1-antitrypsin (AAT) protein activity.

In some embodiments, the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, recombination of the naturally occurring molecule, codon-optimized, or modified version thereof, and combinations of any of the foregoing.

In some embodiments, the method comprises introducing into the cell one or more polynucleotides encoding the one or more DNA endonucleases. In some embodiments, the method comprises introducing into the cell one or more ribonucleic acids (RNAs) encoding the one or more DNA endonucleases. In some embodiments, the one or more polynucleotides or one or more RNAs is one or more modified polynucleotides or one or more modified RNAs. In some embodiments, the method comprises introducing into the cell one or more DNA endonucleases wherein the endonuclease is a protein or polypeptide.

In some embodiments, the method further comprises introducing into the cell one or more guide ribonucleic acids (gRNAs). In some embodiments, the one or more gRNAs are single-molecule guide RNA (sgRNAs). In some embodiments, the one or more gRNAs or one or more sgRNAs is one or more modified gRNAs, one or more modified sgRNAs, or combinations thereof.

In some embodiments, the one or more DNA endonucleases is pre-complexed with one or more gRNAs or one or more sgRNAs, or combinations thereof.

In some embodiments, the method further comprises introducing into the cell a polynucleotide donor template comprising a part of the wild-type SERPINA1 gene or minigene (comprised of, natural or synthetic enhancer and promoter, one or more exons, and natural or synthetic introns, and natural or synthetic 3'UTR and polyadenylation signal), DNA sequences that encode wild-type regulatory elements of the SERPINA1 gene, and/or cDNA. In some embodiments, the part of the wild-type SERPINA1 gene or cDNA can be exon 1, exon 2, exon 3, exon 4, exon 5, intronic regions, fragments or combinations thereof, or the entire SERPINA1 gene or cDNA. In some embodiments, the donor template is either a single or double stranded polynucleotide. In some embodiments, the donor template has homologous arms to the 14q32.13 region.

In some embodiments, the method further comprises introducing into the cell one guide ribonucleic acid (gRNA) and a polynucleotide donor template comprising at least a portion of the wild-type SERPINA1 gene. In some embodiments, the method further comprises introducing into the cell one guide ribonucleic acid (gRNA) and a polynucleotide donor template comprising at least a portion of a codon optimized or modified SERPINA1 gene. The one or more DNA endonucleases is one or more Cas9 endonucleases that effect one double-strand break (DSB) at a DSB locus within or near the SERPINA1 gene (or codon optimized or modified SERPINA1 gene) or other DNA sequences that encode regulatory elements of the SERPINA1 gene, or within or near a safe harbor locus that facilitates insertion of a new sequence from the polynucleotide donor template into the chromosomal DNA at the locus or safe harbor locus that results in a permanent insertion or correction of a part of the chromosomal DNA of the SERPINA1 gene or other DNA sequences that encode regulator elements of the SERPINA1 gene proximal to the locus or safe harbor locus and restoration of AAT protein activity. In some embodiments, the gRNA comprises a spacer sequence that is complementary to a segment of the locus or safe harbor locus. In some embodiments, proximal means nucleotides both upstream and downstream of the locus or safe harbor locus.

In some embodiments, the method further comprises introducing into the cell two guide ribonucleic acid (gRNAs) and a polynucleotide donor template comprising at least a portion of the wild-type SERPINA1 gene, and wherein the one or more DNA endonucleases is two or more Cas9 endonucleases that effect a pair of double-strand breaks (DSBs), the first at a 5' DSB locus and the second at a 3' DSB locus, within or near the SERPINA1 gene or other DNA sequences that encode regulatory elements of the SERPINA1 gene, or within or near a safe harbor locus that facilitates insertion of a new sequence from the polynucleotide donor template into the chromosomal DNA between the 5' DSB locus and the 3' DSB locus that results in permanent insertion or correction of the chromosomal DNA between the 5' DSB locus and the 3' DSB locus within or near the SERPINA1 gene or other DNA sequences that encode regulatory elements of the SERPINA1 gene, or within or near a safe harbor locus and restoration of AAT protein activity, and wherein the first guide RNA comprises a spacer sequence that is complementary to a segment of the 5' DSB locus and the second guide RNA comprises a spacer sequence that is complementary to a segment of the 3' DSB locus.

In some embodiments, the one or more gRNAs are one or more single-molecule guide RNA (sgRNAs). In some embodiments, the one or more gRNAs or one or more sgRNAs is one or more modified gRNAs or one or more modified sgRNAs.

In some embodiments, the one or more DNA endonucleases is pre-complexed with one or more gRNAs or one or more sgRNAs.

In some embodiments, the part of the wild-type SERPINA1 gene or cDNA is the entire SERPINA1 gene or cDNA.

In some embodiments, the donor template is either single or double stranded. In some embodiments, the donor template has homologous arms to the 14q32.13 region.

In some embodiments, the DSB, or 5' DSB and 3' DSB are in the first exon, first intron, or both the first exon and first intron of the SERPINA1 gene.

In some embodiments, the gRNA or sgRNA is directed to one or more of the following pathological variants: rs764325655, rs121912713, rs28929474, rs17580, rs121912714, rs764220898, rs199422211, rs751235320, rs199422210, rs267606950, rs55819880, rs28931570.

In some embodiments, the insertion or correction is by homology directed repair (HDR).

In some embodiments, the method further comprises introducing into the cell two guide ribonucleic acid (gRNAs), and wherein the one or more DNA endonucleases is two or more Cas9 endonucleases that effect a pair of double-strand breaks (DSBs), the first at a 5' DSB locus and the second at a 3' DSB locus, within or near the SERPINA1 gene or other DNA sequences that encode regulatory elements of the SERPINA1 gene, or within or near a safe harbor locus that causes a deletion of the chromosomal DNA between the 5' DSB locus and the 3' DSB locus that results in permanent deletion of the chromosomal DNA between the 5' DSB locus and the 3' DSB locus within or near the SERPINA1 gene or other DNA sequences that encode regulatory elements of the SERPINA1 gene, or within or near a safe harbor locus and restoration of AAT protein activity, and wherein the first guide RNA comprises a spacer sequence that is complementary to a segment of the 5' DSB locus and the second guide RNA comprises a spacer sequence that is complementary to a segment of the 3' DSB locus.

In some embodiments, the two gRNAs are two single-molecule guide RNA (sgRNAs). In some embodiments, the two gRNAs or two sgRNAs are two modified gRNAs or two modified sgRNAs.

In some embodiments, the one or more DNA endonucleases is pre-complexed with one or two gRNAs or one or two sgRNAs.

In some embodiments, both the 5' DSB and 3' DSB are in or near either the first exon, second exon, third exon, fourth exon or fifth exon or introns of the SERPINA1 gene.

In some embodiments, the correction is by homology directed repair (HDR).

In some embodiments, the deletion is a deletion of 1 kb or less.

In some embodiments, the Cas9 or Cpf1 mRNA, gRNA, and donor template are either each formulated separately into lipid nanoparticles or all co-formulated into a lipid nanoparticle.

In some embodiments, the Cas9 or Cpf1 mRNA, gRNA, and donor template are formulated into separate exosomes or are co-formulated into an exosome.

In some embodiments, the Cas9 or Cpf1 mRNA is formulated into a lipid nanoparticle, and both the gRNA and donor template are delivered to the cell by a viral vector. In some embodiments, the viral vector is an adeno-associated virus (AAV) vector. In some embodiments, the AAV vector is an AAV6 vector.

The Cas9 or Cpf1 mRNA can be formulated into a lipid nanoparticle, and the gRNA can be delivered to the cell by electroporation and donor template can be delivered to the cell by a viral vector. In some embodiments, the viral vector is an adeno-associated virus (AAV) vector. In some embodiments, the AAV vector is an AAV6 vector.

In some embodiments, the SERPINA1 gene is located on Chromosome 14: 1,493,319-1,507,264 (Genome Reference Consortium—GRCh38/hg38).

The restoration of AAT protein activity can be compared to wild-type or normal AAT protein activity.

In another aspect, provided herein is one or more guide ribonucleic acids (gRNAs) comprising a spacer sequence selected from the group consisting of the nucleic acid sequences in Examples 1-6 and in SEQ ID NOs 54,860-68,297: for editing the SERPINA1 gene in a cell from a patient with alpha-1 antitrypsin deficiency. In some embodiments, the one or more gRNAs are one or more single-molecule guide RNAs (sgRNAs). In some embodiments, the one or more gRNAs or one or more sgRNAs is one or more modified gRNAs or one or more modified sgRNAs.

In another aspect, provided herein is one or more guide ribonucleic acids (gRNAs) comprising a spacer sequence selected from the group consisting of the nucleic acid sequences in SEQ ID NOs: 1-54,859 for editing a safe harbor locus in a cell from a patient with alpha-1 antitrypsin deficiency, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR. In some embodiments, the one or more gRNAs are one or more single-molecule guide RNAs (sgRNAs). In some embodiments, the one or more gRNAs or one or more sgRNAs is one or more modified gRNAs or one or more modified sgRNAs.

In another aspect, provided herein are cells that have been modified by the preceding methods to permanently correct one or more mutations within the SERPINA1 gene and restore AAT protein activity. Further provided herein are methods for ameliorating Alpha-1 Antitrypsin Deficiency (AATD) by the administration of cells that have been modified by the preceding methods to an AATD patient.

In some embodiments, the methods and compositions of the disclosure comprise one or more modified guide ribonucleic acids (gRNAs). Non-limiting examples of modifications can comprise one or more nucleotides modified at the 2' position of the sugar, in some embodiments a 2'-O-alkyl, 2'-O-alkyl-O-alkyl, or 2'-fluoro-modified nucleotide. In some embodiments, RNA modifications include 2'-fluoro, 2'-amino or 2' O-methyl modifications on the ribose of pyrimidines, abasic residues, desoxy nucleotides, or an inverted base at the 3' end of the RNA.

In some embodiments, the one or more modified guide ribonucleic acids (gRNAs) comprise a modification that makes the modified gRNA more resistant to nuclease digestion than the native oligonucleotide. Non-limiting examples of such modifications include those comprising modified backbones, for example, phosphorothioates, phosphorothyos, phosphotriesters, methyl phosphonates, short chain alkyl or cycloalkyl intersugar linkages or short chain heteroatomic or heterocyclic intersugar linkages.

Various other aspects are described and exemplified herein.

BRIEF DESCRIPTION OF THE DRAWINGS

Various aspects of materials and methods for treatment of Alpha-1 Antitrypsin Deficiency (AATD) disclosed and described in this specification can be better understood by reference to the accompanying figures, in which.

BRIEF DESCRIPTION OF THE SEQUENCE LISTING

Figure 1A:
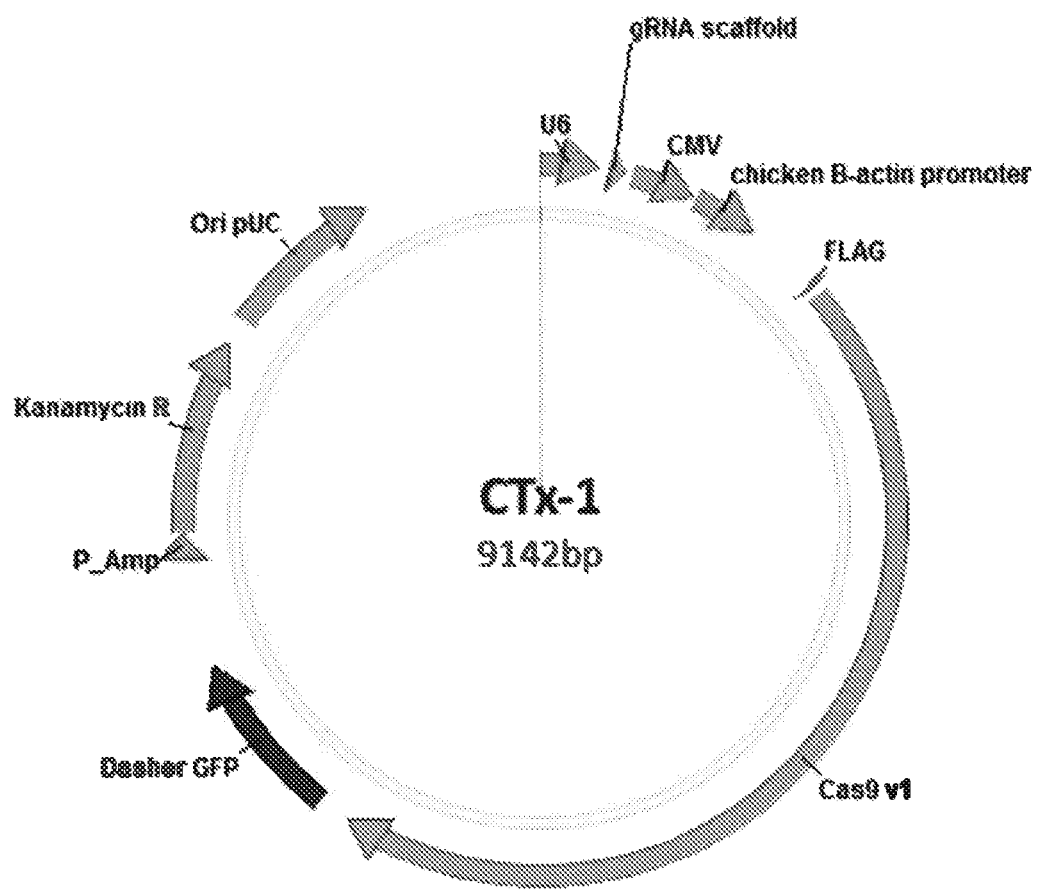
FIG. 1A is an illustration of a plasmid (referred to herein as "CTx-1") comprising a codon optimized gene for *S. pyogenes* Cas9 endonuclease. The CTx-1 plasmid also comprises a gRNA scaffold sequence, which includes a 20 bp spacer sequence from the sequences listed in Examples 1 and 8.

SEQ ID NOs: 1-2,032 are 20 bp spacer sequences for targeting an AAVS1 (PPP1R12C) gene with a *S. pyogenes* Cas9 endonuclease.

SEQ ID NOs: 2,033-2,203 are 20 bp spacer sequences for targeting an AAVS1 (PPP1R12C) gene with a *S. aureus* Cas9 endonuclease.

SEQ ID NOs: 2,204-2,221 are 20 bp spacer sequences for targeting an AAVS1 (PPP1R12C) gene with a *S. thermophilus* Cas9 endonuclease.

SEQ ID NOs: 2,222-2,230 are 20 bp spacer sequences for targeting an AAVS1 (PPP1R12C) gene with a *T. denticola* Cas9 endonuclease.

SEQ ID NOs: 2,231-2,305 are 20 bp spacer sequences for targeting an AAVS1 (PPP1R12C) gene with a *N. meningitides* Cas9 endonuclease.

SEQ ID NOs: 2,306-3,481 are 22 bp spacer sequences for targeting an AAVS1 (PPP1R12C) gene with an *Acidominococcus*, *Lachnospiraceae*, and *Francisella novicida* Cpf1 endonuclease.

SEQ ID NOs: 3,482-3,649 are 20 bp spacer sequences for targeting an Alb gene with a *S. pyogenes* Cas9 endonuclease.

SEQ ID NOs: 3,650-3,677 are 20 bp spacer sequences for targeting an Alb gene with a *S. aureus* Cas9 endonuclease.

SEQ ID NOs: 3,678-3,695 are 20 bp spacer sequences for targeting an Alb gene with a *S. thermophilus* Cas9 endonuclease.

SEQ ID NOs: 3,696-3,700 are 20 bp spacer sequences for targeting an Alb gene with a *T. denticola* Cas9 endonuclease.

SEQ ID NOs: 3,701-3,724 are 20 bp spacer sequences for targeting an Alb gene with a *N. meningitides* Cas9 endonuclease.

SEQ ID NOs: 3,725-4,103 are 22 bp spacer sequences for targeting an Alb gene with an *Acidominococcus*, *Lachnospiraceae*, and *Francisella novicida* Cpf1 endonuclease.

SEQ ID NOs: 4,104-4,448 are 20 bp spacer sequences for targeting an Angptl3 gene with a *S. pyogenes* Cas9 endonuclease.

SEQ ID NOs: 4,449-4,484 are 20 bp spacer sequences for targeting an Angptl3 gene with a *S. aureus* Cas9 endonuclease.

SEQ ID NOs: 4,485-4,507 are 20 bp spacer sequences for targeting an Angptl3 gene with a *S. thermophilus* Cas9 endonuclease.

SEQ ID NOs: 4,508-4,520 are 20 bp spacer sequences for targeting an Angptl3 gene with a *T. denticola* Cas9 endonuclease.

SEQ ID NOs: 4,521-4,583 are 20 bp spacer sequences for targeting an Angptl3 gene with a *N. meningitides* Cas9 endonuclease.

SEQ ID NOs: 4,584-5,431 are 22 bp spacer sequences for targeting an Angptl3 gene with an *Acidominococcus*, *Lachnospiraceae*, and *Francisella novicida* Cpf1 endonuclease.

SEQ ID NOs: 5,432-5,834 are 20 bp spacer sequences for targeting an ApoC3 gene with a *S. pyogenes* Cas9 endonuclease.

SEQ ID NOs: 5,835-5,859 are 20 bp spacer sequences for targeting an ApoC3 gene with a *S. aureus* Cas9 endonuclease.

SEQ ID NOs: 5,860-5,862 are 20 bp spacer sequences for targeting an ApoC3 gene with a *S. thermophilus* Cas9 endonuclease.

SEQ ID NOs: 5,863-5,864 are 20 bp spacer sequences for targeting an ApoC3 gene with a *T. denticola* Cas9 endonuclease.

SEQ ID NOs: 5,865-5,876 are 20 bp spacer sequences for targeting an ApoC3 gene with a *N. meningitides* Cas9 endonuclease.

SEQ ID NOs: 5,877-6,108 are 22 bp spacer sequences for targeting an ApoC3 gene with an *Acidominococcus*, *Lachnospiraceae*, and *Francisella novicida* Cpf1 endonuclease.

SEQ ID NOs: 6,109-7,876 are 20 bp spacer sequences for targeting an ASGR2 gene with a *S. pyogenes* Cas9 endonuclease.

SEQ ID NOs: 7,877-8,082 are 20 bp spacer sequences for targeting an ASGR2 gene with a *S. aureus* Cas9 endonuclease.

SEQ ID NOs: 8,083-8,106 are 20 bp spacer sequences for targeting an ASGR2 gene with a *S. thermophilus* Cas9 endonuclease.

SEQ ID NOs: 8,107-8,118 are 20 bp spacer sequences for targeting an ASGR2 gene with a *T. denticola* Cas9 endonuclease.

SEQ ID NOs: 8,119-8,201 are 20 bp spacer sequences for targeting an ASGR2 gene with a *N. meningitides* Cas9 endonuclease.

SEQ ID NOs: 8,202-9,641 are 22 bp spacer sequences for targeting an ASGR2 gene with an *Acidominococcus*, *Lachnospiraceae*, and *Francisella novicida* Cpf1 endonuclease.

SEQ ID NOs: 9,642-9,844 are 20 bp spacer sequences for targeting a CCR5 gene with a *S. pyogenes* Cas9 endonuclease.

SEQ ID NOs: 9,845-9,876 are 20 bp spacer sequences for targeting a CCR5 gene with a *S. aureus* Cas9 endonuclease.

SEQ ID NOs: 9,877-9,890 are 20 bp spacer sequences for targeting a CCR5 gene with a *S. thermophilus* Cas9 endonuclease.

SEQ ID NOs: 9,891-9,892 are 20 bp spacer sequences for targeting a CCR5 gene with a *T. denticola* Cas9 endonuclease.

SEQ ID NOs: 9,893-9,920 are 20 bp spacer sequences for targeting a CCR5 gene with a *N. meningitides* Cas9 endonuclease.

SEQ ID NOs: 9,921-10,220 are 22 bp spacer sequences for targeting a CCR5 gene with an *Acidominococcus*, *Lachnospiraceae*, and *Francisella novicida* Cpf1 endonuclease.

SEQ ID NOs: 10,221-11,686 are 20 bp spacer sequences for targeting an F9 gene with a *S. pyogenes* Cas9 endonuclease.

SEQ ID NOs: 11,687-11,849 are 20 bp spacer sequences for targeting an F9 gene with a *S. aureus* Cas9 endonuclease.

SEQ ID NOs: 11,850-11,910 are 20 bp spacer sequences for targeting an F9 gene with a *S. thermophilus* Cas9 endonuclease.

SEQ ID NOs: 11,911-11,935 are 20 bp spacer sequences for targeting an F9 gene with a 7*T. denticola* Cas9 endonuclease.

SEQ ID NOs: 11,936-12,088 are 20 bp spacer sequences for targeting an F9 gene with a *N. meningitides* Cas9 endonuclease.

SEQ ID NOs: 12,089-14,229 are 22 bp spacer sequences for targeting an F9 gene with an *Acidominococcus*, *Lachnospiraceae*, and *Francisella novicida* Cpf1 endonuclease.

SEQ ID NOs: 14,230-15,245 are 20 bp spacer sequences for targeting a G6PC gene with a *S. pyogenes* Cas9 endonuclease.

SEQ ID NOs: 15,246-15,362 are 20 bp spacer sequences for targeting a G6PC gene with a *S. aureus* Cas9 endonuclease.

SEQ ID NOs: 15,363-15,386 are 20 bp spacer sequences for targeting a G6PC gene with a *S. thermophilus* Cas9 endonuclease.

SEQ ID NOs: 15,387-15,395 are 20 bp spacer sequences for targeting a G6PC gene with a *T. denticola* Cas9 endonuclease.

SEQ ID NOs: 15,396-15,485 are 20 bp spacer sequences for targeting a G6PC gene with a *N. meningitides* Cas9 endonuclease.

SEQ ID NOs: 15,486-16,580 are 22 bp spacer sequences for targeting a G6PC gene with an *Acidominococcus, Lachnospiraceae*, and *Francisella novicida* Cpf1 endonuclease.

SEQ ID NOs: 16,581-22,073 are 20 bp spacer sequences for targeting a Gys2 gene with a *S. pyogenes* Cas9 endonuclease.

SEQ ID NOs: 22,074-22,749 are 20 bp spacer sequences for targeting a Gys2 gene with a *S. aureus* Cas9 endonuclease.

SEQ ID NOs: 22,750-20,327 are 20 bp spacer sequences for targeting a Gys2 gene with a *S. thermophilus* Cas9 endonuclease.

SEQ ID NOs: 23,028-23,141 are 20 bp spacer sequences for targeting a Gys2 gene with a *T. denticola* Cas9 endonuclease.

SEQ ID NOs: 23,142-23,821 are 20 bp spacer sequences for targeting a Gys2 gene with a *N. meningitides* Cas9 endonuclease.

SEQ ID NOs: 23,822-32,253 are 22 bp spacer sequences for targeting a Gys2 gene with an *Acidominococcus, Lachnospiraceae*, and *Francisella novicida* Cpf1 endonuclease.

SEQ ID NOs: 32,254-33,946 are 20 bp spacer sequences for targeting an HGD gene with a *S. pyogenes* Cas9 endonuclease.

SEQ ID NOs: 33,947-34,160 are 20 bp spacer sequences for targeting an HGD gene with a *S. aureus* Cas9 endonuclease.

SEQ ID NOs: 34,161-34,243 are 20 bp spacer sequences for targeting an HGD gene with a *S. thermophilus* Cas9 endonuclease.

SEQ ID NOs: 34,244-34,262 are 20 bp spacer sequences for targeting an HGD gene with a *T. denticola* Cas9 endonuclease.

SEQ ID NOs: 34,263-34,463 are 20 bp spacer sequences for targeting an HGD gene with a *N. meningitides* Cas9 endonuclease.

SEQ ID NOs: 34,464-36,788 are 22 bp spacer sequences for targeting an HGD gene with an *Acidominococcus, Lachnospiraceae*, and *Francisella novicida* Cpf1 endonuclease.

SEQ ID NOs: 36,789-40,583 are 20 bp spacer sequences for targeting an Lp(a) gene with a *S. pyogenes* Cas9 endonuclease.

SEQ ID NOs: 40,584-40,993 are 20 bp spacer sequences for targeting an Lp(a) gene with a *S. aureus* Cas9 endonuclease.

SEQ ID NOs: 40,994-41,129 are 20 bp spacer sequences for targeting an Lp(a) gene with a *S. thermophilus* Cas9 endonuclease.

SEQ ID NOs: 41,130-41,164 are 20 bp spacer sequences for targeting an Lp(a) gene with a *T. denticola* Cas9 endonuclease.

SEQ ID NOs: 41,165-41,532 are 20 bp spacer sequences for targeting an Lp(a) gene with a *N. meningitides* Cas9 endonuclease.

SEQ ID NOs: 41,533-46,153 are 22 bp spacer sequences for targeting an Lp(a) gene with an *Acidominococcus, Lachnospiraceae*, and *Francisella novicida* Cpf1 endonuclease.

SEQ ID NOs: 46,154-48,173 are 20 bp spacer sequences for targeting a PCSK9 gene with a *S. pyogenes* Cas9 endonuclease.

SEQ ID NOs: 48,174-48,360 are 20 bp spacer sequences for targeting a PCSK9 gene with a *S. aureus* Cas9 endonuclease.

SEQ ID NOs: 48,361-48,396 are 20 bp spacer sequences for targeting a PCSK9 gene with a *S. thermophilus* Cas9 endonuclease.

SEQ ID NOs: 48,397-48,410 are 20 bp spacer sequences for targeting a PCSK9 gene with a *T. denticola* Cas9 endonuclease.

SEQ ID NOs: 48,411-48,550 are 20 bp spacer sequences for targeting a PCSK9 gene with a *N. meningitides* Cas9 endonuclease.

SEQ ID NOs: 48,551-50,344 are 22 bp spacer sequences for targeting a PCSK9 gene with an *Acidominococcus, Lachnospiraceae*, and *Francisella novicida* Cpf1 endonuclease.

SEQ ID NOs: 50,345-51,482 are 20 bp spacer sequences for targeting a Serpina1 gene as a safe harbor locus with a *S. pyogenes* Cas9 endonuclease.

SEQ ID NOs: 51,483-51,575 are 20 bp spacer sequences for targeting a Serpina1 gene as a safe harbor locus with a *S. aureus* Cas9 endonuclease.

SEQ ID NOs: 51,576-51,587 are 20 bp spacer sequences for targeting a Serpina1 gene as a safe harbor locus with a *S. thermophilus* Cas9 endonuclease.

SEQ ID NOs: 51,588-51,590 are 20 bp spacer sequences for targeting a Serpina1 gene as a safe harbor locus with a *T. denticola* Cas9 endonuclease.

SEQ ID NOs: 51,591-51,641 are 20 bp spacer sequences for targeting a Serpina1 gene as a safe harbor locus with a *N. meningitides* Cas9 endonuclease.

SEQ ID NOs: 51,642-52,445 are 22 bp spacer sequences for targeting a Serpina1 gene as a safe harbor locus with an *Acidominococcus, Lachnospiraceae*, and *Francisella novicida* Cpf1 endonuclease.

SEQ ID NOs: 52,446-53,277 are 20 bp spacer sequences for targeting a TF gene with a *S. pyogenes* Cas9 endonuclease.

SEQ ID NOs: 53,278-53,363 are 20 bp spacer sequences for targeting a TF gene with a *S. aureus* Cas9 endonuclease.

SEQ ID NOs: 53,364-53,375 are 20 bp spacer sequences for targeting a TF gene with a *S. thermophilus* Cas9 endonuclease.

SEQ ID NOs: 53,376-53,382 are 20 bp spacer sequences for targeting a TF gene with a *T. denticola* Cas9 endonuclease.

SEQ ID NOs: 53,383-53,426 are 20 bp spacer sequences for targeting a TF gene with a *N. meningitides* Cas9 endonuclease.

SEQ ID NOs: 53,427-54,062 are 22 bp spacer sequences for targeting a TF gene with an *Acidominococcus, Lachnospiraceae*, and *Francisella novicida* Cpf1 endonuclease.

SEQ ID NOs: 54,063-54,362 are 20 bp spacer sequences for targeting a TTR gene with a *S. pyogenes* Cas9 endonuclease.

SEQ ID NOs: 54,363-54,403 are 20 bp spacer sequences for targeting a TTR gene with a *S. aureus* Cas9 endonuclease.

SEQ ID NOs: 54,404-54,420 are 20 bp spacer sequences for targeting a TTR gene with a *S. thermophilus* Cas9 endonuclease.

SEQ ID NOs: 54,421-54,422 are 20 bp spacer sequences for targeting a TTR gene with a *T. denticola* Cas9 endonuclease.

SEQ ID NOs: 54,423-54,457 are 20 bp spacer sequences for targeting a TTR gene with a *N. meningitides* Cas9 endonuclease.

SEQ ID NOs: 54,458-54,859 are 22 bp spacer sequences for targeting a TTR gene with an *Acidominococcus, Lachnospiraceae*, and *Francisella novicida* Cpf1 endonuclease.

SEQ ID NOs: 54,860-61,324 are 20 bp spacer sequences for targeting a SERPINA1 gene (other than as a safe harbor locus) with a *S. pyogenes* Cas9 endonuclease.

SEQ ID NOs: 61,325-61,936 are 20 bp spacer sequences for targeting a SERPINA1 gene (other than as a safe harbor locus) with a *S. aureus* Cas9 endonuclease.

SEQ ID NOs: 61,937-62,069 are 20 bp spacer sequences for targeting a SERPINA1 gene (other than as a safe harbor locus) with a *S. thermophilus* Cas9 endonuclease.

SEQ ID NOs: 62,070-62,120 are 20 bp spacer sequences for targeting a SERPINA1 gene (other than as a safe harbor locus) with a *T. denticola* Cas9 endonuclease.

SEQ ID NOs: 62,121-62,563 are 20 bp spacer sequences for targeting a SERPINA1 gene (other than as a safe harbor locus) with a *N. meningitides* Cas9 endonuclease.

SEQ ID NOs: 62,564-68,297 are 22 bp spacer sequences for targeting a SERPINA1 gene (other than as a safe harbor locus) with an *Acidominococcus, Lachnospiraceae,* and *Francisella novicida* Cpf1 endonuclease.

DETAILED DESCRIPTION

Alpha-1 Antitrypsin Deficiency (AATD)

AATD is caused by mutations, or more rarely by deletions, to the SERPINA1 gene. The SERPINA1 gene is located at 14q32.13, with genomic coordinates (GRCh38) at chr14: 1,493,319-1,507,264. SERPINA1 is comprised of five exons and has a total length of 12.2 kb. The gene has two promoters, with one controlling expression in macrophages. Multiple transcript variants have been reported; however, they all encode the same AAT protein. About 95% of AATD results from pathological alleles PI Z or PI S or their combination.

The SERPINA1 gene encodes alpha-1-antitrypsin (AAT), also known as protease inhibitor (PI), a major plasma serine protease inhibitor. AAT complexes predominantly with elastase, but also with other serine proteases. An important inhibitory action of AAT is against neutrophil elastase, a protease that degrades elastin of the alveolar walls as well as other structural proteins in a variety of tissues.

Therapeutic Approach

As the known forms of AATD are monogenic disorders with recessive inheritance, it is likely that correcting one of the mutant alleles per cell will be sufficient for correction and restoration or partial restoration of AATD function. The correction of one allele can coincide with one copy that remains with the original mutation, or a copy that was cleaved and repaired by non-homologous end joining (NHEJ) and therefore was not properly corrected. Bi-allelic correction can also occur. Various editing strategies that can be employed for specific mutations are discussed below.

Correction of one or possibly both of the mutant alleles provides an important improvement over existing or potential therapies, such as introduction of SERPINA1 expression cassettes through lentivirus delivery and integration. Gene editing has the advantage of precise genome modification and lower adverse effects, for example, the mutation can be corrected by the insertions or deletions that arise due to the NHEJ repair pathway. If the patient's SERPINA1 gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of HDR is a function of the distance between the mutation and the cut site so choosing overlapping or nearby target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor"—i.e., non-deleterious insertion point that is not the SERPINA1 gene itself—, with or without suitable regulatory sequences. If this construct is knocked-in near the SERPINA1 regulatory elements, it should have physiological control, similar to the normal gene. Two or more (e.g., a pair) nucleases can be used to delete mutated gene regions, though a donor would usually have to be provided to restore function. In this case two gRNA and one donor sequence would be supplied.

Provided herein are methods to correct the specific mutation in the gene by inducing a double stranded break with Cas9 and a sgRNA or a pair of double stranded breaks around the mutation using two appropriate sgRNAs, and to provide a donor DNA template to induce Homology-Directed Repair (HDR). In some embodiments, the donor DNA template can be a short single stranded oligonucleotide, a short double stranded oligonucleotide, a long single or double stranded DNA molecule. These methods use gRNAs and donor DNA molecules for each of the variants of SERPINA1.

Provided herein are methods to knock-in SERPINA1 cDNA or a minigene (comprised of one or more exons and introns or natural or synthetic introns) into the locus of the corresponding gene. These methods use a pair of sgRNA targeting the first exon and/or the first intron of the SERPINA1 gene. In some embodiments, the donor DNA is single or double stranded DNA having homologous arms to the 17q21 region.

Provided herein are methods to knock-in SERPINA1 cDNA or a minigene (comprised of one or more exons and introns or natural or synthetic introns) into the locus of the hot-spot, e.g., ALB gene. These methods use a pair of sgRNA targeting the first exon and/or the first intron of the gene located in the liver hotspot. In some embodiments, the donor DNA is single or double stranded DNA having homologous arms to the corresponding region.

Provided herein are cellular, ex vivo and in vivo methods for using genome engineering tools to create permanent changes to the genome by: 1) correcting, by insertions or deletions that arise due to the imprecise NHEJ pathway, one or more mutations within or near the SERPINA1 gene or other DNA sequences that encode regulatory elements of the SERPINA1 gene, 2) correcting, by HDR, one or more mutations within or near the SERPINA1 gene or other DNA sequences that encode regulatory elements of the SERPINA1 gene, or 3) deletion of the mutant region and/or knocking-in SERPINA1 cDNA or minigene (comprised of, natural or synthetic enhancer and promoter, one or more exons, and natural or synthetic introns, and natural or synthetic 3'UTR and polyadenylation signal) into the gene locus or a safe harbor locus of the SERPINA1 gene, and restoring AAT protein activity. Such methods use endonucleases, such as CRISPR-associated (CRISPR/Cas9, Cpf1, and the like) nucleases, to permanently delete, insert, edit, correct, or replace one or more exons or portions thereof (i.e., mutations within or near the coding and/or splicing sequences) or insert in the genomic locus of the SERPINA1 gene or other DNA sequences that encode regulatory elements of the SERPINA1 gene. In this way, examples set forth in the present disclosure can help to restore the reading frame or the wild-type sequence of, or otherwise correct, the gene with a single treatment (rather than deliver potential therapies for the lifetime of the patient). SERPINA1 gene.

Provided herein are methods for treating a patient with AATD. An embodiment of such method is an ex vivo cell based therapy. For example, a patient specific induced pluripotent stem cell (iPSC) is created. Then, the chromosomal DNA of these iPS cells is edited using the materials and methods described herein. Next, the genome-edited iPSCs are differentiated into hepatocytes. Finally, the hepatocytes are implanted into the patient.

Another embodiment of such method is an ex vivo cell based therapy. For example, a biopsy of the patient's liver is performed. Then, a liver specific progenitor cell or primary hepatocyte is isolated from the patient, e.g., by a biopsy. Next, the chromosomal DNA of these progenitor cells or primary hepatocytes is edited using the materials and methods described herein. Finally, the genome-edited progenitor cells or primary hepatocytes are implanted into the patient.

Yet another embodiment of such method is an ex vivo cell based therapy. For example, a biopsy of the patients bone marrow is performed. Then, a mesenchymal stem cell is isolated from the patient, which can be isolated from the patient's bone marrow, e.g., by biopsy, or peripheral blood. Next, the chromosomal DNA of these mesenchymal stem cells is edited using the materials and methods described herein. Next, the genome-edited mesenchymal stem cells are differentiated into hepatocytes. Finally, these hepatocytes are implanted into the patient.

One advantage of an ex vivo cell therapy approach is the ability to conduct a comprehensive analysis of the therapeutic prior to administration. All nuclease based therapeutics have some level of off-target effects. Performing gene correction ex vivo allows one to fully characterize the corrected cell population prior to implantation. Aspects of the invention include sequencing the entire genome of the corrected cells to ensure that the off-target cuts, if any, are in genomic locations associated with minimal risk to the patient. Furthermore, populations of specific cells, including clonal populations, can be isolated prior to implantation.

Another advantage of ex vivo cell therapy relates to genetic correction in iPSCs compared to other primary cell sources. iPSCs are prolific, making it easy to obtain the large number of cells that will be required for a cell based therapy. Furthermore, iPSCs are an ideal cell type for performing clonal isolations. This allows screening for the correct genomic correction, without risking a decrease in viability. In contrast, other potential cell types, such as primary hepatocytes, are viable for only a few passages and difficult to clonally expand. Thus, manipulation of AATD iPSCs will be much easier, and will shorten the amount of time needed to make the desired genetic correction.

Another embodiment of such method is an in vivo based therapy. In this method, the chromosomal DNA of the cells in the patient is corrected using the materials and methods described herein.

An advantage of in vivo gene therapy is the ease of therapeutic production and administration. The same therapeutic approach and therapy will have the potential to be used to treat more than one patient, for example a number of patients who share the same or similar genotype or allele. In contrast, ex vivo cell therapy typically requires using a patient's own cells, which are isolated, manipulated and returned to the same patient.

Also provided herein is a cellular method for editing the SERPINA1 gene in a cell by genome editing. For example, a cell is isolated from a patient or animal. Then, the chromosomal DNA of the cell is edited using the materials and methods described herein.

The methods of the invention, regardless of whether a cellular or ex vivo or in vivo method, involves one or a combination of the following: 1) correcting, by insertions or deletions that arise due to the imprecise NHEJ pathway, one or more mutations within or near the SERPINA1 gene or other DNA sequences that encode regulatory elements of the SERPINA1 gene, 2) correcting, by HDR, one or more mutations within or near the SERPINA1 gene or other DNA sequences that encode regulatory elements of the SERPINA1 gene, or 3) deletion of the mutant region and/or knocking in SERPINA1 cDNA or a minigene (comprised of one or more exons or introns or natural or synthetic introns) or introducing exogenous SERPINA1 DNA or cDNA sequence or a fragment thereof into the locus of the gene or at a heterologous location in the genome (such as a safe harbor locus, such as, e.g., targeting an AAVS1 (PPP1R12C), an ALB gene, an Angptl3 gene, an ApoC3 gene, an ASGR2 gene, a CCR5 gene, a FIX (F9) gene, a G6PC gene, a Gys2 gene, an HGD gene, a Lp(a) gene, a Pcsk9 gene, a Serpina1 gene, a TF gene, and a TTR gene). Assessment of efficiency of HDR mediated knock-in of cDNA into the first exon can utilize cDNA knock-in into "safe harbor" sites such as: single-stranded or double-stranded DNA having homologous arms to one of the following regions, for example: ApoC3 (chr11:116829908-116833071), Angptl3 (chr1:62,597,487-62,606,305), Serpina1 (chr14:94376747-94390692), Lp(a) (chr6: 160531483-160664259), Pcsk9 (chr1:55,039,475-55,064,852), FIX (chrX:139,530,736-139,563,458), ALB (chr4:73,404,254-73,421,411), TTR (chr18:31,591,766-31,599,023), TF (chr3:133,661,997-133,779,005), G6PC (chr17:42,900,796-42,914,432), Gys2 (chr12:21,536,188-21,604,857), AAVS1 (PPP1R12C) (chr19:55,090,912-55,117,599), HGD (chr3:120,628,167-120,682,570), CCR5 (chr3:46,370,854-46,376,206), ASGR2 (chr17:7,101,322-7,114,310). Both the correction and knock-in strategies utilize a donor DNA template in Homology-Directed Repair (HDR). HDR in either strategy may be accomplished by making one or more double-stranded breaks (DSBs) at specific sites in the genome by using one or more endonucleases.

For example, the NHEJ correction strategy can involve restoring the reading frame in the SERPINA1 gene by inducing one single stranded break or double stranded break in the gene of interest with one or more CRISPR endonucleases and a gRNA (e.g., crRNA+tracrRNA, or sgRNA), or two or more single stranded breaks or double stranded breaks in the gene of interest with two or more CRISPR endonucleases and two or more sgRNAs. This approach can require development and optimization of sgRNAs for the SERPINA1 gene.

For example, the HDR correction strategy involves restoring the reading frame in the SERPINA1 gene by inducing one double stranded break in the gene of interest with one or more CRISPR endonucleases and gRNA (e.g., crRNA+ tracrRNA, or sgRNA), or two or more double stranded breaks in the gene of interest with one or more CRISPR endonucleases and two or more appropriate sgRNAs, in the presence of a donor DNA template introduced exogenously to direct the cellular DSB response to Homology-Directed Repair (the donor DNA template can be a short single stranded oligonucleotide, a short double stranded oligonucleotide, a long single or double stranded DNA molecule). This approach requires development and optimization of gRNAS and donor DNA molecules for the major variant of the SERPINA1 gene (PI Z).

For example, the knock-in strategy involves knocking-in SERPINA1 cDNA or a minigene (comprised of, natural or synthetic enhancer and promoter, one or more exons, and natural or synthetic introns, and natural or synthetic 3'UTR and polyadenylation signal) into the locus of the gene using a gRNA (e.g., crRNA _+tracrRNA, or sgRNA) or a pair of sgRNAs targeting upstream of or in the first or other exon and/or intron of the SERPINA1 gene, or in a safe harbor site (such as AAVS1 (PPP1R12C), ALB, Angptl3, ApoC3, ASGR2, CCR5, FIX (F9), G6PC, Gys2, HGD, Lp(a), Pcsk9, Serpina1, TF, and/or TTR). The donor DNA will be single or double stranded DNA having homologous arms to the 14q32.13 region.

For example, the deletion strategy involves deleting one or more mutations in one or more of the five exons of the SERPINA1 gene using one or more endonucleases and two or more gRNAs or sgRNAs.

The advantages for the above strategies (correction and knock-in and deletion) are similar, including in principle both short and long term beneficial clinical and laboratory effects. In addition, it may be that only a low percentage of AAT activity is required to provide therapeutic benefit. Another advantage for all strategies is that most patients have low-level gene and protein activity, therefore suggesting that additional protein expression, for example following gene correction, should not necessarily lead to an immune response against the target gene product. The knock-in approach does provide one advantage over the correction or deletion approach—the ability to treat all patients versus only a subset of patients. While there are common mutations in this gene, there are also many other possible mutations, and using the knock-in method could treat all of them. The other issue with gene editing in this manner is the need for a DNA donor for HDR.

In addition to the above genome editing strategies, another strategy involves modulating expression, function, or activity of SERPINA1 by editing in the regulatory sequence.

In addition to the editing options listed above, Cas9 or similar proteins can be used to target effector domains to the same target sites that can be identified for editing, or additional target sites within range of the effector domain. A range of chromatin modifying enzymes, methylases or demethylases can be used to alter expression of the target gene. One possibility is increasing the expression of the AAT protein if the mutation leads to lower activity. These types of epigenetic regulation have some advantages, particularly as they are limited in possible off-target effects.

A number of types of genomic target sites are present in addition to mutations in the coding and splicing sequences.

The regulation of transcription and translation implicates a number of different classes of sites that interact with cellular proteins or nucleotides. Often the DNA binding sites of transcription factors or other proteins can be targeted for mutation or deletion to study the role of the site, though they can also be targeted to change gene expression. Sites can be added through non-homologous end joining (NHEJ) or direct genome editing by homology directed repair (HDR). Increased use of genome sequencing, RNA expression and genome-wide studies of transcription factor binding have increased the ability to identify how the sites lead to developmental or temporal gene regulation. These control systems may be direct or may involve extensive cooperative regulation that can require the integration of activities from multiple enhancers. Transcription factors typically bind 6-12 bp-long degenerate DNA sequences. The low level of specificity provided by individual sites suggests that complex interactions and rules are involved in binding and the functional outcome. Binding sites with less degeneracy may provide simpler means of regulation. Artificial transcription factors can be designed to specify longer sequences that have less similar sequences in the genome and have lower potential for off-target cleavage. Any of these types of binding sites can be mutated, deleted or even created to enable changes in gene regulation or expression (Canver, M. C. et al., *Nature* (2015)).

Another class of gene regulatory regions having these features is microRNA (miRNA) binding sites. miRNAs are non-coding RNAs that play key roles in post-transcriptional gene regulation. miRNA may regulate the expression of 30% of all mammalian protein-encoding genes. Specific and potent gene silencing by double stranded RNA (RNAi) was discovered, plus additional small noncoding RNA (Canver, M. C. et al., *Nature* (2015)). The largest class of noncoding RNAs important for gene silencing are miRNAs. In mammals, miRNAs are first transcribed as a long RNA transcripts, which can be separate transcriptional units, part of protein introns, or other transcripts. The long transcripts are called primary miRNA (pri-miRNA) that include imperfectly base-paired hairpin structures. These pri-miRNA are cleaved into one or more shorter precursor miRNAs (pre-miRNAs) by Microprocessor, a protein complex in the nucleus, involving Drosha.

Pre-miRNAs are short stem loops ~70 nucleotides in length with a 2-nucleotide 3'-overhang that are exported, into the mature 19-25 nucleotide miRNA:miRNA* duplexes. The miRNA strand with lower base pairing stability (the guide strand) is loaded onto the RNA-induced silencing complex (RISC). The passenger guide strand (marked with *), may be functional, but is usually degraded. The mature miRNA tethers RISC to partly complementary sequence motifs in target mRNAs predominantly found within the 3' untranslated regions (UTRs) and induces posttranscriptional gene silencing (Bartel, D. P. *Cell* 136, 215-233 (2009); Saj, A. & Lai, E. C. *Curr Opin Genet Dev* 21, 504-510 (2011)).

miRNAs are important in development, differentiation, cell cycle and growth control, and in virtually all biological pathways in mammals and other multicellular organisms. miRNAs are also involved in cell cycle control, apoptosis and stem cell differentiation, hematopoiesis, hypoxia, muscle development, neurogenesis, insulin secretion, cholesterol metabolism, aging, viral replication and immune responses.

A single miRNA can target hundreds of different mRNA transcripts, while an individual transcript can be targeted by many different miRNAs. More than 28645 microRNAs have been annotated in the latest release of miRBase (v.21). Some miRNAs are encoded by multiple loci, some of which are expressed from tandemly co-transcribed clusters. The features allow for complex regulatory networks with multiple pathways and feedback controls. miRNAs are integral parts of these feedback and regulatory circuits and can help regulate gene expression by keeping protein production within limits (Herranz, H. & Cohen, S. M. *Genes Dev* 24, 1339-1344 (2010); Posadas, D. M. & Carthew, R. W. *Curr Opin Genet Dev* 27, 1-6 (2014)).

miRNA are also important in a large number of human diseases that are associated with abnormal miRNA expression. This association underscores the importance of the miRNA regulatory pathway. Recent miRNA deletion studies have linked miRNA with regulation of the immune responses (Stem-Ginossar, N. et al., *Science* 317, 376-381 (2007)).

miRNA also have a strong link to cancer and may play a role in different types of cancer. miRNAs have been found to be downregulated in a number of tumors. miRNA are important in the regulation of key cancer-related pathways, such as cell cycle control and the DNA damage response, and are therefore used in diagnosis and are being targeted clinically. MicroRNAs delicately regulate the balance of angiogenesis, such that experiments depleting all microRNAs suppresses tumor angiogenesis (Chen, S. et al., *Genes Dev* 28, 1054-1067 (2014)).

As has been shown for protein coding genes, miRNA genes are also subject to epigenetic changes occurring with cancer. Many miRNA loci are associated with CpG islands increasing their opportunity for regulation by DNA methylation (Weber, B., Stresemann, C., Brueckner, B. & Lyko, F. *Cell Cycle* 6, 1001-1005 (2007)). The majority of studies have used treatment with chromatin remodeling drugs to reveal epigenetically silenced miRNAs.

In addition to their role in RNA silencing, miRNA can also activate translation (Posadas, D. M. & Carthew, R. W. *Curr Opin Genet Dev* 27, 1-6 (2014)). Knocking out these sites may lead to decreased expression of the targeted gene, while introducing these sites may increase expression.

Individual miRNA can be knocked out most effectively by mutating the seed sequence (bases 2-8 of the microRNA), which is important for binding specificity. Cleavage in this region, followed by mis-repair by NHEJ can effectively abolish miRNA function by blocking binding to target sites. miRNA could also be inhibited by specific targeting of the special loop region adjacent to the palindromic sequence. Catalytically inactive Cas9 can also be used to inhibit shRNA expression (Zhao, Y. et al., *Sci Rep* 4, 3943 (2014)). In addition to targeting the miRNA, the binding sites can also be targeted and mutated to prevent the silencing by miRNA.

Human Cells

For ameliorating AATD, as described and illustrated herein, the principal targets for gene editing are human cells. For example, in the ex vivo methods, the human cells are somatic cells, which after being modified using the techniques as described, can give rise to hepatocytes or progenitor cells. For example, in the in vivo methods, the human cells are hepatocytes, renal cells or cells from other affected organs.

By performing gene editing in autologous cells that are derived from and therefore already completely matched with the patient in need, it is possible to generate cells that can be safely re-introduced into the patient, and effectively give rise to a population of cells that will be effective in ameliorating one or more clinical conditions associated with the patient's disease.

Progenitor cells (also referred to as stem cells herein) are capable of both proliferation and giving rise to more progenitor cells, these in turn having the ability to generate a large number of mother cells that can in turn give rise to differentiated or differentiable daughter cells. The daughter cells themselves can be induced to proliferate and produce progeny that subsequently differentiate into one or more mature cell types, while also retaining one or more cells with parental developmental potential. The term "stem cell" refers then, to a cell with the capacity or potential, under particular circumstances, to differentiate to a more specialized or differentiated phenotype, and which retains the capacity, under certain circumstances, to proliferate without substantially differentiating. In one embodiment, the term progenitor or stem cell refers to a generalized mother cell whose descendants (progeny) specialize, often in different directions, by differentiation, e.g., by acquiring completely individual characters, as occurs in progressive diversification of embryonic cells and tissues. Cellular differentiation is a complex process typically occurring through many cell divisions. A differentiated cell may derive from a multipotent cell that itself is derived from a multipotent cell, and so on. While each of these multipotent cells may be considered stem cells, the range of cell types that each can give rise to may vary considerably. Some differentiated cells also have the capacity to give rise to cells of greater developmental potential. Such capacity may be natural or may be induced artificially upon treatment with various factors. In many biological instances, stem cells are also "multipotent" because they can produce progeny of more than one distinct cell type, but this is not required for "stem-ness."

Self-renewal is another important aspect of the stem cell. In theory, self-renewal can occur by either of two major mechanisms. Stem cells may divide asymmetrically, with one daughter retaining the stem state and the other daughter expressing some distinct other specific function and phenotype. Alternatively, some of the stem cells in a population can divide symmetrically into two stems, thus maintaining some stem cells in the population as a whole, while other cells in the population give rise to differentiated progeny only. Generally, "progenitor cells" have a cellular phenotype that is more primitive (i.e., is at an earlier step along a developmental pathway or progression than is a fully differentiated cell). Often, progenitor cells also have significant or very high proliferative potential. Progenitor cells can give rise to multiple distinct differentiated cell types or to a single differentiated cell type, depending on the developmental pathway and on the environment in which the cells develop and differentiate.

In the context of cell ontogeny, the adjective "differentiated," or "differentiating" is a relative term. A "differentiated cell" is a cell that has progressed further down the developmental pathway than the cell to which it is being compared. Thus, stem cells can differentiate into lineage-restricted precursor cells (such as a myocyte progenitor cell), which in turn can differentiate into other types of precursor cells further down the pathway (such as a myocyte precursor), and then to an end-stage differentiated cell, such as a myocyte, which plays a characteristic role in a certain tissue type, and may or may not retain the capacity to proliferate further.

Induced Pluripotent Stem Cells

In some embodiments, the genetically engineered human cells described herein are induced pluripotent stem cells (iPSCs). An advantage of using iPSCs is that the cells can be derived from the same subject to which the progenitor cells are to be administered. That is, a somatic cell can be obtained from a subject, reprogrammed to an induced pluripotent stem cell, and then re-differentiated into a progenitor cell to be administered to the subject (e.g., autologous cells). Because the progenitors are essentially derived from an autologous source, the risk of engraftment rejection or allergic response is reduced compared to the use of cells from another subject or group of subjects. In addition, the use of iPSCs negates the need for cells obtained from an embryonic source. Thus, in one embodiment, the stem cells used in the disclosed methods are not embryonic stem cells.

Although differentiation is generally irreversible under physiological contexts, several methods have been recently developed to reprogram somatic cells to iPSCs. Exemplary methods are known to those of skill in the art and are described briefly herein below.

The term "reprogramming" refers to a process that alters or reverses the differentiation state of a differentiated cell (e.g., a somatic cell). Stated another way, reprogramming refers to a process of driving the differentiation of a cell backwards to a more undifferentiated or more primitive type of cell. It should be noted that placing many primary cells in culture can lead to some loss of fully differentiated characteristics. Thus, simply culturing such cells included in the term differentiated cells does not render these cells non-differentiated cells (e.g., undifferentiated cells) or pluripotent cells. The transition of a differentiated cell to pluripotency requires a reprogramming stimulus beyond the stimuli that lead to partial loss of differentiated character in culture. Reprogrammed cells also have the characteristic of the capacity of extended passaging without loss of growth potential, relative to primary cell parents, which generally have capacity for only a limited number of divisions in culture.

The cell to be reprogrammed can be either partially or terminally differentiated prior to reprogramming. In some embodiments, reprogramming encompasses complete reversion of the differentiation state of a differentiated cell (e.g., a somatic cell) to a pluripotent state or a multipotent state. In some embodiments, reprogramming encompasses complete or partial reversion of the differentiation state of a differentiated cell (e.g., a somatic cell) to an undifferentiated cell (e.g., an embryonic-like cell). Reprogramming can result in expression of particular genes by the cells, the expression of which further contributes to reprogramming. In certain embodiments described herein, reprogramming of a differentiated cell (e.g., a somatic cell) causes the differentiated cell to assume an undifferentiated state (e.g., is an undifferentiated cell). The resulting cells are referred to as "reprogrammed cells," or "induced pluripotent stem cells (iPSCs or iPS cells)."

Reprogramming can involve alteration, e.g., reversal, of at least some of the heritable patterns of nucleic acid modification (e.g., methylation), chromatin condensation, epigenetic changes, genomic imprinting, etc., that occur during cellular differentiation. Reprogramming is distinct from simply maintaining the existing undifferentiated state of a cell that is already pluripotent or maintaining the existing less than fully differentiated state of a cell that is already a multipotent cell (e.g., a myogenic stem cell). Reprogramming is also distinct from promoting the self-renewal or proliferation of cells that are already pluripotent or multipotent, although the compositions and methods described herein can also be of use for such purposes, in some embodiments.

Many methods are known in the art that can be used to generate pluripotent stem cells from somatic cells. Any such method that reprograms a somatic cell to the pluripotent phenotype would be appropriate for use in the methods described herein.

Reprogramming methodologies for generating pluripotent cells using defined combinations of transcription factors have been described. Mouse somatic cells can be converted to ES cell-like cells with expanded developmental potential by the direct transduction of Oct4, Sox2, Klf4, and c-Myc; see, e.g., Takahashi and Yamanaka, Cell 126(4): 663-76 (2006). iPSCs resemble ES cells, as they restore the pluripotency-associated transcriptional circuitry and much of the epigenetic landscape. In addition, mouse iPSCs satisfy all the standard assays for pluripotency: specifically, in vitro differentiation into cell types of the three germ layers, teratoma formation, contribution to chimeras, germline transmission [see, e.g., Maherali and Hochedlinger, Cell Stem Cell. 3(6):595-605 (2008)], and tetraploid complementation.

Human iPSCs can be obtained using similar transduction methods, and the transcription factor trio, OCT4, SOX2, and NANOG, has been established as the core set of transcription factors that govern pluripotency; see, e.g., Budniatzky and Gepstein, Stem Cells Transl Med. 3(4):448-57 (2014); Barrett et al., Stem Cells Trans Med 3:1-6 sctm.2014-0121 (2014); Focosi et al., Blood Cancer Journal 4: e211 (2014); and references cited therein. The production of iPSCs can be achieved by the introduction of nucleic acid sequences encoding stem cell-associated genes into an adult, somatic cell, historically using viral vectors.

iPSCs can be generated or derived from terminally differentiated somatic cells, as well as from adult stem cells, or somatic stem cells. That is, a non-pluripotent progenitor cell can be rendered pluripotent or multipotent by reprogramming. In such instances, it may not be necessary to include as many reprogramming factors as required to reprogram a terminally differentiated cell. Further, reprogramming can be induced by the non-viral introduction of reprogramming factors, e.g., by introducing the proteins themselves, or by introducing nucleic acids that encode the reprogramming factors, or by introducing messenger RNAs that upon translation produce the reprogramming factors (see e.g., Warren et al., Cell Stem Cell, 7(5):618-30 (2010). Reprogramming can be achieved by introducing a combination of nucleic acids encoding stem cell-associated genes, including, for example, Oct-4 (also known as Oct-3/4 or Pouf51), Sox1, Sox2, Sox3, Sox 15, Sox 18, NANOG, Klf1, Klf2, Klf4, Klf5, NR5A2, c-Myc, 1-Myc, n-Myc, Rem2, Tert, and LIN28. In one embodiment, reprogramming using the methods and compositions described herein can further comprise introducing one or more of Oct-3/4, a member of the Sox family, a member of the Klf family, and a member of the Myc family to a somatic cell. In one embodiment, the methods and compositions described herein further comprise introducing one or more of each of Oct-4, Sox2, Nanog, c-MYC and Klf4 for reprogramming. As noted above, the exact method used for reprogramming is not necessarily critical to the methods and compositions described herein. However, where cells differentiated from the reprogrammed cells are to be used in, e.g., human therapy, in one embodiment the reprogramming is not effected by a method that alters the genome. Thus, in such embodiments, reprogramming is achieved, e.g., without the use of viral or plasmid vectors.

The efficiency of reprogramming (i.e., the number of reprogrammed cells) derived from a population of starting cells can be enhanced by the addition of various agents, e.g., small molecules, as shown by Shi et al., Cell-Stem Cell 2:525-528 (2008); Huangfu et al., Nature Biotechnology 26(7):795-797 (2008) and Marson et al., Cell-Stem Cell 3: 132-135 (2008). Thus, an agent or combination of agents that enhance the efficiency or rate of induced pluripotent stem cell production can be used in the production of patient-specific or disease-specific iPSCs. Some non-limiting examples of agents that enhance reprogramming efficiency include soluble Wnt, Wnt conditioned media, BIX-01294 (a G9a histone methyltransferase), PD0325901 (a MEK inhibitor), DNA methyltransferase inhibitors, histone deacetylase (HDAC) inhibitors, valproic acid, 5'-azacytidine, dexamethasone, suberoylanilide, hydroxamic acid (SAHA), vitamin C, and trichostatin (TSA), among others.

Other non-limiting examples of reprogramming enhancing agents include: Suberoylanilide Hydroxamic Acid (SAHA (e.g., MK0683, vorinostat) and other hydroxamic acids), BML-210, Depudecin (e.g., (−)-Depudecin), HC Toxin, Nullscript (4-(1,3-Dioxo-1H,3H-benzo[de]isoquinolin-2-yl)-N-hydroxybutanamide), Phenylbutyrate (e.g., sodium phenylbutyrate) and Valproic Acid ((VPA) and other short chain fatty acids), Scriptaid, Suramin Sodium, Trichostatin A (TSA), APHA Compound 8, Apicidin, Sodium Butyrate, pivaloyloxymethyl butyrate (Pivanex, AN-9), Trapoxin B, Chlamydocin, Depsipeptide (also known as FR901228 or FK228), benzamides (e.g., CI-994 (e.g., N-acetyl dinaline) and MS-27-275), MGCD0103, NVP-LAQ-824, CBHA (m-carboxycinnaminic acid bishydroxamic acid), JNJ16241199, Tubacin, A-161906, proxamide, oxamflatin, 3-CI-UCHA (e.g., 6-(3-chlorophenylureido) caproic hydroxamic acid), AOE (2-amino-8-oxo-9, 10-epoxydecanoic acid), CHAP31 and CHAP 50. Other reprogramming enhancing agents include, for example, dominant negative forms of the HDACs (e.g., catalytically inactive forms), siRNA inhibitors of the HDACs, and antibodies that specifically bind to the HDACs. Such inhibitors are available, e.g., from BIOMOL International, Fukasawa, Merck Biosciences, Novartis, Gloucester Pharmaceuticals, Titan Pharmaceuticals, MethylGene, and Sigma Aldrich.

To confirm the induction of pluripotent stem cells for use with the methods described herein, isolated clones can be tested for the expression of a stem cell marker. Such expression in a cell derived from a somatic cell identifies the cells as induced pluripotent stem cells. Stem cell markers are selected from the non-limiting group including SSEA3, SSEA4, CD9, Nanog, Fbxl5, Ecatl, Esgl, Eras, Gdf3, Fgf4, Cripto, Daxl, Zpf296, Slc2a3, Rexl, Utfl, and Natl. In one embodiment, a cell that expresses Oct4 or Nanog is identified as pluripotent. Methods for detecting the expression of such markers can include, for example, RT-PCR and immunological methods that detect the presence of the encoded polypeptides, such as Western blots or flow cytometric analyses. In some embodiments, detection involves not only RT-PCR, but also includes detection of protein markers. Intracellular markers may be best identified via RT-PCR, or protein detection methods such as immunocytochemistry, while cell surface markers are readily identified, e.g., by immunocytochemistry.

The pluripotent stem cell character of isolated cells can be confirmed by tests evaluating the ability of the iPSCs to differentiate into cells of each of the three germ layers. As one example, teratoma formation in nude mice can be used to evaluate the pluripotent character of the isolated clones. The cells are introduced into nude mice and histology and/or immunohistochemistry is performed on a tumor arising from the cells. The growth of a tumor comprising cells from all three germ layers, for example, further indicates that the cells are pluripotent stem cells.

Hepatocytes

In some embodiments, the genetically engineered human cells described herein are hepatocytes. A hepatocyte is a cell of the main parenchymal tissue of the liver. Hepatocytes make up 70-85% of the liver's mass. These cells are involved in: protein synthesis; protein storage; transformation of carbohydrates; synthesis of cholesterol, bile salts and phospholipids; detoxification, modification, and excretion of exogenous and endogenous substances; and initiation of formation and secretion of bile.

SERPINA1 is primarily expressed in hepatocytes (parenchymal liver cells), which are a major source of circulating protein, with secondary expression in monocytes and neutrophils. Therefore, the correction of SERPINA1 would be primarily targeted at hepatocytes and the liver.

Creating Patient Specific IPSCs

One step of the ex vivo methods of the invention involves creating a patient specific iPS cell, patient specific iPS cells, or a patient specific iPS cell line. There are many established methods in the art for creating patient specific iPS cells, as described in Takahashi and Yamanaka 2006; Takahashi, Tanabe et al. 2007. For example, the creating step comprises: a) isolating a somatic cell, such as a skin cell or fibroblast from the patient; and b) introducing a set of pluripotency-associated genes into the somatic cell in order to induce the cell to become a pluripotent stem cell. In some embodiments, the set of pluripotency-associated genes is one or more of the genes selected from the group consisting of OCT4, SOX2, KLF4, Lin28, NANOG, and cMYC.

Performing a Biopsy or Aspirate of the Patient's Liver or Bone Marrow

A biopsy or aspirate is a sample of tissue or fluid taken from the body. There are many different kinds of biopsies or aspirates. Nearly all of them involve using a sharp tool to remove a small amount of tissue. If the biopsy will be on the skin or other sensitive area, numbing medicine is applied first. A biopsy or aspirate may be performed according to any of the known methods in the art. For example, in a liver biopsy, a needle is injected into the liver through the skin of the belly, capturing the liver tissue. For example, in a bone marrow aspirate, a large needle is used to enter the pelvis bone to collect bone marrow.

Isolating a Liver Specific Progenitor Cell or Primary Hepatocyte

Liver specific progenitor cells and primary hepatocytes may be isolated according to any method known in the art. For example, human hepatocytes are isolated from fresh surgical specimens (e.g., an autologous sample). Healthy liver tissue is used to isolate hepatocytes by collagenase digestion. The obtained cell suspension is filtered through a 100-mm nylon mesh and sedimented by centrifugation at 50 g for 5 minutes, resuspended, and washed two to three times in cold wash medium. Human liver stem cells are obtained by culturing under stringent conditions of hepatocytes obtained from fresh liver preparations. Hepatocytes seeded on collagen-coated plates are cultured for 2 weeks. After 2 weeks, surviving cells are removed, and characterized for expression of stem cells markers (Herrera et al, STEM CELLS 2006; 24: 2840-2850).

Isolating a Mesenchymal Stem Cell

Mesenchymal stem cells may be isolated according to any method known in the art, such as from a patient's bone marrow or peripheral blood. For example, marrow aspirate is collected into a syringe with heparin. Cells are washed and centrifuged on a Percoll™. Cells, such as blood cells, liver cells, interstitial cells, macrophages, mast cells, and thymocytes, are separated using Percoll™. The cells are cultured in Dulbecco's modified Eagle's medium (DMEM) (low glucose) containing 10% fetal bovine serum (FBS) (Pittinger M F, Mackay A M, Beck S C et al., Science 1999; 284:143-147).

Genome Editing

Genome editing generally refers to the process of modifying the nucleotide sequence of a genome, preferably in a precise or pre-determined manner. Examples of methods of genome editing described herein include methods of using site-directed nucleases to cut deoxyribonucleic acid (DNA) at precise target locations in the genome, thereby creating double-strand or single-strand DNA breaks at particular locations within the genome. Such breaks can be and regularly are repaired by natural, endogenous cellular processes, such as homology-directed repair (HDR) and non-homologous end-joining (NHEJ), as recently reviewed in Cox et al., Nature Medicine 21(2), 121-31 (2015). These two main DNA repair processes consist of a family of alternative pathways. NHEJ directly joins the DNA ends resulting from a double-strand break, sometimes with the loss or addition of nucleotide sequence, which may disrupt or enhance gene expression. HDR utilizes a homologous sequence, or donor sequence, as a template for inserting a defined DNA sequence at the break point. The homologous sequence may be in the endogenous genome, such as a sister chromatid. Alternatively, the donor may be an exogenous nucleic acid, such as a plasmid, a single-strand oligonucleotide, a double-stranded oligonucleotide, a duplex oligonucleotide or a virus, that has regions of high homology with the nuclease-cleaved locus, but which may also contain additional sequence or sequence changes including deletions that can be incorporated into the cleaved target locus. A third repair mechanism is microhomology-mediated end joining (MMEJ), also referred to as "Alternative NHEJ", in which the genetic outcome is similar to NHEJ in that small deletions and insertions can occur at the cleavage site. MMEJ makes use of homologous sequences of a few basepairs flanking the DNA break site to drive a more favored DNA end joining repair outcome, and recent reports have further elucidated the molecular mechanism of this process; see, e.g., Cho and Greenberg, Nature 518, 174-76 (2015); Kent et al., Nature Structural and Molecular Biology, Adv. Online doi:10.1038/nsmb.2961 (2015); Mateos-Gomez et al., Nature 518, 254-57 (2015); Ceccaldi et al., Nature 528, 258-62 (2015). In some instances it may be possible to predict likely repair outcomes based on analysis of potential microhomologies at the site of the DNA break.

Each of these genome editing mechanisms can be used to create desired genomic alterations. A step in the genome editing process is to create one or two DNA breaks, the latter as double-strand breaks or as two single-stranded breaks, in the target locus as close as possible to the site of intended mutation. This can be achieved via the use of site-directed polypeptides, as described and illustrated herein.

Site-directed polypeptides, such as a DNA endonuclease, can introduce double-strand breaks or single-strand breaks in nucleic acids, e.g., genomic DNA. The double-strand break can stimulate a cell's endogenous DNA-repair pathways (e.g., homology-dependent repair or non-homologous end joining or alternative non-homologous end joining (A-NHEJ) or microhomology-mediated end joining). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide, double-stranded oligonucleotide, or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances it may be possible to predict likely repair outcomes based on analysis of potential microhomologies in the nuclease target regions.

Thus, in some cases, homologous recombination is used to insert an exogenous polynucleotide sequence into the target nucleic acid cleavage site. An exogenous polynucleotide sequence is termed a donor polynucleotide (or donor or donor sequence or polynucleotide donor template) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

CRISPR Endonuclease System

A CRISPR (Clustered Regularly Interspaced Short Palindromic Repeats) genomic locus can be found in the genomes of many prokaryotes (e.g., bacteria and archaea). In prokaryotes, the CRISPR locus encodes products that function as a type of immune system to help defend the prokaryotes against foreign invaders, such as virus and phage. There are three stages of CRISPR locus function: integration of new sequences into the CRISPR locus, expression of CRISPR RNA (crRNA), and silencing of foreign invader nucleic acid. Five types of CRISPR systems (e.g., Type I, Type II, Type III, Type U, and Type V) have been identified.

A CRISPR locus includes a number of short repeating sequences referred to as "repeats." When expressed, the repeats can form secondary hairpin structures (e.g., hairpins) and/or comprise unstructured single-stranded sequences. The repeats usually occur in clusters and frequently diverge between species. The repeats are regularly interspaced with unique intervening sequences referred to as "spacers," resulting in a repeat-spacer-repeat locus architecture. The spacers are identical to or have high homology with known foreign invader sequences. A spacer-repeat unit encodes a crisprRNA (crRNA), which is processed into a mature form of the spacer-repeat unit. A crRNA comprises a "seed" or spacer sequence that is involved in targeting a target nucleic acid (in the naturally occurring form in prokaryotes, the spacer sequence targets the foreign invader nucleic acid). A spacer sequence is located at the 5' or 3' end of the crRNA.

A CRISPR locus also comprises polynucleotide sequences encoding CRISPR Associated (Cas) genes. Cas genes encode endonucleases involved in the biogenesis and the interference stages of crRNA function in prokaryotes. Some Cas genes comprise homologous secondary and/or tertiary structures.

Type II CRISPR Systems crRNA biogenesis in a Type II CRISPR system in nature requires a trans-activating CRISPR RNA (tracrRNA). The tracrRNA is modified by endogenous RNaseIII, and then hybridizes to a crRNA repeat in the pre-crRNA array. Endogenous RNaseIII is recruited to cleave the pre-crRNA. Cleaved crRNAs are subjected to exoribonuclease trimming to produce the mature crRNA form (e.g., 5' trimming). The tracrRNA remains hybridized to the crRNA, and the tracrRNA and the crRNA associate with a site-directed polypeptide (e.g., Cas9). The crRNA of the crRNA-tracrRNA-Cas9 complex guides the complex to a target nucleic acid to which the crRNA can hybridize. Hybridization of the crRNA to the target nucleic acid activates Cas9 for targeted nucleic acid cleavage. The target nucleic acid in a Type II CRISPR system is referred to as a protospacer adjacent motif (PAM). In nature, the PAM is essential to facilitate binding of a site-directed polypeptide (e.g., Cas9) to the target nucleic acid. Type II systems (also referred to as Nmeni or CASS4) are further subdivided into Type II-A (CASS4) and II-B (CASS4a). Jinek et al., *Science,* 337 (6096):816-821 (2012) showed that the CRISPR/Cas9 system is useful for RNA-programmable genome editing, and international patent application publication number WO2013/176772 provides numerous examples and applications of the CRISPR/Cas endonuclease system for site-specific gene editing.

Type V CRISPR Systems

Type V CRISPR systems have several important differences from Type II systems. For example, Cpf1 is a single RNA-guided endonuclease that, in contrast to Type II systems, lacks tracrRNA. In fact, Cpf1-associated CRISPR arrays are processed into mature crRNAS without the requirement of an additional trans-activating tracrRNA. The Type V CRISPR array is processed into short mature crRNAs of 42-44 nucleotides in length, with each mature crRNA beginning with 19 nucleotides of direct repeat followed by 23-25 nucleotides of spacer sequence. In contrast, mature crRNAs in Type II systems start with 20-24 nucleotides of spacer sequence followed by about 22 nucleotides of direct repeat. Also, Cpf1 utilizes a T-rich protospacer-adjacent motif such that Cpf1-crRNA complexes efficiently cleave target DNA preceded by a short T-rich PAM, which is in contrast to the G-rich PAM following the target DNA for Type II systems. Thus, Type V systems cleave at a point that is distant from the PAM, while Type II systems cleave at a point that is adjacent to the PAM. In addition, in contrast to Type II systems, Cpf1 cleaves DNA via a staggered DNA double-stranded break with a 4 or 5 nucleotide 5' overhang. Type II systems cleave via a blunt double-stranded break. Similar to Type II systems, Cpf1 contains a predicted RuvC-like endonuclease domain, but lacks a second HNH endonuclease domain, which is in contrast to Type II systems.

Cas Genes/Polypeptides and Protospacer Adjacent Motifs

Figure 1B:
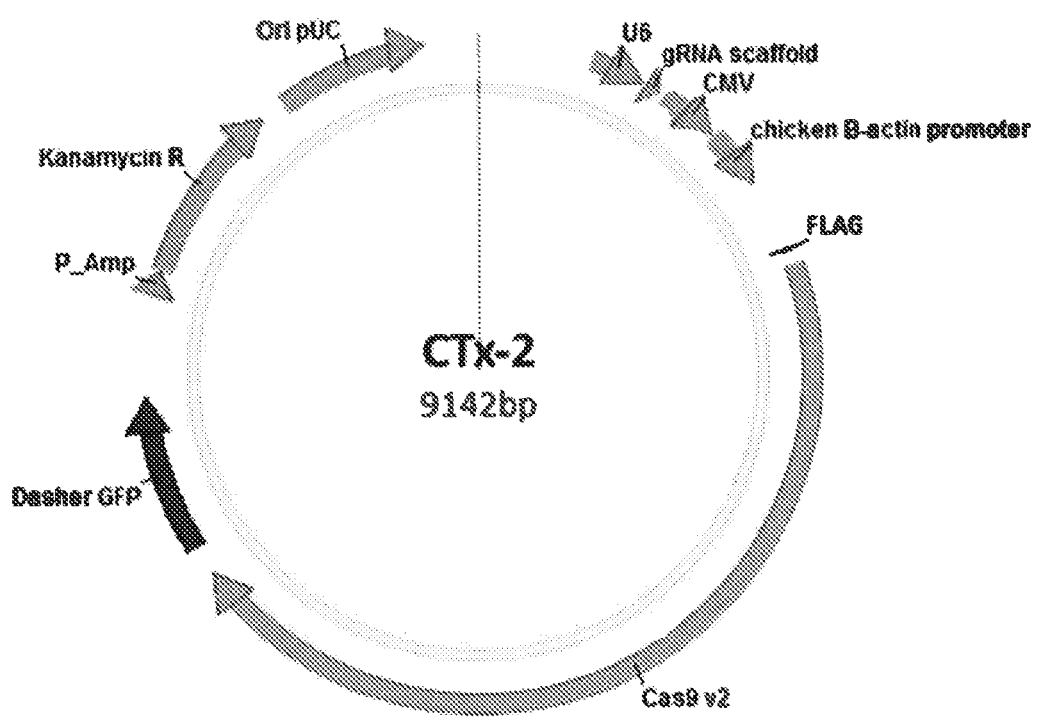
FIG. 1B is an illustration of a plasmid (referred to herein as "CTx-2") comprising a different codon optimized gene for *S. pyogenes* Cas9 endonuclease. The CTx-2 plasmid also comprises a gRNA scaffold sequence, which includes a 20 bp spacer sequence from the sequences listed in Examples 1 and 8.
Figure 1C:
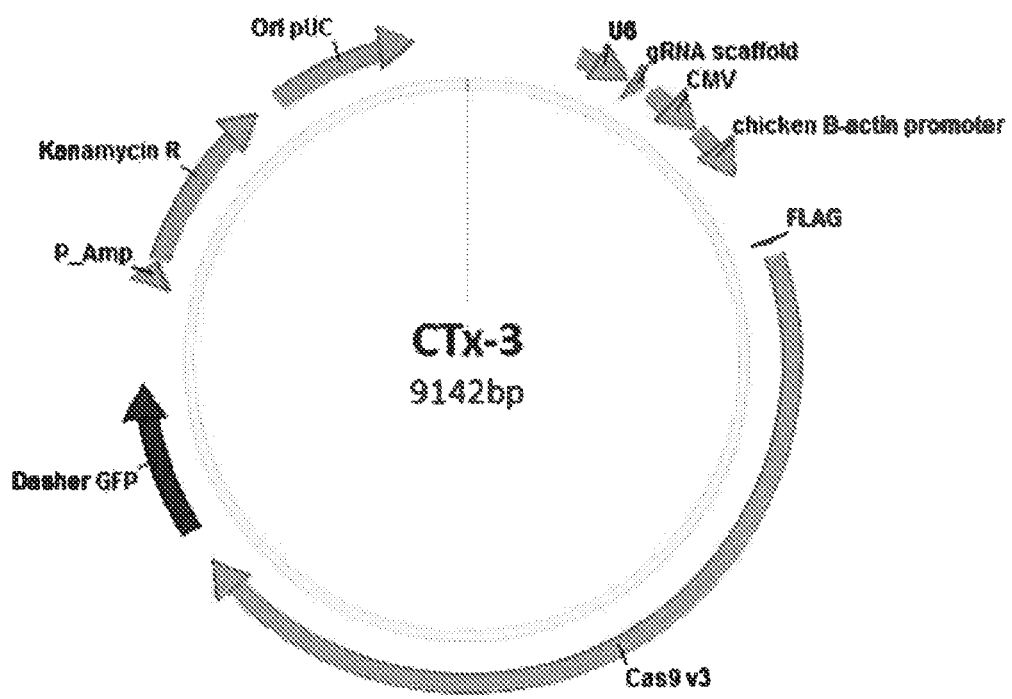
FIG. 1C is an illustration of a plasmid (referred to herein as "CTx-3") comprising yet another different codon optimized gene for *S. pyogenes* Cas9 endonuclease. The CTx-3 plasmid also comprises a gRNA scaffold sequence, which includes a 20 bp spacer sequence from the sequences listed in Examples 1 and 8.
Figure 2A:
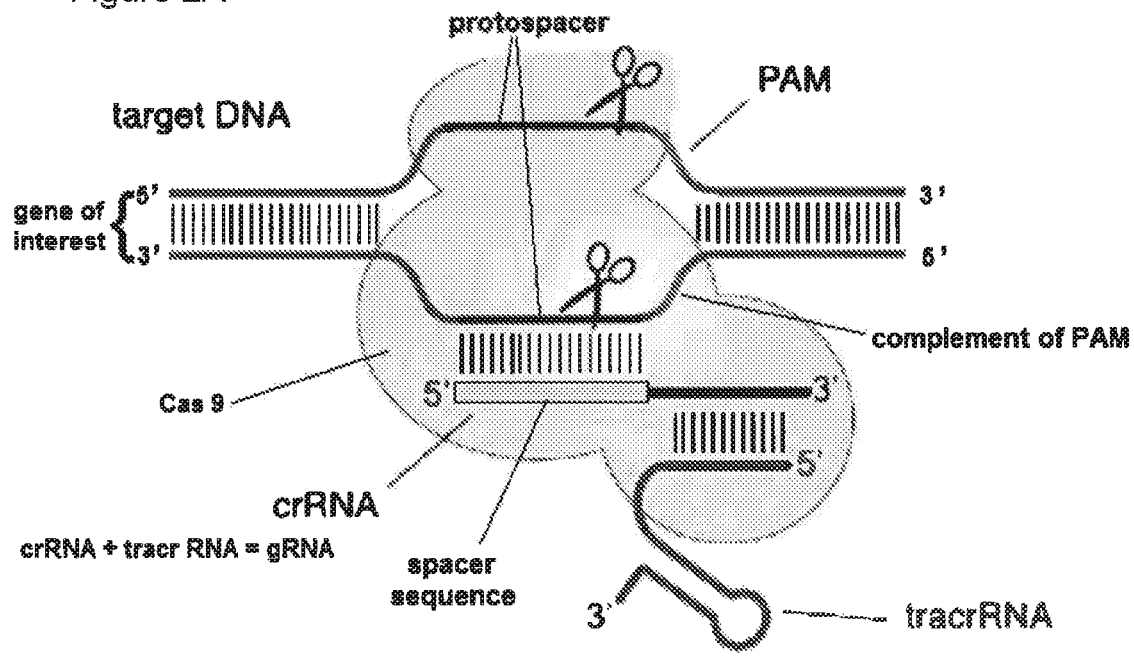
FIG. 2A is an illustration depicting the type II CRISPR/Cas system.
Figure 2B:
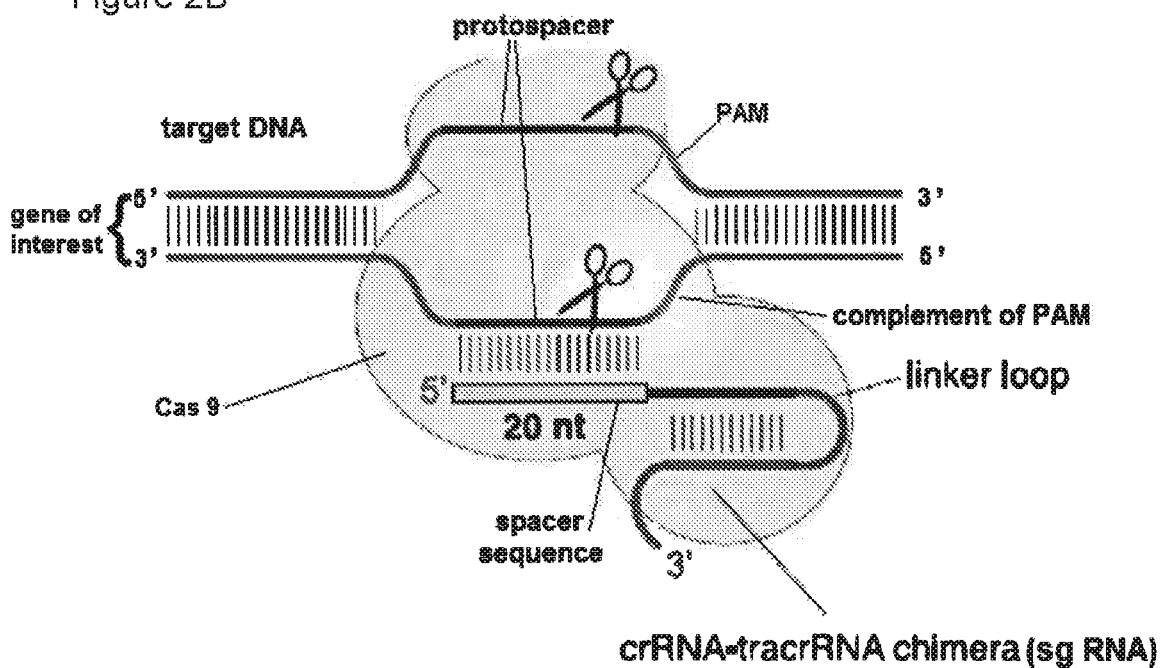
FIG. 2B is another illustration depicting the type II CRISPR/Cas system.

Exemplary CRISPR/Cas polypeptides include the Cas9 polypeptides in FIG. 1 of Fonfara et al., *Nucleic Acids Research,* 42: 2577-2590 (2014). The CRISPR/Cas gene naming system has undergone extensive rewriting since the Cas genes were discovered. FIG. 5 of Fonfara, supra, provides PAM sequences for the Cas9 polypeptides from various species.

Site-Directed Polypeptides

A site-directed polypeptide is a nuclease used in genome editing to cleave DNA. The site-directed may be administered to a cell or a patient as either one or more polypeptides, or one or more mRNAs encoding the polypeptide.

In the context of a CRISPR/Cas or CRISPR/Cpf1 system, the site-directed polypeptide can bind to a guide RNA that, in turn, specifies the site in the target DNA to which the polypeptide is directed. In embodiments of CRISPR/Cas or CRISPR/Cpf1 systems herein, the site-directed polypeptide is an endonuclease, such as a DNA endonuclease.

In some embodiments, a site-directed polypeptide comprises a plurality of nucleic acid-cleaving (i.e., nuclease) domains. Two or more nucleic acid-cleaving domains can be linked together via a linker. In some embodiments, the linker comprises a flexible linker. Linkers may comprise 1, 2, 3, 4, 5, 6, 7, 8, 9, 10, 11, 12, 13, 14, 15, 16, 17, 18, 19, 20, 21, 22, 23, 24, 25, 30, 35, 40 or more amino acids in length.

Naturally-occurring wild-type Cas9 enzymes comprise two nuclease domains, a HNH nuclease domain and a RuvC domain. Herein, the "Cas9" refers to both naturally-occurring and recombinant Cas9s. Cas9 enzymes contemplated herein comprises a HNH or HNH-like nuclease domain, and/or a RuvC or RuvC-like nuclease domain.

HNH or HNH-like domains comprise a McrA-like fold. HNH or HNH-like domains comprises two antiparallel β-strands and an α-helix. HNH or HNH-like domains comprises a metal binding site (e.g., a divalent cation binding site). HNH or HNH-like domains can cleave one strand of a target nucleic acid (e.g., the complementary strand of the crRNA targeted strand).

RuvC or RuvC-like domains comprise an RNaseH or RNaseH-like fold. RuvC/RNaseH domains are involved in a diverse set of nucleic acid-based functions including acting on both RNA and DNA. The RNaseH domain comprises 5 β-strands surrounded by a plurality of α-helices. RuvC/RNaseH or RuvC/RNaseH-like domains comprise a metal binding site (e.g., a divalent cation binding site). RuvC/RNaseH or RuvC/RNaseH-like domains can cleave one strand of a target nucleic acid (e.g., the non-complementary strand of a double-stranded target DNA).

Site-directed polypeptides can introduce double-strand breaks or single-strand breaks in nucleic acids, e.g., genomic DNA. The double-strand break can stimulate a cell's endogenous DNA-repair pathways (e.g., homology-dependent repair (HDR) or non-homologous end joining (NHEJ) or alternative non-homologous end joining (A-NHEJ) or microhomology-mediated end joining (MMEJ)). NHEJ can repair cleaved target nucleic acid without the need for a homologous template. This can sometimes result in small deletions or insertions (indels) in the target nucleic acid at the site of cleavage, and can lead to disruption or alteration of gene expression. HDR can occur when a homologous repair template, or donor, is available. The homologous donor template comprises sequences that are homologous to sequences flanking the target nucleic acid cleavage site. The sister chromatid is generally used by the cell as the repair template. However, for the purposes of genome editing, the repair template is often supplied as an exogenous nucleic acid, such as a plasmid, duplex oligonucleotide, single-strand oligonucleotide or viral nucleic acid. With exogenous donor templates, it is common to introduce an additional nucleic acid sequence (such as a transgene) or modification (such as a single or multiple base change or a deletion) between the flanking regions of homology so that the additional or altered nucleic acid sequence also becomes incorporated into the target locus. MMEJ results in a genetic outcome that is similar to NHEJ in that small deletions and insertions can occur at the cleavage site. MMEJ makes use of homologous sequences of a few basepairs flanking the cleavage site to drive a favored end-joining DNA repair outcome. In some instances it may be possible to predict likely repair outcomes based on analysis of potential micro-homologies in the nuclease target regions.

Thus, in some cases, homologous recombination is used to insert an exogenous polynucleotide sequence into the target nucleic acid cleavage site. An exogenous polynucleotide sequence is termed a donor polynucleotide (or donor or donor sequence) herein. In some embodiments, the donor polynucleotide, a portion of the donor polynucleotide, a copy of the donor polynucleotide, or a portion of a copy of the donor polynucleotide is inserted into the target nucleic acid cleavage site. In some embodiments, the donor polynucleotide is an exogenous polynucleotide sequence, i.e., a sequence that does not naturally occur at the target nucleic acid cleavage site.

The modifications of the target DNA due to NHEJ and/or HDR can lead to, for example, mutations, deletions, alterations, integrations, gene correction, gene replacement, gene tagging, transgene insertion, nucleotide deletion, gene disruption, translocations and/or gene mutation. The processes of deleting genomic DNA and integrating non-native nucleic acid into genomic DNA are examples of genome editing.

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to a wild-type exemplary site-directed polypeptide [e.g., Cas9 from *S. pyogenes*, US2014/0068797 Sequence ID No. 8 or Sapranauskas et al., *Nucleic Acids Res,* 39(21): 9275-9282 (2011)], and various other site-directed polypeptides).

In some embodiments, the site-directed polypeptide comprises an amino acid sequence having at least 10%, at least 15%, at least 20%, at least 30%, at least 40%, at least 50%, at least 60%, at least 70%, at least 75%, at least 80%, at least 85%, at least 90%, at least 95%, at least 99%, or 100% amino acid sequence identity to the nuclease domain of a wild-type exemplary site-directed polypeptide (e.g., Cas9 from *S. pyogenes,* supra).

In some embodiments, a site-directed polypeptide comprises at least 70, 75, 80, 85, 90, 95, 97, 99, or 100% identity to a wild-type site-directed polypeptide (e.g., Cas9 from *S. pyogenes,* supra) over 10 contiguous amino acids. In some embodiments, a site-directed polypeptide comprises at most: 70, 75, 80, 85, 90, 95, 97, 99, or 100% identity to a wild-type site-directed polypeptide (e.g., Cas9 from *S. pyogenes,* supra) over 10 contiguous amino acids. In some embodiments, a site-directed polypeptide comprises at least: 70, 75, 80, 85, 90, 95, 97, 99, or 100% identity to a wild-type site-directed polypeptide (e.g., Cas9 from *S. pyogenes,* supra) over 10 contiguous amino acids in a HNH nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes,* supra) over 10 contiguous amino acids in a HNH nuclease domain of the site-directed polypeptide. In some embodiments, a site-directed polypeptide comprises at least: 70, 75, 80, 85, 90, 95, 97, 99, or 100% identity to a wild-type site-directed polypeptide (e.g., Cas9 from *S. pyogenes,* supra) over 10 contiguous amino acids in a RuvC nuclease domain of the site-directed polypeptide. In some embodiments, a site-directed polypeptide comprises at most: 70, 75, 80, 85, 90, 95, 97, 99, or 100% identity to a wild-type site-directed polypeptide (e.g., Cas9 from *S. pyogenes,* supra) over 10 contiguous amino acids in a RuvC nuclease domain of the site-directed polypeptide.

In some embodiments, the site-directed polypeptide comprises a modified form of a wild-type exemplary site-directed polypeptide. The modified form of the wild-type exemplary site-directed polypeptide comprises a mutation that reduces the nucleic acid-cleaving activity of the site-directed polypeptide. In some embodiments, the modified form of the wild-type exemplary site-directed polypeptide has less than 90%, less than 80%, less than 70%, less than 60%, less than 50%, less than 40%, less than 30%, less than 20%, less than 10%, less than 5%, or less than 1% of the nucleic acid-cleaving activity of the wild-type exemplary site-directed polypeptide (e.g., Cas9 from *S. pyogenes,* supra). The modified form of the site-directed polypeptide can have no substantial nucleic acid-cleaving activity. When a site-directed polypeptide is a modified form that has no substantial nucleic acid-cleaving activity, it is referred to herein as "enzymatically inactive."

In some embodiments, the modified form of the site-directed polypeptide comprises a mutation such that it can induce a single-strand break (SSB) on a target nucleic acid (e.g., by cutting only one of the sugar-phosphate backbones of a double-strand target nucleic acid). In some embodiments, the mutation results in less than 90%, less than 80%, less than 70%, less than 60%, less than 50%, less than 40%, less than 30%, less than 20%, less than 10%, less than 5%, or less than 1% of the nucleic acid-cleaving activity in one or more of the plurality of nucleic acid-cleaving domains of the wild-type site directed polypeptide (e.g., Cas9 from *S. pyogenes,* supra). In some embodiments, the mutation results in one or more of the plurality of nucleic acid-cleaving domains retaining the ability to cleave the complementary strand of the target nucleic acid, but reducing its ability to cleave the non-complementary strand of the target nucleic acid. In some embodiments, the mutation results in one or more of the plurality of nucleic acid-cleaving domains retaining the ability to cleave the non-complementary strand of the target nucleic acid, but reducing its ability to cleave the complementary strand of the target nucleic acid. For example, residues in the wild-type exemplary *S. pyogenes* Cas9 polypeptide, such as Asp10, His840, Asn854 and Asn856, are mutated to inactivate one or more of the plurality of nucleic acid-cleaving domains (e.g., nuclease domains). In some embodiments, the residues to be mutated correspond to residues Asp10, His840, Asn854 and Asn856 in the wild-type exemplary *S. pyogenes* Cas9 polypeptide (e.g., as determined by sequence and/or structural alignment). Non-limiting examples of mutations include D10A, H840A, N854A or N856A. One skilled in the art will recognize that mutations other than alanine substitutions are suitable.

In some embodiments, a D10A mutation is combined with one or more of H840A, N854A, or N856A mutations to produce a site-directed polypeptide substantially lacking DNA cleavage activity. In some embodiments, a H840A mutation is combined with one or more of D10A, N854A, or N856A mutations to produce a site-directed polypeptide substantially lacking DNA cleavage activity. In some embodiments, a N854A mutation is combined with one or more of H840A, D10A, or N856A mutations to produce a site-directed polypeptide substantially lacking DNA cleavage activity. In some embodiments, a N856A mutation is combined with one or more of H840A, N854A, or D10A mutations to produce a site-directed polypeptide substantially lacking DNA cleavage activity. Site-directed polypeptides that comprise one substantially inactive nuclease domain are referred to as "nickases".

Nickase variants of RNA-guided endonucleases, for example Cas9, can be used to increase the specificity of CRISPR-mediated genome editing. Wild type Cas9 is typically guided by a single guide RNA designed to hybridize with a specified ~20 nucleotide sequence in the target sequence (such as an endogenous genomic locus). However, several mismatches can be tolerated between the guide RNA and the target locus, effectively reducing the length of required homology in the target site to, for example, as little as 13 nt of homology, and thereby resulting in elevated potential for binding and double-strand nucleic acid cleavage by the CRISPR/Cas9 complex elsewhere in the target genome—also known as off-target cleavage. Because nickase variants of Cas9 each only cut one strand, in order to create a double-strand break it is necessary for a pair of nickases to bind in close proximity and on opposite strands of the target nucleic acid, thereby creating a pair of nicks, which is the equivalent of a double-strand break. This requires that two separate guide RNAs—one for each nickase—must bind in close proximity and on opposite strands of the target nucleic acid. This requirement essentially doubles the minimum length of homology needed for the double-strand break to occur, thereby reducing the likelihood that a double-strand cleavage event will occur elsewhere in the genome, where the two guide RNA sites—if they exist—are unlikely to be sufficiently close to each other to enable the double-strand break to form. As described in the art, nickases can also be used to promote HDR versus NHEJ. HDR can be used to introduce selected changes into target sites in the genome through the use of specific donor sequences that effectively mediate the desired changes. Descriptions of various CRISPR/Cas systems for use in gene editing can be found, e.g., in international patent application publication number WO2013/176772, and in *Nature Biotechnology* 32, 347-355 (2014), and references cited therein.

Mutations contemplated include substitutions, additions, and deletions, or any combination thereof. In some embodiments, the mutation converts the mutated amino acid to alanine. In some embodiments, the mutation converts the mutated amino acid to another amino acid (e.g., glycine, serine, threonine, cysteine, valine, leucine, isoleucine, methionine, proline, phenylalanine, tyrosine, tryptophan, aspartic acid, glutamic acid, asparagines, glutamine, histidine, lysine, or arginine). In some embodiments, the mutation converts the mutated amino acid to a non-natural amino acid (e.g., selenomethionine). In some embodiments, the mutation converts the mutated amino acid to amino acid mimics (e.g., phosphomimics). In some embodiments, the mutation is a conservative mutation. For example, the mutation can convert the mutated amino acid to amino acids that resemble the size, shape, charge, polarity, conformation, and/or rotamers of the mutated amino acids (e.g., cysteine/serine mutation, lysine/asparagine mutation, histidine/phenylalanine mutation). In some embodiments, the mutation causes a shift in reading frame and/or the creation of a premature stop codon. In some embodiments, mutations cause changes to regulatory regions of genes or loci that affect expression of one or more genes.

In some embodiments, the site-directed polypeptide (e.g., variant, mutated, enzymatically inactive and/or conditionally enzymatically inactive site-directed polypeptide) targets nucleic acid. In some embodiments, the site-directed polypeptide (e.g., variant, mutated, enzymatically inactive and/or conditionally enzymatically inactive endoribonuclease) targets DNA. In some embodiments, the site-directed polypeptide (e.g., variant, mutated, enzymatically inactive and/or conditionally enzymatically inactive endoribonuclease) targets RNA.

In some embodiments, the site-directed polypeptide comprises one or more non-native sequences (e.g., the site-directed polypeptide is a fusion protein).

In some embodiments, the site-directed polypeptide comprises an amino acid sequence comprising at least 15% amino acid identity to a Cas9 from a bacterium (e.g., *S. pyogenes*), a nucleic acid binding domain, and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain).

In some embodiments, the site-directed polypeptide comprises an amino acid sequence comprising at least 15% amino acid identity to a Cas9 from a bacterium (e.g., *S. pyogenes*), and two nucleic acid cleaving domains, wherein one or both of the nucleic acid cleaving domains comprise at least 50% amino acid identity to a nuclease domain from Cas9 from a bacterium (e.g., *S. pyogenes*).

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), and non-native sequence (for example, a nuclear localization signal) or a linker linking the site-directed polypeptide to a non-native sequence.

In some embodiments, the site-directed polypeptide comprises an amino acid sequence comprising at least 15% amino acid identity to a Cas9 from a bacterium (e.g., *S. pyogenes*), two nucleic acid cleaving domains (i.e., a HNH domain and a RuvC domain), wherein the site-directed polypeptide comprises a mutation in one or both of the nucleic acid cleaving domains that reduces the cleaving activity of the nuclease domains by at least 50%.

In some embodiments, the site-directed polypeptide comprises an amino acid sequence comprising at least 15% amino acid identity to a Cas9 from a bacterium (e.g., *S. pyogenes*), and two nucleic acid cleaving domains (i.e., a HNH domain and a RuvC domain), wherein one of the nuclease domains comprises mutation of aspartic acid 10, and/or wherein one of the nuclease domains comprises mutation of histidine 840, and wherein the mutation reduces the cleaving activity of the nuclease domain(s) by at least 50%.

In some embodiments of the invention, the one or more site-directed polypeptides, e.g. DNA endonucleases, include two nickases that together effect one double-strand break at a specific locus in the genome, or four nickases that together effect two double-strand breaks at specific loci in the genome. Alternatively, one site-directed polypeptide, e.g. DNA endonuclease, effects one double-strand break at a specific locus in the genome.

Genome-Targeting Nucleic Acid

The present disclosure provides a genome-targeting nucleic acid that can direct the activities of an associated polypeptide (e.g., a site-directed polypeptide) to a specific target sequence within a target nucleic acid. In some embodiments, the genome-targeting nucleic acid is an RNA. A genome-targeting RNA is referred to as a "guide RNA" or "gRNA" herein. A guide RNA comprises at least a spacer sequence that hybridizes to a target nucleic acid sequence of interest, and a CRISPR repeat sequence. In Type II systems, the gRNA also comprises a second RNA called the tracrRNA sequence. In the Type II guide RNA (gRNA), the CRISPR repeat sequence and tracrRNA sequence hybridize to each other to form a duplex. In the Type V guide RNA (gRNA), the crRNA forms a duplex. In both systems, the duplex binds a site-directed polypeptide, such that the guide RNA and site-direct polypeptide form a complex. The genome-targeting nucleic acid provides target specificity to the complex by virtue of its association with the site-directed polypeptide. The genome-targeting nucleic acid thus directs the activity of the site-directed polypeptide.

Exemplary guide RNAs include the spacer sequences in SEQ ID NOs: 1-68,297, for example, in SEQ ID NOs: 54,860-68,297, shown with the genome location of their target sequence and the associated Cas9 or Cpf1 cut site, wherein the genome location is based on the GRCh38/hg38 human genome assembly. As is understood by the person of ordinary skill in the art, each guide RNA is designed to include a spacer sequence complementary to its genomic target sequence. For example, each of the spacer sequences in SEQ ID NOs: 1-68,297, for example, in SEQ ID NOs: 54,860-68,297 may be put into a single RNA chimera or a crRNA (along with a corresponding tracrRNA). See Jinek et al., Science, 337, 816-821 (2012) and Deltcheva et al., Nature, 471, 602-607 (2011).

In some embodiments, the genome-targeting nucleic acid is a double-molecule guide RNA. In some embodiments, the genome-targeting nucleic acid is a single-molecule guide RNA.

A double-molecule guide RNA comprises two strands of RNA. The first strand comprises in the 5' to 3' direction, an optional spacer extension sequence, a spacer sequence and a minimum CRISPR repeat sequence. The second strand comprises a minimum tracrRNA sequence (complementary to the minimum CRISPR repeat sequence), a 3' tracrRNA sequence and an optional tracrRNA extension sequence.

A single-molecule guide RNA (sgRNA) in a Type II system comprises, in the 5' to 3' direction, an optional spacer extension sequence, a spacer sequence, a minimum CRISPR repeat sequence, a single-molecule guide linker, a minimum tracrRNA sequence, a 3' tracrRNA sequence and an optional tracrRNA extension sequence. The optional tracrRNA extension may comprise elements that contribute additional functionality (e.g., stability) to the guide RNA. The single-molecule guide linker links the minimum CRISPR repeat and the minimum tracrRNA sequence to form a hairpin structure. The optional tracrRNA extension comprises one or more hairpins.

A single-molecule guide RNA (sgRNA) in a Type V system comprises, in the 5' to 3' direction, a minimum CRISPR repeat sequence and a spacer sequence.

By way of illustration, guide RNAs used in the CRISPR/Cas system, or other smaller RNAs can be readily synthesized by chemical means, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating RNAs of greater length is to produce two or more molecules that are ligated together. Much longer RNAs, such as those encoding a Cas9 or Cpf1 endonuclease, are more readily generated enzymatically. Various types of RNA modifications can be introduced during or after chemical synthesis and/or enzymatic generation of RNAs, e.g., modifications that enhance stability, reduce the likelihood or degree of innate immune response, and/or enhance other attributes, as described in the art.

Spacer Extension Sequence

In some embodiments of genome-targeting nucleic acids, a spacer extension sequence can provide stability and/or provide a location for modifications of a genome-targeting nucleic acid. A spacer extension sequence can modify on- or off-target activity or specificity. In some embodiments, a spacer extension sequence is provided. A spacer extension sequence may have a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, or 7000 or more nucleotides. A spacer extension sequence may have a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400, 1000, 2000, 3000, 4000, 5000, 6000, 7000 or more nucleotides. In some embodiments, a spacer extension sequence is less than 10 nucleotides in length. In some embodiments, a spacer extension sequence is between 10-30 nucleotides in length. In some embodiments, a spacer extension sequence is between 30-70 nucleotides in length.

In some embodiments, the spacer extension sequence comprises another moiety (e.g., a stability control sequence, an endoribonuclease binding sequence, a ribozyme). In some embodiments, the moiety decreases or increases the stability of a nucleic acid targeting nucleic acid. In some embodiments, the moiety is a transcriptional terminator segment (i.e., a transcription termination sequence). In some embodiments, the moiety functions in a eukaryotic cell. In some embodiments, the moiety functions in a prokaryotic cell. In some embodiments, the moiety functions in both eukaryotic and prokaryotic cells. Non-limiting examples of suitable moieties include: a 5' cap (e.g., a 7-methylguanylate cap (m7 G)), a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like).

Spacer Sequence

The spacer sequence hybridizes to a sequence in a target nucleic acid of interest. The spacer of a genome-targeting nucleic acid interacts with a target nucleic acid in a sequence-specific manner via hybridization (i.e., base pairing). The nucleotide sequence of the spacer thus varies depending on the sequence of the target nucleic acid of interest.

In a CRISPR/Cas system herein, the spacer sequence is designed to hybridize to a target nucleic acid that is located 5' of a PAM of the Cas9 enzyme used in the system. The spacer may perfectly match the target sequence or may have mismatches. Each Cas9 enzyme has a particular PAM sequence that it recognizes in a target DNA. For example, *S. pyogenes* recognizes in a target nucleic acid a PAM that comprises the sequence 5'-NRG-3', where R comprises either A or G, where N is any nucleotide and N is immediately 3' of the target nucleic acid sequence targeted by the spacer sequence.

In some embodiments, the target nucleic acid sequence comprises 20 nucleotides. In some embodiments, the target nucleic acid comprises less than 20 nucleotides. In some embodiments, the target nucleic acid comprises more than 20 nucleotides. In some embodiments, the target nucleic acid comprises at least: 5, 10, 15, 16, 17, 18, 19, 20, 21, 22, 23, 24, 25, 30 or more nucleotides. In some embodiments, the target nucleic acid comprises at most: 5, 10, 15, 16, 17, 18, 19, 20, 21, 22, 23, 24, 25, 30 or more nucleotides. In some embodiments, the target nucleic acid sequence comprises 20 bases immediately 5' of the first nucleotide of the PAM. For example, in a sequence comprising 5'-NNNNNNNNNNNNNNNNNNNNNRG-3' (SEQ ID NO: 68,298), the target nucleic acid comprises the sequence that corresponds to the Ns, wherein N is any nucleotide, and the underlined NRG sequence is the S. pyogenes PAM.

In some embodiments, the spacer sequence that hybridizes to the target nucleic acid has a length of at least about 6 nucleotides (nt). The spacer sequence can be at least about 6 nt, at least about 10 nt, at least about 15 nt, at least about 18 nt, at least about 19 nt, at least about 20 nt, at least about 25 nt, at least about 30 nt, at least about 35 nt or at least about 40 nt, from about 6 nt to about 80 nt, from about 6 nt to about 50 nt, from about 6 nt to about 45 nt, from about 6 nt to about 40 nt, from about 6 nt to about 35 nt, from about 6 nt to about 30 nt, from about 6 nt to about 25 nt, from about 6 nt to about 20 nt, from about 6 nt to about 19 nt, from about 10 nt to about 50 nt, from about 10 nt to about 45 nt, from about 10 nt to about 40 nt, from about 10 nt to about 35 nt, from about 10 nt to about 30 nt, from about 10 nt to about 25 nt, from about 10 nt to about 20 nt, from about 10 nt to about 19 nt, from about 19 nt to about 25 nt, from about 19 nt to about 30 nt, from about 19 nt to about 35 nt, from about 19 nt to about 40 nt, from about 19 nt to about 45 nt, from about 19 nt to about 50 nt, from about 19 nt to about 60 nt, from about 20 nt to about 25 nt, from about 20 nt to about 30 nt, from about 20 nt to about 35 nt, from about 20 nt to about 40 nt, from about 20 nt to about 45 nt, from about 20 nt to about 50 nt, or from about 20 nt to about 60 nt. In some embodiments, the spacer sequence comprises 20 nucleotides. In some embodiments, the spacer comprises 19 nucleotides.

In some embodiments, the percent complementarity between the spacer sequence and the target nucleic acid is at least about 30%, at least about 40%, at least about 50%, at least about 60%, at least about 65%, at least about 70%, at least about 75%, at least about 80%, at least about 85%, at least about 90%, at least about 95%, at least about 97%, at least about 98%, at least about 99%, or 100%. In some embodiments, the percent complementarity between the spacer sequence and the target nucleic acid is at most about 30%, at most about 40%, at most about 50%, at most about 60%, at most about 65%, at most about 70%, at most about 75%, at most about 80%, at most about 85%, at most about 90%, at most about 95%, at most about 97%, at most about 98%, at most about 99%, or 100%. In some embodiments, the percent complementarity between the spacer sequence and the target nucleic acid is 100% over the six contiguous 5'-most nucleotides of the target sequence of the complementary strand of the target nucleic acid. In some embodiments, the percent complementarity between the spacer sequence and the target nucleic acid is at least 60% over about 20 contiguous nucleotides. The length of the spacer sequence and the target nucleic acid can differ by 1 to 6 nucleotides, which may be thought of as a bulge or bulges.

In some embodiments, a spacer sequence is designed or chosen using a computer program. The computer program can use variables, such as predicted melting temperature, secondary structure formation, predicted annealing temperature, sequence identity, genomic context, chromatin accessibility, % GC, frequency of genomic occurrence (e.g., of sequences that are identical or are similar but vary in one or more spots as a result of mismatch, insertion or deletion), methylation status, presence of SNPs, and the like.

Minimum CRISPR Repeat Sequence

In some embodiments, a minimum CRISPR repeat sequence is a sequence with at least about 30%, about 40%, about 50%, about 60%, about 65%, about 70%, about 75%, about 80%, about 85%, about 90%, about 95%, or 100% sequence identity to a reference CRISPR repeat sequence (e.g., crRNA from S. pyogenes).

A minimum CRISPR repeat sequence comprises nucleotides that can hybridize to a minimum tracrRNA sequence in a cell. The minimum CRISPR repeat sequence and a minimum tracrRNA sequence form a duplex, i.e. a base-paired double-stranded structure. Together, the minimum CRISPR repeat sequence and the minimum tracrRNA sequence bind to the site-directed polypeptide. At least a part of the minimum CRISPR repeat sequence hybridizes to the minimum tracrRNA sequence. In some embodiments, at least a part of the minimum CRISPR repeat sequence comprises at least about 30%, about 40%, about 50%, about 60%, about 65%, about 70%, about 75%, about 80%, about 85%, about 90%, about 95%, or 100% complementary to the minimum tracrRNA sequence. In some embodiments, at least a part of the minimum CRISPR repeat sequence comprises at most about 30%, about 40%, about 50%, about 60%, about 65%, about 70%, about 75%, about 80%, about 85%, about 90%, about 95%, or 100% complementary to the minimum tracrRNA sequence.

The minimum CRISPR repeat sequence can have a length from about 7 nucleotides to about 100 nucleotides. For example, the length of the minimum CRISPR repeat sequence is from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the minimum CRISPR repeat sequence is approximately 9 nucleotides in length. In some embodiments, the minimum CRISPR repeat sequence is approximately 12 nucleotides in length.

In some embodiments, the minimum CRISPR repeat sequence is at least about 60% identical to a reference minimum CRISPR repeat sequence (e.g., wild-type crRNA from S. pyogenes) over a stretch of at least 6, 7, or 8 contiguous nucleotides. For example, the minimum CRISPR repeat sequence is at least about 65% identical, at least about 70% identical, at least about 75% identical, at least about 80% identical, at least about 85% identical, at least about 90% identical, at least about 95% identical, at least about 98% identical, at least about 99% identical or 100% identical to a reference minimum CRISPR repeat sequence over a stretch of at least 6, 7, or 8 contiguous nucleotides.

Minimum tracrRNA Sequence

In some embodiments, a minimum tracrRNA sequence is a sequence with at least about 30%, about 40%, about 50%, about 60%, about 65%, about 70%, about 75%, about 80%, about 85%, about 90%, about 95%, or 100% sequence identity to a reference tracrRNA sequence (e.g., wild type tracrRNA from *S. pyogenes*).

A minimum tracrRNA sequence comprises nucleotides that hybridize to a minimum CRISPR repeat sequence in a cell. A minimum tracrRNA sequence and a minimum CRISPR repeat sequence form a duplex, i.e. a base-paired double-stranded structure. Together, the minimum tracrRNA sequence and the minimum CRISPR repeat bind to a site-directed polypeptide. At least a part of the minimum tracrRNA sequence can hybridize to the minimum CRISPR repeat sequence. In some embodiments, the minimum tracrRNA sequence is at least about 30%, about 40%, about 50%, about 60%, about 65%, about 70%, about 75%, about 80%, about 85%, about 90%, about 95%, or 100% complementary to the minimum CRISPR repeat sequence.

The minimum tracrRNA sequence can have a length from about 7 nucleotides to about 100 nucleotides. For example, the minimum tracrRNA sequence can be from about 7 nucleotides (nt) to about 50 nt, from about 7 nt to about 40 nt, from about 7 nt to about 30 nt, from about 7 nt to about 25 nt, from about 7 nt to about 20 nt, from about 7 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt or from about 15 nt to about 25 nt long. In some embodiments, the minimum tracrRNA sequence is approximately 9 nucleotides in length. In some embodiments, the minimum tracrRNA sequence is approximately 12 nucleotides. In some embodiments, the minimum tracrRNA consists of tracrRNA nt 23-48 described in Jinek et al., supra.

In some embodiments, the minimum tracrRNA sequence is at least about 60% identical to a reference minimum tracrRNA (e.g., wild type, tracrRNA from *S. pyogenes*) sequence over a stretch of at least 6, 7, or 8 contiguous nucleotides. For example, the minimum tracrRNA sequence is at least about 65% identical, about 70% identical, about 75% identical, about 80% identical, about 85% identical, about 90% identical, about 95% identical, about 98% identical, about 99% identical or 100% identical to a reference minimum tracrRNA sequence over a stretch of at least 6, 7, or 8 contiguous nucleotides.

In some embodiments, the duplex between the minimum CRISPR RNA and the minimum tracrRNA comprises a double helix. In some embodiments, the duplex between the minimum CRISPR RNA and the minimum tracrRNA comprises at least about 1, 2, 3, 4, 5, 6, 7, 8, 9, or 10 or more nucleotides. In some embodiments, the duplex between the minimum CRISPR RNA and the minimum tracrRNA comprises at most about 1, 2, 3, 4, 5, 6, 7, 8, 9, or 10 or more nucleotides.

In some embodiments, the duplex comprises a mismatch (i.e., the two strands of the duplex are not 100% complementary). In some embodiments, the duplex comprises at least about 1, 2, 3, 4, or 5 or mismatches. In some embodiments, the duplex comprises at most about 1, 2, 3, 4, or 5 or mismatches. In some embodiments, the duplex comprises no more than 2 mismatches.

Bulges

In some embodiments, there is a "bulge" in the duplex between the minimum CRISPR RNA and the minimum tracrRNA. The bulge is an unpaired region of nucleotides within the duplex. In some embodiments, the bulge contributes to the binding of the duplex to the site-directed polypeptide. A bulge comprises, on one side of the duplex, an unpaired 5'-XXXY-3' where X is any purine and Y comprises a nucleotide that can form a wobble pair with a nucleotide on the opposite strand, and an unpaired nucleotide region on the other side of the duplex. The number of unpaired nucleotides on the two sides of the duplex can be different.

In one example, the bulge comprises an unpaired purine (e.g., adenine) on the minimum CRISPR repeat strand of the bulge. In some embodiments, a bulge comprises an unpaired 5'-AAGY-3' of the minimum tracrRNA sequence strand of the bulge, where Y comprises a nucleotide that can form a wobble pairing with a nucleotide on the minimum CRISPR repeat strand.

In some embodiments, a bulge on the minimum CRISPR repeat side of the duplex comprises at least 1, 2, 3, 4, or 5 or more unpaired nucleotides. In some embodiments, a bulge on the minimum CRISPR repeat side of the duplex comprises at most 1, 2, 3, 4, or 5 or more unpaired nucleotides. In some embodiments, a bulge on the minimum CRISPR repeat side of the duplex comprises 1 unpaired nucleotide.

In some embodiments, a bulge on the minimum tracrRNA sequence side of the duplex comprises at least 1, 2, 3, 4, 5, 6, 7, 8, 9, or 10 or more unpaired nucleotides. In some embodiments, a bulge on the minimum tracrRNA sequence side of the duplex comprises at most 1, 2, 3, 4, 5, 6, 7, 8, 9, or 10 or more unpaired nucleotides. In some embodiments, a bulge on a second side of the duplex (e.g., the minimum tracrRNA sequence side of the duplex) comprises 4 unpaired nucleotides.

In some embodiments, a bulge comprises at least one wobble pairing. In some embodiments, a bulge comprises at most one wobble pairing. In some embodiments, a bulge comprises at least one purine nucleotide. In some embodiments, a bulge comprises at least 3 purine nucleotides. In some embodiments, a bulge sequence comprises at least 5 purine nucleotides. In some embodiments, a bulge sequence comprises at least one guanine nucleotide. In some embodiments, a bulge sequence comprises at least one adenine nucleotide.

Hairpins

In various embodiments, one or more hairpins are located 3' to the minimum tracrRNA in the 3' tracrRNA sequence.

In some embodiments, the hairpin starts at least about 1, 2, 3, 4, 5, 6, 7, 8, 9, 10, 15, or 20 or more nucleotides 3' from the last paired nucleotide in the minimum CRISPR repeat and minimum tracrRNA sequence duplex. In some embodiments, the hairpin can start at most about 1, 2, 3, 4, 5, 6, 7, 8, 9 or 10 or more nucleotides 3' of the last paired nucleotide in the minimum CRISPR repeat and minimum tracrRNA sequence duplex.

In some embodiments, a hairpin comprises at least about 1, 2, 3, 4, 5, 6, 7, 8, 9, 10, 15, or 20 or more consecutive nucleotides. In some embodiments, a hairpin comprises at most about 1, 2, 3, 4, 5, 6, 7, 8, 9, 10, 15, or more consecutive nucleotides.

In some embodiments, a hairpin comprises a CC dinucleotide (i.e., two consecutive cytosine nucleotides).

In some embodiments, a hairpin comprises duplexed nucleotides (e.g., nucleotides in a hairpin, hybridized together). For example, a hairpin comprises a CC dinucleotide that is hybridized to a GG dinucleotide in a hairpin duplex of the 3' tracrRNA sequence.

One or more of the hairpins can interact with guide RNA-interacting regions of a site-directed polypeptide.

In some embodiments, there are two or more hairpins, and in some embodiments there are three or more hairpins.

3' tracrRNA Sequence

In some embodiments, a 3' tracrRNA sequence comprises a sequence with at least about 30%, about 40%, about 50%, about 60%, about 65%, about 70%, about 75%, about 80%, about 85%, about 90%, about 95%, or 100% sequence identity to a reference tracrRNA sequence (e.g., a tracrRNA from S. pyogenes).

In some embodiments, the 3' tracrRNA sequence has a length from about 6 nucleotides to about 100 nucleotides. For example, the 3' tracrRNA sequence can have a length from about 6 nucleotides (nt) to about 50 nt, from about 6 nt to about 40 nt, from about 6 nt to about 30 nt, from about 6 nt to about 25 nt, from about 6 nt to about 20 nt, from about 6 nt to about 15 nt, from about 8 nt to about 40 nt, from about 8 nt to about 30 nt, from about 8 nt to about 25 nt, from about 8 nt to about 20 nt, from about 8 nt to about 15 nt, from about 15 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the 3' tracrRNA sequence has a length of approximately 14 nucleotides.

In some embodiments, the 3' tracrRNA sequence is at least about 60% identical to a reference 3' tracrRNA sequence (e.g., wild type 3' tracrRNA sequence from S. pyogenes) over a stretch of at least 6, 7, or 8 contiguous nucleotides. For example, the 3' tracrRNA sequence is at least about 60% identical, about 65% identical, about 70% identical, about 75% identical, about 80% identical, about 85% identical, about 90% identical, about 95% identical, about 98% identical, about 99% identical, or 100% identical, to a reference 3' tracrRNA sequence (e.g., wild type 3' tracrRNA sequence from S. pyogenes) over a stretch of at least 6, 7, or 8 contiguous nucleotides.

In some embodiments, a 3' tracrRNA sequence comprises more than one duplexed region (e.g., hairpin, hybridized region). In some embodiments, a 3' tracrRNA sequence comprises two duplexed regions.

In some embodiments, the 3' tracrRNA sequence comprises a stem loop structure. In some embodiments, a stem loop structure in the 3' tracrRNA comprises at least 1, 2, 3, 4, 5, 6, 7, 8, 9, 10, 15 or 20 or more nucleotides. In some embodiments, the stem loop structure in the 3' tracrRNA comprises at most 1, 2, 3, 4, 5, 6, 7, 8, 9 or 10 or more nucleotides. In some embodiments, the stem loop structure comprises a functional moiety. For example, the stem loop structure may comprise an aptamer, a ribozyme, a protein-interacting hairpin, a CRISPR array, an intron, or an exon. In some embodiments, the stem loop structure comprises at least about 1, 2, 3, 4, or 5 or more functional moieties. In some embodiments, the stem loop structure comprises at most about 1, 2, 3, 4, or 5 or more functional moieties.

In some embodiments, the hairpin in the 3' tracrRNA sequence comprises a P-domain. In some embodiments, the P-domain comprises a double-stranded region in the hairpin.

tracrRNA Extension Sequence

A tracrRNA extension sequence may be provided whether the tracrRNA is in the context of single-molecule guides or double-molecule guides. In some embodiments, a tracrRNA extension sequence has a length from about 1 nucleotide to about 400 nucleotides. In some embodiments, a tracrRNA extension sequence has a length of more than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, or 400 nucleotides. In some embodiments, a tracrRNA extension sequence has a length from about 20 to about 5000 or more nucleotides. In some embodiments, a tracrRNA extension sequence has a length of more than 1000 nucleotides. In some embodiments, a tracrRNA extension sequence has a length of less than 1, 5, 10, 15, 20, 25, 30, 35, 40, 45, 50, 60, 70, 80, 90, 100, 120, 140, 160, 180, 200, 220, 240, 260, 280, 300, 320, 340, 360, 380, 400 or more nucleotides. In some embodiments, a tracrRNA extension sequence can have a length of less than 1000 nucleotides. In some embodiments, a tracrRNA extension sequence comprises less than 10 nucleotides in length. In some embodiments, a tracrRNA extension sequence is 10-30 nucleotides in length. In some embodiments, tracrRNA extension sequence is 30-70 nucleotides in length.

In some embodiments, the tracrRNA extension sequence comprises a functional moiety (e.g., a stability control sequence, ribozyme, endoribonuclease binding sequence). In some embodiments, the functional moiety comprises a transcriptional terminator segment (i.e., a transcription termination sequence). In some embodiments, the functional moiety has a total length from about 10 nucleotides (nt) to about 100 nucleotides, from about 10 nt to about 20 nt, from about 20 nt to about 30 nt, from about 30 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt, from about 15 nt to about 80 nt, from about 15 nt to about 50 nt, from about 15 nt to about 40 nt, from about 15 nt to about 30 nt, or from about 15 nt to about 25 nt. In some embodiments, the functional moiety functions in a eukaryotic cell. In some embodiments, the functional moiety functions in a prokaryotic cell. In some embodiments, the functional moiety functions in both eukaryotic and prokaryotic cells.

Non-limiting examples of suitable tracrRNA extension functional moieties include a 3' poly-adenylated tail, a riboswitch sequence (e.g., to allow for regulated stability and/or regulated accessibility by proteins and protein complexes), a sequence that forms a dsRNA duplex (i.e., a hairpin), a sequence that targets the RNA to a subcellular location (e.g., nucleus, mitochondria, chloroplasts, and the like), a modification or sequence that provides for tracking (e.g., direct conjugation to a fluorescent molecule, conjugation to a moiety that facilitates fluorescent detection, a sequence that allows for fluorescent detection, etc.), and/or a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like). In some embodiments, a tracrRNA extension sequence comprises a primer binding site or a molecular index (e.g., barcode sequence). In some embodiments, the tracrRNA extension sequence comprises one or more affinity tags.

Single-Molecule Guide Linker Sequence

In some embodiments, the linker sequence of a single-molecule guide nucleic acid has a length from about 3 nucleotides to about 100 nucleotides. In Jinek et al., supra, for example, a simple 4 nucleotide "tetraloop" (-GAAA-) was used, Science, 337(6096):816-821 (2012). An illustrative linker has a length from about 3 nucleotides (nt) to about 90 nt, from about 3 nt to about 80 nt, from about 3 nt to about 70 nt, from about 3 nt to about 60 nt, from about 3 nt to about 50 nt, from about 3 nt to about 40 nt, from about 3 nt to about 30 nt, from about 3 nt to about 20 nt, from about 3 nt to about 10 nt. For example, the linker can have a length from about 3 nt to about 5 nt, from about 5 nt to about 10 nt, from about 10 nt to about 15 nt, from about 15 nt to about 20 nt, from about 20 nt to about 25 nt, from about 25 nt to about 30 nt, from about 30 nt to about 35 nt, from about 35 nt to about 40 nt, from about 40 nt to about 50 nt, from about 50 nt to about 60 nt, from about 60 nt to about 70 nt, from about 70 nt to about 80 nt, from about 80 nt to about 90 nt, or from about 90 nt to about 100 nt. In some embodiments, the linker of a single-molecule guide nucleic acid is between 4 and 40 nucleotides. In some embodiments, a linker is at least about 100, 500, 1000, 1500, 2000, 2500, 3000, 3500, 4000, 4500, 5000, 5500, 6000, 6500, or 7000 or more nucleotides. In some embodiments, a linker is at most about 100, 500, 1000, 1500, 2000, 2500, 3000, 3500, 4000, 4500, 5000, 5500, 6000, 6500, or 7000 or more nucleotides.

Linkers can comprise any of a variety of sequences, although preferably the linker will not comprise sequences that have extensive regions of homology with other portions of the guide RNA, which might cause intramolecular binding that could interfere with other functional regions of the guide. In Jinek et al., supra, a simple 4 nucleotide sequence -GAAA- was used, Science, 337(6096):816-821 (2012), but numerous other sequences, including longer sequences can likewise be used.

In some embodiments, the linker sequence comprises a functional moiety. For example, the linker sequence may comprise one or more features, including an aptamer, a ribozyme, a protein-interacting hairpin, a protein binding site, a CRISPR array, an intron, or an exon. In some embodiments, the linker sequence comprises at least about 1, 2, 3, 4, or 5 or more functional moieties. In some embodiments, the linker sequence comprises at most about 1, 2, 3, 4, or 5 or more functional moieties.

Genome Engineering Strategies to Correct Cells by Insertion, Correction, Deletion, or Replacement of One or More Mutations or Exons within or Near the Gene, or by Knocking-in SERPINA1 cDNA or a Minigene into the Locus of the Corresponding Gene or Safe Harbor Site The methods of the present disclosure can involve correction of one or both of the mutant alleles. Gene editing to correct the mutation has the advantage of restoration of correct expression levels and temporal control. Sequencing the patient's SERPINA1 alleles allows for design of the gene editing strategy to best correct the identified mutation(s).

A step of the ex vivo methods of the invention involves editing/correcting the patient specific iPS cells using genome engineering. Alternatively, a step of the ex vivo methods of the invention involves editing/correcting the progenitor cell, primary hepatocyte, mesenchymal stem cell, or liver progenitor cell. Likewise, a step of the in vivo methods of the invention involves editing/correcting the cells in an AATD patient using genome engineering. Similarly, a step in the cellular methods of the invention involves editing/correcting the SERPINA1 gene in a human cell by genome engineering.

AATD patients exhibit one or more mutations in the SERPINA1 gene. Therefore, different patients will generally require different correction strategies. Any CRISPR endonuclease may be used in the methods of the invention, each CRISPR endonuclease having its own associated PAM, which may or may not be disease specific. For example, gRNA spacer sequences for targeting the SERPINA1 gene with a CRISPR/Cas9 endonuclease from *S. pyogenes* have been identified in SEQ ID NOs: 54,860-61,324. gRNA spacer sequences for targeting the SERPINA1 gene with a CRISPR/Cas9 endonuclease from *S. aureus* have been identified in SEQ ID NOs: 61,325-61,936. gRNA spacer sequences for targeting the SERPINA1 gene with a CRISPR/Cas9 endonuclease from *S. thermophilus* have been identified in SEQ ID NOs: 61,9347-62,069. gRNA spacer sequences for targeting the SERPINA1 gene with a CRISPR/Cas9 endonuclease from *T denticola* have been identified in SEQ ID NOs: 62,070-62,120. gRNA spacer sequences for targeting the SERPINA1 gene with a CRISPR/Cas9 endonuclease from *N. meningitides* have been identified in SEQ ID NOs: 62,121-62,563. gRNA spacer sequences for targeting the SERPINA1 gene with a CRISPR/Cpf1 endonuclease from *Acidominococcus, Lachnospiraceae*, and *Francisella novicida* have been identified in SEQ ID NOs: 62,564-68,297. gRNA spacer sequences for targeting, e.g., targeting exon 1-2 of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *S. pyogenes* have been identified in Example 7. gRNA spacer sequences for targeting, e.g., targeting exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *S. aureus* have been identified in Example 8. gRNA spacer sequences for targeting, e.g., targeting exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *S. thermophilus* have been identified in Example 9. gRNA spacer sequences for targeting, e.g., targeting exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *T. denticola* have been identified in Example 10. gRNA spacer sequences for targeting, e.g., targeting exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *N. meningitides* have been identified in Example 11. gRNA spacer sequences for targeting, e.g., targeting exon 1-2 of, AAVS1 (PPP1R12C), ALB, Angptl3, ApoC3, ASGR2, CCR5, FIX (F9), G6PC, Gys2, HGD, Lp(a), Pcsk9, Serpina1, TF, and TTR with a CRISPR/Cas9 endonuclease from *Acidominococcus, Lachnospiraceae*, and *Francisella novicida* have been identified in Example 12.

For example, the mutation can be corrected by the insertions or deletions that arise due to the imprecise NHEJ repair pathway. If the patient's SERPINA1 gene has an inserted or deleted base, a targeted cleavage can result in a NHEJ-mediated insertion or deletion that restores the frame. Missense mutations can also be corrected through NHEJ-mediated correction using one or more guide RNA. The ability or likelihood of the cut(s) to correct the mutation can be designed or evaluated based on the local sequence and micro-homologies. NHEJ can also be used to delete segments of the gene, either directly or by altering splice donor or acceptor sites through cleavage by one gRNA targeting several locations, or several gRNAs. This may be useful if an amino acid, domain or exon contains the mutations and can be removed or inverted, or if the deletion otherwise restored function to the protein. Pairs of guide strands have been used for deletions and corrections of inversions.

Alternatively, the donor for correction by HDR contains the corrected sequence with small or large flanking homology arms to allow for annealing. HDR is essentially an error-free mechanism that uses a supplied homologous DNA sequence as a template during DSB repair. The rate of homology directed repair (HDR) is a function of the distance between the mutation and the cut site so choosing overlapping or nearest target sites is important. Templates can include extra sequences flanked by the homologous regions or can contain a sequence that differs from the genomic sequence, thus allowing sequence editing.

In addition to correcting mutations by NHEJ or HDR, a range of other options are possible. If there are small or large deletions or multiple mutations, a cDNA can be knocked in that contains the exons affected. A full length cDNA can be knocked into any "safe harbor", but must use a supplied or other promoter. If this construct is knocked into the correct location, it will have physiological control, similar to the normal gene. Pairs of nucleases can be used to delete mutated gene regions, though a donor would usually have to be provided to restore function. In this case two gRNA would be supplied and one donor sequence.

Some genome engineering strategies involve correction of one or more mutations in or near the SERPINA1 gene or deleting the mutant SERPINA1 DNA and/or knocking-in SERPINA1 cDNA or a minigene (comprised of one or more exons and introns or natural or synthetic introns) into the locus of the corresponding gene or a safe harbor locus by homology directed repair (HDR), which is also known as homologous recombination (HR). Homology directed repair is one strategy for treating patients that have inactivating mutations in or near the SERPINA1 gene. These strategies will restore the SERPINA1 gene and completely reverse, treat, and/or mitigate the diseased state. This strategy will require a more custom approach based on the location of the patient's inactivating mutation(s). Donor nucleotides for correcting mutations are small (<300 bp). This is advantageous, as HDR efficiencies may be inversely related to the size of the donor molecule. Also, it is expected that the donor templates can fit into size constrained viral vector molecules, e.g., adeno-associated virus (AAV) molecules, which have been shown to be an effective means of donor template delivery. Also, it is expected that the donor templates can fit into other size constrained molecules, including, by way of non-limiting example, platelets and/or exosomes or other microvesicles.

Homology direct repair is a cellular mechanism for repairing double-stranded breaks (DSBs). The most common form is homologous recombination. There are additional pathways for HDR, including single-strand annealing and alternative-HDR. Genome engineering tools allow researchers to manipulate the cellular homologous recombination pathways to create site-specific modifications to the genome. It has been found that cells can repair a double-stranded break using a synthetic donor molecule provided in trans. Therefore, by introducing a double-stranded break near a specific mutation and providing a suitable donor, targeted changes can be made in the genome. Specific cleavage increases the rate of HDR more than 1,000 fold above the rate of 1 in $10^5$ cells receiving a homologous donor alone. The rate of homology directed repair (HDR) at a particular nucleotide is a function of the distance to the cut site, so choosing overlapping or nearest target sites is important. Gene editing offers the advantage over gene addition, as correcting in situ leaves the rest of the genome unperturbed.

Supplied donors for editing by HDR vary markedly but generally contain the intended sequence with small or large flanking homology arms to allow annealing to the genomic DNA. The homology regions flanking the introduced genetic changes can be 30 bp or smaller, or as large as a multi-kilobase cassette that can contain promoters, cDNAs, etc. Both single-stranded and double-stranded oligonucleotide donors have been used. These oligonucleotides range in size from less than 100 nt to over many kb, though longer ssDNA can also be generated and used. Double-stranded donors are often used, including PCR amplicons, plasmids, and mini-circles. In general, it has been found that an AAV vector is a very effective means of delivery of a donor template, though the packaging limits for individual donors is <5 kb. Active transcription of the donor increased HDR three-fold, indicating the inclusion of promoter may increase conversion. Conversely, CpG methylation of the donor decreased gene expression and HDR.

In addition to wildtype endonucleases, such as Cas9, nickase variants exist that have one or the other nuclease domain inactivated resulting in cutting of only one DNA strand. HDR can be directed from individual Cas nickases or using pairs of nickases that flank the target area. Donors can be single-stranded, nicked, or dsDNA.

The donor DNA can be supplied with the nuclease or independently by a variety of different methods, for example by transfection, nano-particle, micro-injection, or viral transduction. A range of tethering options has been proposed to increase the availability of the donors for HDR. Examples include attaching the donor to the nuclease, attaching to DNA binding proteins that bind nearby, or attaching to proteins that are involved in DNA end binding or repair.

The repair pathway choice can be guided by a number of culture conditions, such as those that influence cell cycling, or by targeting of DNA repair and associated proteins. For example, to increase HDR, key NHEJ molecules can be suppressed, such as KU70, KU80 or DNA ligase IV.

Without a donor present, the ends from a DNA break or ends from different breaks can be joined using the several nonhomologous repair pathways in which the DNA ends are joined with little or no base-pairing at the junction. In addition to canonical NHEJ, there are similar repair mechanisms, such as alt-NHEJ. If there are two breaks, the intervening segment can be deleted or inverted. NHEJ repair pathways can lead to insertions, deletions or mutations at the joints.

NHEJ was used to insert a 15-kb inducible gene expression cassette into a defined locus in human cell lines after nuclease cleavage. Maresca, M., Lin, V. G., Guo, N. & Yang, Y., *Genome Res* 23, 539-546 (2013).

In addition to genome editing by NHEJ or HDR, site-specific gene insertions have been conducted that use both the NHEJ pathway and HR. A combination approach may be applicable in certain settings, possibly including intron/exon borders. NHEJ may prove effective for ligation in the intron, while the error-free HDR may be better suited in the coding region.

As stated previously, the SERPINA1 gene contains 5 exons. Any one or more of the 5 exons or nearby introns may be repaired in order to correct a mutation and restore the inactive AAT protein. Alternatively, there are various mutations associated with AATD, which are a combination of missense, nonsense, frameshift and other mutations, with the common effect of inactivating AAT. Any one or more of the mutations may be repaired in order to restore the inactive AAT. For example, one or more of the following pathological variants may be corrected: rs764325655, rs121912713, rs28929474, rs17580, rs121912714, rs764220898, rs199422211, rs751235320, rs199422210, rs267606950, rs55819880, rs28931570 (See Table 1). These variants include deletions, insertions and single nucleotide polymorphisms. As a further alternative, SERPINA1 cDNA or minigene (comprised of, natural or synthetic enhancer and promoter, one or more exons, and natural or synthetic introns, and natural or synthetic 3'UTR and polyadenylation signal) may be knocked-in to the locus of the corresponding gene or knocked-in to a safe harbor site, such as AAVS1 (PPP1R12C), ALB, Angptl3, ApoC3, ASGR2, CCR5, FIX (F9), G6PC, Gys2, HGD, Lp(a), Pcsk9, Serpina1, TF, and/or TTR. The safe harbor locus can be selected from the group consisting of: exon 1-2 of AAVS1 (PPP1R12C), exon 1-2 of ALB, exon 1-2 of Angptl3, exon 1-2 of ApoC3, exon 1-2 of ASGR2, exon 1-2 of CCR5, exon 1-2 of FIX (F9), exon 1-2 of G6PC, exon 1-2 of Gys2, exon 1-2 of HGD, exon 1-2 of Lp(a), exon 1-2 of Pcsk9, exon 1-2 of Serpina1, exon 1-2 of TF, and exon 1-2 of TTR. In some embodiments, the methods provide one gRNA or a pair of gRNAs that can be used to facilitate incorporation of a new sequence from a polynucleotide donor template to correct one or more mutations or to knock-in a part of or the entire SERPINA1 gene or cDNA.

TABLE 1

| Variant | Location | Variant type |
|---|---|---|
| rs764325655 | 94,378,547-94,378,548 | Insertion |
| rs121912713 | 94,378,561 | single nucleotide variation |
| rs28929474 | 94,378,610 | single nucleotide variation |
| rs17580 | 94,380,925 | single nucleotide variation |
| rs121912714 | 94,380,949 | single nucleotide variation |
| rs764220898 | 94,381,043 | single nucleotide variation |
| rs199422211 | 94,381,067 | single nucleotide variation |
| rs751235320 | 94,382,591 | single nucleotide variation |
| rs199422210 | 94,382,686 | single nucleotide variation |
| rs267606950 | 94,382,686 | Insertion |
| rs55819880 | 94,383,008 | single nucleotide variation |
| rs28931570 | 94,383,051 | single nucleotide variation |

Some embodiments of the methods provide gRNA pairs that make a deletion by cutting the gene twice, one gRNA cutting at the 5' end of one or more mutations and the other gRNA cutting at the 3' end of one or more mutations that facilitates insertion of a new sequence from a polynucleotide donor template to replace the one or more mutations, or deletion may exclude mutant amino acids or amino acids adjacent to it (e.g., premature stop codon) and lead to expression of a functional protein, or restore an open reading frame. The cutting may be accomplished by a pair of DNA endonucleases that each makes a DSB in the genome, or by multiple nickases that together make a DSB in the genome.

Alternatively, some embodiments of the methods provide one gRNA to make one double-strand cut around one or more mutations that facilitates insertion of a new sequence from a polynucleotide donor template to replace the one or more mutations. The double-strand cut may be made by a single DNA endonuclease or multiple nickases that together make a DSB in the genome, or single gRNA may lead to deletion (MMEJ), which may exclude mutant amino acid (e.g., premature stop codon) and lead to expression of a functional protein, or restore an open reading frame.

Illustrative modifications within the SERPINA1 gene include replacements within or near (proximal) to the mutations referred to above, such as within the region of less than 3 kb, less than 2 kb, less than 1 kb, less than 0.5 kb upstream or downstream of the specific mutation. Given the relatively wide variations of mutations in the SERPINA1 gene, it will be appreciated that numerous variations of the replacements referenced above (including without limitation larger as well as smaller deletions), would be expected to result in restoration of AAT protein activity.

Such variants include replacements that are larger in the 5' and/or 3' direction than the specific mutation in question, or smaller in either direction. Accordingly, by "near" or "proximal" with respect to specific replacements, it is intended that the SSB or DSB locus associated with a desired replacement boundary (also referred to herein as an endpoint) may be within a region that is less than about 3 kb from the reference locus noted. In some embodiments, the DSB locus is more proximal and within 2 kb, within 1 kb, within 0.5 kb, or within 0.1 kb. In the case of small replacement, the desired endpoint is at or "adjacent to" the reference locus, by which it is intended that the endpoint is within 100 bp, within 50 bp, within 25 bp, or less than about 10 bp to 5 bp from the reference locus.

Embodiments comprising larger or smaller replacements are expected to provide the same benefit, as long as the AAT protein activity is restored. It is thus expected that many variations of the replacements described and illustrated herein will be effective for ameliorating AATD.

Another genome engineering strategy involves exon deletion. Targeted deletion of specific exons is an attractive strategy for treating a large subset of patients with a single therapeutic cocktail. Deletions can either be single exon deletions or multi-exon deletions. While multi-exon deletions can reach a larger number of patients, for larger deletions the efficiency of deletion greatly decreases with increased size. Therefore, deletions range can be from 40 to 10,000 base pairs (bp) in size. For example, deletions may range from 40-100; 100-300; 300-500; 500-1,000; 1,000-2,000; 2,000-3,000; 3,000-5,000; or 5,000-10,000 base pairs in size.

Deletions can occur in enhancer, promoter, 1st intron, and/or 3'UTR leading to upregulation of the gene expression, and/or through deletion of the regulatory elements.

As stated previously, the AAT gene contains 5 exons. Any one or more of the 5 exons, or aberrant intronic splice acceptor or donor sites, may be deleted in order to restore the AAT reading frame. In some embodiments, the methods provide gRNA pairs that can be used to delete exons 1, 2, 3, 4, or 5, or any combination of them.

In order to ensure that the pre-mRNA is properly processed following exon deletion, the surrounding splicing signals can be deleted. Splicing donor and acceptors are generally within 100 base pairs of the neighboring intron. Therefore, in some examples, methods can provide all gRNAs that cut approximately +/−100-3100 bp with respect to each exon/intron junction of interest.

For any of the genome editing strategies, gene editing can be confirmed by sequencing or PCR analysis.

Target Sequence Selection

Shifts in the location of the 5' boundary and/or the 3' boundary relative to particular reference loci are used to facilitate or enhance particular applications of gene editing, which depend in part on the endonuclease system selected for the editing, as further described and illustrated herein.

In a first, non-limiting example of such target sequence selection, many endonuclease systems have rules or criteria that guide the initial selection of potential target sites for cleavage, such as the requirement of a PAM sequence motif in a particular position adjacent to the DNA cleavage sites in the case of CRISPR Type II or Type V endonucleases.

In another non-limiting example of target sequence selection or optimization, the frequency of "off-target" activity for a particular combination of target sequence and gene editing endonuclease (i.e. the frequency of DSBs occurring at sites other than the selected target sequence) is assessed relative to the frequency of on-target activity. In some cases, cells that have been correctly edited at the desired locus may have a selective advantage relative to other cells. Illustrative, but nonlimiting, examples of a selective advantage include the acquisition of attributes such as enhanced rates of replication, persistence, resistance to certain conditions, enhanced rates of successful engraftment or persistence in vivo following introduction into a patient, and other attributes associated with the maintenance or increased numbers or viability of such cells. In other cases, cells that have been correctly edited at the desired locus may be positively selected for by one or more screening methods used to identify, sort or otherwise select for cells that have been correctly edited. Both selective advantage and directed selection methods may take advantage of the phenotype associated with the correction. In some embodiments, cells may be edited two or more times in order to create a second modification that creates a new phenotype that is used to select or purify the intended population of cells. Such a second modification could be created by adding a second gRNA for a selectable or screenable marker. In some cases, cells can be correctly edited at the desired locus using a DNA fragment that contains the cDNA and also a selectable marker.

Whether any selective advantage is applicable or any directed selection is to be applied in a particular case, target sequence selection is also guided by consideration of off-target frequencies in order to enhance the effectiveness of the application and/or reduce the potential for undesired alterations at sites other than the desired target. As described further and illustrated herein and in the art, the occurrence of off-target activity is influenced by a number of factors including similarities and dissimilarities between the target site and various off target sites, as well as the particular endonuclease used. Bioinformatics tools are available that assist in the prediction of off-target activity, and frequently such tools can also be used to identify the most likely sites of off-target activity, which can then be assessed in experimental settings to evaluate relative frequencies of off-target to on-target activity, thereby allowing the selection of sequences that have higher relative on-target activities. Illustrative examples of such techniques are provided herein, and others are known in the art.

Another aspect of target sequence selection relates to homologous recombination events. Sequences sharing regions of homology can serve as focal points for homologous recombination events that result in deletion of intervening sequences. Such recombination events occur during the normal course of replication of chromosomes and other DNA sequences, and also at other times when DNA sequences are being synthesized, such as in the case of repairs of double-strand breaks (DSBs), which occur on a regular basis during the normal cell replication cycle but may also be enhanced by the occurrence of various events (such as UV light and other inducers of DNA breakage) or the presence of certain agents (such as various chemical inducers). Many such inducers cause DSBs to occur indiscriminately in the genome, and DSBs are regularly being induced and repaired in normal cells. During repair, the original sequence may be reconstructed with complete fidelity, however, in some cases, small insertions or deletions (referred to as "indels") are introduced at the DSB site.

DSBs may also be specifically induced at particular locations, as in the case of the endonucleases systems described herein, which can be used to cause directed or preferential gene modification events at selected chromosomal locations. The tendency for homologous sequences to be subject to recombination in the context of DNA repair (as well as replication) can be taken advantage of in a number of circumstances, and is the basis for one application of gene editing systems, such as CRISPR, in which homology directed repair is used to insert a sequence of interest, provided through use of a "donor" polynucleotide, into a desired chromosomal location.

Regions of homology between particular sequences, which can be small regions of "microhomology" that may comprise as few as ten basepairs or less, can also be used to bring about desired deletions. For example, a single DSB is introduced at a site that exhibits microhomology with a nearby sequence. During the normal course of repair of such DSB, a result that occurs with high frequency is the deletion of the intervening sequence as a result of recombination being facilitated by the DSB and concomitant cellular repair process.

In some circumstances, however, selecting target sequences within regions of homology can also give rise to much larger deletions, including gene fusions (when the deletions are in coding regions), which may or may not be desired given the particular circumstances.

The examples provided herein further illustrate the selection of various target regions for the creation of DSBs designed to induce replacements that result in restoration of AAT protein activity, as well as the selection of specific target sequences within such regions that are designed to minimize off-target events relative to on-target events.

Nucleic Acid Modifications

In some embodiments, polynucleotides introduced into cells comprise one or more modifications that can be used individually or in combination, for example, to enhance activity, stability or specificity, alter delivery, reduce innate immune responses in host cells, or for other enhancements, as further described herein and known in the art.

In certain embodiments, modified polynucleotides are used in the CRISPR/Cas9/Cpf1 system, in which case the guide RNAs (either single-molecule guides or double-molecule guides) and/or a DNA or an RNA encoding a Cas or Cpf1 endonuclease introduced into a cell can be modified, as described and illustrated below. Such modified polynucleotides can be used in the CRISPR/Cas9/Cpf1 system to edit any one or more genomic loci.

Using the CRISPR/Cas9/Cpf1 system for purposes of nonlimiting illustrations of such uses, modifications of guide RNAs can be used to enhance the formation or stability of the CRISPR/Cas9/Cpf1 genome editing complex comprising guide RNAs, which may be single-molecule guides or double-molecule, and a Cas or Cpf1 endonuclease. Modifications of guide RNAs can also or alternatively be used to enhance the initiation, stability or kinetics of interactions between the genome editing complex with the target sequence in the genome, which can be used, for example, to enhance on-target activity. Modifications of guide RNAs can also or alternatively be used to enhance specificity, e.g., the relative rates of genome editing at the on-target site as compared to effects at other (off-target) sites.

Modifications can also or alternatively be used to increase the stability of a guide RNA, e.g., by increasing its resistance to degradation by ribonucleases (RNases) present in a cell, thereby causing its half-life in the cell to be increased. Modifications enhancing guide RNA half-life can be particularly useful in embodiments in which a Cas or Cpf1 endonuclease is introduced into the cell to be edited via an RNA that needs to be translated in order to generate endonuclease, because increasing the half-life of guide RNAs introduced at the same time as the RNA encoding the endonuclease can be used to increase the time that the guide RNAs and the encoded Cas or Cpf1 endonuclease co-exist in the cell.

Modifications can also or alternatively be used to decrease the likelihood or degree to which RNAs introduced into cells elicit innate immune responses. Such responses, which have been well characterized in the context of RNA interference (RNAi), including small-interfering RNAs (siRNAs), as described below and in the art, tend to be associated with reduced half-life of the RNA and/or the elicitation of cytokines or other factors associated with immune responses.

One or more types of modifications can also be made to RNAs encoding an endonuclease that are introduced into a cell, including, without limitation, modifications that enhance the stability of the RNA (such as by increasing its degradation by RNAses present in the cell), modifications that enhance translation of the resulting product (i.e. the endonuclease), and/or modifications that decrease the likelihood or degree to which the RNAs introduced into cells elicit innate immune responses.

Combinations of modifications, such as the foregoing and others, can likewise be used. In the case of CRISPR/Cas9/Cpf1, for example, one or more types of modifications can be made to guide RNAs (including those exemplified above), and/or one or more types of modifications can be made to RNAs encoding Cas endonuclease (including those exemplified above).

By way of illustration, guide RNAs used in the CRISPR/Cas9/Cpf1 system, or other smaller RNAs can be readily synthesized by chemical means, enabling a number of modifications to be readily incorporated, as illustrated below and described in the art. While chemical synthetic procedures are continually expanding, purifications of such RNAs by procedures such as high performance liquid chromatography (HPLC, which avoids the use of gels such as PAGE) tends to become more challenging as polynucleotide lengths increase significantly beyond a hundred or so nucleotides. One approach used for generating chemically-modified RNAs of greater length is to produce two or more molecules that are ligated together. Much longer RNAs, such as those encoding a Cas9 endonuclease, are more readily generated enzymatically. While fewer types of modifications are generally available for use in enzymatically produced RNAs, there are still modifications that can be used to, e.g., enhance stability, reduce the likelihood or degree of innate immune response, and/or enhance other attributes, as described further below and in the art; and new types of modifications are regularly being developed.

By way of illustration of various types of modifications, especially those used frequently with smaller chemically synthesized RNAs, modifications can comprise one or more nucleotides modified at the 2' position of the sugar, in some embodiments a 2'-O-alkyl, 2'-O-alkyl-O-alkyl, or 2'-fluoro-modified nucleotide. In some embodiments, RNA modifications include 2'-fluoro, 2'-amino or 2' O-methyl modifications on the ribose of pyrimidines, abasic residues, or an inverted base at the 3' end of the RNA. Such modifications are routinely incorporated into oligonucleotides and these oligonucleotides have been shown to have a higher Tm (i.e., higher target binding affinity) than 2'-deoxyoligonucleotides against a given target.

A number of nucleotide and nucleoside modifications have been shown to make the oligonucleotide into which they are incorporated more resistant to nuclease digestion than the native oligonucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Some oligonucleotides are oligonucleotides with phosphorothioate backbones and those with heteroatom backbones, particularly CH2-NH—O—CH2, CH,~N(CH3)~O~CH2 (known as a methylene(methylimino) or MMI backbone), CH2-O—N(CH3)-CH2, CH2-N(CH3)-N(CH3)-CH2 and O—N (CH3)-CH2-CH2 backbones, wherein the native phosphodiester backbone is represented as O—P—O—CH,); amide backbones [see De Mesmaeker et al., Ace. Chem. Res., 28:366-374 (1995)]; morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Braasch and David Corey, Biochemistry, 41(14): 4503-4510 (2002); Genesis, Volume 30, Issue 3, (2001); Heasman, Dev. Biol., 243: 209-214 (2002); Nasevicius et al., Nat. Genet., 26:216-220 (2000); Lacerra et al., Proc. Natl. Acad. Sci., 97: 9591-9596 (2000); and U.S. Pat. No. 5,034,506, issued Jul. 23, 1991.

Cyclohexenyl nucleic acid oligonucleotide mimetics are described in Wang et al., J. Am. Chem. Soc., 122: 8595-8602 (2000).

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489, 677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

One or more substituted sugar moieties can also be included, e.g., one of the following at the 2' position: OH, SH, SCH3, F, OCN, OCH3 OCH3, OCH3 O(CH2)n CH3, O(CH2)n NH2, or O(CH2)n CH3, where n is from 1 to about 10; C1 to C10 lower alkyl, alkoxyalkoxy, substituted lower alkyl, alkaryl or aralkyl; Cl; Br; CN; CF3; OCF3; O—, S—, or N-alkyl; O—, S—, or N-alkenyl; SOCH3; SO2CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other substituents having similar properties. In some embodiments, a modification includes 2'-methoxyethoxy (2'-0-CH2CH2OCH3, also known as 2'-O-(2-methoxyethyl)) (Martin et al, Helv. Chim. Acta, 1995, 78, 486). Other modifications include 2'-methoxy (2'-0-CH3), 2'-propoxy (2'-OCH2 CH2CH3) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics, such as cyclobutyls in place of the pentofuranosyl group.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds comprise, but are not limited to, U.S. Pat. Nos. 5,539,082; 5,714,331; and 5,719,262. Further teaching of PNA compounds can be found in Nielsen et al, Science, 254: 1497-1500 (1991).

Guide RNAs can also include, additionally or alternatively, nucleobase (often referred to in the art simply as "base") modifications or substitutions. As used herein, "unmodified" or "natural" nucleobases include adenine (A), guanine (G), thymine (T), cytosine (C), and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 8-azaguanine, 7-deazaguanine, N6 (6-aminohexyl)adenine, and 2,6-diaminopurine. Kornberg, A., DNA Replication, W. H. Freeman & Co., San Francisco, pp 75-77 (1980); Gebeyehu et al., Nucl. Acids Res. 15:4513 (1997). A "universal" base known in the art, e.g., inosine, can also be included. 5-Me-C substitutions have been shown to increase nucleic acid duplex stability by 0.6-1.2° C. (Sanghvi, Y. S., in Crooke, S. T. and Lebleu, B., eds., Antisense Research and Applications, CRC Press, Boca Raton, 1993, pp. 276-278) and are embodiments of base substitutions.

Modified nucleobases comprise other synthetic and natural nucleobases, such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine, and 3-deazaguanine and 3-deazaadenine.

Further, nucleobases comprise those disclosed in U.S. Pat. No. 3,687,808, those disclosed in 'The Concise Encyclopedia of Polymer Science And Engineering', pages 858-859, Kroschwitz, J. I., ed. John Wiley & Sons, 1990, those disclosed by Englisch et al., Angewandle Chemie, International Edition', 1991, 30, page 613, and those disclosed by Sanghvi, Y. S., Chapter 15, Antisense Research and Applications', pages 289-302, Crooke, S. T. and Lebleu, B. ea., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2C (Sanghvi, Y. S., Crooke, S. T. and Lebleu, B., eds, 'Antisense Research and Applications', CRC Press, Boca Raton, 1993, pp. 276-278) and are embodiments of base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,681,941; 5,750,692; 5,763,588; 5,830,653; 6,005,096; and U.S. Patent Application Publication 2003/0158403.

Thus, the term "modified" refers to a non-natural sugar, phosphate, or base that is incorporated into a guide RNA, an endonuclease, or both a guide RNA and an endonuclease. It is not necessary for all positions in a given oligonucleotide to be uniformly modified, and in fact more than one of the aforementioned modifications may be incorporated in a single oligonucleotide, or even in a single nucleoside within an oligonucleotide.

In some embodiments, the guide RNAs and/or mRNA (or DNA) encoding an endonuclease are chemically linked to one or more moieties or conjugates that enhance the activity, cellular distribution, or cellular uptake of the oligonucleotide. Such moieties comprise, but are not limited to, lipid moieties such as a cholesterol moiety [Letsinger et al., Proc. Natl. Acad. Sci. USA, 86: 6553-6556 (1989)]; cholic acid [Manoharan et al., Bioorg. Med. Chem. Let., 4: 1053-1060 (1994)]; a thioether, e.g., hexyl-S-tritylthiol [Manoharan et al, Ann. N. Y. Acad. Sci., 660: 306-309 (1992) and Manoharan et al., Bioorg. Med. Chem. Let, 3: 2765-2770 (1993)]; a thiocholesterol [Oberhauser et al., Nucl. Acids Res., 20: 533-538 (1992)]; an aliphatic chain, e.g., dodecandiol or undecyl residues [Kabanov et al., FEBS Lett., 259: 327-330 (1990) and Svinarchuk et al., Biochimie, 75: 49-54 (1993)]; a phospholipid, e.g., di-hexadecyl-rac-glycerol or triethylammonium 1,2-di-O-hexadecyl-rac-glycero-3-H-phosphonate [Manoharan et al., Tetrahedron Lett., 36: 3651-3654 (1995) and Shea et al., Nucl. Acids Res., 18: 3777-3783 (1990)]; a polyamine or a polyethylene glycol chain [Mancharan et al., Nucleosides & Nucleotides, 14: 969-973 (1995)]; adamantane acetic acid [Manoharan et al., Tetrahedron Lett., 36: 3651-3654 (1995)]; a palmityl moiety [(Mishra et al., Biochim. Biophys. Acta, 1264: 229-237 (1995)]; or an octadecylamine or hexylamino-carbonyl-t oxycholesterol moiety [Crooke et al., J. Pharmacol. Exp. Ther., 277: 923-937 (1996)]. See also U.S. Pat. Nos. 4,828, 979; 4,948,882; 5,218,105; 5,525,465; 5,541,313; 5,545, 730; 5,552,538; 5,578,717; 5,580,731; 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241; 5,391,723; 5,416,203; 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599, 928 and 5,688,941.

Sugars and other moieties can be used to target proteins and complexes comprising nucleotides, such as cationic polysomes and liposomes, to particular sites. For example, hepatic cell directed transfer can be mediated via asialoglycoprotein receptors (ASGPRs); see, e.g., Hu, et al., Protein Pept Lett. 21(10):1025-30 (2014). Other systems known in the art and regularly developed can be used to target biomolecules of use in the present case and/or complexes thereof to particular target cells of interest.

These targeting moieties or conjugates can include conjugate groups covalently bound to functional groups, such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-racglycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

Longer polynucleotides that are less amenable to chemical synthesis and are typically produced by enzymatic synthesis can also be modified by various means. Such modifications can include, for example, the introduction of certain nucleotide analogs, the incorporation of particular sequences or other moieties at the 5' or 3' ends of molecules, and other modifications. By way of illustration, the mRNA encoding Cas9 is approximately 4 kb in length and can be synthesized by in vitro transcription. Modifications to the mRNA can be applied to, e.g., increase its translation or stability (such as by increasing its resistance to degradation with a cell), or to reduce the tendency of the RNA to elicit an innate immune response that is often observed in cells following introduction of exogenous RNAs, particularly longer RNAs such as that encoding Cas9.

Numerous such modifications have been described in the art, such as polyA tails, 5' cap analogs (e.g., Anti Reverse Cap Analog (ARCA) or m7G(5')ppp(5')G (mCAP)), modified 5' or 3' untranslated regions (UTRs), use of modified bases (such as Pseudo-UTP, 2-Thio-UTP, 5-Methylcytidine-5'-Triphosphate (5-Methyl-CTP) or N6-Methyl-ATP), or treatment with phosphatase to remove 5' terminal phosphates. These and other modifications are known in the art, and new modifications of RNAs are regularly being developed.

There are numerous commercial suppliers of modified RNAs, including for example, TriLink Biotech, AxoLabs, Bio-Synthesis Inc., Dharmacon and many others. As described by TriLink, for example, 5-Methyl-CTP can be used to impart desirable characteristics, such as increased nuclease stability, increased translation or reduced interaction of innate immune receptors with in vitro transcribed RNA. 5-Methylcytidine-5'-Triphosphate (5-Methyl-CTP), N6-Methyl-ATP, as well as Pseudo-UTP and 2-Thio-UTP, have also been shown to reduce innate immune stimulation in culture and in vivo while enhancing translation, as illustrated in publications by Kormann et al. and Warren et al. referred to below.

It has been shown that chemically modified mRNA delivered in vivo can be used to achieve improved therapeutic effects; see, e.g., Kormann et al., Nature Biotechnology 29, 154-157 (2011). Such modifications can be used, for example, to increase the stability of the RNA molecule and/or reduce its immunogenicity. Using chemical modifications such as Pseudo-U, N6-Methyl-A, 2-Thio-U and 5-Methyl-C, it was found that substituting just one quarter of the uridine and cytidine residues with 2-Thio-U and 5-Methyl-C respectively resulted in a significant decrease in toll-like receptor (TLR) mediated recognition of the mRNA in mice. By reducing the activation of the innate immune system, these modifications can be used to effectively increase the stability and longevity of the mRNA in vivo; see, e.g., Kormann et al., supra.

It has also been shown that repeated administration of synthetic messenger RNAs incorporating modifications designed to bypass innate anti-viral responses can reprogram differentiated human cells to pluripotency. See, e.g., Warren, et al., Cell Stem Cell, 7(5):618-30 (2010). Such modified mRNAs that act as primary reprogramming proteins can be an efficient means of reprogramming multiple human cell types. Such cells are referred to as induced pluripotency stem cells (iPSCs), and it was found that enzymatically synthesized RNA incorporating 5-Methyl-CTP, Pseudo-UTP and an Anti Reverse Cap Analog (ARCA) could be used to effectively evade the cell's antiviral response; see, e.g., Warren et al., supra.

Other modifications of polynucleotides described in the art include, for example, the use of polyA tails, the addition of 5' cap analogs (such as m7G(5')ppp(5')G (mCAP)), modifications of 5' or 3' untranslated regions (UTRs), or treatment with phosphatase to remove 5' terminal phosphates—and new approaches are regularly being developed.

A number of compositions and techniques applicable to the generation of modified RNAs for use herein have been developed in connection with the modification of RNA interference (RNAi), including small-interfering RNAs (siRNAs). siRNAs present particular challenges in vivo because their effects on gene silencing via mRNA interference are generally transient, which can require repeat administration. In addition, siRNAs are double-stranded RNAs (dsRNA) and mammalian cells have immune responses that have evolved to detect and neutralize dsRNA, which is often a by-product of viral infection. Thus, there are mammalian enzymes such as PKR (dsRNA-responsive kinase), and potentially retinoic acid-inducible gene I (RIG-I), that can mediate cellular responses to dsRNA, as well as Toll-like receptors (such as TLR3, TLR7 and TLR8) that can trigger the induction of cytokines in response to such molecules; see, e.g., the reviews by Angart et al., Pharmaceuticals (Basel) 6(4): 440-468 (2013); Kanasty et al., Molecular Therapy 20(3): 513-524 (2012); Burnett et al., Biotechnol J. 6(9):1130-46 (2011); Judge and MacLachlan, Hum Gene Ther 19(2):111-24 (2008); and references cited therein.

A large variety of modifications have been developed and applied to enhance RNA stability, reduce innate immune responses, and/or achieve other benefits that can be useful in connection with the introduction of polynucleotides into human cells, as described herein; see, e.g., the reviews by Whitehead K A et al., Annual Review of Chemical and Biomolecular Engineering, 2: 77-96 (2011); Gaglione and Messere, Mini Rev Med Chem, 10(7):578-95 (2010); Chemolovskaya et al, Curr Opin Mol Ther., 12(2):158-67 (2010); Deleavey et al., Curr Protoc Nucleic Acid Chem Chapter 16:Unit 16.3 (2009); Behlke, Oligonucleotides 18(4):305-19 (2008); Fucini et al., Nucleic Acid Ther 22(3): 205-210 (2012); Bremsen et al., Front Genet 3:154 (2012).

As noted above, there are a number of commercial suppliers of modified RNAs, many of which have specialized in modifications designed to improve the effectiveness of siRNAs. A variety of approaches are offered based on various findings reported in the literature. For example, Dharmacon notes that replacement of a non-bridging oxygen with sulfur (phosphorothioate, PS) has been extensively used to improve nuclease resistance of siRNAs, as reported by Kole, Nature Reviews Drug Discovery 11:125-140 (2012). Modifications of the 2'-position of the ribose have been reported to improve nuclease resistance of the internucleotide phosphate bond while increasing duplex stability (Tm), which has also been shown to provide protection from immune activation. A combination of moderate PS backbone modifications with small, well-tolerated 2'-substitutions (2'-O-Methyl, 2'-Fluoro, 2'-Hydro) have been associated with highly stable siRNAs for applications in vivo, as reported by Soutschek et al. Nature 432:173-178 (2004); and 2'-O-Methyl modifications have been reported to be effective in improving stability as reported by Volkov, Oligonucleotides 19:191-202 (2009). With respect to decreasing the induction of innate immune responses, modifying specific sequences with 2'-O-Methyl, 2'-Fluoro, 2'-Hydro have been reported to reduce TLR7/TLR8 interaction while generally preserving silencing activity; see, e.g., Judge et al., Mol. Ther. 13:494-505 (2006); and Cekaite et al., J. Mol. Biol. 365:90-108 (2007). Additional modifications, such as 2-thiouracil, pseudouracil, 5-methylcytosine, 5-methyluracil, and N6-methyladenosine have also been shown to minimize the immune effects mediated by TLR3, TLR7, and TLR8; see, e.g., Kariko, K. et al., Immunity 23:165-175 (2005).

As is also known in the art, and commercially available, a number of conjugates can be applied to polynucleotides, such as RNAs, for use herein that can enhance their delivery and/or uptake by cells, including for example, cholesterol, tocopherol and folic acid, lipids, peptides, polymers, linkers and aptamers; see, e.g., the review by Winkler, Ther. Deliv. 4:791-809 (2013), and references cited therein.

Codon-Optimization

In some embodiments, a polynucleotide encoding a site-directed polypeptide is codon-optimized according to methods standard in the art for expression in the cell containing the target DNA of interest. For example, if the intended target nucleic acid is in a human cell, a human codon-optimized polynucleotide encoding Cas9 is contemplated for use for producing the Cas9 polypeptide.

Complexes of a Genome-Targeting Nucleic Acid and a Site-Directed Polypeptide

A genome-targeting nucleic acid interacts with a site-directed polypeptide (e.g., a nucleic acid-guided nuclease such as Cas9), thereby forming a complex. The genome-targeting nucleic acid guides the site-directed polypeptide to a target nucleic acid.

RNPs

As stated previously, the site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

Nucleic Acids Encoding System Components

In another aspect, the present disclosure provides a nucleic acid comprising a nucleotide sequence encoding a genome-targeting nucleic acid of the disclosure, a site-directed polypeptide of the disclosure, and/or any nucleic acid or proteinaceous molecule necessary to carry out the embodiments of the methods of the disclosure.

In some embodiments, the nucleic acid encoding a genome-targeting nucleic acid of the disclosure, a site-directed polypeptide of the disclosure, and/or any nucleic acid or proteinaceous molecule necessary to carry out the embodiments of the methods of the disclosure comprises a vector (e.g., a recombinant expression vector).

The term "vector" refers to a nucleic acid molecule capable of transporting another nucleic acid to which it has been linked. One type of vector is a "plasmid", which refers to a circular double-stranded DNA loop into which additional nucleic acid segments can be ligated. Another type of vector is a viral vector, wherein additional nucleic acid segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome.

In some embodiments, vectors are capable of directing the expression of nucleic acids to which they are operatively linked. Such vectors are referred to herein as "recombinant expression vectors", or more simply "expression vectors", which serve equivalent functions.

The term "operably linked" means that the nucleotide sequence of interest is linked to regulatory sequence(s) in a manner that allows for expression of the nucleotide sequence. The term "regulatory sequence" is intended to include, for example, promoters, enhancers and other expression control elements (e.g., polyadenylation signals). Such regulatory sequences are well known in the art and are described, for example, in Goeddel; Gene Expression Technology: Methods in Enzymology 185, Academic Press, San Diego, Calif. (1990). Regulatory sequences include those that direct constitutive expression of a nucleotide sequence in many types of host cells, and those that direct expression of the nucleotide sequence only in certain host cells (e.g., tissue-specific regulatory sequences). It will be appreciated by those skilled in the art that the design of the expression vector can depend on such factors as the choice of the target cell, the level of expression desired, and the like.

Expression vectors contemplated include, but are not limited to, viral vectors based on vaccinia virus, poliovirus, adenovirus, adeno-associated virus, SV40, herpes simplex virus, human immunodeficiency virus, retrovirus (e.g., Murine Leukemia Virus, spleen necrosis virus, and vectors derived from retroviruses such as Rous Sarcoma Virus, Harvey Sarcoma Virus, avian leukosis virus, a lentivirus, human immunodeficiency virus, myeloproliferative sarcoma virus, and mammary tumor virus) and other recombinant vectors. Other vectors contemplated for eukaryotic target cells include, but are not limited to, the vectors pXT1, pSG5, pSVK3, pBPV, pMSG, and pSVLSV40 (Pharmacia). Additional vectors contemplated for eukaryotic target cells include, but are not limited to, the vectors pCTx-1, pCTx-2, and pCTx-3, which are described in FIGS. 1A-1C. Other vectors may be used so long as they are compatible with the host cell.

In some embodiments, a vector comprises one or more transcription and/or translation control elements. Depending on the host/vector system utilized, any of a number of suitable transcription and translation control elements, including constitutive and inducible promoters, transcription enhancer elements, transcription terminators, etc. may be used in the expression vector. In some embodiments, the vector is a self-inactivating vector that either inactivates the viral sequences or the components of the CRISPR machinery or other elements.

Non-limiting examples of suitable eukaryotic promoters (i.e., promoters functional in a eukaryotic cell) include those from cytomegalovirus (CMV) immediate early, herpes simplex virus (HSV) thymidine kinase, early and late SV40, long terminal repeats (LTRs) from retrovirus, human elongation factor-1 promoter (EF1), a hybrid construct comprising the cytomegalovirus (CMV) enhancer fused to the chicken beta-actin promoter (CAG), murine stem cell virus promoter (MSCV), phosphoglycerate kinase-1 locus promoter (PGK), and mouse metallothionein-I.

For expressing small RNAs, including guide RNAs used in connection with Cas endonuclease, various promoters such as RNA polymerase III promoters, including for example U6 and H1, can be advantageous. Descriptions of and parameters for enhancing the use of such promoters are known in art, and additional information and approaches are regularly being described; see, e.g., Ma, H. et al., *Molecular Therapy—Nucleic Acids* 3, e161 (2014) doi:10.1038/mtna.2014.12.

The expression vector may also contain a ribosome binding site for translation initiation and a transcription terminator. The expression vector may also include appropriate sequences for amplifying expression. The expression vector may also include nucleotide sequences encoding non-native tags (e.g., histidine tag, hemagglutinin tag, green fluorescent protein, etc.) that are fused to the site-directed polypeptide, thus resulting in a fusion protein.

In some embodiments, a promoter is an inducible promoter (e.g., a heat shock promoter, tetracycline-regulated promoter, steroid-regulated promoter, metal-regulated promoter, estrogen receptor-regulated promoter, etc.). In some embodiments, a promoter is a constitutive promoter (e.g., CMV promoter, UBC promoter). In some embodiments, the promoter is a spatially restricted and/or temporally restricted promoter (e.g., a tissue specific promoter, a cell type specific promoter, etc.).

In some embodiments, the nucleic acid encoding a genome-targeting nucleic acid of the disclosure and/or a site-directed polypeptide are packaged into or on the surface of delivery vehicles for delivery to cells. Delivery vehicles contemplated include, but are not limited to, nanospheres, liposomes, quantum dots, nanoparticles, polyethylene glycol particles, hydrogels, and micelles. As described in the art, a variety of targeting moieties can be used to enhance the preferential interaction of such vehicles with desired cell types or locations.

Introduction of the complexes, polypeptides, and nucleic acids of the disclosure into cells can occur by viral or bacteriophage infection, transfection, conjugation, protoplast fusion, lipofection, electroporation, nucleofection, calcium phosphate precipitation, polyethyleneimine (PEI)-mediated transfection, DEAE-dextran mediated transfection, liposome-mediated transfection, particle gun technology, calcium phosphate precipitation, direct micro-injection, nanoparticle-mediated nucleic acid delivery, and the like.

Delivery

Guide RNA polynucleotides (RNA or DNA) and/or endonuclease polynucleotide(s) (RNA or DNA) can be delivered by viral or non-viral delivery vehicles known in the art. Alternatively, endonuclease polypeptide(s) may be delivered by non-viral delivery vehicles known in the art, such as electroporation or lipid nanoparticles. In some embodiments, the DNA endonuclease may be delivered as one or more polypeptides, either alone or pre-complexed with one or more guide RNAs, or one or more crRNA together with a tracrRNA.

Polynucleotides may be delivered by non-viral delivery vehicles including, but not limited to, nanoparticles, liposomes, ribonucleoproteins, positively charged peptides, small molecule RNA-conjugates, aptamer-RNA chimeras, and RNA-fusion protein complexes. Some exemplary non-viral delivery vehicles are described in Peer and Lieberman, Gene Therapy, 18: 1127-1133 (2011) (which focuses on non-viral delivery vehicles for siRNA that are also useful for delivery of other polynucleotides).

Polynucleotides, such as guide RNA, sgRNA, and mRNA encoding an endonuclease, may be delivered to a cell or a patient by a lipid nanoparticle (LNP).

A LNP refers to any particle having a diameter of less than 1000 nm, 500 nm, 250 nm, 200 nm, 150 nm, 100 nm, 75 nm, 50 nm, or 25 nm. Alternatively, a nanoparticle may range in size from 1-1000 nm, 1-500 nm, 1-250 nm, 25-200 nm, 25-100 nm, 35-75 nm, or 25-60 nm.

LNPs may be made from cationic, anionic, or neutral lipids. Neutral lipids, such as the fusogenic phospholipid DOPE or the membrane component cholesterol, may be included in LNPs as 'helper lipids' to enhance transfection activity and nanoparticle stability. Limitations of cationic lipids include low efficacy owing to poor stability and rapid clearance, as well as the generation of inflammatory or anti-inflammatory responses.

LNPs may also be comprised of hydrophobic lipids, hydrophilic lipids, or both hydrophobic and hydrophilic lipids.

Any lipid or combination of lipids that are known in the art may be used to produce a LNP. Examples of lipids used to produce LNPs are: DOTMA, DOSPA, DOTAP, DMRIE, DC-cholesterol, DOTAP-cholesterol, GAP-DMORIE-DPyPE, and GL67A-DOPE-DMPE-polyethylene glycol (PEG). Examples of cationic lipids are: 98N12-5, C12-200, DLin-KC2-DMA (KC2), DLin-MC3-DMA (MC3), XTC, MD1, and 7C1. Examples of neutral lipids are: DPSC, DPPC, POPC, DOPE, and SM. Examples of PEG-modified lipids are: PEG-DMG, PEG-CerC14, and PEG-CerC20.

The lipids may be combined in any number of molar ratios to produce a LNP. In addition, the polynucleotide(s) may be combined with lipid(s) in a wide range of molar ratios to produce a LNP.

As stated previously, the site-directed polypeptide and genome-targeting nucleic acid may each be administered separately to a cell or a patient. On the other hand, the site-directed polypeptide may be pre-complexed with one or more guide RNAs, or one or more crRNA together with a tracrRNA. The pre-complexed material may then be administered to a cell or a patient. Such pre-complexed material is known as a ribonucleoprotein particle (RNP).

RNA is capable of forming specific interactions with RNA or DNA. While this property is exploited in many biological processes, it also comes with the risk of promiscuous interactions in a nucleic acid-rich cellular environment. One solution to this problem is the formation of ribonucleoprotein particles (RNPs), in which the RNA is pre-complexed with an endonuclease. Another benefit of the RNP is protection of the RNA from degradation.

The endonuclease in the RNP may be modified or unmodified. Likewise, the gRNA, crRNA, tracrRNA, or sgRNA may be modified or unmodified. Numerous modifications are known in the art and may be used.

The endonuclease and sgRNA are generally combined in a 1:1 molar ratio. Alternatively, the endonuclease, crRNA and tracrRNA are generally combined in a 1:1:1 molar ratio. However, a wide range of molar ratios may be used to produce a RNP.

A recombinant adeno-associated virus (AAV) vector may be used for delivery. Techniques to produce rAAV particles, in which an AAV genome to be packaged that includes the polynucleotide to be delivered, rep and cap genes, and helper virus functions are provided to a cell are standard in the art. Production of rAAV requires that the following components are present within a single cell (denoted herein as a packaging cell): a rAAV genome, AAV rep and cap genes separate from (i.e., not in) the rAAV genome, and helper virus functions. The AAV rep and cap genes may be from any AAV serotype for which recombinant virus can be derived, and may be from a different AAV serotype than the rAAV genome ITRs, including, but not limited to, AAV serotypes AAV-1, AAV-2, AAV-3, AAV-4, AAV-5, AAV-6, AAV-7, AAV-8, AAV-9, AAV-10, AAV-11, AAV-12, AAV-13 and AAV rh.74. Production of pseudotyped rAAV is disclosed in, for example, international patent application publication number WO 01/83692. See Table 2.

TABLE 2

| AAV Serotype | Genbank Accession No. |
| --- | --- |
| AAV-1 | NC_002077.1 |
| AAV-2 | NC_001401.2 |
| AAV-3 | NC_001729.1 |
| AAV-3B | AF028705.1 |
| AAV-4 | NC_001829.1 |
| AAV-5 | NC_006152.1 |
| AAV-6 | AF028704.1 |
| AAV-7 | NC_006260.1 |
| AAV-8 | NC_006261.1 |
| AAV-9 | AX753250.1 |
| AAV-10 | AY631965.1 |
| AAV-11 | AY631966.1 |
| AAV-12 | DQ813647.1 |
| AAV-13 | EU285562.1 |

A method of generating a packaging cell involves creating a cell line that stably expresses all of the necessary components for AAV particle production. For example, a plasmid (or multiple plasmids) comprising a rAAV genome lacking AAV rep and cap genes, AAV rep and cap genes separate from the rAAV genome, and a selectable marker, such as a neomycin resistance gene, are integrated into the genome of a cell. AAV genomes have been introduced into bacterial plasmids by procedures such as GC tailing (Samulski et al., 1982, Proc. Natl. Acad. S6. USA, 79:2077-2081), addition of synthetic linkers containing restriction endonuclease cleavage sites (Laughlin et al., 1983, Gene, 23:65-73) or by direct, blunt-end ligation (Senapathy & Carter, 1984, J. Biol. Chem., 259:4661-4666). The packaging cell line is then infected with a helper virus, such as adenovirus. The advantages of this method are that the cells are selectable and are suitable for large-scale production of rAAV. Other examples of suitable methods employ adenovirus or baculovirus, rather than plasmids, to introduce rAAV genomes and/or rep and cap genes into packaging cells.

General principles of rAAV production are reviewed in, for example, Carter, 1992, Current Opinions in Biotechnology, 1533-539; and Muzyczka, 1992, Curr. Topics in Microbial. and Immunol., 158:97-129). Various approaches are described in Ratschin et al., Mol. Cell. Biol. 4:2072 (1984); Hermonat et al., Proc. Natl. Acad. Sci. USA, 81:6466 (1984); Tratschin et al., Mol. Cell. Biol. 5:3251 (1985); McLaughlin et al., J. Virol., 62:1963 (1988); and Lebkowski et al., 1988 Mol. Cell. Biol., 7:349 (1988). Samulski et al. (1989, J. Virol., 63:3822-3828); U.S. Pat. No. 5,173,414; WO 95/13365 and corresponding U.S. Pat. No. 5,658,776; WO 95/13392; WO 96/17947; PCT/US98/18600; WO 97/09441 (PCT/US96/14423); WO 97/08298 (PCT/US96/13872); WO 97/21825 (PCT/US96/20777); WO 97/06243 (PCT/FR96/01064); WO 99/11764; Perrin et al. (1995) Vaccine 13:1244-1250; Paul et al. (1993) Human Gene Therapy 4:609-615; Clark et al. (1996) Gene Therapy 3:1124-1132; U.S. Pat. Nos. 5,786,211; 5,871,982; and 6,258,595.

AAV vector serotypes can be matched to target cell types. For example, the following exemplary cell types may be transduced by the indicated AAV serotypes among others. See Table 3.

TABLE 3

| Tissue/Cell Type | Serotype |
| --- | --- |
| Liver | AAV3, AAV5, AAV8, AAV9 |
| Skeletal muscle | AAV1, AAV7, AAV6, AAV8, AAV9 |
| Central nervous system | AAV5, AAV1, AAV4 |
| RPE | AAV5, AAV4 |
| Photoreceptor cells | AAV5 |
| Lung | AAV9 |
| Heart | AAV8 |
| Pancreas | AAV8 |
| Kidney | AAV2, AAV8 |

In addition to adeno-associated viral vectors, other viral vectors can be used. Such viral vectors include, but are not limited to, lentivirus, alphavirus, enterovirus, pestivirus, baculovirus, herpesvirus, Epstein Barr virus, papovavirusr, poxvirus, vaccinia virus, and herpes simplex virus.

In some embodiments, Cas9 mRNA, sgRNA targeting one or two loci in SERPINA1 genes, and donor DNA are each separately formulated into lipid nanoparticles, or are all co-formulated into one lipid nanoparticle, or co-formulated into two or more lipid nanoparticles.

In some embodiments, Cas9 mRNA is formulated in a lipid nanoparticle, while sgRNA and donor DNA are delivered in an AAV vector. In some embodiments, Cas9 mRNA and sgRNA are co-formulated in a lipid nanoparticle, while donor DNA is delivered in an AAV vector.

Options are available to deliver the Cas9 nuclease as a DNA plasmid, as mRNA or as a protein. The guide RNA can be expressed from the same DNA, or can also be delivered as an RNA. The RNA can be chemically modified to alter or improve its half-life, or decrease the likelihood or degree of immune response. The endonuclease protein can be complexed with the gRNA prior to delivery. Viral vectors allow efficient delivery; split versions of Cas9 and smaller orthologs of Cas9 can be packaged in AAV, as can donors for HDR. A range of non-viral delivery methods also exist that can deliver each of these components, or non-viral and viral methods can be employed in tandem. For example, nanoparticles can be used to deliver the protein and guide RNA, while AAV can be used to deliver a donor DNA.

Exosomes

Exosomes, a type of microvesicle bound by phospholipid bilayer, can be used to deliver nucleic acids to specific tissue. Many different types of cells within the body naturally secrete exosomes. Exosomes form within the cytoplasm when endosomes invaginate and form multivesicular-endosomes (MVE). When the MVE fuses with the cellular membrane, the exosomes are secreted in the extracellular space. Ranging between 30-120 nm in diameter, exosomes can shuttle various molecules from one cell to another in a form of cell-to-cell communication. Cells that naturally produce exosomes, such as mast cells, can be genetically altered to produce exosomes with surface proteins that target specific tissues, alternatively exosomes can be isolated from the bloodstream. Specific nucleic acids can be placed within the engineered exosomes with electroporation. When introduced systemically, the exosomes can deliver the nucleic acids to the specific target tissue.

Genetically Modified Cells

The term "genetically modified cell" refers to a cell that comprises at least one genetic modification introduced by genome editing (e.g., using the CRISPR/Cas system). In some ex vivo embodiments herein, the genetically modified cell is a genetically modified progenitor cell. In some in vivo embodiments herein, the genetically modified cell is a genetically modified liver cell. A genetically modified cell comprising an exogenous genome-targeting nucleic acid and/or an exogenous nucleic acid encoding a genome-targeting nucleic acid is contemplated herein.

The term "control treated population" describes a population of cells that has been treated with identical media, viral induction, nucleic acid sequences, temperature, confluency, flask size, pH, etc., with the exception of the addition of the genome editing components. Any method known in the art can be used to measure restoration of SERPINA1 gene or protein expression or activity, for example, Western Blot analysis of the AAT protein or quantifying SERPINA1 mRNA.

The term "isolated cell" refers to a cell that has been removed from an organism in which it was originally found, or a descendant of such a cell. Optionally, the cell has been cultured in vitro, e.g., under defined conditions or in the presence of other cells. Optionally, the cell is later introduced into a second organism or re-introduced into the organism from which it (or the cell from which it is descended) was isolated.

The term "isolated population" with respect to an isolated population of cells refers to a population of cells that has been removed and separated from a mixed or heterogeneous population of cells. In some embodiments, an isolated population is a substantially pure population of cells, as compared to the heterogeneous population from which the cells were isolated or enriched. In some embodiments, the isolated population is an isolated population of human progenitor cells, e.g., a substantially pure population of human progenitor cells, as compared to a heterogeneous population of cells comprising human progenitor cells and cells from which the human progenitor cells were derived.

The term "substantially enhanced," with respect to a particular cell population, refers to a population of cells in which the occurrence of a particular type of cell is increased relative to pre-existing or reference levels, by at least 2-fold, at least 3-, at least 4-, at least 5-, at least 6-, at least 7-, at least 8-, at least 9, at least 10-, at least 20-, at least 50-, at least 100-, at least 400-, at least 1000-, at least 5000-, at least 20000-, at least 100000- or more fold depending, e.g., on the desired levels of such cells for ameliorating AATD.

The term "substantially enriched" with respect to a particular cell population, refers to a population of cells that is at least about 10%, about 20%, about 30%, about 40%, about 50%, about 60%, about 70% or more with respect to the cells making up a total cell population.

The terms "substantially enriched" or "substantially pure" with respect to a particular cell population, refers to a population of cells that is at least about 75%, at least about 85%, at least about 90%, or at least about 95% pure, with respect to the cells making up a total cell population. That is, the terms "substantially pure" or "essentially purified," with regard to a population of progenitor cells, refers to a population of cells that contain fewer than about 20%, about 15%, about 10%, about 9%, about 8%, about 7%, about 6%, about 5%, about 4%, about 3%, about 2%, about 1%, or less than 1%, of cells that are not progenitor cells as defined by the terms herein.

Differentiation of Genome Edited IPSCs into Hepatocytes

Another step of the ex vivo methods of the invention involves differentiating the genome edited iPSCs into hepatocytes. The differentiating step may be performed according to any method known in the art. For example, hiPSC are differentiated into definitive endoderm using various treatments, including activin and B27 supplement (Life Technology). The definitive endoderm is further differentiated into hepatocyte, the treatment includes: FGF4, HGF, BMP2, BMP4, Oncostatin M, Dexametason, etc. (Duan et al, STEM CELLS; 2010; 28:674-686, Ma et al, STEM CELLS TRANSLATIONAL MEDICINE 2013; 2:409-419).

Differentiation of Genome Edited Mesenchymal Stem Cells into Hepatocytes

Another step of the ex vivo methods of the invention involves differentiating the genome edited mesenchymal stem cells into hepatocytes. The differentiating step may be performed according to any method known in the art. For example, hMSC are treated with various factors and hormones, including insulin, transferrin, FGF4, HGF, bile acids (Sawitza I et al, Sci Rep. 2015; 5: 13320).

Implanting Cells into Patients

Another step of the ex vivo methods of the invention involves implanting the hepatocytes into patients. This implanting step may be accomplished using any method of implantation known in the art. For example, the genetically modified cells may be injected directly in the patient's liver or otherwise administered to the patient.

Another step of the ex vivo methods of the invention involves implanting the progenitor cells or primary hepatocytes into patients. This implanting step may be accomplished using any method of implantation known in the art. For example, the genetically modified cells may be injected directly in the patients liver or otherwise administered to the patient. The genetically modified cells may be purified ex vivo using a selected marker.

Pharmaceutically Acceptable Carriers

The ex vivo methods of administering progenitor cells to a subject contemplated herein involve the use of therapeutic compositions comprising progenitor cells.

Therapeutic compositions contain a physiologically tolerable carrier together with the cell composition, and optionally at least one additional bioactive agent as described herein, dissolved or dispersed therein as an active ingredient. In some embodiments, the therapeutic composition is not substantially immunogenic when administered to a mammal or human patient for therapeutic purposes, unless so desired.

In general, the progenitor cells described herein are administered as a suspension with a pharmaceutically acceptable carrier. One of skill in the art will recognize that a pharmaceutically acceptable carrier to be used in a cell composition will not include buffers, compounds, cryopreservation agents, preservatives, or other agents in amounts that substantially interfere with the viability of the cells to be delivered to the subject. A formulation comprising cells can include e.g., osmotic buffers that permit cell membrane integrity to be maintained, and optionally, nutrients to maintain cell viability or enhance engraftment upon administration. Such formulations and suspensions are known to those of skill in the art and/or can be adapted for use with the progenitor cells, as described herein, using routine experimentation.

A cell composition can also be emulsified or presented as a liposome composition, provided that the emulsification procedure does not adversely affect cell viability. The cells and any other active ingredient can be mixed with excipients that are pharmaceutically acceptable and compatible with the active ingredient, and in amounts suitable for use in the therapeutic methods described herein.

Additional agents included in a cell composition can include pharmaceutically acceptable salts of the components therein. Pharmaceutically acceptable salts include the acid addition salts (formed with the free amino groups of the polypeptide) that are formed with inorganic acids, such as, for example, hydrochloric or phosphoric acids, or such organic acids as acetic, tartaric, mandelic and the like. Salts formed with the free carboxyl groups can also be derived from inorganic bases, such as, for example, sodium, potassium, ammonium, calcium or ferric hydroxides, and such organic bases as isopropylamine, trimethylamine, 2-ethylamino ethanol, histidine, procaine and the like.

Physiologically tolerable carriers are well known in the art. Exemplary liquid carriers are sterile aqueous solutions that contain no materials in addition to the active ingredients and water, or contain a buffer such as sodium phosphate at physiological pH value, physiological saline or both, such as phosphate-buffered saline. Still further, aqueous carriers can contain more than one buffer salt, as well as salts such as sodium and potassium chlorides, dextrose, polyethylene glycol and other solutes. Liquid compositions can also contain liquid phases in addition to and to the exclusion of water. Exemplary of such additional liquid phases are glycerin, vegetable oils such as cottonseed oil, and water-oil emulsions. The amount of an active compound used in the cell compositions that is effective in the treatment of a particular disorder or condition will depend on the nature of the disorder or condition, and can be determined by standard clinical techniques.

Administration & Efficacy

The terms "administering," "introducing" and "transplanting" are used interchangeably in the context of the placement of cells, e.g., progenitor cells, into a subject, by a method or route that results in at least partial localization of the introduced cells at a desired site, such as a site of injury or repair, such that a desired effect(s) is produced. The cells e.g., progenitor cells, or their differentiated progeny can be administered by any appropriate route that results in delivery to a desired location in the subject where at least a portion of the implanted cells or components of the cells remain viable. The period of viability of the cells after administration to a subject can be as short as a few hours, e.g., twenty-four hours, to a few days, to as long as several years, or even the life time of the patient, i.e., long-term engraftment. For example, in some embodiments described herein, an effective amount of myogenic progenitor cells is administered via a systemic route of administration, such as an intraperitoneal or intravenous route.

The terms "individual", "subject," "host" and "patient" are used interchangeably herein and refer to any subject for whom diagnosis, treatment or therapy is desired. In some embodiments, the subject is a mammal. In some embodiments, the subject is a human being.

When provided prophylactically, progenitor cells described herein can be administered to a subject in advance of any symptom of AATD, e.g., prior to the development of emphysema, airflow obstruction, chronic bronchitis, or liver disease. Accordingly, the prophylactic administration of a liver progenitor cell population serves to prevent AATD.

When provided therapeutically, liver progenitor cells are provided at (or after) the onset of a symptom or indication of AATD, e.g., upon the onset of lung or liver disease.

In some embodiments described herein, the liver progenitor cell population being administered according to the methods described herein comprises allogeneic liver progenitor cells obtained from one or more donors. "Allogeneic" refers to a liver progenitor cell or biological samples comprising liver progenitor cells or biological samples obtained from one or more different donors of the same species, where the genes at one or more loci are not identical. For example, a liver progenitor cell population being administered to a subject can be derived from one more unrelated donor subjects, or from one or more nonidentical siblings. In some embodiments, syngeneic liver progenitor cell populations can be used, such as those obtained from genetically identical animals, or from identical twins. In other embodiments, the liver progenitor cells are autologous cells; that is, the liver progenitor cells are obtained or isolated from a subject and administered to the same subject, i.e., the donor and recipient are the same.

In one embodiment, the term "effective amount" refers to the amount of a population of progenitor cells or their progeny needed to prevent or alleviate at least one or more signs or symptoms of AATD, and relates to a sufficient amount of a composition to provide the desired effect, e.g., to treat a subject having AATD. The term "therapeutically effective amount" therefore refers to an amount of progenitor cells or a composition comprising progenitor cells that is sufficient to promote a particular effect when administered to a typical subject, such as one who has or is at risk for AATD. An effective amount would also include an amount sufficient to prevent or delay the development of a symptom of the disease, alter the course of a symptom of the disease (for example but not limited to, slow the progression of a symptom of the disease), or reverse a symptom of the disease. It is understood that for any given case, an appropriate "effective amount" can be determined by one of ordinary skill in the art using routine experimentation.

For use in the various embodiments described herein, an effective amount of progenitor cells comprises at least $10^2$ progenitor cells, at least $5 \times 10^2$ progenitor cells, at least $10^3$ progenitor cells, at least $5 \times 10^3$ progenitor cells, at least $10^4$ progenitor cells, at least $5 \times 10^4$ progenitor cells, at least $10^5$ progenitor cells, at least $2 \times 10^5$ progenitor cells, at least $3 \times 10^5$ progenitor cells, at least $4 \times 10^5$ progenitor cells, at least $5 \times 10^5$ progenitor cells, at least $6 \times 10^5$ progenitor cells, at least $7 \times 10^5$ progenitor cells, at least $8 \times 10^5$ progenitor cells, at least $9 \times 10^5$ progenitor cells, at least $1 \times 10^6$ progenitor cells, at least $2 \times 10^6$ progenitor cells, at least $3 \times 10^6$ progenitor cells, at least $4 \times 10^6$ progenitor cells, at least $5 \times 10^6$ progenitor cells, at least $6 \times 10^6$ progenitor cells, at least $7 \times 10^6$ progenitor cells, at least $8 \times 10^6$ progenitor cells, at least $9 \times 10^6$ progenitor cells, or multiples thereof. The progenitor cells are derived from one or more donors, or are obtained from an autologous source. In some embodiments described herein, the progenitor cells are expanded in culture prior to administration to a subject in need thereof.

Modest and incremental increases in the levels of functional AAT expressed in cells of patients having AATD can be beneficial for ameliorating one or more symptoms of the disease, for increasing long-term survival, and/or for reducing side effects associated with other treatments. Upon administration of such cells to human patients, the presence of liver progenitors that are producing increased levels of functional AAT is beneficial. In some embodiments, effective treatment of a subject gives rise to at least about 3%, 5% or 7% functional AAT relative to total AAT in the treated subject. In some embodiments, functional AAT will be at least about 10% of total AAT. In some embodiments, functional AAT will be at least about 20% to 30% of total AAT. Similarly, the introduction of even relatively limited subpopulations of cells having significantly elevated levels of functional AAT can be beneficial in various patients because in some situations normalized cells will have a selective advantage relative to diseased cells. However, even modest levels of liver progenitors with elevated levels of functional AAT can be beneficial for ameliorating one or more aspects of AATD in patients. In some embodiments, about 10%, about 20%, about 30%, about 40%, about 50%, about 60%, about 70%, about 80%, about 90% or more of the liver progenitors in patients to whom such cells are administered are producing increased levels of functional AAT.

"Administered" refers to the delivery of a progenitor cell composition into a subject by a method or route that results in at least partial localization of the cell composition at a desired site. A cell composition can be administered by any appropriate route that results in effective treatment in the subject, i.e. administration results in delivery to a desired location in the subject where at least a portion of the composition delivered, i.e. at least $1 \times 10^4$ cells are delivered to the desired site for a period of time. Modes of administration include injection, infusion, instillation, or ingestion. "Injection" includes, without limitation, intravenous, intramuscular, intra-arterial, intrathecal, intraventricular, intracapsular, intraorbital, intracardiac, intradermal, intraperitoneal, transtracheal, subcutaneous, subcuticular, intraarticular, sub capsular, subarachnoid, intraspinal, intracerebro spinal, and intrasternal injection and infusion. In some embodiments, the route is intravenous. For the delivery of cells, administration by injection or infusion can be made.

In one embodiment, the cells are administered systemically. The phrases "systemic administration," "administered systemically", "peripheral administration" and "administered peripherally" refer to the administration of a population of progenitor cells other than directly into a target site, tissue, or organ, such that it enters, instead, the subject's circulatory system and, thus, is subject to metabolism and other like processes.

The efficacy of a treatment comprising a composition for the treatment of AATD can be determined by the skilled clinician. However, a treatment is considered "effective treatment," if any one or all of the signs or symptoms of, as but one example, levels of functional AAT are altered in a beneficial manner (e.g., increased by at least 10%), or other clinically accepted symptoms or markers of disease are improved or ameliorated. Efficacy can also be measured by failure of an individual to worsen as assessed by hospitalization or need for medical interventions (e.g., chronic obstructive pulmonary disease, or progression of the disease is halted or at least slowed). Methods of measuring these indicators are known to those of skill in the art and/or described herein. Treatment includes any treatment of a disease in an individual or an animal (some non-limiting examples include a human, or a mammal) and includes: (1) inhibiting the disease, e.g., arresting, or slowing the progression of symptoms; or (2) relieving the disease, e.g., causing regression of symptoms; and (3) preventing or reducing the likelihood of the development of symptoms.

The treatment according to the present invention ameliorates one or more symptoms associated with AATD by increasing the amount of functional AAT in the individual. Early signs typically associated with AATD, include for example, emphysema, airflow obstruction, chronic bronchitis, or liver disease (obstructive jaundice and increased aminotransferase levels in early life, and fibrosis and cirrhosis in the absence of a history of liver complications during childhood).

Kits

The present disclosure provides kits for carrying out the methods of the invention. A kit can include one or more of a genome-targeting nucleic acid, a polynucleotide encoding a genome-targeting nucleic acid, a site-directed polypeptide, a polynucleotide encoding a site-directed polypeptide, and/or any nucleic acid or proteinaceous molecule necessary to carry out the embodiments of the methods of the invention, or any combination thereof.

In some embodiments, a kit comprises: (1) a vector comprising a nucleotide sequence encoding a genome-targeting nucleic acid, and (2) the site-directed polypeptide or a vector comprising a nucleotide sequence encoding the site-directed polypeptide and (3) a reagent for reconstitution and/or dilution of the vector(s) and or polypeptide.

In some embodiments, a kit comprises: (1) a vector comprising (i) a nucleotide sequence encoding a genome-targeting nucleic acid, and (ii) a nucleotide sequence encoding the site-directed polypeptide and (2) a reagent for reconstitution and/or dilution of the vector.

In some embodiments of any of the above kits, the kit comprises a single-molecule guide genome-targeting nucleic acid. In some embodiments of any of the above kits, the kit comprises a double-molecule genome-targeting nucleic acid. In some embodiments of any of the above kits, the kit comprises two or more double-molecule guides or single-molecule guides. In some embodiments, the kits comprise a vector that encodes the nucleic acid targeting nucleic acid.

In some embodiments of any of the above kits, the kit can further comprise a polynucleotide to be inserted to effect the desired genetic modification.

Components of a kit may be in separate containers, or combined in a single container.

In some embodiments, a kit described above further comprises one or more additional reagents, where such additional reagents are selected from a buffer, a buffer for introducing a polypeptide or polynucleotide into a cell, a wash buffer, a control reagent, a control vector, a control RNA polynucleotide, a reagent for in vitro production of the polypeptide from DNA, adaptors for sequencing and the like. A buffer can be a stabilization buffer, a reconstituting buffer, a diluting buffer, or the like. In some embodiments, a kit can also include one or more components that may be used to facilitate or enhance the on-target binding or the cleavage of DNA by the endonuclease, or improve the specificity of targeting.

In addition to the above-mentioned components, a kit can further include instructions for using the components of the kit to practice the methods. The instructions for practicing the methods are generally recorded on a suitable recording medium. For example, the instructions may be printed on a substrate, such as paper or plastic, etc. The instructions may be present in the kits as a package insert, in the labeling of the container of the kit or components thereof (i.e., associated with the packaging or subpackaging), etc. The instructions can be present as an electronic storage data file present on a suitable computer readable storage medium, e.g. CD-ROM, diskette, flash drive, etc. In some instances, the actual instructions are not present in the kit, but means for obtaining the instructions from a remote source (e.g. via the Internet), can be provided. An example of this embodiment is a kit that includes a web address where the instructions can be viewed and/or from which the instructions can be downloaded. As with the instructions, this means for obtaining the instructions can be recorded on a suitable substrate.

Guide RNA Formulation

Guide RNAs of the invention are formulated with pharmaceutically acceptable excipients such as carriers, solvents, stabilizers, adjuvants, diluents, etc., depending upon the particular mode of administration and dosage form. Guide RNA compositions are generally formulated to achieve a physiologically compatible pH, and range from a pH of about 3 to a pH of about 11, about pH 3 to about pH 7, depending on the formulation and route of administration. In some embodiments, the pH is adjusted to a range from about pH 5.0 to about pH 8. In some embodiments, the compositions comprise a therapeutically effective amount of at least one compound as described herein, together with one or more pharmaceutically acceptable excipients. Optionally, the compositions comprise a combination of the compounds described herein, or may include a second active ingredient useful in the treatment or prevention of bacterial growth (for example and without limitation, anti-bacterial or anti-microbial agents), or may include a combination of reagents of the invention.

Suitable excipients include, for example, carrier molecules that include large, slowly metabolized macromolecules such as proteins, polysaccharides, polylactic acids, polyglycolic acids, polymeric amino acids, amino acid copolymers, and inactive virus particles. Other exemplary excipients include antioxidants (for example and without limitation, ascorbic acid), chelating agents (for example and without limitation, EDTA), carbohydrates (for example and without limitation, dextrin, hydroxyalkylcellulose, and hydroxyalkylmethylcellulose), stearic acid, liquids (for example and without limitation, oils, water, saline, glycerol and ethanol), wetting or emulsifying agents, pH buffering substances, and the like.

Other Possible Therapeutic Approaches

Gene editing can be conducted using nucleases engineered to target specific sequences. To date there are four major types of nucleases: meganucleases and their derivatives, zinc finger nucleases (ZFNs), transcription activator like effector nucleases (TALENs), and CRISPR-Cas9 nuclease systems. The nuclease platforms vary in difficulty of design, targeting density and mode of action, particularly as the specificity of ZFNs and TALENs is through protein-DNA interactions, while RNA-DNA interactions primarily guide Cas9. Cas9 cleavage also requires an adjacent motif, the PAM, which differs between different CRISPR systems. Cas9 from *Streptococcus pyogenes* cleaves using a NRG PAM, CRISPR from *Neisseria meningitidis* can cleave at sites with PAMs including NNNNGATT, NNNNNGTTT and NNNNGCTT. A number of other Cas9 orthologs target protospacer adjacent to alternative PAMs.

CRISPR endonucleases, such as Cas9, can be used in the methods of the invention. However, the teachings described herein, such as therapeutic target sites, could be applied to other forms of endonucleases, such as ZFNs, TALENs, HEs, or MegaTALs, or using combinations of nucleases. However, in order to apply the teachings of the present invention to such endonucleases, one would need to, among other things, engineer proteins directed to the specific target sites.

Additional binding domains can be fused to the Cas9 protein to increase specificity. The target sites of these constructs would map to the identified gRNA specified site, but would require additional binding motifs, such as for a zinc finger domain. In the case of Mega-TAL, a meganuclease can be fused to a TALE DNA-binding domain. The meganuclease domain can increase specificity and provide the cleavage. Similarly, inactivated or dead Cas9 (dCas9) can be fused to a cleavage domain and require the sgRNA/Cas9 target site and adjacent binding site for the fused DNA-binding domain. This likely would require some protein engineering of the dCas9, in addition to the catalytic inactivation, to decrease binding without the additional binding site.

Zinc Finger Nucleases

Zinc finger nucleases (ZFNs) are modular proteins comprised of an engineered zinc finger DNA binding domain linked to the catalytic domain of the type II endonuclease FokI. Because FokI functions only as a dimer, a pair of ZFNs must be engineered to bind to cognate target "half-site" sequences on opposite DNA strands and with precise spacing between them to enable the catalytically active FokI dimer to form. Upon dimerization of the FokI domain, which itself has no sequence specificity per se, a DNA double-strand break is generated between the ZFN half-sites as the initiating step in genome editing.

The DNA binding domain of each ZFN is typically comprised of 3-6 zinc fingers of the abundant Cys2-His2 architecture, with each finger primarily recognizing a triplet of nucleotides on one strand of the target DNA sequence, although cross-strand interaction with a fourth nucleotide also can be important. Alteration of the amino acids of a finger in positions that make key contacts with the DNA alters the sequence specificity of a given finger. Thus, a four-finger zinc finger protein will selectively recognize a 12 bp target sequence, where the target sequence is a composite of the triplet preferences contributed by each finger, although triplet preference can be influenced to varying degrees by neighboring fingers. An important aspect of ZFNs is that they can be readily re-targeted to almost any genomic address simply by modifying individual fingers, although considerable expertise is required to do this well. In most applications of ZFNs, proteins of 4-6 fingers are used, recognizing 12-18 bp respectively. Hence, a pair of ZFNs will typically recognize a combined target sequence of 24-36 bp, not including the 5-7 bp spacer between half-sites. The binding sites can be separated further with larger spacers, including 15-17 bp. A target sequence of this length is likely to be unique in the human genome, assuming repetitive sequences or gene homologs are excluded during the design process. Nevertheless, the ZFN protein-DNA interactions are not absolute in their specificity so off-target binding and cleavage events do occur, either as a heterodimer between the two ZFNs, or as a homodimer of one or the other of the ZFNs. The latter possibility has been effectively eliminated by engineering the dimerization interface of the FokI domain to create "plus" and "minus" variants, also known as obligate heterodimer variants, which can only dimerize with each other, and not with themselves. Forcing the obligate heterodimer prevents formation of the homodimer. This has greatly enhanced specificity of ZFNs, as well as any other nuclease that adopts these FokI variants.

A variety of ZFN-based systems have been described in the art, modifications thereof are regularly reported, and numerous references describe rules and parameters that are used to guide the design of ZFNs; see, e.g., Segal et al., *Proc Natl Acad Sci USA* 96(6):2758-63 (1999); Dreier B et al., *J Mol Biol.* 303(4):489-502 (2000); Liu Q et al., *J Biol Chem.* 277(6):3850-6 (2002); Dreier et al., *J Biol Chem* 280(42): 35588-97 (2005); and Dreier et al., *J Biol Chem.* 276(31): 29466-78 (2001).

Transcription Activator-Like Effector Nucleases (TAL-ENs)

TALENs represent another format of modular nucleases whereby, as with ZFNs, an engineered DNA binding domain is linked to the FokI nuclease domain, and a pair of TALENs operate in tandem to achieve targeted DNA cleavage. The major difference from ZFNs is the nature of the DNA binding domain and the associated target DNA sequence recognition properties. The TALEN DNA binding domain derives from TALE proteins, which were originally described in the plant bacterial pathogen *Xanthomonas* sp. TALEs are comprised of tandem arrays of 33-35 amino acid repeats, with each repeat recognizing a single basepair in the target DNA sequence that is typically up to 20 bp in length, giving a total target sequence length of up to 40 bp. Nucleotide specificity of each repeat is determined by the repeat variable diresidue (RVD), which includes just two amino acids at positions 12 and 13. The bases guanine, adenine, cytosine and thymine are predominantly recognized by the four RVDs: Asn-Asn, Asn-Ille, His-Asp and Asn-Gly, respectively. This constitutes a much simpler recognition code than for zinc fingers, and thus represents an advantage over the latter for nuclease design. Nevertheless, as with ZFNs, the protein-DNA interactions of TALENs are not absolute in their specificity, and TALENs have also benefited from the use of obligate heterodimer variants of the FokI domain to reduce off-target activity.

Additional variants of the FokI domain have been created that are deactivated in their catalytic function. If one half of either a TALEN or a ZFN pair contains an inactive FokI domain, then only single-strand DNA cleavage (nicking) will occur at the target site, rather than a DSB. The outcome is comparable to the use of CRISPR/Cas9 "nickase" mutants in which one of the Cas9 cleavage domains has been deactivated. DNA nicks can be used to drive genome editing by HDR, but at lower efficiency than with a DSB. The main benefit is that off-target nicks are quickly and accurately repaired, unlike the DSB, which is prone to NHEJ-mediated mis-repair.

A variety of TALEN-based systems have been described in the art, and modifications thereof are regularly reported; see, e.g., Boch, *Science* 326(5959):1509-12 (2009); Mak et al., *Science* 335(6069):716-9 (2012); and Moscou et al., *Science* 326(5959):1501 (2009). The use of TALENs based on the "Golden Gate" platform, or cloning scheme, has been described by multiple groups; see, e.g., Cermak et al., *Nucleic Acids Res.* 39(12):e82 (2011); Li et al., *Nucleic Acids Res.* 39(14):6315-25 (2011); Weber et al., *PLoS One.* 6(2):e16765 (2011); Wang et al., *J Genet Genomics* 41(6): 339-47, Epub 2014 May 17 (2014); and Cermak T et al., *Methods Mol Biol.* 1239:133-59 (2015).

Homing Endonucleases

Homing endonucleases (HEs) are sequence-specific endonucleases that have long recognition sequences (14-44 base pairs) and cleave DNA with high specificity—often at sites unique in the genome. There are at least six known families of HEs as classified by their structure, including LAGLI-DADG (SEQ ID NO: 68,299), GIY-YIG, His-Cis box, H-N-H, PD-(D/E)xK, and Vsr-like that are derived from a broad range of hosts, including eukarya, protists, bacteria, archaea, cyanobacteria and phage. As with ZFNs and TALENs, HEs can be used to create a DSB at a target locus as the initial step in genome editing. In addition, some natural and engineered HEs cut only a single strand of DNA, thereby functioning as site-specific nickases. The large target sequence of HEs and the specificity that they offer have made them attractive candidates to create site-specific DSBs.

A variety of HE-based systems have been described in the art, and modifications thereof are regularly reported; see, e.g., the reviews by Steentoft et al., *Glycobiology* 24(8):663-80 (2014); Belfort and Bonocora, *Methods Mol Biol.* 1123: 1-26 (2014); Hafez and Hausner, *Genome* 55(8):553-69 (2012); and references cited therein.

MegaTAL/Tev-mTALEN/MegaTev

As further examples of hybrid nucleases, the MegaTAL platform and Tev-mTALEN platform use a fusion of TALE DNA binding domains and catalytically active HEs, taking advantage of both the tunable DNA binding and specificity of the TALE, as well as the cleavage sequence specificity of the HE; see, e.g., Boissel et al., *NAR* 42: 2591-2601 (2014);

Kleinstiver et al., G3 4:1155-65 (2014); and Boissel and Scharenberg, *Methods Mol. Biol.* 1239: 171-96 (2015).

In a further variation, the MegaTev architecture is the fusion of a meganuclease (Mega) with the nuclease domain derived from the GIY-YIG homing endonuclease I-TevI (Tev). The two active sites are positioned ~30 bp apart on a DNA substrate and generate two DSBs with non-compatible cohesive ends; see, e.g., Wolfs et al., *NAR* 42, 8816-29 (2014). It is anticipated that other combinations of existing nuclease-based approaches will evolve and be useful in achieving the targeted genome modifications described herein.

dCas9-FokI and Other Nucleases

Combining the structural and functional properties of the nuclease platforms described above offers a further approach to genome editing that can potentially overcome some of the inherent deficiencies. As an example, the CRISPR genome editing system typically uses a single Cas9 endonuclease to create a DSB. The specificity of targeting is driven by a 20 or 22 nucleotide sequence in the guide RNA that undergoes Watson-Crick base-pairing with the target DNA (plus an additional 2 bases in the adjacent NAG or NGG PAM sequence in the case of Cas9 from *S. pyogenes*). Such a sequence is long enough to be unique in the human genome, however, the specificity of the RNA/DNA interaction is not absolute, with significant promiscuity sometimes tolerated, particularly in the 5' half of the target sequence, effectively reducing the number of bases that drive specificity. One solution to this has been to completely deactivate the Cas9 catalytic function—retaining only the RNA-guided DNA binding function—and instead fusing a FokI domain to the deactivated Cas9; see, e.g., Tsai et al., *Nature Biotech* 32: 569-76 (2014); and Guilinger et al., *Nature Biotech.* 32: 577-82 (2014). Because FokI must dimerize to become catalytically active, two guide RNAs are required to tether two Cas9-FokI fusions in close proximity to form the dimer and cleave DNA. This essentially doubles the number of bases in the combined target sites, thereby increasing the stringency of targeting by CRISPR-based systems.

As further example, fusion of the TALE DNA binding domain to a catalytically active HE, such as I-TevI, takes advantage of both the tunable DNA binding and specificity of the TALE, as well as the cleavage sequence specificity of I-TevI, with the expectation that off-target cleavage may be further reduced.

Methods and Compositions of the Invention

Accordingly, the present disclosure relates in particular to the following non-limiting inventions: In a first method, Method 1, the present disclosure provides a method for editing the SERPINA1 gene in a human cell by genome editing, the method comprising the step of introducing into the human cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in a permanent deletion, insertion, or correction or modulation of expression or function of one or more mutations or exons within or near or affecting the expression or function of the SERPINA1 gene or other DNA sequences that encode regulatory elements of the SERPINA1 gene and restoration of alpha-1-antitrypsin (AAT) protein activity.

In another method, Method 2, the present disclosure provides a method for inserting a SERPINA1 gene in a human cell by genome editing, the method comprising introducing into the human cell one or more deoxyribonucleic acid (DNA) endonucleases to effect one or more single-strand breaks (SSBs) or double-strand breaks (DSBs) within or near a safe harbor locus that results in a permanent insertion of the SERPINA1 gene or minigene, and results in restoration of AAT activity.

In another method, Method 3, the present disclosure provides an ex vivo method for treating a patient with alpha-1 antitrypsin deficiency (AATD) comprising the steps of: i) creating a patient specific induced pluripotent stem cell (iPSC); ii) editing within or near a SERPINA1 gene or other DNA sequences that encode regulatory elements of the SERPINA1 gene of the iPSC, or within or near a safe harbor locus of the iPSC; iii) differentiating the genome edited iPSC into a hepatocyte; and iv) implanting the hepatocyte into the patient.

In another method, Method 4, the present disclosure provides the method of Method 3, wherein the creating step comprises: a) isolating a somatic cell from the patient; and b) introducing a set of pluripotency-associated genes into the somatic cell to induce the somatic cell to become a pluripotent stem cell.

In another method, Method 5, the present disclosure provides the method of Method 4, wherein the somatic cell is a fibroblast.

In another method, Method 6, the present disclosure provides the method of Method 4, wherein the set of pluripotency-associated genes is one or more of the genes selected from the group consisting of OCT4, SOX2, KLF4, Lin28, NANOG and cMYC.

In another method, Method 7, the present disclosure provides the method of any one of Methods 3-6, wherein the editing step comprises introducing into the iPSC one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent deletion, insertion, or correction or modulation of expression or function of one or more mutations or exons within or near or affecting the expression or function of the SERPINA1 gene or other DNA sequences that encode regulatory elements of the SERPINA1 gene, or within or near a safe harbor locus that results in permanent insertion of the SERPINA1 or minigene, and restoration of alpha-1-antitrypsin (AAT) protein activity.

In another method, Method 8, the present disclosure provides the method of Method 7, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another method, Method 9, the present disclosure provides the method of any one of Methods 3-8, wherein the differentiating step comprises one or more of the following to differentiate the genome edited iPSC into a hepatocyte: contacting the genome edited iPSC with one or more of activin, B27 supplement, FGF4, HGF, BMP2, BMP4, Oncostatin M, Dexametason.

In another method, Method 10, the present disclosure provides the method of any one of Methods 3-9, wherein the implanting step comprises implanting the hepatocyte into the patient by transplantation, local injection, or systemic infusion, or combinations thereof.

In another method, Method 11, the present disclosure provides an ex vivo method for treating a patient with alpha-1 antitrypsin deficiency (AATD), the method comprising the steps of: i) performing a biopsy of the patient's liver, ii) isolating a liver specific progenitor cell or primary hepatocyte; iii) editing within or near the SERPINA1 gene or other DNA sequences that encode regulatory elements of the SERPINA1 gene of the progenitor cell or primary hepatocyte or editing within or near a safe harbor locus of the progenitor cell or primary hepatocyte; and iv) implanting the genome-edited progenitor cell or primary hepatocyte into the patient.

In another method, Method 12, the present disclosure provides the method of Method 11, wherein the isolating step comprises: perfusion of fresh liver tissues with digestion enzymes, cell differential centrifugation, cell culturing, and combinations thereof.

In another method, Method 13, the present disclosure provides the method of any one of Methods 11-12, wherein the editing step comprises introducing into the progenitor cell or primary hepatocyte one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in a permanent deletion, insertion, correction, or modulation of expression or function of one or more mutations or exons within or near or affecting the expression or function the SERPINA1 gene or other DNA sequences that encode regulatory elements of the SERPINA1 gene, or within or near a safe harbor locus that results in permanent insertion of the SERPINA1 gene or minigene, and restoration of alpha-1-antitrypsin (AAT) protein activity.

In another method, Method 14, the present disclosure provides the method of Method 13, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another method, Method 15, the present disclosure provides the method of any one of Methods 11-14, wherein the implanting step comprises implanting the genome-edited progenitor cell or primary hepatocyte into the patient by transplantation, local injection, or systemic infusion, or combinations thereof.

In another method, Method 16, the present disclosure provides an ex vivo method for treating a patient with alpha-1 antitrypsin deficiency (AATD), the method comprising the steps of: i) performing a biopsy of the patients bone marrow; ii) isolating a mesenchymal stem cell from the patient; iii) editing within or near the SERPINA1 gene or other DNA sequences that encode regulatory elements of the SERPINA1 gene of the mesenchymal stem cell or editing within or near a safe harbor locus of the mesenchymal stem cell; iv) differentiating the genome-edited mesenchymal stem cell into a hepatocyte; and v) implanting the hepatocyte into the patient.

In another method, Method 17, the present disclosure provides the method of Method 16, wherein the mesenchymal stem cell is isolated from the patient's bone marrow or peripheral blood.

In another method, Method 18, the present disclosure provides the method of Method 16, wherein the isolating step comprises: aspiration of bone marrow and isolation of mesenchymal cells by density centrifugation using Percoll™.

In another method, Method 19, the present disclosure provides the method of any one of Methods 16-18, wherein the editing step comprises introducing into the mesenchymal stem cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent deletion, insertion, correction, or modulation of expression or function of one or more mutations or exons within or near or affecting the expression or function of the SERPINA1 gene or other DNA sequences that encode regulatory elements of the SERPINA1 gene, or within or near a safe harbor locus that results in permanent insertion of the SERPINA1 gene or minigene, and restoration of alpha-1-antitrypsin (AAT) protein activity.

In another method, Method 20, the present disclosure provides the method of Method 19, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another method, Method 21, the present disclosure provides the method of any one of Methods 16-19, wherein the differentiating step comprises one or more of the following to differentiate the genome edited stem cell into a hepatocyte: contacting the genome edited mesenchymal stem cell with one or more of insulin, transferrin, FGF4, HGF, or bile acids.

In another method, Method 22, the present disclosure provides the method of any one of Methods 16-21, wherein the implanting step comprises implanting the hepatocyte into the patient by transplantation, local injection, or systemic infusion, or combinations thereof.

In another method, Method 23, the present disclosure provides an in vivo method for treating a patient with alpha-1 antitrypsin deficiency (AATD), the method comprising the step of editing the SERPINA1 gene in a cell of the patient, or other DNA sequences that encode regulatory elements of the SERPINA1 gene, or editing within or near a safe harbor locus in a cell of the patient.

In another method, Method 24, the present disclosure provides the method of Method 23, wherein the editing step comprises introducing into the cell one or more deoxyribonucleic acid (DNA) endonucleases to effect one or more single-strand breaks (SSBs) or double-strand breaks (DSBs) within or near the SERPINA1 gene or other DNA sequences that encode regulatory elements of the SERPINA1 gene that results in permanent deletion, insertion, or correction or modulation of one or more mutations or exons within or near the SERPINA1 gene or other DNA sequences that encode regulatory elements of the SERPINA1 gene, or within or near a safe harbor locus that results in permanent insertion of the SERPINA1 gene or minigene, and restoration of alpha-1-antitrypsin (AAT) protein activity.

In another method, Method 25, the present disclosure provides the method of any one of Methods 1, 2, 7, 13, 19, or 24, wherein the one or more DNA endonucleases is a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; or a homolog thereof, recombination of the naturally occurring molecule, codon-optimized, or modified version thereof, and combinations thereof.

In another method, Method 26, the present disclosure provides the method of Method 25, wherein the method comprises introducing into the cell one or more polynucleotides encoding the one or more DNA endonucleases.

In another method, Method 27, the present disclosure provides the method of Method 25, wherein the method comprises introducing into the cell one or more ribonucleic acids (RNAs) encoding the one or more DNA endonucleases.

In another method, Method 28, the present disclosure provides the method of any one of Methods 26 or 27, wherein the one or more polynucleotides or one or more RNAs is one or more modified polynucleotides or one or more modified RNAs, the present disclosure provides the method of In another method, Method 29, the present disclosure provides the method of Method 26, wherein the DNA endonuclease is a protein or polypeptide.

In another method, Method 30, the present disclosure provides the method of The method of any one of the preceding Methods, wherein the method further comprises introducing into the cell one or more guide ribonucleic acids (gRNAs).

In another method, Method 31, the present disclosure provides the method of Method 30, wherein the one or more gRNAs are single-molecule guide RNA (sgRNAs).

In another method, Method 32, the present disclosure provides the method of any one of Methods 30-31, wherein the one or more gRNAs or one or more sgRNAs is one or more modified gRNAs or one or more modified sgRNAs.

In another method, Method 33, the present disclosure provides the method of any one of Methods 30-32, wherein the one or more DNA endonucleases is pre-complexed with one or more gRNAs or one or more sgRNAs.

In another method, Method 34, the present disclosure provides the method of The method of any one of the preceding Methods, wherein the method further comprises introducing into the cell a polynucleotide donor template comprising at least a portion of the wild-type SERPINA1 gene or minigene or cDNA.

In another method, Method 35, the present disclosure provides the method of Method 34, wherein the at least a portion of the wild-type SERPINA1 gene or minigene or cDNA is exon 1, exon 2, exon 3, exon 4, exon 5, intronic regions, fragments or combinations thereof, the entire SERPINA1 gene, DNA sequences that encode wild type regulatory elements of the SERPINA1 gene, minigene or cDNA.

In another method, Method 36, the present disclosure provides the method of any one of Methods 34-35, wherein the donor template is either a single or double stranded polynucleotide.

In another method, Method 37, the present disclosure provides the method of any one of Methods 34-36, wherein the donor template has homologous arms to the 14q32.13 region.

In another method, Method 38, the present disclosure provides the method of any one of Methods 1, 2, 7, 13, 19, or 24, wherein the method further comprises introducing into the cell one guide ribonucleic acid (gRNA) and a polynucleotide donor template comprising at least a portion of the wild-type SERPINA1 gene, and wherein the one or more DNA endonucleases is one or more Cas9 endonucleases that effect one double-strand break (DSB) at a DSB locus within or near the SERPINA1 gene or other DNA sequences that encode regulatory elements of the SERPINA1 gene, or within or near a safe harbor locus that facilitates insertion of a new sequence from the polynucleotide donor template into the chromosomal DNA at the locus or safe harbor locus that results in permanent insertion or correction of a part of the chromosomal DNA of the SERPINA1 gene or other DNA sequences that encode regulatory elements of the SERPINA1 gene proximal to the locus or safe harbor locus and restoration of AAT protein activity, and wherein the gRNA comprises a spacer sequence that is complementary to a segment of the locus or safe harbor locus.

In another method, Method 39, the present disclosure provides the method of Method 38, wherein proximal means nucleotides both upstream and downstream of the locus or safe harbor locus.

In another method, Method 40, the present disclosure provides the method of any one of Methods 1, 2, 7, 13, 19, or 24, wherein the method further comprises introducing into the cell two guide ribonucleic acid (gRNAs) and a polynucleotide donor template comprising at least a portion of the wild-type SERPINA1 gene, and wherein the one or more DNA endonucleases is two or more Cas9 endonucleases that effect a pair of double-strand breaks (DSBs), the first at a 5' DSB locus and the second at a 3' DSB locus, within or near the SERPINA1 gene or other DNA sequences that encode regulatory elements of the SERPINA1 gene, or within or near a safe harbor locus that facilitates insertion of a new sequence from the polynucleotide donor template into the chromosomal DNA between the 5' DSB locus and the 3' DSB locus that results in permanent insertion or correction of the chromosomal DNA between the 5' DSB locus and the 3' DSB locus within or near the SERPINA1 gene or other DNA sequences that encode regulatory elements of the SERPINA1 gene, or within or near a safe harbor locus and restoration of AAT protein activity, and wherein the first guide RNA comprises a spacer sequence that is complementary to a segment of the 5' DSB locus and the second guide RNA comprises a spacer sequence that is complementary to a segment of the 3' DSB locus.

In another method, Method 41, the present disclosure provides the method of any one of Methods 38-40, wherein the one or two gRNAs are one or two single-molecule guide RNA (sgRNAs).

In another method, Method 42, the present disclosure provides the method of any one of Methods 38-41, wherein the one or two gRNAs or one or two sgRNAs is one or two modified gRNAs or one or two modified sgRNAs.

In another method, Method 43, the present disclosure provides the method of any one of Methods 38-42, wherein the one or more DNA endonucleases is pre-complexed with one or two gRNAs or one or two sgRNAs.

In another method, Method 44, the present disclosure provides the method of any one of Methods 38-43, wherein the at least a portion of the wild-type SERPINA1 gene or minigene or cDNA is exon 1, exon 2, exon 3, exon 4, exon 5, intronic regions, fragments or combinations thereof, the entire SERPINA1 gene, DNA sequences that encode wild-type regulatory elements of the SERPINA1 gene, minigene, or cDNA.

In another method, Method 45, the present disclosure provides the method of any one of Methods 38-44, wherein the donor template is either a single or double stranded polynucleotide.

In another method, Method 46, the present disclosure provides the method of any one of Methods 38-45, wherein the donor template has homologous arms to the 14q32.13 region.

In another method, Method 47, the present disclosure provides the method of Method 44, wherein the DSB, or 5' DSB and 3' DSB are in the first, second, third, fourth, fifth exon or intron, SERPINA1 gene.

In another method, Method 48, the present disclosure provides the method of any one of Methods 1, 2, 7, 13, 19, 24, 30-33, or 38-41, wherein the gRNA or sgRNA is directed to one or more of the following pathological variants:

rs764325655, rs121912713, rs28929474, rs17580, rs121912714, rs764220898, rs199422211, rs751235320, rs199422210, rs267606950, rs55819880, rs28931570.

In another method, Method 49, the present disclosure provides the method of any one of Methods 1, 2, 7, 13, 19, or 24-48, wherein the insertion or correction is by homology directed repair (HDR).

In another method, Method 50, the present disclosure provides the method of any one of Methods 1, 2, 7, 13, 19, or 24, wherein the method further comprises introducing into the cell two guide ribonucleic acid (gRNAs), and wherein the one or more DNA endonucleases is two or more Cas9 endonucleases that effect a pair of double-strand breaks (DSBs), the first at a 5' DSB locus and the second at a 3' DSB locus, within or near the SERPINA1 gene that causes a deletion of the chromosomal DNA between the 5' DSB locus and the 3' DSB locus that results in permanent deletion of the chromosomal DNA between the 5' DSB locus and the 3' DSB locus within or near the SERPINA1 gene and restoration of AAT protein activity, and wherein the first guide RNA comprises a spacer sequence that is complementary to a segment of the 5' DSB locus and the second guide RNA comprises a spacer sequence that is complementary to a segment of the 3' DSB locus.

In another method, Method 51, the present disclosure provides the method of Method 50, wherein the two gRNAs are two single-molecule guide RNA (sgRNAs).

In another method, Method 52, the present disclosure provides the method of any one of Methods 50-51, wherein the two gRNAs or two sgRNAs are two modified gRNAs or two modified sgRNAs.

In another method, Method 53, the present disclosure provides the method of any one of Methods 50-52, wherein the one or more DNA endonucleases is pre-complexed with one or two gRNAs or one or two sgRNAs.

In another method, Method 54, the present disclosure provides the method of any one of Methods 50-53, wherein both the 5' DSB and 3' DSB are in or near either the first exon, second exon, third exon, fourth exon or fifth exon of the SERPINA1 gene.

In another method, Method 55, the present disclosure provides the method of any one of Method 50-54, wherein the deletion is a deletion of 1 kb or less.

In another method, Method 56, the present disclosure provides the method of any one of Methods 1, 2, 7, 13, or 19-55, wherein the Cas9 or Cpf1 mRNA, gRNA, and a donor template are either each formulated into separate lipid nanoparticles or all co-formulated into a lipid nanoparticle.

In another method, Method 57, the present disclosure provides the method of any one of Methods 1, 6, 11, 15 or 19-55, wherein the Cas9 or Cpf1 mRNA is formulated into a lipid nanoparticle, and both the gRNA and donor template are delivered by a viral vector.

In another method, Method 58, the present disclosure provides the method of Method 57, wherein the viral vector is an adeno-associated virus (AAV).

In another method, Method 59, the present disclosure provides the method of Method 58, wherein the AAV vector is an AAV6 vector.

In another method, Method 60, the present disclosure provides the method of any one of Methods 1, 2, 7, 13, 19 or 24-55, wherein the Cas9 or Cpf1 mRNA, gRNA and a donor template are either each formulated into separate exosomes or all co-formulated into an exosome.

In another method, Method 61, the present disclosure provides the method of any one of Methods 1, 2, 7, 13, 19 or 24-55, wherein the Cas9 or Cpf1 mRNA is formulated into a lipid nanoparticle, and the gRNA is delivered to the cell by electroporation and donor template is delivered to the cell by a viral vector, the present disclosure provides the method of In another method, Method 62, the present disclosure provides the method of Method 61, wherein the viral vector is an adeno-associated virus (AAV) vector.

In another method, Method 63, the present disclosure provides the method of Method 62, wherein the AAV vector is an AAV6 vector.

In another method, Method 64, the present disclosure provides the method of any one of the preceding Methods, wherein the SERPINA1 gene is located on Chromosome 14: 1,493,319-1,507,264 (Genome Reference Consortium—GRCh38/hg38).

In another method, Method 65, the present disclosure provides the method of any one of Methods 1, 2, 7, 13, 19 or 24-55, wherein the restoration of AAT protein activity is compared to wild-type or normal AAT protein activity.

In another method, Method 66, the present disclosure provides the method of Method 1, wherein the human cell is a liver cell.

In another method, Method 67, the present disclosure provides the method of Method 23, wherein the cell is a liver cell.

In another method, Method 68, the present disclosure provides the method of any one of Methods 1, 2, 7, 13, 19 or 24-55, wherein the SERPINA1 gene is operably linked to an exogenous promoter that drives expression of the SERPINA1 gene.

In another method, Method 69, the present disclosure provides the method of any one of Methods 1, 2, 7, 13, 19 or 24-55, wherein the one or more DSBs occurs at a location immediately 3' to an endogenous promoter locus.

The present disclosure also provides a composition, Composition 1, of one or more guide ribonucleic acids (gRNAs) for editing a SERPINA1 gene in a cell from a patient with alpha-1 antitrypsin deficiency (AATD), the one or more gRNAs comprising a spacer sequence selected from the group consisting of the nucleic acid sequences in SEQ ID NOs: 54,860-68,297 for editing the SERPINA1 gene in a cell from a patient with alpha-1 antitrypsin deficiency.

In another composition, Composition 2, the present disclosure provides the composition of Composition 1, wherein the one or more gRNAs are one or more single-molecule guide RNAs (sgRNAs).

In another composition, Composition 3, the present disclosure provides the composition of Composition 1 or Composition 2, wherein the one or more gRNAs or one or more sgRNAs is one or more modified gRNAs or one or more modified sgRNAs.

In another composition, Composition 4, the present disclosure provides the composition of Composition 1 or Composition 2 or Composition 3, wherein the cell is a liver cell.

The present disclosure also provides a composition, Composition 5, of one or more guide ribonucleic acids (gRNAs) for editing a safe harbor locus in a cell from a patient with alpha-1 antitrypsin deficiency (AATD), the one or more gRNAs comprising a spacer sequence selected from the group consisting of the nucleic acid sequences in SEQ ID NOs: 1-54,859 for editing the safe harbor locus in a cell from a patient with alpha-1 antitrypsin deficiency, wherein the safe harbor locus is selected from the group consisting of AAVS1 (PPP1R12C), ALB, Angptl3, ApoC3, ASGR2, CCR5, FIX (F9), G6PC, Gys2, HGD, Lp(a), Pcsk9, Serpina1, TF, and TTR.

In another composition, Composition 6, the present disclosure provides the composition of Composition 5, wherein the one or more gRNAs are one or more single-molecule guide RNAs (sgRNAs).

In another composition, Composition 7, the present disclosure provides the composition of Composition 5 or Composition 6, wherein the one or more gRNAs or one or more sgRNAs is one or more modified gRNAs or one or more modified sgRNAs.

In another composition, Composition 8, the present disclosure provides the composition of Composition 5 or Composition 6 or Composition 7, wherein the cell is a liver cell.

Definitions

The term "comprising" or "comprises" is used in reference to compositions, methods, and respective component (s) thereof, that are essential to the invention, yet open to the inclusion of unspecified elements, whether essential or not.

The term "consisting essentially of" refers to those elements required for a given embodiment. The term permits the presence of additional elements that do not materially affect the basic and novel or functional characteristic(s) of that embodiment of the invention.

The term "consisting of" refers to compositions, methods, and respective components thereof as described herein, which are exclusive of any element not recited in that description of the embodiment.

The singular forms "a," "an," and "the" include plural references, unless the context clearly dictates otherwise.

Certain numerical values presented herein are preceded by the term "about." The term "about" is used to provide literal support for the numerical value the term "about" precedes, as well as a numerical value that is approximately the numerical value, that is the approximating unrecited numerical value may be a number which, in the context it is presented, is the substantial equivalent of the specifically recited numerical value. The term "about" means numerical values within ±10% of the recited numerical value.

When a range of numerical values is presented herein, it is contemplated that each intervening value between the lower and upper limit of the range, the values that are the upper and lower limits of the range, and all stated values with the range are encompassed within the disclosure. All the possible sub-ranges within the lower and upper limits of the range are also contemplated by the disclosure.

EXAMPLES

The invention will be more fully understood by reference to the following examples, which provide illustrative non-limiting embodiments of the invention.

The examples describe the use of the CRISPR system as an illustrative genome editing technique to create defined therapeutic genomic replacements, termed "genomic modifications" herein, in the SERPINA1 gene that lead to permanent correction of mutations in the genomic locus, or expression at a heterologous locus, that restore AAT protein activity. Introduction of the defined therapeutic modifications represents a novel therapeutic strategy for the potential amelioration of AATD, as described and illustrated herein.

Example 1—CRISPR/SpCas9 Target Sites for the SERPINA1 Gene (Other than as a Safe Harbor Locus)

Regions of the SERPINA1 gene were scanned for target sites. Each area was scanned for a protospacer adjacent motif (PAM) having the sequence NRG. gRNA 20 bp spacer sequences corresponding to the PAM were identified, as shown in SEQ ID NOs: 54,860-61,324.

Example 2—CRISPR/SaCas9 Target Sites for the SERPINA1 Gene (Other than as a Safe Harbor Locus)

Regions of the SERPINA1 gene were scanned for target sites. Each area was scanned for a protospacer adjacent motif (PAM) having the sequence NNGRRT. gRNA 20 bp spacer sequences corresponding to the PAM were identified, as shown in SEQ ID NOs: 61,324-61,936.

Example 3—CRISPR/StCas9 Target Sites for the SERPINA1 Gene (Other than as a Safe Harbor Locus)

Regions of the SERPINA1 gene were scanned for target sites. Each area was scanned for a protospacer adjacent motif (PAM) having the sequence NNAGAAW. gRNA 20 bp spacer sequences corresponding to the PAM were identified, as shown in SEQ ID NOs: 61,937-62,069.

Example 4—CRISPR/TdCas9 Target Sites for the SERPINA1 Gene (Other than as a Safe Harbor Locus)

Regions of the SERPINA1 gene were scanned for target sites. Each area was scanned for a protospacer adjacent motif (PAM) having the sequence NAAAAC. gRNA 20 bp spacer sequences corresponding to the PAM were identified, as shown in SEQ ID NOs: 69,070-62,120.

Example 5—CRISPR/NmCas9 Target Sites for the SERPINA1 Gene (Other than as a Safe Harbor Locus)

Regions of the SERPINA1 gene were scanned for target sites. Each area was scanned for a protospacer adjacent motif (PAM) having the sequence NNNNGHTT. gRNA 20 bp spacer sequences corresponding to the PAM were identified, as shown in SEQ ID NOs: 62,121-62,563.

Example 6—CRISPR/Cpf1 Target Sites for the SERPINA1 Gene (Other than as a Safe Harbor Locus)

Regions of the SERPINA1 gene were scanned for target sites. Each area was scanned for a protospacer adjacent motif (PAM) having the sequence YTN. gRNA 22 bp spacer sequences corresponding to the PAM were identified, as shown in SEQ ID NOs: 62,564-68,297.

Example 7—CRISPR/SpCas9 Target Sites for Safe Harbor Loci

The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence NRG. gRNA 20 bp spacer sequences corresponding to the PAM were identified, as shown in the following sequences: AAVS1 (PPP1R12C): SEQ ID NOs. 1-2,032; ALB: SEQ ID NOs. 3,482-3,649; Angptl3: SEQ ID NOs. 4,104-4,448; ApoC3: SEQ ID NOs. 5,432-5,834; ASGR2: SEQ ID NOs. 6,109-7,876; CCR5: SEQ ID NOs. 9,642-9,844; FIX (F9): SEQ ID NOs. 10,221-11,686; G6PC: SEQ ID NOs. 14,230-15,245; Gys2: SEQ ID NOs. 16,581-22,073; HGD: SEQ ID NOs. 32,254-33,946; Lp(a): SEQ ID NOs. 36,789-40,583; Pcsk9: SEQ ID NOs. 46,154-48,173; Serpina1: SEQ ID NOs. 50,345-51,482; TF: SEQ ID NOs. 52,446-53,277; and TTR: SEQ ID NOs. 54,063-54,362.

Example 8—CRISPR/SaCas9 Target Sites for Safe Harbor Loci

The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence NNGRRT. gRNA 20 bp spacer sequences corresponding to the PAM were identified, as shown in the following sequences: AAVS1 (PPP1R12C): SEQ ID NOs. 2,033-2,203; ALB: SEQ ID NOs. 3,650-3,677; Angptl3: SEQ ID NOs. 4,449-4,484; ApoC3: SEQ ID NOs. 5,835-5,859; ASGR2: SEQ ID NOs. 7,877-8,082; CCR5: SEQ ID NOs. 9,845-9,876; FIX (F9): SEQ ID NOs. 11,687-11,849; G6PC: SEQ ID NOs. 15,246-15,362; Gys2: SEQ ID NOs. 22,074-22,749; HGD: SEQ ID NOs. 33,947-34,160; Lp(a): SEQ ID NOs. 40,584-40,993; Pcsk9: SEQ ID NOs. 48,174-48,360; Serpina1: SEQ ID NOs. 51,483-51,575; TF: SEQ ID NOs. 53,278-53,363; and TTR: SEQ ID NOs. 54,363-54,403.

Example 9—CRISPR/StCas9 Target Sites for Safe Harbor Loci

The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence NNAGAAW. gRNA 20 bp spacer sequences corresponding to the PAM were identified, as shown in the following sequences: AAVS1 (PPP1R12C): SEQ ID NOs. 2,204-2,221; ALB: SEQ ID NOs. 3,678-3,695; Angptl3: SEQ ID NOs. 4,485-4,507; ApoC3: SEQ ID NOs. 5,860-5,862; ASGR2: SEQ ID NOs. 8,083-8,106; CCR5: SEQ ID NOs. 9,877-9,890; FIX (F9): SEQ ID NOs. 11,850-11,910; G6PC: SEQ ID NOs. 15,363-15,386; Gys2: SEQ ID NOs. 22,750-20,327; HGD: SEQ ID NOs. 34,161-34,243; Lp(a): SEQ ID NOs. 40,994-41,129; Pcsk9: SEQ ID NOs. 48,361-48,396; Serpina1: SEQ ID NOs. 51,576-51,587; TF: SEQ ID NOs. 53,364-53,375; and TTR: SEQ ID NOs. 54,404-54,420.

Example 10—CRISPR/TdCas9 Target Sites for Safe Harbor Loci

The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence NAAAAC. gRNA 20 bp spacer sequences corresponding to the PAM were identified, as shown in the following sequences: AAVS1 (PPP1R12C): SEQ ID NOs. 2,222-2,230; ALB: SEQ ID NOs. 3,696-3,700; Angptl3: SEQ ID NOs. 4,508-4,520; ApoC3: SEQ ID NOs. 5,863-5,864; ASGR2: SEQ ID NOs. 8,107-8,118; CCR5: SEQ ID NOs. 9,891-9,892; FIX (F9): SEQ ID NOs. 11,911-11,935; G6PC: SEQ ID NOs. 15,387-15,395; Gys2: SEQ ID NOs. 23,028-23,141; HGD: SEQ ID NOs. 34,244-34,262; Lp(a): SEQ ID NOs. 41,130-41,164; Pcsk9: SEQ ID NOs. 48,397-48,410; Serpina1: SEQ ID NOs. 51,588-51,590; TF: SEQ ID NOs. 53,376-53,382; and TTR: SEQ ID NOs. 54,421-54,422.

Example 11—CRISPR/NmCas9 Target Sites for Safe Harbor Loci

The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence NNNNGHTT. gRNA 20 bp spacer sequences corresponding to the PAM were identified, as shown in the following sequences: AAVS1 (PPP1R12C): SEQ ID NOs. 2,231-2,305; ALB: SEQ ID NOs. 3,701-3,724; Angptl3: SEQ ID NOs. 4,521-4,583; ApoC3: SEQ ID NOs. 5,865-5,876; ASGR2: SEQ ID NOs. 8,119-8,201; CCR5: SEQ ID NOs. 9,893-9,920; FIX (F9): SEQ ID NOs. 11,936-12,088; G6PC: SEQ ID NOs. 15,396-15,485; Gys2: SEQ ID NOs. 23,142-23,821; HGD: SEQ ID NOs. 34,263-34,463; Lp(a): SEQ ID NOs. 41,165-41,532; Pcsk9: SEQ ID NOs. 48,411-48,550; Serpina1: SEQ ID NOs. 51,591-51,641; TF: SEQ ID NOs. 53,383-53,426; and TTR: SEQ ID NOs. 54,423-54,457.

Example 12—CRISPR/Cpf1 Target Sites for Safe Harbor Loci

Exons 1-2 of the AAVS1 (PPP1R12C) gene were scanned for target sites. The following safe harbor loci were scanned for target sites: Exons 1-2 of AAVS1 (PPP1R12C), Exons 1-2 of ALB, Exons 1-2 of Angptl3, Exons 1-2 of ApoC3, Exons 1-2 of ASGR2, Exons 1-2 of CCR5, Exons 1-2 of FIX (F9), Exons 1-2 of G6PC, Exons 1-2 of Gys2, Exons 1-2 of HGD, Exons 1-2 of Lp(a), Exons 1-2 of Pcsk9, Exons 1-2 of Serpina1, Exons 1-2 of TF, and Exons 1-2 of TTR. Each area was scanned for a protospacer adjacent motif (PAM) having the sequence YTN. gRNA 22 bp spacer sequences corresponding to the PAM were identified, as shown in the following sequences: AAVS1 (PPP1R12C): SEQ ID NOs. 2,306-3,481; ALB: SEQ ID NOs. 3,725-4,103; Angptl3: SEQ ID NOs. 4,584-5,431; ApoC3: SEQ ID NOs. 5,877-6,108; ASGR2: SEQ ID NOs. 8,202-9,641; CCR5: SEQ ID NOs. 9,921-10,220; FIX (F9): SEQ ID NOs. 12,089-14,229; G6PC: SEQ ID NOs. 15,486-16,580; Gys2: SEQ ID NOs. 23,822-32,253; HGD: SEQ ID NOs. 34,464-36,788; Lp(a): SEQ ID NOs. 41,533-46,153; Pcsk9: SEQ ID NOs. 48,551-

50,344; Serpina1: SEQ ID NOs. 51,642-52,445; TF: SEQ ID NOs. 53,427-54,062; and TTR: SEQ ID NOs. 54,458-54,859.

Example 13—Bioinformatics Analysis of the Guide Strands

Candidate guides will be screened and selected in a multi-step process that involves both theoretical binding and experimentally assessed activity. By way of illustration, candidate guides having sequences that match a particular on-target site, such as a site within the SERPINA1 gene, with adjacent PAM can be assessed for their potential to cleave at off-target sites having similar sequences, using one or more of a variety of bioinformatics tools available for assessing off-target binding, as described and illustrated in more detail below, in order to assess the likelihood of effects at chromosomal positions other than those intended. Candidates predicted to have relatively lower potential for off-target activity can then be assessed experimentally to measure their on-target activity, and then off-target activities at various sites. Preferred guides have sufficiently high on-target activity to achieve desired levels of gene editing at the selected locus, and relatively lower off-target activity to reduce the likelihood of alterations at other chromosomal loci. The ratio of on-target to off-target activity is often referred to as the "specificity" of a guide.

For initial screening of predicted off-target activities, there are a number of bioinformatics tools known and publicly available that can be used to predict the most likely off-target sites; and since binding to target sites in the CRISPR/Cas9/Cpf1 nuclease system is driven by Watson-Crick base pairing between complementary sequences, the degree of dissimilarity (and therefore reduced potential for off-target binding) is essentially related to primary sequence differences: mismatches and bulges, i.e. bases that are changed to a non-complementary base, and insertions or deletions of bases in the potential off-target site relative to the target site. An exemplary bioinformatics tool called COSMID (CRISPR Off-target Sites with Mismatches, Insertions and Deletions) (available on the web at crispr.bme.gatech.edu) compiles such similarities. Other bioinformatics tools include, but are not limited to, GUIDO, autoCOSMID, and CCtop.

Bioinformatics were used to minimize off-target cleavage in order to reduce the detrimental effects of mutations and chromosomal rearrangements. Studies on CRISPR/Cas9 systems suggested the possibility of high off-target activity due to nonspecific hybridization of the guide strand to DNA sequences with base pair mismatches and/or bulges, particularly at positions distal from the PAM region. Therefore, it is important to have a bioinformatics tool that can identify potential off-target sites that have insertions and/or deletions between the RNA guide strand and genomic sequences, in addition to base-pair mismatches. The bioinformatics-based tool, COSMID (CRISPR Off-target Sites with Mismatches, Insertions and Deletions) was therefore used to search genomes for potential CRISPR off-target sites (available on the web at crispr.bme.gatech.edu). COSMID output ranked lists of the potential off-target sites based on the number and location of mismatches, allowing more informed choice of target sites, and avoiding the use of sites with more likely off-target cleavage.

Additional bioinformatics pipelines were employed that weigh the estimated on- and/or off-target activity of gRNA targeting sites in a region. Other features that may be used to predict activity include information about the cell type in question, DNA accessibility, chromatin state, transcription factor binding sites, transcription factor binding data, and other CHIP-seq data. Additional factors are weighed that predict editing efficiency, such as relative positions and directions of pairs of gRNAs, local sequence features and micro-homologies.

Example 14—Testing of Preferred Guides in Cells for On-Target Activity

The gRNAs predicted to have the lowest off target activity will then be tested for on-target activity in a model cell line, such as Huh-7 cells, and evaluated for indel frequency using TIDE or next generation sequencing. TIDE is a web tool to rapidly assess genome editing by CRISPR-Cas9 of a target locus determined by a guide RNA (gRNA or sgRNA). Based on the quantitative sequence trace data from two standard capillary sequencing reactions, the TIDE software quantifies the editing efficacy and identifies the predominant types of insertions and deletions (indels) in the DNA of a targeted cell pool. See Brinkman et al, Nucl. Acids Res. (2014) for a detailed explanation and examples. Next-generation sequencing (NGS), also known as high-throughput sequencing, is the catch-all term used to describe a number of different modern sequencing technologies including: Illumina (Solexa) sequencing, Roche 454 sequencing, Ion torrent: Proton/PGM sequencing, and SOLiD sequencing. These recent technologies allow one to sequence DNA and RNA much more quickly and cheaply than the previously used Sanger sequencing, and as such have revolutionized the study of genomics and molecular biology.

Transfection of tissue culture cells, allows screening of different constructs and a robust means of testing activity and specificity. Tissue culture cell lines, such as Huh-7 cells, are easily transfected and result in high activity. These or other cell lines will be evaluated to determine the cell lines that provide the best surrogate. These cells will then be used for many early stage tests. For example, individual gRNAs for *S. pyogenes* Cas9 will be transfected into the cells using plasmids, such as, for example, CTx-1, CTx-2, or CTx-3 described in FIG. 1A-1C, which are suitable for expression in human cells. Several days later, the genomic DNA is harvested and the target site amplified by PCR. The cutting activity can be measured by the rate of insertions, deletions and mutations introduced by NHEJ repair of the free DNA ends. Although this method cannot differentiate correctly repaired sequences from uncleaved DNA, the level of cutting can be gauged by the amount of mis-repair. Off-target activity can be observed by amplifying identified putative off-target sites and using similar methods to detect cleavage. Translocation can also be assayed using primers flanking cut sites, to determine if specific cutting and translocations happen. Un-guided assays have been developed allowing complementary testing of off-target cleavage including guide-seq. The gRNA or pairs of gRNA with significant activity can then be followed up in cultured cells to measure correction of SERPINA1 mutation. Off-target events can be followed again. These experiments allow optimization of nuclease and donor design and delivery.

Example 15—Testing of Preferred Guides in Cells for Off-Target Activity

The gRNAs having the best on-target activity from the TIDE and next generation sequencing studies in the above example will then be tested for off-target activity using whole genome sequencing.

Example 16—Testing Different Approaches for HDR Gene Editing

After testing the gRNAs for both on-target activity and off-target activity, the mutation correction and knock-in strategies will be tested for HDR gene editing.

For the mutation correction approach, the donor DNA template will be provided as a short single-stranded oligonucleotide, a short double-stranded oligonucleotide (PAM sequence intact/PAM sequence mutated), a long single-stranded DNA molecule (PAM sequence intact/PAM sequence mutated) or a long double-stranded DNA molecule (PAM sequence intact/PAM sequence mutated). In addition, the donor DNA template will be delivered by AAV.

For the cDNA knock-in approach, a single-stranded or double-stranded DNA having homologous arms to the 14q32.13 region may include more than 40 nt of the first exon (the first coding exon) of the SERPINA1 gene, the complete CDS of the SERPINA1 gene and 3'UTR of the SERPINA1 gene, and at least 40 nt of the following intron. The single-stranded or double-stranded DNA having homologous arms to the 14q32.13 region, which includes more than 80 nt of the first exon of the SERPINA1 gene, the complete CDS of the SERPINA1 gene and 3'UTR of the SERPINA1 gene, and at least 80 nt of the following intron. The single-stranded or double-stranded DNA having homologous arms to the 14q32.13 region may include more than 100 nt of the first exon of the SERPINA1 gene, the complete CDS of the SERPINA1 gene and 3'UTR of the SERPINA1 gene, and at least 100 nt of the following intron. The single-stranded or double-stranded DNA having homologous arms to the 14q32.13 region may include more than 150 nt of the first exon of the SERPINA1 gene, the complete CDS of the SERPINA1 gene and 3'UTR of the SERPINA1 gene, and at least 150 nt of the following intron. The single-stranded or double-stranded DNA having homologous arms to the 14q32.13 region may include more than 300 nt of the first exon of the SERPINA1 gene, the complete CDS of the SERPINA1 gene and 3'UTR of the SERPINA1 gene, and at least 300 nt of the following intron. The single-stranded or double-stranded DNA having homologous arms to the 14q32.13 region may include more than 400 nt of the first exon of the SERPINA1 gene, the complete CDS of the SERPINA1 gene and 3'UTR of the SERPINA1 gene, and at least 400 nt of the following the first intron. Alternatively, the DNA template will be delivered by AAV.

For the cDNA or minigene knock-in approach, a single-stranded or double-stranded DNA having homologous arms to the 14q32.13, which includes more than 80 nt of the second exon (the first coding exon) of the SERPINA1 gene, the complete CDS of the SERPINA1 gene and 3'UTR of the SERPINA1 gene, and at least 80 nt of the following intron. Alternatively, the DNA template will be delivered by AAV.

Next, the efficiency of HDR mediated correction of the common mutation of the PI Z allele of SERPINA1 and knock-in of cDNA minigene (comprised of, natural or synthetic enhancer and promoter, one or more exons, and natural or synthetic introns, and natural or synthetic 3'UTR and polyadenylation signal) into the $2^{nd}$ exon will be assessed.

Example 17—Re-Assessment of Lead CRISPR-Cas9/DNA Donor Combinations

After testing the different strategies for HDR gene editing, the lead CRISPR-Cas9/DNA donor combinations will be re-assessed in primary human hepatocytes for efficiency of deletion, recombination, and off-target specificity. Cas9 mRNA or RNP will be formulated into lipid nanoparticles for delivery, sgRNAs will be formulated into nanoparticles or delivered as AAV, and donor DNA will be formulated into nanoparticles or delivered as AAV.

Example 18—In Vivo Testing in Relevant Mouse Model

After the CRISPR-Cas9/DNA donor combinations have been re-assessed, the lead formulations will be tested in vivo in an animal model. Suitable animal models include, by way of non-limiting example, a FGR mouse model with the livers repopulated with human hepatocytes or iPSC derived hepatocytes (normal or AAT deficient).

Culture in human cells allows direct testing on the human target and the background human genome, as described above.

Preclinical efficacy and safety evaluations can be observed through engraftment of modified mouse or human hepatocytes in FGR mice. The modified cells can be observed in the months after engraftment.

Example 19—Screening of gRNAs

To identify a large spectrum of pairs of gRNAs able to edit the SERPINA1 DNA target region, an in vitro transcribed (IVT) gRNA screen was conducted. SERPINA1 genomic sequence was submitted for analysis using gRNA design software. The resulting list of gRNAs was narrowed to a list of about 200 gRNAs based on uniqueness of sequence—only gRNAs without a perfect match somewhere else in the genome were screened—and minimal predicted off targets. This set of gRNAs was transcribed in vitro and transfected using messenger Max into HEK293T cells that constitutively express Cas9. Cells were harvested 48 hours post transfection, the genomic DNA was isolated, and cutting efficiency was evaluated using TIDE analysis. The cutting efficiency of the gRNA (% indels) is listed in Table 4.

Figure 3:
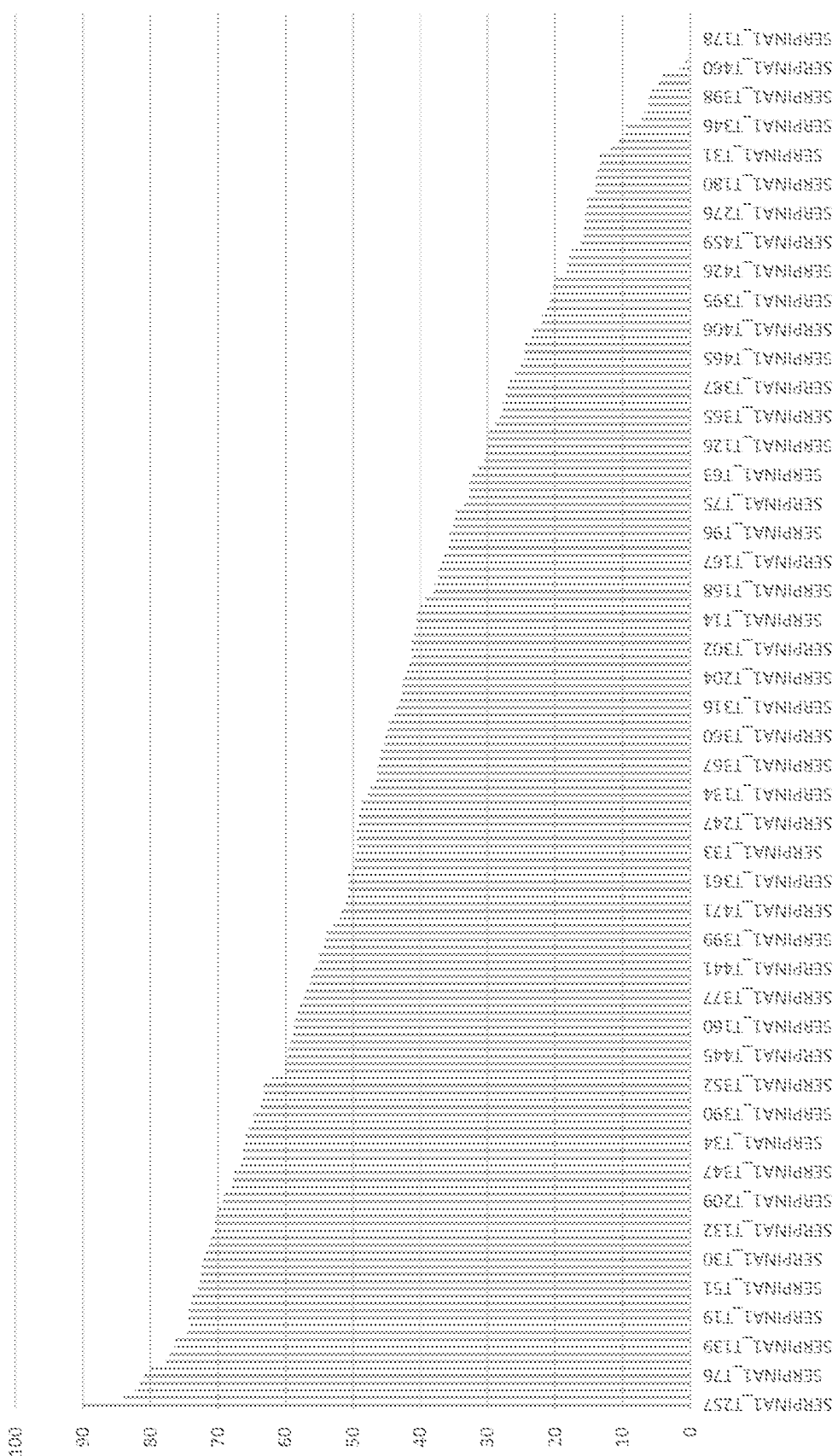
FIG. 3 is a graph depicting cutting efficiencies of gRNAs transcribed in vitro and transfected using messenger Max into HEK293T cells that constitutively express Cas9, as evaluated using TIDE analysis.

It was found that about 14% of the tested gRNAs induced cutting efficiencies over 70%. (FIG. 3).

TABLE 4 gRNA sequences and cutting efficiencies in HEK293T-Cas9 cells

| Guide Name | Guide Sequence | | % Indel |
|---|---|---|---|
| SERPINA1_T61 | CCCAATGTCTAGAAGGTCTT | (SEQ ID NO: 55, 783) | 70.3 |
| SFRPINA1_T37 | GCCCAATGTCTAGAAGGTCT | (SEQ ID NO: 55, 782) | 50.6 |
| SERPINA1_T185 | ATCAAGGCCCAATGTCTAGA | (SEQ ID NO: 55, 781) | 58.1 |

TABLE 4-continued gRNA sequences and cutting efficiencies
in HEK293T-Cas9 cells

| Guide Name | Guide Sequence | | % Indel |
|---|---|---|---|
| SERPINA1_T70 | GCCCAAGACCTTCTAGACAT | (SEQ ID NO: 60, 476) | 56.1 |
| SERPINA1_T88 | CCCAAGACCTTCTAGACATT | (SEQ ID NO: 60, 477) | 60 |
| SERPINA1_T162 | GTGTCAGTATGGATAAATCA | (SEQ ID NO: 55, 778) | 59.2 |
| SFRPINA1_T170 | CAAACCTTTCTGTGTCAGTA | (SEQ ID NO: 55, 776) | 7.1 |
| SERPINA1_T390 | TTATCCATACTGACACAGAA | (SEQ ID NO: 60, 480) | 64.7 |
| SERPINA1_T388 | CATACTGACACAGAAAGGTT | (SEQ ID NO: 60, 481) | 63.6 |
| SERPINA1_T283 | ATACTGACACAGAAAGGTTT | (SEQ ID NO: 60, 482) | 70.5 |
| SERPINA1_T282 | TTTGGGCTAAGTTGTTTCAA | (SEQ ID NO: 60, 485) | 40.5 |
| SERPINA1_T72 | CACCAAATCTCACAGATCGA | (SEQ ID NO: 55, 771) | 81.6 |
| SFRPINA1_T73 | CTCCTTCGATCTGTGAGATT | (SEQ ID NO: 60, 487) | 47.3 |
| SERPINA1_T259 | GCTAAAGATGACACTTATTT | (SEQ ID NO: 60, 490) | 73.9 |
| SERPINA1_T275 | CACTTATTTTGGAAAACTAA | (SEQ ID NO: 60, 492) | 0.6 |
| SERPINA1_T182 | ATGGAACTGCAGTTGTTCAT | (SEQ ID NO: 55, 764) | 52.8 |
| SERPINA1_T323 | AACAACTGCAGTTCCATGAA | (SEQ ID NO: 60, 494) | 66.2 |
| SERPINA1_T383 | CAAGATAATGCAGCCATTCA | (SEQ ID NO: 55, 762) | 50.7 |
| SERPINA1_T177 | CATGAATGGCTGCATTATCT | (SEQ ID NO: 60, 495) | 22 |
| SERPINA1_T280 | ATGAATGGCTGCATTATCTT | (SEQ ID NO: 60, 496) | 57.8 |
| SERPINA1_T244 | TGAATGGCTGCATTATCTTG | (SEQ ID NO: 60, 497) | 51.8 |
| SERPINA1_T66 | GGCTGCATTATCTTGGGGTC | (SEQ ID NO: 60, 498) | 18 |
| SERPINA1_T128 | GCTGCATTATCTTGGGGTCT | (SEQ ID NO: 60, 499) | 34.8 |
| 5FRPINA1_T385 | CACTGTGAAGGTCACTGCCA | (SEQ ID NO: 60, 504) | 50.8 |
| SERPINA1_T194 | CTCCTTGAGGACACGGACCC | (SEQ ID NO: 55, 756) | 15.2 |
| SERPINA1_T418 | TGCCAGGGTCCGTGTCCTCA | (SEQ ID NO: 60, 506) | 49.6 |
| SERPINA1_T59 | ACACGGCTTGAAGCTCCTTG | (SEQ ID NO: 55, 754) | 49.2 |
| SERPINA1_T257 | GCTCTCTCCTTTCTAGTACA | (SEQ ID NO: 55, 751) | 90.1 |
| SERPINA1_T13 | CTTCAAGCCGTGTACTAGAA | (SEQ ID NO: 60, 511) | 15.5 |
| SERPINA1_T291 | TACTAGAAAGGAGAGAGCCC | (SEQ ID NO: 60, 515) | 45.8 |
| SERPINA1_T431 | TAGAAAGGAGAGAGCCCTGG | (SEQ ID NO: 60, 517) | 60.1 |
| SERPINA1_T341 | TCACTCCACGTCTGCCTCCA | (SEQ ID NO: 55, 749) | 83.9 |
| SERPINA1_T471 | GTCACTCCACGTCTGCCTCC | (SEQ ID NO: 55, 748) | 51.7 |
| SERPINA1_T294 | GAGAGCCCTGGAGGCAGACG | (SEQ ID NO: 60, 519) | 44.8 |
| SERPINA1_T187 | TGCACCCACAACTCAGAACA | (SEQ ID NO: 55, 744) | 77.1 |
| SERPINA1_T92 | GTGCACCCACAACTCAGAAC | (SEQ ID NO: 55, 743) | 46.5 |
| SERPINA1_T314 | CTCTTCCCTGTTCTGAGTTG | (SEQ ID NO: 60, 522) | 27.8 |
| SERPINA1_T120 | AGTTGTGGGTGCACCTGAGC | (SEQ ID NO: 60, 526) | 10.6 |
| SERPINA1_T224 | GTTGTGGGTGCACCTGAGCA | (SEQ ID NO: 60, 527) | 72.5 |
| SERPINA1_T274 | TTGTGGGTGCACCTGAGCAG | (SEQ ID NO: 60, 528) | 39.8 |
| SERPINA1_T167 | AAGCGCCTCTCCCCCTGCTC | (SEQ ID NO: 55, 740) | 36.8 |

TABLE 4-continued gRNA sequences and cutting efficiencies in HEK293T-Cas9 cells

| Guide Name | Guide Sequence | % Indel |
|---|---|---|
| SERPINA1_T437 | TGTGGGTGCACCTGAGCAGG (SEQ ID NO: 60, 529) | 42.7 |
| SERPINA1_T81 | CAGGGGGAGAGGCGCTTGTC (SEQ ID NO: 60, 534) | 15.8 |
| SERPINA1_T168 | AGAGGCGCTTGTCAGGAAGA (SEQ ID NO: 60, 536) | 38 |
| SERPINA1_T336 | CTTGTCAGGAAGATGGACAG (SEQ ID NO: 60, 539) | 46 |
| SERPINA1_T360 | TTGTCAGGAAGATGGACAGA (SEQ ID NO: 60, 540) | 45.1 |
| SERPINA1_T405 | TGTCAGGAAGATGGACAGAG (SEQ ID NO: 60, 541) | 80.2 |
| SERPINA1_T379 | AAGGCTTTGGCTGATGGGGC (SEQ ID NO: 55, 737) | 17.5 |
| SERPINA1_T180 | CCTCAAGGCTTTGGCTGATG (SEQ ID NO: 55, 736) | 14 |
| SERPINA1_T135 | TCCTCAAGGCTTTGGCTGAT (SEQ ID NO: 55, 735) | 25.9 |
| SERPINA1_T197 | CTCCTCAAGGCTTTGGCTGA (SEQ ID NO: 55, 734) | 20.3 |
| SERPINA1_T345 | CTTGCTCCTCCTCAAGGCTT (SEQ ID NO: 55, 733) | 23.8 |
| SERPIN20_T150 | CCCCATCAGCCAAAGCCTTG (SEQ ID NO: 60, 547) | 34.9 |
| SERPINA1_T328 | CATCAGCCAAAGCCTTGAGG (SEQ ID NO: 60, 549) | 35.7 |
| SERPINA1_T138 | ATAGGCCTTGCTCCTCCTCA (SEQ ID NO: 55, 732) | 76.2 |
| SERPINA1_T348 | CAAAGCCTTGAGGAGGAGCA (SEQ ID NO: 60, 552) | 24.4 |
| SERPINA1_T176 | AGGAGCAAGGCCTATGTGAC (SEQ ID NO: 60, 554) | 32.7 |
| SERPINA1_T376 | CCTCTCCCTCCCTGTCACAT (SEQ ID NO: 55, 730) | 70.1 |
| SERPINA1_T308 | GGAGCAAGGCCTATGTGACA (SEQ ID NO: 60, 555) | 58.8 |
| SERPINA1_T181 | GCAAGGCCTATGTGACAGGG (SEQ ID NO: 60, 557) | 71 |
| SERPINA1_T265 | CAAGGCCTATGTGACAGGGA (SEQ ID NO: 60, 558) | 44.6 |
| SERPINA1_T465 | CCTATGTGACAGGGAGGGAG (SEQ ID NO: 60, 561) | 24.5 |
| SERPINA1_T392 | CAGGGAGGGAGAGGATGTGC (SEQ ID NO: 60, 563) | 26.9 |
| SERPINA1_T372 | AGGGAGGGAGAGGATGTGCA (SEQ ID NO: 60, 564) | 74.3 |
| SERPINA1_T459 | GGGAGAGGATGTGCAGGGCC (SEQ ID NO: 60, 566) | 16. |
| SERPINA1_T444 | GGAGAGGATGTGCAGGGCCA (SEQ ID NO: 60, 567) | 32.7 |
| SERPINA1_T113 | TCACTCCCCCTGGACGGCCC (SEQ ID NO: 55, 728) | 9.7 |
| SERPINA1_T253 | GTGCAGGGCCAGGGCCGTCC (SEQ ID NO: 60, 569) | 67.9 |
| SERPINA1_T312 | TGCAGGGCCAGGGCCGTCCA (SEQ ID NO: 60, 570) | 63.7 |
| SERPINA1_T445 | GCAGGGCCAGGGCCGTCCAG (SEQ ID NO: 60, 571) | 59.7 |
| SERPINA1_T441 | CAGGGCCAGGGCCGTCCAGG (SEQ ID NO: 60, 572) | 55.8 |
| SERPINA1_T51 | AAGCGCTCACTCCCCCTGGA (SEQ ID NO: 55, 727) | 72.9 |
| SERPINA1_T114 | CAGGAAGCGCTCACTCCCCC (SEQ ID NO: 55, 726) | 69.2 |
| SERPINA1_T164 | CAGGGGGAGTGAGCGCTTCC (SEQ ID NO: 60, 575) | 56.2 |
| SERPINA1_T155 | AGGGGGAGTGAGCGCTTCCT (SEQ ID NO: 60, 576) | 37.3 |
| SERPINA1_T240 | GGGAGTGAGCGCTTCCTGGG (SEQ ID NO: 60, 578) | 71.3 |
| SERPINA1_T46 | GGCTCACGTGGACACCTCCC (SEQ ID NO: 55, 724) | 65.4 |
| SERPINA1_T30 | GGCCTCGAGCAAGGCTCACG (SEQ ID NO: 55, 722) | 72.2 |

TABLE 4-continued gRNA sequences and cutting efficiencies in HEK293T-Cas9 cells

| Guide Name | Guide Sequence | % Indel |
|---|---|---|
| SERPINA3_T7 | GTCCACGTGAGCCTTGCTCG (SEQ ID NO: 60, 581) | 58.6 |
| SERPINA1_T209 | CTGATCCCAGGCCTCGAGCA (SEQ ID NO: 55, 721) | 69.2 |
| SERPINA1_T476 | CGTGAGCCTTGCTCGAGGCC (SEQ ID NO: 60, 582) | 13.4 |
| SERPINA1_T67 | GTGAGCCTTGCTCGAGGCCT (SEQ ID NO: 60, 583) | 0.2 |
| SERPINA1_T34 | CACGTTGTAAGGCTGATCCC (SEQ ID NO: 55, 718) | 66 |
| SERPINA3_T139 | AGAAGCAGAGACACGTTGTA (SEQ ID NO: 55, 716) | 76.4 |
| SERPINA1_T49 | GCCTTATGCACGGCCTGGAG (SEQ ID NO: 55, 709) | 66.2 |
| SERPINA1_T19 | AGCCTTATGCACGGCCTGGA (SEQ ID NO: 55, 708) | 74.2 |
| SERPINA1_T52 | CAGCCTTATGCACGGCCTGG (SEQ ID NO: 55, 707) | 25.1 |
| SERPINA1_T32 | GCACAGCCTTATGCACGGCC (SEQ ID NO: 55, 705) | 65.9 |
| SERPINA1_T54 | TCCCCTCCAGGCCGTGCATA (SEQ ID NO: 60, 588) | 73.8 |
| SERPINA3_T107 | GGTCAGCACAGCCTTATGCA (SEQ ID NO: 55, 704) | 82.2 |
| SERPINA1_T9 | TTCAGTCCCTTTCTCGTCGA (SEQ ID NO: 55, 701) | 42 |
| SERPINA1_T5 | GTGCTGACCATCGACGAGAA (SEQ ID NO: 60, 591) | 53.9 |
| SERPINA1_T14 | TGCTGACCATCGACGAGAAA (SEQ ID NO: 60, 592) | 40.5 |
| SERPINA1_T355 | GAGAAAGGGACTGAAGCTGC (SEQ ID NO: 60, 594) | 15.3 |
| SERPINA3_T75 | GGGTATGGCCTCTAAAAACA (SEQ ID NO: 55, 697) | 33.5 |
| SERPINA1_T175 | TGCTGGGGCCATGTTTTTAG (SEQ ID NO: 60, 599) | 45.3 |
| SERPINA1_T213 | GGGGGGGATAGACATGGGTA (SEQ ID NO: 55, 696) | 55 |
| SERPINA1_T11 | ACCTCGGGGGGATAGACAT (SEQ ID NO: 55, 695) | 39.3 |
| SERPINA1_733 | GACCTCGGGGGGATAGACA (SEQ ID NO: 55, 694) | 49.4 |
| SERPINA1_T6 | ACCCATGTCTATCCCCCCCG (SEQ ID NO: 60, 601) | 66.5 |
| SERPINA1_T31 | TGTTGAACTTGACCTCGGGG (SEQ ID NO: 55, 692) | 13.3 |
| SERPINA1_T29 | TTGTTGAACTTGACCTCGGG (SEQ ID NO: 55, 691) | 4.6 |
| SERPINA1_T23 | TTTGTTGAACTTGACCTCGG (SEQ ID NO: 55, 690) | 36.4 |
| SERPINA1_T18 | GTTTGTTGAACTTGACCTCG (SEQ ID NO: 55, 689) | 20 |
| SERPINA1_T74 | GGTTTGTTGAACTTGACCTC (SEQ ID NO: 55, 688) | 56.9 |
| SERPINA1_T63 | GGGTTTGTTGAACTTGACCT (SEQ ID NO: 55, 687) | 32.2 |
| SERPINA1_T317 | TCAATCATTAAGAAGACAAA (SEQ ID NO: 55, 686) | 63.2 |
| SERPINA1_T276 | TTCAATCATTAAGAAGACAA (SEQ ID NO: 55, 685) | 15.5 |
| SERPINA1_T365 | TCCCATGAAGAGGGGAGACT (SEQ ID NO: 55, 681) | 28.2 |
| SERPINA1_T188 | TACCAAGTCTCCCCTCTTCA (SEQ ID NO: 60, 604) | 27.4 |
| SERPINA1_T243 | ACCAAGTCTCCCCTCTTCAT (SEQ ID NO: 60, 605) | 46.2 |
| SERPINA1_T289 | CACCACTTTTCCCATGAAGA (SEQ ID NO: 55, 678) | 20.6 |
| SERPINA1_T293 | TCACCACTTTTCCCATGAAG (SEQ ID NO: 55, 677) | 24.5 |
| SERPINA1_T334 | TCCCCTCTTCATGGGAAAAG (SEQ ID NO: 60, 607) | 48.9 |
| SERPINA1_T252 | AGAGGCAGTTATTTTTGGGT (SEQ ID NO: 55, 674) | 14.1 |
| SERPINA1_T346 | GAGAGGCAGTTATTTTTGGG (SEQ ID NO: 55, 673) | 9.5 |

TABLE 4-continued gRNA sequences and cutting efficiencies in HEK293T-Cas9 cells

| Guide Name | Guide Sequence | | % Indel |
|---|---|---|---|
| SERPINA1_T134 | AGCGAGAGGCAGTTATTTTT | (SEQ ID NO: 55, 672) | 47.8 |
| SERPINA1_T331 | GAGCGAGAGGCAGTTATTTT | (SEQ ID NO: 55, 671) | 54.3 |
| SERPINA1_T399 | GGGAGGGGTTGAGGAGCGAG | (SEQ ID NO: 55, 669) | 54.1 |
| SERPINA1_T464 | GGGAGGGGGCCAGGGATGGA | (SEQ ID NO: 55, 658) | 13.9 |
| SERPINA1_T460 | AGGGAGGGGGCCAGGGATGG | (SEQ ID NO: 55, 657) | 1.5 |
| SERPINA1_T462 | CAACCCCTCCCCTCCATCCC | (SEQ ID NO: 60, 608) | 21.9 |
| SERPINA1_T256 | CCCTTCTTTAATGTCATCCA | (SEQ ID NO: 55, 646) | 55 |
| 5E5PINA1_T96 | ACCCTTCTTTAATGTCATCC | (SEQ ID NO: 55, 645) | 35.6 |
| SERPINA1_T229 | ACATTAAAGAAGGGTTGAGC | (SEQ ID NO: 60, 615) | 30 |
| SERPINA1_T361 | TTTACAGTCACATGCAGGCA | (SEQ ID NO: 55, 642) | 50.7 |
| SERPINA1_T201 | ATTTACAGTCACATGCAGGC | (SEQ ID NO: 55, 641) | 49.4 |
| SERPINA1_T132 | AGGGATTTACAGTCACATGC | (SEQ ID NO: 55, 639) | 70.7 |
| SERPINA1_T316 | AGACTCAGAGAAAACATGGG | (SEQ ID NO: 55, 635) | 43.6 |
| SERPINA1_T302 | AGACTCAGAGAAAACATGGG | (SEQ ID NO: 55, 633) | 41.3 |
| SERPINA1_T271 | ATACAGCCTCAGCAGGCAAA | (SEQ ID NO: 55, 628) | 67.7 |
| SERPINA1_T193 | CATACAGCCTCAGCAGGCAA | (SEQ ID NO: 55, 627) | 40.5 |
| SERPINA1_T340 | GAGTCTCCCTTTGCCTGCTG | (SEQ ID NO: 60, 618) | 72.6 |
| SERPINA1_T169 | AGCCCACATACAGCCTCAGC | (SEQ ID NO: 55, 625) | 49.8 |
| 5E5PINA1_T129 | TTGCCTGCTGAGGCTGTATG | (SEQ ID NO: 60, 619) | 74.3 |
| SERPINA1_T145 | TGCCTGCTGAGGCTGTATGT | (SEQ ID NO: 60, 620) | 41.2 |
| SERPINA1_T204 | TGAGGCTGTATGTGGGCTCC | (SEQ ID NO: 60, 622) | 42.6 |
| SERPINA1_T35 | CCGAAGACAGCACTGTTACC | (SEQ ID NO: 55, 620) | 29 |
| SERPINA1_T184 | CCAGGTAACAGTGCTGTCTT | (SEQ ID NO: 60, 624) | 0 |
| SERPINA1_T178 | CAGGTAACAGTGCTGTCTTC | (SEQ ID NO: 60, 625) | 0 |
| SERPINA1_T157 | CTCCATGAACACAGTTCAGG | (SEQ ID NO: 55, 617) | 0 |
| SERPINA1_T140 | GCTCCATGAACACAGTTCAG | (SEQ ID NO: 55, 616) | 41.6 |
| SERPINA1_T147 | AACTGTGTTCATGGAGCATC | (SEQ ID NO: 60, 628) | 18.2 |
| SE5PINA1_T273 | TGTTCATGGAGCATCTGGCT | (SEQ ID NO: 60, 630) | 61.9 |
| SERPINA1_T247 | CATGGAGCATCTGGCTGGGT | (SEQ ID NO: 60, 632) | 49.1 |
| SERPINA1_T380 | CTGGCTGGGTAGGCACATGC | (SEQ ID NO: 60, 633) | 77.7 |
| SERPINA1_T456 | CACATGCTGGGCTTGAATCC | (SEQ ID NO: 60, 636) | 0 |
| SERPINA1_T352 | ACATGCTGGGCTTGAATCCA | (SEQ ID NO: 60, 637) | 63.2 |
| SE5PINA1_T443 | ATGCTGGGCTTGAATCCAGG | (SEQ ID NO: 60, 639) | 71.8 |
| SERPINA1_T377 | TGCTGGGCTTGAATCCAGGG | (SEQ ID NO: 60, 640) | 57.3 |
| SERPINA1_T76 | GCTGAGGATTCAGTCCCCCC | (SEQ ID NO: 55, 607) | 80.9 |
| SERPINA1_T44 | GGGCCCAGGTCCGTAAGGTG | (SEQ ID NO: 55, 605) | 42.7 |
| SERPINA1_T160 | GGGACTGAATCCTCAGCTTA | (SEQ ID NO: 60, 642) | 58.7 |

TABLE 4-continued gRNA sequences and cutting efficiencies in HEK293T-Cas9 cells

| Guide Name | Guide Sequence | % Indel |
|---|---|---|
| SERPINA1_T4 | GAATCCTCAGCTTACGGACC (SEQ ID NO: 60, 643) | 13.7 |
| SERPINA1_T20 | AATCCTCAGCTTACGGACCT (SEQ ID NO: 60, 644) | 6.1 |
| SERPINA1_T207 | CTCCAGAAACAGATGGGCCC (SEQ ID NO: 55, 602) | 43 |
| SERPINA1_T260 | GGAGCCCTCCAGAAACAGAT (SEQ ID NO: 55, 600) | 74.5 |
| SERPINA1_T403 | TGGAGCCCTCCAGAAACAGA (SEQ ID NO: 55, 599) | 37.8 |
| SERPINA1_T87 | GACCTGGGCCCATCTGTTTC (SEQ ID NO: 60, 645) | 49.4 |
| SERPINA1_T284 | CTGGGCCCATCTGTTTCTGG (SEQ ID NO: 60, 647) | 32.7 |
| SERPINA1_T228 | TGGGCCCATCTGTTTCTGGA (SEQ ID NO: 60, 648) | 72.4 |
| SERPINA1_T406 | CAAGACAGGACAAGGAAGAC (SEQ ID NO: 55, 595) | 22.2 |
| SERPINA1_T304 | CAGTCTTCCTTGTCCTGTCT (SEQ ID NO: 60, 650) | 37.4 |
| SERPINA1_T126 | CTTCTTGGGGACTCCAAGAC (SEQ ID NO: 55, 591) | 30.1 |
| SERPINA1_T137 | CTGTCTTGGAGTCCCCAAGA (SEQ ID NO: 60, 654) | 0 |
| SERPINA1_T324 | CTCCCCTGTGATTCCTTCTT (SEQ ID NO: 55, 587) | 41.3 |
| SERPINA1_T367 | CCTCCCCTGTGATTCCTTCT (SEQ ID NO: 55, 586) | 46.3 |
| SERPINA1_T248 | GTCCCCAAGAAGGAATCACA (SEQ ID NO: 60, 657) | 51 |
| SERPINA1_T310 | TCCCCAAGAAGGAATCACAG (SEQ ID NO: 60, 658) | 27.8 |
| SERPINA1_T342 | CCAAGAAGGAATCACAGGGG (SEQ ID NO: 60, 660) | 49 |
| SERPINA1_T332 | GTGGAGGCTGGGGTCATGGC (SEQ ID NO: 55, 584) | 48.7 |
| SERPINA1_T358 | CTTGGTGGAGCCTGGGGTCA (SEQ ID NO: 55, 583) | 30 |
| SERPINA1_T395 | CAGATACCAGCCATGACCCC (SEQ ID NO: 60, 664) | 20.8 |
| SERPINA1_T362 | AAGATGCTTGGTGGAGCCTG (SEQ ID NO: 55, 582) | 21.1 |
| SERPINA1_T235 | GAAGATGCTTGGTGGAGCCT (SEQ ID NO: 55, 581) | 4.1 |
| SERPINA1_T238 | TGAAGATGCTTGGTGGAGCC (SEQ ID NO: 55, 580) | 5.8 |
| SERPINA1_T255 | GGGGACATGAAGATGCTTGG (SEQ ID NO: 55, 578) | 59.5 |
| SERPINA1_T296 | CAGGGGACATGAAGATGCT (SEQ ID NO: 55, 577) | 64.9 |
| SERPINA1_T455 | GGGAGTGGGGGATGAGCAGG (SEQ ID NO: 55, 575) | 43.7 |
| SERPINA1_T347 | GGGGAGTGGGGGATGAGCAG (SEQ ID NO: 55, 574) | 67.5 |
| SERPINA1_T387 | GGGGGAGTGGGGGATGAGCA (SEQ ID NO: 55, 573) | 27 |
| SERPINA1_T416 | GGGGGGAGTGGGGGATGAGC (SEQ ID NO: 55, 572) | 15.8 |
| SERPINA1_T440 | CTCTGGGTGGGGGGAGTGG (SEQ ID NO: 55, 569) | 31.4 |
| SERPINA1_T430 | ACTCTGGGTGGGGGGAGTG (SEQ ID NO: 55, 568) | 11.8 |
| SERPINA1_T389 | AACTCTGGGTGGGGGGAGT (SEQ ID NO: 55, 567) | 6.7 |
| SERPINA1_T398 | CAACTCTGGGTGGGGGGAG (SEQ ID NO: 55, 566) | 6.1 |
| SERPINA1_T415 | ATGAGCAACTCTGGGTGGGG (SEQ ID NO: 55, 564) | 35.7 |
| SERPINA1_T412 | GATGAGCAACTCTGGGTGGG (SEQ ID NO: 55, 563) | 30.3 |
| SERPINA1_T396 | GGATGAGCAACTCTGGGTGG (SEQ ID NO: 55, 562) | 30.4 |
| SERPINA1_T426 | AGGATGAGCAACTCTGGGTG (SEQ ID NO: 55, 561) | 18.5 |
| SERPINA1_T246 | CAGGATGAGCAACTCTGGGT (SEQ ID NO: 55, 560) | 35.1 |

TABLE 4-continued gRNA sequences and cutting efficiencies
in HEK293T-Cas9 cells

| Guide Name | Guide Sequence | | % Indel |
|---|---|---|---|
| SERPINA1_T373 | GCAGGATGAGCAACTCTGGG | (SEQ ID NO: 55, 559) | 40.8 |
| SERPINA1_T205 | CTGGCAGGATGAGCAACTCT | (SEQ ID NO: 55, 558) | #N/A |
| SERPINA1_T174 | CCTGGCAGGATGAGCAACTC | (SEQ ID NO: 55, 557) | #N/A |
| SERPINA1_T219 | CCAGAGTTGCTCATCCTGCC | (SEQ ID NO: 60, 669) | #N/A |
| SERPINA1_T171 | CAGAGTTGCTCATCCTGCCA | (SEQ ID NO: 60, 670) | #N/A |

Note Regarding Illustrative Embodiments

While the present disclosure provides descriptions of various specific embodiments for the purpose of illustrating various aspects of the present invention and/or its potential applications, it is understood that variations and modifications will occur to those skilled in the art. Accordingly, the invention or inventions described herein should be understood to be at least as broad as they are claimed, and not as more narrowly defined by particular illustrative embodiments provided herein.

Any patent, publication, or other disclosure material identified herein is incorporated by reference into this specification in its entirety unless otherwise indicated, but only to the extent that the incorporated material does not conflict with existing descriptions, definitions, statements, or other disclosure material expressly set forth in this specification. As such, and to the extent necessary, the express disclosure as set forth in this specification supersedes any conflicting material incorporated by reference. Any material, or portion thereof, that is said to be incorporated by reference into this specification, but which conflicts with existing definitions, statements, or other disclosure material set forth herein, is only incorporated to the extent that no conflict arises between that incorporated material and the existing disclosure material. Applicants reserve the right to amend this specification to expressly recite any subject matter, or portion thereof, incorporated by reference herein.

SEQUENCE LISTING (68299 sequences)

SEQ ID NO: 1 - DNA, 20 bp, Artificial Sequence
  chemically synthesized
tggcgatatctaggtagcca

SEQ ID NO: 2 - DNA, 20 bp, Artificial Sequence
  chemically synthesized
ggcgatatctaggtagccac

SEQ ID NO: 3 - DNA, 20 bp, Artificial Sequence
  chemically synthesized
cgatatctaggtagccacag

SEQ ID NO: 4 - DNA, 20 bp, Artificial Sequence
  chemically synthesized
gatatctaggtagccacagg

SEQ ID NO: 5 - DNA, 20 bp, Artificial Sequence
  chemically synthesized
atctaggtagccacaggagg

SEQ ID NO: 6 - DNA, 20 bp, Artificial Sequence
  chemically synthesized
ccacaggaggcggccacgtg

SEQ ID NO: 7 - DNA, 20 bp, Artificial Sequence
  chemically synthesized
caggaggcggccacgtgcag

SEQ ID NO: 8 - DNA, 20 bp, Artificial Sequence
  chemically synthesized
cggccacgtgcagtggcgtc

SEQ ID NO: 9 - DNA, 20 bp, Artificial Sequence
  chemically synthesized
tccagccctcgttgtctgcc

SEQ ID NO: 10 - DNA, 20 bp, Artificial Sequence
  chemically synthesized
ctcgttgtctgcctggttca

SEQ ID NO: 11 - DNA, 20 bp, Artificial Sequence
  chemically synthesized
gttgtctgcctggttcacag

SEQ ID NO: 12 - DNA, 20 bp, Artificial Sequence
  chemically synthesized
cagtggcgccctgctccacc

SEQ ID NO: 13 - DNA, 20 bp, Artificial Sequence
  chemically synthesized
tggcgccctgctccaccaag

SEQ ID NO: 14 - DNA, 20 bp, Artificial Sequence
  chemically synthesized
accaagaagcgcaccacctc

SEQ ID NO: 15 - DNA, 20 bp, Artificial Sequence
  chemically synthesized
ccaagaagcgcaccacctcc

SEQ ID NO: 16 - DNA, 20 bp, Artificial Sequence
  chemically synthesized
cctccaggttctcatcaatg

SEQ ID NO: 17 - DNA, 20 bp, Artificial Sequence
  chemically synthesized
ctccaggttctcatcaatgc

SEQ ID NO: 18 - DNA, 20 bp, Artificial Sequence
  chemically synthesized
ggttctcatcaatgcaggcc

SEQ ID NO: 19 - DNA, 20 bp, Artificial Sequence
  chemically synthesized
gttctcatcaatgcaggcct

SEQ ID NO: 20 - DNA, 20 bp, Artificial Sequence
  chemically synthesized
ttctcatcaatgcaggcctg

SEQ ID NO: 21 - DNA, 20 bp, Artificial Sequence
  chemically synthesized
tctcatcaatgcaggcctgg

SEQ ID NO: 22 - DNA, 20 bp, Artificial Sequence
  chemically synthesized
catcaatgcaggcctggggg

SEQ ID NO: 23 - DNA, 20 bp, Artificial Sequence
  chemically synthesized
atcaatgcaggcctgggggt

SEQ ID NO: 24 - DNA, 20 bp, Artificial Sequence
  chemically synthesized
gcaggcctgggggtgggaaa

SEQ ID NO: 25 - DNA, 20 bp, Artificial Sequence
  chemically synthesized
tgggggtgggaaacagccgt

SEQ ID NO: 26 - DNA, 20 bp, Artificial Sequence
  chemically synthesized
gccgtcagccgcacctaccc

SEQ ID NO: 27 - DNA, 20 bp, Artificial Sequence
  chemically synthesized
agccgcacctaccccagcca

SEQ ID NO: 28 - DNA, 20 bp, Artificial Sequence
  chemically synthesized
ctaccccagccacggtgtcc

SEQ ID NO: 29 - DNA, 20 bp, Artificial Sequence
  chemically synthesized
cccagccacggtgtcccagc

SEQ ID NO: 30 - DNA, 20 bp, Artificial Sequence
  chemically synthesized
gccacggtgtcccagcaagt

SEQ ID NO: 31 - DNA, 20 bp, Artificial Sequence
  chemically synthesized
ccacggtgtcccagcaagtc

SEQ ID NO: 32 - DNA, 20 bp, Artificial Sequence
  chemically synthesized
gtcccagcaagtcgggactc

SEQ ID NO: 33 - DNA, 20 bp, Artificial Sequence
  chemically synthesized
cccagcaagtcgggactcca

SEQ ID NO: 34 - DNA, 20 bp, Artificial Sequence
  chemically synthesized
ccagcaagtcgggactccag

SEQ ID NO: 35 - DNA, 20 bp, Artificial Sequence
  chemically synthesized
cagcaagtcgggactccaga

SEQ ID NO: 36 - DNA, 20 bp, Artificial Sequence
  chemically synthesized
gcaagtcgggactccagagg

SEQ ID NO: 37 - DNA, 20 bp, Artificial Sequence
  chemically synthesized
tccagagggagccacgaaaa

SEQ ID NO: 38 - DNA, 20 bp, Artificial Sequence
  chemically synthesized
gggagccacgaaaacagatc

SEQ ID NO: 39 - DNA, 20 bp, Artificial Sequence
  chemically synthesized
ggagccacgaaaacagatcc

SEQ ID NO: 40 - DNA, 20 bp, Artificial Sequence
  chemically synthesized
gagccacgaaaacagatcca

SEQ ID NO: 41 - DNA, 20 bp, Artificial Sequence
  chemically synthesized
cgaaaacagatccagggaca

SEQ ID NO: 42 - DNA, 20 bp, Artificial Sequence
  chemically synthesized
cagatccagggacacggtgc

SEQ ID NO: 43 - DNA, 20 bp, Artificial Sequence
  chemically synthesized
agatccagggacacggtgct

SEQ ID NO: 44 - DNA, 20 bp, Artificial Sequence
  chemically synthesized
ccagggacacggtgctagga

SEQ ID NO: 45 - DNA, 20 bp, Artificial Sequence
  chemically synthesized
gggacacggtgctaggacag

SEQ ID NO: 46 - DNA, 20 bp, Artificial Sequence
  chemically synthesized
ggacacggtgctaggacagt

SEQ ID NO: 47 - DNA, 20 bp, Artificial Sequence
  chemically synthesized
gacacggtgctaggacagtg

SEQ ID NO: 48 - DNA, 20 bp, Artificial Sequence
  chemically synthesized
cagtggggaaaatgacccaa

SEQ ID NO: 49 - DNA, 20 bp, Artificial Sequence
  chemically synthesized
gaaaatgacccaacagcctc

SEQ ID NO: 50 - DNA, 20 bp, Artificial Sequence
  chemically synthesized
acccaacagcctctggccac

SEQ ID NO: 51 - DNA, 20 bp, Artificial Sequence
  chemically synthesized
cctctggccactggctgttt

SEQ ID NO: 52 - DNA, 20 bp, Artificial Sequence
  chemically synthesized
ctggctgtttaagatacgcc

SEQ ID NO: 53 - DNA, 20 bp, Artificial Sequence
  chemically synthesized
ttaagatacgcctggttgcc

SEQ ID NO: 54 - DNA, 20 bp, Artificial Sequence
  chemically synthesized
agatacgcctggttgcccag

SEQ ID NO: 55 - DNA, 20 bp, Artificial Sequence
  chemically synthesized
acgcctggttgcccagtggt

SEQ ID NO: 56 - DNA, 20 bp, Artificial Sequence
  chemically synthesized
cgcctggttgcccagtggtc

SEQ ID NO: 57 - DNA, 20 bp, Artificial Sequence
  chemically synthesized
tggttgcccagtggtcaggc

SEQ ID NO: 58 - DNA, 20 bp, Artificial Sequence
  chemically synthesized
tgcccagtggtcaggccggc

SEQ ID NO: 59 - DNA, 20 bp, Artificial Sequence
  chemically synthesized
gcccagtggtcaggccggcc

SEQ ID NO: 60 - DNA, 20 bp, Artificial Sequence
  chemically synthesized
ggtcaggccggccaggcctt

SEQ ID NO: 61 - DNA, 20 bp, Artificial Sequence
  chemically synthesized
ccggccaggccttcagtgct

SEQ ID NO: 62 - DNA, 20 bp, Artificial Sequence
  chemically synthesized
gccaggccttcagtgctcag

SEQ ID NO: 63 - DNA, 20 bp, Artificial Sequence
  chemically synthesized
gtgctcagtggaaaccacga

SEQ ID NO: 64 - DNA, 20 bp, Artificial Sequence
  chemically synthesized
tgctcagtggaaaccacgaa

SEQ ID NO: 65 - DNA, 20 bp, Artificial Sequence
  chemically synthesized
ggaaaccacgaaaggactcc

SEQ ID NO: 66 - DNA, 20 bp, Artificial Sequence
  chemically synthesized
gactcctggctatctgcaaa

SEQ ID NO: 67 - DNA, 20 bp, Artificial Sequence
  chemically synthesized
actcctggctatctgcaaac

SEQ ID NO: 68 - DNA, 20 bp, Artificial Sequence
  chemically synthesized
cctggctatctgcaaacagg

SEQ ID NO: 69 - DNA, 20 bp, Artificial Sequence
  chemically synthesized
atctgcaaacaggaagtgaa

SEQ ID NO: 70 - DNA, 20 bp, Artificial Sequence
  chemically synthesized
tctgcaaacaggaagtgaac

SEQ ID NO: 71 - DNA, 20 bp, Artificial Sequence
  chemically synthesized
ctgcaaacaggaagtgaacg

SEQ ID NO: 72 - DNA, 20 bp, Artificial Sequence
  chemically synthesized
caaacaggaagtgaacgggg

SEQ ID NO: 73 - DNA, 20 bp, Artificial Sequence
  chemically synthesized
aaacaggaagtgaacgggga

SEQ ID NO: 74 - DNA, 20 bp, Artificial Sequence
  chemically synthesized
aacaggaagtgaacggggaa

SEQ ID NO: 75 - DNA, 20 bp, Artificial Sequence
  chemically synthesized
caggaagtgaacggggaagg

SEQ ID NO: 76 - DNA, 20 bp, Artificial Sequence
  chemically synthesized
aggaagtgaacggggaaggg

SEQ ID NO: 77 - DNA, 20 bp, Artificial Sequence
  chemically synthesized
ggaagtgaacggggaaggga

SEQ ID NO: 78 - DNA, 20 bp, Artificial Sequence
  chemically synthesized
gaagtgaacggggaagggag

SEQ ID NO: 79 - DNA, 20 bp, Artificial Sequence
  chemically synthesized
aagtgaacggggaagggagg

SEQ ID NO: 80 - DNA, 20 bp, Artificial Sequence
  chemically synthesized
aagggagggggcttctcatc

SEQ ID NO: 81 - DNA, 20 bp, Artificial Sequence
  chemically synthesized
agggagggggcttctcatct

SEQ ID NO: 82 - DNA, 20 bp, Artificial Sequence
  chemically synthesized
gggggcttctcatctgggtg

SEQ ID NO: 83 - DNA, 20 bp, Artificial Sequence
  chemically synthesized
ggggcttctcatctgggtgc

SEQ ID NO: 84 - DNA, 20 bp, Artificial Sequence
  chemically synthesized
ctgggtgcgggaaccccaca

SEQ ID NO: 85 - DNA, 20 bp, Artificial Sequence
  chemically synthesized
gaaccccacatggtacctgt

SEQ ID NO: 86 - DNA, 20 bp, Artificial Sequence
  chemically synthesized
cacatggtacctgttagaca

SEQ ID NO: 87 - DNA, 20 bp, Artificial Sequence
  chemically synthesized
aaaacccccgtcaccaccca

SEQ ID NO: 88 - DNA, 20 bp, Artificial Sequence
  chemically synthesized
aaacccccgtcaccacccac

SEQ ID NO: 89 - DNA, 20 bp, Artificial Sequence
  chemically synthesized
cccccgtcaccacccacagg

SEQ ID NO: 90 - DNA, 20 bp, Artificial Sequence
  chemically synthesized
ccacccacaggtggcgcttc

SEQ ID NO: 91 - DNA, 20 bp, Artificial Sequence
  chemically synthesized
caggtggcgcttccagtgct

SEQ ID NO: 92 - DNA, 20 bp, Artificial Sequence
  chemically synthesized
ggcgcttccagtgctcagac

SEQ ID NO: 93 - DNA, 20 bp, Artificial Sequence
  chemically synthesized
gcgcttccagtgctcagact

SEQ ID NO: 94 - DNA, 20 bp, Artificial Sequence
  chemically synthesized
cgcttccagtgctcagacta

SEQ ID NO: 95 - DNA, 20 bp, Artificial Sequence
  chemically synthesized
ttccagtgctcagactaggg

SEQ ID NO: 96 - DNA, 20 bp, Artificial Sequence
  chemically synthesized
ccagtgctcagactagggaa

SEQ ID NO: 97 - DNA, 20 bp, Artificial Sequence
  chemically synthesized
cagtgctcagactagggaag

SEQ ID NO: 98 - DNA, 20 bp, Artificial Sequence
  chemically synthesized
tcagactagggaagaggttc

SEQ ID NO: 99 - DNA, 20 bp, Artificial Sequence
  chemically synthesized
ggttccagcccctcctcctt

SEQ ID NO: 100 - DNA, 20 bp, Artificial Sequence
  chemically synthesized
ttccagcccctcctccttca

SEQ ID NO: 101 - DNA, 20 bp, Artificial Sequence
  chemically synthesized
agcccctcctccttcagagc

SEQ ID NO: 102 - DNA, 20 bp, Artificial Sequence
  chemically synthesized
gcccctcctccttcagagcc

SEQ ID NO: 103 - DNA, 20 bp, Artificial Sequence
  chemically synthesized
ccctcctccttcagagccag

SEQ ID NO: 104 - DNA, 20 bp, Artificial Sequence
  chemically synthesized
tccttcagagccaggagtcc

SEQ ID NO: 105 - DNA, 20 bp, Artificial Sequence
  chemically synthesized
gagccaggagtcctggcccc

SEQ ID NO: 106 - DNA, 20 bp, Artificial Sequence
  chemically synthesized
agcccctcctgccttaaacc

SEQ ID NO: 107 - DNA, 20 bp, Artificial Sequence
  chemically synthesized
cctcctgccttaaacccagc

SEQ ID NO: 108 - DNA, 20 bp, Artificial Sequence
  chemically synthesized
ctcctgccttaaacccagcc

SEQ ID NO: 109 - DNA, 20 bp, Artificial Sequence
  chemically synthesized
aaacccagccaggtccttcc

SEQ ID NO: 110 - DNA, 20 bp, Artificial Sequence
  chemically synthesized
aacccagccaggtccttcca

SEQ ID NO: 111 - DNA, 20 bp, Artificial Sequence
  chemically synthesized
acccagccaggtccttccaa

SEQ ID NO: 112 - DNA, 20 bp, Artificial Sequence
  chemically synthesized
gccaggtccttccaagggtc

SEQ ID NO: 113 - DNA, 20 bp, Artificial Sequence
  chemically synthesized
gtccttccaagggtcaagct

SEQ ID NO: 114 - DNA, 20 bp, Artificial Sequence
  chemically synthesized
gtcaagctcggaaaccaccc

SEQ ID NO: 115 - DNA, 20 bp, Artificial Sequence
  chemically synthesized
aagctcggaaaccaccccag

SEQ ID NO: 116 - DNA, 20 bp, Artificial Sequence
  chemically synthesized
ccaccccagcagatactctg

SEQ ID NO: 117 - DNA, 20 bp, Artificial Sequence
  chemically synthesized
caccccagcagatactctgc

SEQ ID NO: 118 - DNA, 20 bp, Artificial Sequence
  chemically synthesized
gcagatactctgcaggaacg

SEQ ID NO: 119 - DNA, 20 bp, Artificial Sequence
  chemically synthesized
actctgcaggaacgaagccg

SEQ ID NO: 120 - DNA, 20 bp, Artificial Sequence
  chemically synthesized
ctctgcaggaacgaagccgt

SEQ ID NO: 121 - DNA, 20 bp, Artificial Sequence
  chemically synthesized
caggaacgaagccgtgggcc

SEQ ID NO: 122 - DNA, 20 bp, Artificial Sequence
  chemically synthesized
aggaacgaagccgtgggccc

SEQ ID NO: 123 - DNA, 20 bp, Artificial Sequence
  chemically synthesized
ggaacgaagccgtgggccca

SEQ ID NO: 124 - DNA, 20 bp, Artificial Sequence
  chemically synthesized
gccgtgggcccagggctatg

SEQ ID NO: 125 - DNA, 20 bp, Artificial Sequence
  chemically synthesized
ccgtgggcccagggctatgc

SEQ ID NO: 126 - DNA, 20 bp, Artificial Sequence
  chemically synthesized
cgtgggcccagggctatgca

SEQ ID NO: 127 - DNA, 20 bp, Artificial Sequence
  chemically synthesized
gggcccagggctatgcaggg

SEQ ID NO: 128 - DNA, 20 bp, Artificial Sequence
  chemically synthesized
gcccagggctatgcagggtg

SEQ ID NO: 129 - DNA, 20 bp, Artificial Sequence
  chemically synthesized
cccagggctatgcagggtgg

SEQ ID NO: 130 - DNA, 20 bp, Artificial Sequence
  chemically synthesized
agggctatgcagggtggagg

SEQ ID NO: 131 - DNA, 20 bp, Artificial Sequence
  chemically synthesized
gggctatgcagggtggagga

SEQ ID NO: 132 - DNA, 20 bp, Artificial Sequence
  chemically synthesized
ggaggaaggccaccctgtgc

SEQ ID NO: 133 - DNA, 20 bp, Artificial Sequence
  chemically synthesized
gaggaaggccaccctgtgct

SEQ ID NO: 134 - DNA, 20 bp, Artificial Sequence
  chemically synthesized
aaggccaccctgtgctggga

SEQ ID NO: 135 - DNA, 20 bp, Artificial Sequence
  chemically synthesized
accctgtgctgggacagact

SEQ ID NO: 136 - DNA, 20 bp, Artificial Sequence
  chemically synthesized
ccctgtgctgggacagactc

SEQ ID NO: 137 - DNA, 20 bp, Artificial Sequence
  chemically synthesized
cctgtgctgggacagactca

SEQ ID NO: 138 - DNA, 20 bp, Artificial Sequence
  chemically synthesized
ctgtgctgggacagactcag

SEQ ID NO: 139 - DNA, 20 bp, Artificial Sequence
  chemically synthesized
ctgggacagactcaggggcc

SEQ ID NO: 140 - DNA, 20 bp, Artificial Sequence
  chemically synthesized
tgggacagactcaggggcct

SEQ ID NO: 141 - DNA, 20 bp, Artificial Sequence
  chemically synthesized
gacagactcaggggcctggg

SEQ ID NO: 142 - DNA, 20 bp, Artificial Sequence
  chemically synthesized
acagactcaggggcctgggc

SEQ ID NO: 143 - DNA, 20 bp, Artificial Sequence
  chemically synthesized
aggggcctgggcgggactcc

SEQ ID NO: 144 - DNA, 20 bp, Artificial Sequence
  chemically synthesized
gggcctgggcgggactccca

SEQ ID NO: 145 - DNA, 20 bp, Artificial Sequence
  chemically synthesized
ggcctgggcgggactcccag

SEQ ID NO: 146 - DNA, 20 bp, Artificial Sequence
  chemically synthesized
gcctgggcgggactcccaga

SEQ ID NO: 147 - DNA, 20 bp, Artificial Sequence
  chemically synthesized
cctgggcgggactcccagag

SEQ ID NO: 148 - DNA, 20 bp, Artificial Sequence
  chemically synthesized
ggcgggactcccagaggggt

SEQ ID NO: 149 - DNA, 20 bp, Artificial Sequence
  chemically synthesized
ggactcccagaggggtgaga

SEQ ID NO: 150 - DNA, 20 bp, Artificial Sequence
  chemically synthesized
cagctgcacacctgtgtgcc

SEQ ID NO: 151 - DNA, 20 bp, Artificial Sequence
  chemically synthesized
agctgcacacctgtgtgcct

SEQ ID NO: 152 - DNA, 20 bp, Artificial Sequence
  chemically synthesized
acacctgtgtgcctgggccc

SEQ ID NO: 153 - DNA, 20 bp, Artificial Sequence
  chemically synthesized
cacctgtgtgcctgggcccc

SEQ ID NO: 154 - DNA, 20 bp, Artificial Sequence
  chemically synthesized
ggccccaggctgtcacactc

SEQ ID NO: 155 - DNA, 20 bp, Artificial Sequence
  chemically synthesized
ctgtcacactccagttcact

SEQ ID NO: 156 - DNA, 20 bp, Artificial Sequence
  chemically synthesized
tgtcacactccagttcactg

SEQ ID NO: 157 - DNA, 20 bp, Artificial Sequence
  chemically synthesized
tcactgaggccccctctgca

SEQ ID NO: 158 - DNA, 20 bp, Artificial Sequence
  chemically synthesized
cactgaggccccctctgcac

SEQ ID NO: 159 - DNA, 20 bp, Artificial Sequence
  chemically synthesized
actgaggccccctctgcacg

SEQ ID NO: 160 - DNA, 20 bp, Artificial Sequence
  chemically synthesized
cccctctgcacggggccctg

SEQ ID NO: 161 - DNA, 20 bp, Artificial Sequence
  chemically synthesized
tctgcacggggccctgcagc

SEQ ID NO: 162 - DNA, 20 bp, Artificial Sequence
  chemically synthesized
ctgcacggggccctgcagcc

SEQ ID NO: 163 - DNA, 20 bp, Artificial Sequence
  chemically synthesized
tgcacggggccctgcagcca

SEQ ID NO: 164 - DNA, 20 bp, Artificial Sequence
  chemically synthesized
gcacggggccctgcagccag

SEQ ID NO: 165 - DNA, 20 bp, Artificial Sequence
  chemically synthesized
cctgcagccaggggctgaca

SEQ ID NO: 166 - DNA, 20 bp, Artificial Sequence
  chemically synthesized
ctgcagccaggggctgacac

SEQ ID NO: 167 - DNA, 20 bp, Artificial Sequence
  chemically synthesized
accgtttctcattcttccct

SEQ ID NO: 168 - DNA, 20 bp, Artificial Sequence
  chemically synthesized
ccgtttctcattcttccctt

SEQ ID NO: 169 - DNA, 20 bp, Artificial Sequence
  chemically synthesized
cgtttctcattcttccctta

SEQ ID NO: 170 - DNA, 20 bp, Artificial Sequence
  chemically synthesized
gtttctcattcttcccttag

SEQ ID NO: 171 - DNA, 20 bp, Artificial Sequence
  chemically synthesized
tcccttaggggtccaaaact

SEQ ID NO: 172 - DNA, 20 bp, Artificial Sequence
  chemically synthesized
cccttaggggtccaaaactt

SEQ ID NO: 173 - DNA, 20 bp, Artificial Sequence
  chemically synthesized
ccttaggggtccaaaacttg

SEQ ID NO: 174 - DNA, 20 bp, Artificial Sequence
  chemically synthesized
cttaggggtccaaaacttgg

SEQ ID NO: 175 - DNA, 20 bp, Artificial Sequence
  chemically synthesized
ttaggggtccaaaacttggg

SEQ ID NO: 176 - DNA, 20 bp, Artificial Sequence
  chemically synthesized
tccaaaacttggggggacaa

SEQ ID NO: 177 - DNA, 20 bp, Artificial Sequence
  chemically synthesized
acttggggggacaaaagccg

SEQ ID NO: 178 - DNA, 20 bp, Artificial Sequence
  chemically synthesized
gggggacaaaagccgaagtc

SEQ ID NO: 179 - DNA, 20 bp, Artificial Sequence
  chemically synthesized
ggggacaaaagccgaagtcc

SEQ ID NO: 180 - DNA, 20 bp, Artificial Sequence
  chemically synthesized
gggacaaaagccgaagtcca

SEQ ID NO: 181 - DNA, 20 bp, Artificial Sequence
  chemically synthesized
ggacaaaagccgaagtccag

SEQ ID NO: 182 - DNA, 20 bp, Artificial Sequence
  chemically synthesized
gacaaaagccgaagtccagg

SEQ ID NO: 183 - DNA, 20 bp, Artificial Sequence
  chemically synthesized
aaagccgaagtccagggggt

SEQ ID NO: 184 - DNA, 20 bp, Artificial Sequence
  chemically synthesized
agccgaagtccagggggtcg

SEQ ID NO: 185 - DNA, 20 bp, Artificial Sequence
  chemically synthesized
gccgaagtccagggggtcgg

SEQ ID NO: 186 - DNA, 20 bp, Artificial Sequence
  chemically synthesized
cgaagtccagggggtcggag

SEQ ID NO: 187 - DNA, 20 bp, Artificial Sequence
  chemically synthesized
gaagtccagggggtcggagg

SEQ ID NO: 188 - DNA, 20 bp, Artificial Sequence
  chemically synthesized
aagtccagggggtcggagga

SEQ ID NO: 189 - DNA, 20 bp, Artificial Sequence
  chemically synthesized
gtcggaggagggacttgccc

SEQ ID NO: 190 - DNA, 20 bp, Artificial Sequence
  chemically synthesized
tcggaggagggacttgcccc

SEQ ID NO: 191 - DNA, 20 bp, Artificial Sequence
  chemically synthesized
gggacttgccccaggccttg

SEQ ID NO: 192 - DNA, 20 bp, Artificial Sequence
  chemically synthesized
gccccaggccttgtggacac

SEQ ID NO: 193 - DNA, 20 bp, Artificial Sequence
  chemically synthesized
ccccaggccttgtggacact

SEQ ID NO: 194 - DNA, 20 bp, Artificial Sequence
  chemically synthesized
caggccttgtggacactggg

SEQ ID NO: 195 - DNA, 20 bp, Artificial Sequence
  chemically synthesized
aggccttgtggacactgggt

SEQ ID NO: 196 - DNA, 20 bp, Artificial Sequence
  chemically synthesized
tgtggacactgggtgggctc

SEQ ID NO: 197 - DNA, 20 bp, Artificial Sequence
  chemically synthesized
gtggacactgggtgggctcc

SEQ ID NO: 198 - DNA, 20 bp, Artificial Sequence
  chemically synthesized
gtgggctccgggacctgaac

SEQ ID NO: 199 - DNA, 20 bp, Artificial Sequence
  chemically synthesized
gggctccgggacctgaactg

SEQ ID NO: 200 - DNA, 20 bp, Artificial Sequence
  chemically synthesized
ccgggacctgaactggagct

SEQ ID NO: 201 - DNA, 20 bp, Artificial Sequence
  chemically synthesized
cgggacctgaactggagctg

SEQ ID NO: 202 - DNA, 20 bp, Artificial Sequence
  chemically synthesized
gacctgaactggagctgagg

SEQ ID NO: 203 - DNA, 20 bp, Artificial Sequence
  chemically synthesized
acctgaactggagctgagga

SEQ ID NO: 204 - DNA, 20 bp, Artificial Sequence
  chemically synthesized
ctgaactggagctgaggaag

SEQ ID NO: 205 - DNA, 20 bp, Artificial Sequence
  chemically synthesized
ctggagctgaggaaggagtg

SEQ ID NO: 206 - DNA, 20 bp, Artificial Sequence
  chemically synthesized
aaggagtgaagctaaactcc

SEQ ID NO: 207 - DNA, 20 bp, Artificial Sequence
  chemically synthesized
aagctaaactcctagatcca

SEQ ID NO: 208 - DNA, 20 bp, Artificial Sequence
  chemically synthesized
agctaaactcctagatccac

SEQ ID NO: 209 - DNA, 20 bp, Artificial Sequence
  chemically synthesized
cacgggataaattacccccc

SEQ ID NO: 210 - DNA, 20 bp, Artificial Sequence
  chemically synthesized
ccaagtccctcacctctcca

SEQ ID NO: 211 - DNA, 20 bp, Artificial Sequence
  chemically synthesized
cctctccaaagctgcccatc

SEQ ID NO: 212 - DNA, 20 bp, Artificial Sequence
  chemically synthesized
tctccaaagctgcccatctg

SEQ ID NO: 213 - DNA, 20 bp, Artificial Sequence
  chemically synthesized
ctccaaagctgcccatctgg

SEQ ID NO: 214 - DNA, 20 bp, Artificial Sequence
  chemically synthesized
ccaaagctgcccatctggag

SEQ ID NO: 215 - DNA, 20 bp, Artificial Sequence
  chemically synthesized
caaagctgcccatctggagg

SEQ ID NO: 216 - DNA, 20 bp, Artificial Sequence
  chemically synthesized
agctgcccatctggaggagg

SEQ ID NO: 217 - DNA, 20 bp, Artificial Sequence
  chemically synthesized
gctgcccatctggaggaggc

SEQ ID NO: 218 - DNA, 20 bp, Artificial Sequence
  chemically synthesized
tgcccatctggaggaggcgg

SEQ ID NO: 219 - DNA, 20 bp, Artificial Sequence
  chemically synthesized
gcccatctggaggaggcggg

SEQ ID NO: 220 - DNA, 20 bp, Artificial Sequence
  chemically synthesized
cccatctggaggaggcggga

SEQ ID NO: 221 - DNA, 20 bp, Artificial Sequence
  chemically synthesized
catctggaggaggcgggagg

SEQ ID NO: 222 - DNA, 20 bp, Artificial Sequence
  chemically synthesized
aggaggcgggagggagctac

SEQ ID NO: 223 - DNA, 20 bp, Artificial Sequence
  chemically synthesized
ggaggcgggagggagctacg

SEQ ID NO: 224 - DNA, 20 bp, Artificial Sequence
  chemically synthesized
gaggcgggagggagctacga

SEQ ID NO: 225 - DNA, 20 bp, Artificial Sequence
  chemically synthesized
gggagggagctacgagggcc

SEQ ID NO: 226 - DNA, 20 bp, Artificial Sequence
  chemically synthesized
gagggagctacgagggccaa

SEQ ID NO: 227 - DNA, 20 bp, Artificial Sequence
  chemically synthesized
gctacgagggccaagagcat

SEQ ID NO: 228 - DNA, 20 bp, Artificial Sequence
  chemically synthesized
ctacgagggccaagagcatg

SEQ ID NO: 229 - DNA, 20 bp, Artificial Sequence
  chemically synthesized
gggccaagagcatgaggtca

SEQ ID NO: 230 - DNA, 20 bp, Artificial Sequence
  chemically synthesized
agcatgaggtcatggaaact

SEQ ID NO: 231 - DNA, 20 bp, Artificial Sequence
  chemically synthesized
gcatgaggtcatggaaactc

SEQ ID NO: 232 - DNA, 20 bp, Artificial Sequence
  chemically synthesized
tcatggaaactcgggctgtg

SEQ ID NO: 233 - DNA, 20 bp, Artificial Sequence
  chemically synthesized
catggaaactcgggctgtga

SEQ ID NO: 234 - DNA, 20 bp, Artificial Sequence
  chemically synthesized
atggaaactcgggctgtgaa

SEQ ID NO: 235 - DNA, 20 bp, Artificial Sequence
  chemically synthesized
tggaaactcgggctgtgaag

SEQ ID NO: 236 - DNA, 20 bp, Artificial Sequence
  chemically synthesized
tgaaggggccgcacgtgccc

SEQ ID NO: 237 - DNA, 20 bp, Artificial Sequence
  chemically synthesized
gaaggggccgcacgtgccct

SEQ ID NO: 238 - DNA, 20 bp, Artificial Sequence
  chemically synthesized
ggccgcacgtgccctgggaa

SEQ ID NO: 239 - DNA, 20 bp, Artificial Sequence
  chemically synthesized
gccgcacgtgccctgggaac

SEQ ID NO: 240 - DNA, 20 bp, Artificial Sequence
  chemically synthesized
ccctgggaacgggatgaact

SEQ ID NO: 241 - DNA, 20 bp, Artificial Sequence
  chemically synthesized
tcggctcgtttatttccacc

SEQ ID NO: 242 - DNA, 20 bp, Artificial Sequence
  chemically synthesized
ttatttccacccagttgtca

SEQ ID NO: 243 - DNA, 20 bp, Artificial Sequence
  chemically synthesized
ccacccagttgtcatggcga

SEQ ID NO: 244 - DNA, 20 bp, Artificial Sequence
  chemically synthesized
cacccagttgtcatggcgat

SEQ ID NO: 245 - DNA, 20 bp, Artificial Sequence
  chemically synthesized
acccagttgtcatggcgata

SEQ ID NO: 246 - DNA, 20 bp, Artificial Sequence
  chemically synthesized
cccagttgtcatggcgatag

SEQ ID NO: 247 - DNA, 20 bp, Artificial Sequence
  chemically synthesized
cagttgtcatggcgataggg

SEQ ID NO: 248 - DNA, 20 bp, Artificial Sequence
  chemically synthesized
agttgtcatggcgatagggg

SEQ ID NO: 249 - DNA, 20 bp, Artificial Sequence
  chemically synthesized
gttgtcatggcgatagggga

SEQ ID NO: 250 - DNA, 20 bp, Artificial Sequence
  chemically synthesized
ttgtcatggcgataggggag

SEQ ID NO: 251 - DNA, 20 bp, Artificial Sequence
  chemically synthesized
tgtcatggcgataggggagg

SEQ ID NO: 252 - DNA, 20 bp, Artificial Sequence
  chemically synthesized
gtcatggcgataggggaggg

SEQ ID NO: 253 - DNA, 20 bp, Artificial Sequence
  chemically synthesized
tggcgataggggaggggggc

SEQ ID NO: 254 - DNA, 20 bp, Artificial Sequence
  chemically synthesized
ggcgataggggaggggggca

SEQ ID NO: 255 - DNA, 20 bp, Artificial Sequence
  chemically synthesized
cgataggggaggggggcaag

SEQ ID NO: 256 - DNA, 20 bp, Artificial Sequence
  chemically synthesized
ataggggaggggggcaagga

SEQ ID NO: 257 - DNA, 20 bp, Artificial Sequence
  chemically synthesized
gaggggggcaaggagagcaa

SEQ ID NO: 258 - DNA, 20 bp, Artificial Sequence
  chemically synthesized
aggggggcaaggagagcaat

SEQ ID NO: 259 - DNA, 20 bp, Artificial Sequence
  chemically synthesized
gcaatgggcctttccctttc

SEQ ID NO: 260 - DNA, 20 bp, Artificial Sequence
  chemically synthesized
caatgggcctttccctttca

SEQ ID NO: 261 - DNA, 20 bp, Artificial Sequence
  chemically synthesized
ttccctttcaaggacctgcc

SEQ ID NO: 262 - DNA, 20 bp, Artificial Sequence
  chemically synthesized
tttcaaggacctgcccagta

SEQ ID NO: 263 - DNA, 20 bp, Artificial Sequence
  chemically synthesized
ttcaaggacctgcccagtac

SEQ ID NO: 264 - DNA, 20 bp, Artificial Sequence
  chemically synthesized
cagtacaggcatccctgtga

SEQ ID NO: 265 - DNA, 20 bp, Artificial Sequence
  chemically synthesized
catccctgtgaaagatgcct

SEQ ID NO: 266 - DNA, 20 bp, Artificial Sequence
  chemically synthesized
atccctgtgaaagatgcctg

SEQ ID NO: 267 - DNA, 20 bp, Artificial Sequence
  chemically synthesized
tgtgaaagatgcctgaggcc

SEQ ID NO: 268 - DNA, 20 bp, Artificial Sequence
  chemically synthesized
gtgaaagatgcctgaggcct

SEQ ID NO: 269 - DNA, 20 bp, Artificial Sequence
  chemically synthesized
gatgcctgaggcctgggcac

SEQ ID NO: 270 - DNA, 20 bp, Artificial Sequence
  chemically synthesized
atgcctgaggcctgggcacc

SEQ ID NO: 271 - DNA, 20 bp, Artificial Sequence
  chemically synthesized
tgcctgaggcctgggcacca

SEQ ID NO: 272 - DNA, 20 bp, Artificial Sequence
  chemically synthesized
ggcctgggcaccagggactc

SEQ ID NO: 273 - DNA, 20 bp, Artificial Sequence
  chemically synthesized
cctgggcaccagggactcca

SEQ ID NO: 274 - DNA, 20 bp, Artificial Sequence
  chemically synthesized
gcaccagggactccagagtc

SEQ ID NO: 275 - DNA, 20 bp, Artificial Sequence
  chemically synthesized
caccagggactccagagtcc

SEQ ID NO: 276 - DNA, 20 bp, Artificial Sequence
  chemically synthesized
caacccctccccattcaacc

SEQ ID NO: 277 - DNA, 20 bp, Artificial Sequence
  chemically synthesized
aacccctccccattcaaccc

SEQ ID NO: 278 - DNA, 20 bp, Artificial Sequence
  chemically synthesized
cccctccccattcaacccag

SEQ ID NO: 279 - DNA, 20 bp, Artificial Sequence
  chemically synthesized
ccctccccattcaacccagg

SEQ ID NO: 280 - DNA, 20 bp, Artificial Sequence
  chemically synthesized
ccccattcaacccaggaggc

SEQ ID NO: 281 - DNA, 20 bp, Artificial Sequence
  chemically synthesized
cccattcaacccaggaggcc

SEQ ID NO: 282 - DNA, 20 bp, Artificial Sequence
  chemically synthesized
caacccaggaggccaggccc

SEQ ID NO: 283 - DNA, 20 bp, Artificial Sequence
  chemically synthesized
ggccccagcccttccgccct

SEQ ID NO: 284 - DNA, 20 bp, Artificial Sequence
  chemically synthesized
agcccttccgccctcagatg

SEQ ID NO: 285 - DNA, 20 bp, Artificial Sequence
  chemically synthesized
gcccttccgccctcagatga

SEQ ID NO: 286 - DNA, 20 bp, Artificial Sequence
  chemically synthesized
ccttccgccctcagatgaag

SEQ ID NO: 287 - DNA, 20 bp, Artificial Sequence
  chemically synthesized
cgccctcagatgaaggagtc

SEQ ID NO: 288 - DNA, 20 bp, Artificial Sequence
  chemically synthesized
gccctcagatgaaggagtcc

SEQ ID NO: 289 - DNA, 20 bp, Artificial Sequence
  chemically synthesized
gatgaaggagtccaggcccc

SEQ ID NO: 290 - DNA, 20 bp, Artificial Sequence
  chemically synthesized
gcccccagcctctccccatt

SEQ ID NO: 291 - DNA, 20 bp, Artificial Sequence
  chemically synthesized
agcctctccccattcagacc

SEQ ID NO: 292 - DNA, 20 bp, Artificial Sequence
  chemically synthesized
gcctctccccattcagaccc

SEQ ID NO: 293 - DNA, 20 bp, Artificial Sequence
  chemically synthesized
cctctccccattcagaccca

SEQ ID NO: 294 - DNA, 20 bp, Artificial Sequence
  chemically synthesized
ctctccccattcagacccag

SEQ ID NO: 295 - DNA, 20 bp, Artificial Sequence
  chemically synthesized
cccattcagacccaggggtc

SEQ ID NO: 296 - DNA, 20 bp, Artificial Sequence
  chemically synthesized
ccattcagacccaggggtcc

SEQ ID NO: 297 - DNA, 20 bp, Artificial Sequence
  chemically synthesized
cagacccaggggtccaggcc

SEQ ID NO: 298 - DNA, 20 bp, Artificial Sequence
  chemically synthesized
aggcccagccccgcctccct

SEQ ID NO: 299 - DNA, 20 bp, Artificial Sequence
  chemically synthesized
agccccgcctccctaagacc

SEQ ID NO: 300 - DNA, 20 bp, Artificial Sequence
  chemically synthesized
cccgcctccctaagacccag

SEQ ID NO: 301 - DNA, 20 bp, Artificial Sequence
  chemically synthesized
ctccctaagacccagaagtc

SEQ ID NO: 302 - DNA, 20 bp, Artificial Sequence
  chemically synthesized
tccctaagacccagaagtcc

SEQ ID NO: 303 - DNA, 20 bp, Artificial Sequence
  chemically synthesized
gacccagaagtccaggcccc

SEQ ID NO: 304 - DNA, 20 bp, Artificial Sequence
  chemically synthesized
gcccccagcccctcctccct

SEQ ID NO: 305 - DNA, 20 bp, Artificial Sequence
  chemically synthesized
ccctcctccctcagacccac

SEQ ID NO: 306 - DNA, 20 bp, Artificial Sequence
  chemically synthesized
ctccctcagacccacgagtc

SEQ ID NO: 307 - DNA, 20 bp, Artificial Sequence
  chemically synthesized
tccctcagacccacgagtcc

SEQ ID NO: 308 - DNA, 20 bp, Artificial Sequence
  chemically synthesized
agacccacgagtccaggccc

SEQ ID NO: 309 - DNA, 20 bp, Artificial Sequence
  chemically synthesized
ggccccagcccctcctccct

SEQ ID NO: 310 - DNA, 20 bp, Artificial Sequence
  chemically synthesized
agcccctcctccctcggacc

SEQ ID NO: 311 - DNA, 20 bp, Artificial Sequence
  chemically synthesized
gcccctcctccctcggaccc

SEQ ID NO: 312 - DNA, 20 bp, Artificial Sequence
  chemically synthesized
ccctcctccctcggacccag

SEQ ID NO: 313 - DNA, 20 bp, Artificial Sequence
  chemically synthesized
ctccctcggacccaggagtc

SEQ ID NO: 314 - DNA, 20 bp, Artificial Sequence
  chemically synthesized
tccctcggacccaggagtcc

SEQ ID NO: 315 - DNA, 20 bp, Artificial Sequence
  chemically synthesized
gacccaggagtccaggcccc

SEQ ID NO: 316 - DNA, 20 bp, Artificial Sequence
  chemically synthesized
gcccccagtccctccaccct

SEQ ID NO: 317 - DNA, 20 bp, Artificial Sequence
  chemically synthesized
agtccctccaccctcagacc

SEQ ID NO: 318 - DNA, 20 bp, Artificial Sequence
  chemically synthesized
gtccctccaccctcagaccc

SEQ ID NO: 319 - DNA, 20 bp, Artificial Sequence
  chemically synthesized
ccctccaccctcagacccag

SEQ ID NO: 320 - DNA, 20 bp, Artificial Sequence
  chemically synthesized
caccctcagacccaggagtc

SEQ ID NO: 321 - DNA, 20 bp, Artificial Sequence
  chemically synthesized
accctcagacccaggagtcc

SEQ ID NO: 322 - DNA, 20 bp, Artificial Sequence
  chemically synthesized
agacccaggagtccaggccc

SEQ ID NO: 323 - DNA, 20 bp, Artificial Sequence
  chemically synthesized
ggccccagcccctcctccct

SEQ ID NO: 324 - DNA, 20 bp, Artificial Sequence
  chemically synthesized
agcccctcctccctcggacc

SEQ ID NO: 325 - DNA, 20 bp, Artificial Sequence
  chemically synthesized
gcccctcctccctcggaccc

SEQ ID NO: 326 - DNA, 20 bp, Artificial Sequence
  chemically synthesized
ccctcctccctcggacccag

SEQ ID NO: 327 - DNA, 20 bp, Artificial Sequence
  chemically synthesized
ctccctcggacccaggagtc

SEQ ID NO: 328 - DNA, 20 bp, Artificial Sequence
  chemically synthesized
tccctcggacccaggagtcc

SEQ ID NO: 329 - DNA, 20 bp, Artificial Sequence
  chemically synthesized
ggacccaggagtccaggccc

SEQ ID NO: 330 - DNA, 20 bp, Artificial Sequence
  chemically synthesized
agcccctcctctctcaaacc

SEQ ID NO: 331 - DNA, 20 bp, Artificial Sequence
  chemically synthesized
gcccctcctctctcaaaccc

SEQ ID NO: 332 - DNA, 20 bp, Artificial Sequence
  chemically synthesized
ccctcctctctcaaacccag

SEQ ID NO: 333 - DNA, 20 bp, Artificial Sequence
  chemically synthesized
ctctctcaaacccaggagcc

SEQ ID NO: 334 - DNA, 20 bp, Artificial Sequence
  chemically synthesized
tctctcaaacccaggagccc

SEQ ID NO: 335 - DNA, 20 bp, Artificial Sequence
  chemically synthesized
aacccaggagcccaggcccc

SEQ ID NO: 336 - DNA, 20 bp, Artificial Sequence
  chemically synthesized
gcccccagctcttctctgtt

SEQ ID NO: 337 - DNA, 20 bp, Artificial Sequence
  chemically synthesized
gctcttctctgttcagccct

SEQ ID NO: 338 - DNA, 20 bp, Artificial Sequence
  chemically synthesized
ctgttcagccctaagaatcc

SEQ ID NO: 339 - DNA, 20 bp, Artificial Sequence
  chemically synthesized
agccctaagaatcctggctc

SEQ ID NO: 340 - DNA, 20 bp, Artificial Sequence
  chemically synthesized
ggctccagcccctcctactc

SEQ ID NO: 341 - DNA, 20 bp, Artificial Sequence
  chemically synthesized
tactctagcccccaaccccc

SEQ ID NO: 342 - DNA, 20 bp, Artificial Sequence
  chemically synthesized
cccccaaccccctagccact

SEQ ID NO: 343 - DNA, 20 bp, Artificial Sequence
  chemically synthesized
ccccaaccccctagccacta

SEQ ID NO: 344 - DNA, 20 bp, Artificial Sequence
  chemically synthesized
cccctagccactaaggcaat

SEQ ID NO: 345 - DNA, 20 bp, Artificial Sequence
  chemically synthesized
ccctagccactaaggcaatt

SEQ ID NO: 346 - DNA, 20 bp, Artificial Sequence
  chemically synthesized
cctagccactaaggcaattg

SEQ ID NO: 347 - DNA, 20 bp, Artificial Sequence
  chemically synthesized
ccactaaggcaattggggtg

SEQ ID NO: 348 - DNA, 20 bp, Artificial Sequence
  chemically synthesized
cactaaggcaattggggtgc

SEQ ID NO: 349 - DNA, 20 bp, Artificial Sequence
  chemically synthesized
aggcaattggggtgcaggaa

SEQ ID NO: 350 - DNA, 20 bp, Artificial Sequence
  chemically synthesized
ggcaattggggtgcaggaat

SEQ ID NO: 351 - DNA, 20 bp, Artificial Sequence
  chemically synthesized
gcaattggggtgcaggaatg

SEQ ID NO: 352 - DNA, 20 bp, Artificial Sequence
  chemically synthesized
caattggggtgcaggaatgg

SEQ ID NO: 353 - DNA, 20 bp, Artificial Sequence
  chemically synthesized
ttggggtgcaggaatggggg

SEQ ID NO: 354 - DNA, 20 bp, Artificial Sequence
  chemically synthesized
tggggtgcaggaatgggggc

SEQ ID NO: 355 - DNA, 20 bp, Artificial Sequence
  chemically synthesized
ggggtgcaggaatgggggca

SEQ ID NO: 356 - DNA, 20 bp, Artificial Sequence
  chemically synthesized
caggaatgggggcagggtac

SEQ ID NO: 357 - DNA, 20 bp, Artificial Sequence
  chemically synthesized
ggcagggtaccagcctcacc

SEQ ID NO: 358 - DNA, 20 bp, Artificial Sequence
  chemically synthesized
agggtaccagcctcaccaag

SEQ ID NO: 359 - DNA, 20 bp, Artificial Sequence
  chemically synthesized
aagtggttgataaacccacg

SEQ ID NO: 360 - DNA, 20 bp, Artificial Sequence
  chemically synthesized
agtggttgataaacccacgt

SEQ ID NO: 361 - DNA, 20 bp, Artificial Sequence
  chemically synthesized
gtggttgataaacccacgtg

SEQ ID NO: 362 - DNA, 20 bp, Artificial Sequence
  chemically synthesized
aaacccacgtggggtaccct

SEQ ID NO: 363 - DNA, 20 bp, Artificial Sequence
  chemically synthesized
cgtggggtaccctaagaact

SEQ ID NO: 364 - DNA, 20 bp, Artificial Sequence
  chemically synthesized
gtggggtaccctaagaactt

SEQ ID NO: 365 - DNA, 20 bp, Artificial Sequence
  chemically synthesized
gtaccctaagaacttgggaa

SEQ ID NO: 366 - DNA, 20 bp, Artificial Sequence
  chemically synthesized
taagaacttgggaacagcca

SEQ ID NO: 367 - DNA, 20 bp, Artificial Sequence
  chemically synthesized
gaacttgggaacagccacag

SEQ ID NO: 368 - DNA, 20 bp, Artificial Sequence
  chemically synthesized
aacttgggaacagccacagc

SEQ ID NO: 369 - DNA, 20 bp, Artificial Sequence
  chemically synthesized
acttgggaacagccacagca

SEQ ID NO: 370 - DNA, 20 bp, Artificial Sequence
  chemically synthesized
cttgggaacagccacagcag

SEQ ID NO: 371 - DNA, 20 bp, Artificial Sequence
  chemically synthesized
ttgggaacagccacagcagg

SEQ ID NO: 372 - DNA, 20 bp, Artificial Sequence
  chemically synthesized
tgggaacagccacagcaggg

SEQ ID NO: 373 - DNA, 20 bp, Artificial Sequence
  chemically synthesized
cacagcaggggggcgatgct

SEQ ID NO: 374 - DNA, 20 bp, Artificial Sequence
  chemically synthesized
acagcaggggggcgatgctt

SEQ ID NO: 375 - DNA, 20 bp, Artificial Sequence
  chemically synthesized
cagcaggggggcgatgcttg

SEQ ID NO: 376 - DNA, 20 bp, Artificial Sequence
  chemically synthesized
gcgatgcttggggacctgcc

SEQ ID NO: 377 - DNA, 20 bp, Artificial Sequence
  chemically synthesized
gatgcttggggacctgcctg

SEQ ID NO: 378 - DNA, 20 bp, Artificial Sequence
  chemically synthesized
gcttggggacctgcctggag

SEQ ID NO: 379 - DNA, 20 bp, Artificial Sequence
  chemically synthesized
cttggggacctgcctggaga

SEQ ID NO: 380 - DNA, 20 bp, Artificial Sequence
  chemically synthesized
gacctgcctggagaaggatg

SEQ ID NO: 381 - DNA, 20 bp, Artificial Sequence
  chemically synthesized
acctgcctggagaaggatgc

SEQ ID NO: 382 - DNA, 20 bp, Artificial Sequence
  chemically synthesized
cctggagaaggatgcaggac

SEQ ID NO: 383 - DNA, 20 bp, Artificial Sequence
  chemically synthesized
aggatgcaggacgagaaaca

SEQ ID NO: 384 - DNA, 20 bp, Artificial Sequence
  chemically synthesized
caggacgagaaacacagccc

SEQ ID NO: 385 - DNA, 20 bp, Artificial Sequence
  chemically synthesized
aggacgagaaacacagcccc

SEQ ID NO: 386 - DNA, 20 bp, Artificial Sequence
  chemically synthesized
acgagaaacacagccccagg

SEQ ID NO: 387 - DNA, 20 bp, Artificial Sequence
  chemically synthesized
gagaaacacagccccaggtg

SEQ ID NO: 388 - DNA, 20 bp, Artificial Sequence
  chemically synthesized
acagccccaggtggagaaac

SEQ ID NO: 389 - DNA, 20 bp, Artificial Sequence
  chemically synthesized
ccccaggtggagaaactggc

SEQ ID NO: 390 - DNA, 20 bp, Artificial Sequence
  chemically synthesized
cccaggtggagaaactggcc

SEQ ID NO: 391 - DNA, 20 bp, Artificial Sequence
  chemically synthesized
ggagaaactggccgggaatc

SEQ ID NO: 392 - DNA, 20 bp, Artificial Sequence
  chemically synthesized
agaaactggccgggaatcaa

SEQ ID NO: 393 - DNA, 20 bp, Artificial Sequence
  chemically synthesized
gccgggaatcaagagtcacc

SEQ ID NO: 394 - DNA, 20 bp, Artificial Sequence
  chemically synthesized
cgggaatcaagagtcaccca

SEQ ID NO: 395 - DNA, 20 bp, Artificial Sequence
  chemically synthesized
aatcaagagtcacccagaga

SEQ ID NO: 396 - DNA, 20 bp, Artificial Sequence
  chemically synthesized
accaaccatccctgttttcc

SEQ ID NO: 397 - DNA, 20 bp, Artificial Sequence
  chemically synthesized
ccaaccatccctgttttcct

SEQ ID NO: 398 - DNA, 20 bp, Artificial Sequence
  chemically synthesized
atccctgttttcctaggact

SEQ ID NO: 399 - DNA, 20 bp, Artificial Sequence
  chemically synthesized
tccctgttttcctaggactg

SEQ ID NO: 400 - DNA, 20 bp, Artificial Sequence
  chemically synthesized
ccctgttttcctaggactga

SEQ ID NO: 401 - DNA, 20 bp, Artificial Sequence
  chemically synthesized
tttcctaggactgagggttt

SEQ ID NO: 402 - DNA, 20 bp, Artificial Sequence
  chemically synthesized
gagggtttcagtgctaaaac

SEQ ID NO: 403 - DNA, 20 bp, Artificial Sequence
  chemically synthesized
agggtttcagtgctaaaact

SEQ ID NO: 404 - DNA, 20 bp, Artificial Sequence
  chemically synthesized
gtgctaaaactaggctgtcc

SEQ ID NO: 405 - DNA, 20 bp, Artificial Sequence
  chemically synthesized
tgctaaaactaggctgtcct

SEQ ID NO: 406 - DNA, 20 bp, Artificial Sequence
  chemically synthesized
actaggctgtcctgggcaaa

SEQ ID NO: 407 - DNA, 20 bp, Artificial Sequence
  chemically synthesized
ctgtcctgggcaaacagcat

SEQ ID NO: 408 - DNA, 20 bp, Artificial Sequence
  chemically synthesized
cctgggcaaacagcataagc

SEQ ID NO: 409 - DNA, 20 bp, Artificial Sequence
  chemically synthesized
taagctggtcaccccacacc

SEQ ID NO: 410 - DNA, 20 bp, Artificial Sequence
  chemically synthesized
acccagacctgacccaaacc

SEQ ID NO: 411 - DNA, 20 bp, Artificial Sequence
  chemically synthesized
aacccagctcccctgcttct

SEQ ID NO: 412 - DNA, 20 bp, Artificial Sequence
  chemically synthesized
gcttcttggccacgtaacct

SEQ ID NO: 413 - DNA, 20 bp, Artificial Sequence
  chemically synthesized
tcttggccacgtaacctgag

SEQ ID NO: 414 - DNA, 20 bp, Artificial Sequence
  chemically synthesized
cttggccacgtaacctgaga

SEQ ID NO: 415 - DNA, 20 bp, Artificial Sequence
  chemically synthesized
ttggccacgtaacctgagaa

SEQ ID NO: 416 - DNA, 20 bp, Artificial Sequence
  chemically synthesized
aatccctcctctctgaaccc

SEQ ID NO: 417 - DNA, 20 bp, Artificial Sequence
  chemically synthesized
cccagcccaccccaatgctc

SEQ ID NO: 418 - DNA, 20 bp, Artificial Sequence
  chemically synthesized
ccagcccaccccaatgctcc

SEQ ID NO: 419 - DNA, 20 bp, Artificial Sequence
  chemically synthesized
ccccaatgctccaggcctcc

SEQ ID NO: 420 - DNA, 20 bp, Artificial Sequence
  chemically synthesized
cccaatgctccaggcctcct

SEQ ID NO: 421 - DNA, 20 bp, Artificial Sequence
  chemically synthesized
aggcctcctgggataccccg

SEQ ID NO: 422 - DNA, 20 bp, Artificial Sequence
  chemically synthesized
gcctcctgggataccccgaa

SEQ ID NO: 423 - DNA, 20 bp, Artificial Sequence
  chemically synthesized
cctgggataccccgaagagt

SEQ ID NO: 424 - DNA, 20 bp, Artificial Sequence
  chemically synthesized
ccccgaagagtgagtttgcc

SEQ ID NO: 425 - DNA, 20 bp, Artificial Sequence
  chemically synthesized
cgaagagtgagtttgccaag

SEQ ID NO: 426 - DNA, 20 bp, Artificial Sequence
  chemically synthesized
tttgccaagcagtcacccca

SEQ ID NO: 427 - DNA, 20 bp, Artificial Sequence
  chemically synthesized
ccaagcagtcaccccacagt

SEQ ID NO: 428 - DNA, 20 bp, Artificial Sequence
  chemically synthesized
aagcagtcaccccacagttg

SEQ ID NO: 429 - DNA, 20 bp, Artificial Sequence
  chemically synthesized
agcagtcaccccacagttgg

SEQ ID NO: 430 - DNA, 20 bp, Artificial Sequence
  chemically synthesized
cagtcaccccacagttggag

SEQ ID NO: 431 - DNA, 20 bp, Artificial Sequence
  chemically synthesized
ttggaggagaatccacccaa

SEQ ID NO: 432 - DNA, 20 bp, Artificial Sequence
  chemically synthesized
tggaggagaatccacccaaa

SEQ ID NO: 433 - DNA, 20 bp, Artificial Sequence
  chemically synthesized
aggagaatccacccaaaagg

SEQ ID NO: 434 - DNA, 20 bp, Artificial Sequence
  chemically synthesized
aatccacccaaaaggcagcc

SEQ ID NO: 435 - DNA, 20 bp, Artificial Sequence
  chemically synthesized
ccacccaaaaggcagcctgg

SEQ ID NO: 436 - DNA, 20 bp, Artificial Sequence
  chemically synthesized
ccaaaaggcagcctggtaga

SEQ ID NO: 437 - DNA, 20 bp, Artificial Sequence
  chemically synthesized
caaaaggcagcctggtagac

SEQ ID NO: 438 - DNA, 20 bp, Artificial Sequence
  chemically synthesized
aaaaggcagcctggtagaca

SEQ ID NO: 439 - DNA, 20 bp, Artificial Sequence
  chemically synthesized
ggcagcctggtagacagggc

SEQ ID NO: 440 - DNA, 20 bp, Artificial Sequence
  chemically synthesized
gcagcctggtagacagggct

SEQ ID NO: 441 - DNA, 20 bp, Artificial Sequence
  chemically synthesized
cagcctggtagacagggctg

SEQ ID NO: 442 - DNA, 20 bp, Artificial Sequence
  chemically synthesized
cctggtagacagggctgggg

SEQ ID NO: 443 - DNA, 20 bp, Artificial Sequence
  chemically synthesized
agggctggggtggcctctcg

SEQ ID NO: 444 - DNA, 20 bp, Artificial Sequence
  chemically synthesized
gggctggggtggcctctcgt

SEQ ID NO: 445 - DNA, 20 bp, Artificial Sequence
  chemically synthesized
ggctggggtggcctctcgtg

SEQ ID NO: 446 - DNA, 20 bp, Artificial Sequence
  chemically synthesized
gggtggcctctcgtggggtc

SEQ ID NO: 447 - DNA, 20 bp, Artificial Sequence
  chemically synthesized
ggtggcctctcgtggggtcc

SEQ ID NO: 448 - DNA, 20 bp, Artificial Sequence
  chemically synthesized
cctctcgtggggtccaggcc

SEQ ID NO: 449 - DNA, 20 bp, Artificial Sequence
  chemically synthesized
ctcgtggggtccaggccaag

SEQ ID NO: 450 - DNA, 20 bp, Artificial Sequence
  chemically synthesized
tcgtggggtccaggccaagt

SEQ ID NO: 451 - DNA, 20 bp, Artificial Sequence
  chemically synthesized
tggggtccaggccaagtagg

SEQ ID NO: 452 - DNA, 20 bp, Artificial Sequence
  chemically synthesized
tccaggccaagtaggtggcc

SEQ ID NO: 453 - DNA, 20 bp, Artificial Sequence
  chemically synthesized
ccaggccaagtaggtggcct

SEQ ID NO: 454 - DNA, 20 bp, Artificial Sequence
  chemically synthesized
caggccaagtaggtggcctg

SEQ ID NO: 455 - DNA, 20 bp, Artificial Sequence
  chemically synthesized
agtaggtggcctggggcctc

SEQ ID NO: 456 - DNA, 20 bp, Artificial Sequence
  chemically synthesized
gtaggtggcctggggcctct

SEQ ID NO: 457 - DNA, 20 bp, Artificial Sequence
  chemically synthesized
taggtggcctggggcctctg

SEQ ID NO: 458 - DNA, 20 bp, Artificial Sequence
  chemically synthesized
aggtggcctggggcctctgg

SEQ ID NO: 459 - DNA, 20 bp, Artificial Sequence
  chemically synthesized
cctggggcctctgggggatg

SEQ ID NO: 460 - DNA, 20 bp, Artificial Sequence
  chemically synthesized
ctggggcctctgggggatgc

SEQ ID NO: 461 - DNA, 20 bp, Artificial Sequence
  chemically synthesized
tggggcctctgggggatgca

SEQ ID NO: 462 - DNA, 20 bp, Artificial Sequence
  chemically synthesized
ggggcctctgggggatgcag

SEQ ID NO: 463 - DNA, 20 bp, Artificial Sequence
  chemically synthesized
gcctctgggggatgcagggg

SEQ ID NO: 464 - DNA, 20 bp, Artificial Sequence
  chemically synthesized
cctctgggggatgcagggga

SEQ ID NO: 465 - DNA, 20 bp, Artificial Sequence
  chemically synthesized
ctctgggggatgcaggggaa

SEQ ID NO: 466 - DNA, 20 bp, Artificial Sequence
  chemically synthesized
tctgggggatgcaggggaag

SEQ ID NO: 467 - DNA, 20 bp, Artificial Sequence
  chemically synthesized
ctgggggatgcaggggaagg

SEQ ID NO: 468 - DNA, 20 bp, Artificial Sequence
  chemically synthesized
gatgcaggggaagggggatg

SEQ ID NO: 469 - DNA, 20 bp, Artificial Sequence
  chemically synthesized
atgcaggggaagggggatgc

SEQ ID NO: 470 - DNA, 20 bp, Artificial Sequence
  chemically synthesized
tgcaggggaagggggatgca

SEQ ID NO: 471 - DNA, 20 bp, Artificial Sequence
  chemically synthesized
gcaggggaagggggatgcag

SEQ ID NO: 472 - DNA, 20 bp, Artificial Sequence
  chemically synthesized
ggaagggggatgcaggggaa

SEQ ID NO: 473 - DNA, 20 bp, Artificial Sequence
  chemically synthesized
gaagggggatgcaggggaac

SEQ ID NO: 474 - DNA, 20 bp, Artificial Sequence
  chemically synthesized
aagggggatgcaggggaacg

SEQ ID NO: 475 - DNA, 20 bp, Artificial Sequence
  chemically synthesized
gatgcaggggaacggggatg

SEQ ID NO: 476 - DNA, 20 bp, Artificial Sequence
  chemically synthesized
atgcaggggaacggggatgc

SEQ ID NO: 477 - DNA, 20 bp, Artificial Sequence
  chemically synthesized
tgcaggggaacggggatgca

SEQ ID NO: 478 - DNA, 20 bp, Artificial Sequence
  chemically synthesized
gcaggggaacggggatgcag

SEQ ID NO: 479 - DNA, 20 bp, Artificial Sequence
  chemically synthesized
ggaacggggatgcaggggaa

SEQ ID NO: 480 - DNA, 20 bp, Artificial Sequence
  chemically synthesized
gaacggggatgcaggggaac

SEQ ID NO: 481 - DNA, 20 bp, Artificial Sequence
  chemically synthesized
aacggggatgcaggggaacg

SEQ ID NO: 482 - DNA, 20 bp, Artificial Sequence
  chemically synthesized
ggatgcaggggaacggggct

SEQ ID NO: 483 - DNA, 20 bp, Artificial Sequence
  chemically synthesized
ggggaacggggctcagtctg

SEQ ID NO: 484 - DNA, 20 bp, Artificial Sequence
  chemically synthesized
ggaacggggctcagtctgaa

SEQ ID NO: 485 - DNA, 20 bp, Artificial Sequence
  chemically synthesized
acggggctcagtctgaagag

SEQ ID NO: 486 - DNA, 20 bp, Artificial Sequence
  chemically synthesized
ggggctcagtctgaagagca

SEQ ID NO: 487 - DNA, 20 bp, Artificial Sequence
  chemically synthesized
ctcagtctgaagagcagagc

SEQ ID NO: 488 - DNA, 20 bp, Artificial Sequence
  chemically synthesized
tcagtctgaagagcagagcc

SEQ ID NO: 489 - DNA, 20 bp, Artificial Sequence
  chemically synthesized
agcagagccaggaacccctg

SEQ ID NO: 490 - DNA, 20 bp, Artificial Sequence
  chemically synthesized
gcagagccaggaacccctgt

SEQ ID NO: 491 - DNA, 20 bp, Artificial Sequence
  chemically synthesized
cagagccaggaacccctgta

SEQ ID NO: 492 - DNA, 20 bp, Artificial Sequence
  chemically synthesized
agccaggaacccctgtaggg

SEQ ID NO: 493 - DNA, 20 bp, Artificial Sequence
  chemically synthesized
gccaggaacccctgtaggga

SEQ ID NO: 494 - DNA, 20 bp, Artificial Sequence
  chemically synthesized
ccaggaacccctgtagggaa

SEQ ID NO: 495 - DNA, 20 bp, Artificial Sequence
  chemically synthesized
caggaacccctgtagggaag

SEQ ID NO: 496 - DNA, 20 bp, Artificial Sequence
  chemically synthesized
gaacccctgtagggaagggg

SEQ ID NO: 497 - DNA, 20 bp, Artificial Sequence
  chemically synthesized
aacccctgtagggaaggggc

SEQ ID NO: 498 - DNA, 20 bp, Artificial Sequence
  chemically synthesized
cccctgtagggaaggggcag

SEQ ID NO: 499 - DNA, 20 bp, Artificial Sequence
  chemically synthesized
cctgtagggaaggggcagga

SEQ ID NO: 500 - DNA, 20 bp, Artificial Sequence
  chemically synthesized
tagggaaggggcaggagagc

SEQ ID NO: 501 - DNA, 20 bp, Artificial Sequence
  chemically synthesized
agggaaggggcaggagagcc

SEQ ID NO: 502 - DNA, 20 bp, Artificial Sequence
  chemically synthesized
gggaaggggcaggagagcca

SEQ ID NO: 503 - DNA, 20 bp, Artificial Sequence
  chemically synthesized
ggaaggggcaggagagccag

SEQ ID NO: 504 - DNA, 20 bp, Artificial Sequence
  chemically synthesized
ggcaggagagccaggggcat

SEQ ID NO: 505 - DNA, 20 bp, Artificial Sequence
  chemically synthesized
ggagagccaggggcatgaga

SEQ ID NO: 506 - DNA, 20 bp, Artificial Sequence
  chemically synthesized
gagccaggggcatgagatgg

SEQ ID NO: 507 - DNA, 20 bp, Artificial Sequence
  chemically synthesized
aggggcatgagatggtggac

SEQ ID NO: 508 - DNA, 20 bp, Artificial Sequence
  chemically synthesized
ggggcatgagatggtggacg

SEQ ID NO: 509 - DNA, 20 bp, Artificial Sequence
  chemically synthesized
gcatgagatggtggacgagg

SEQ ID NO: 510 - DNA, 20 bp, Artificial Sequence
  chemically synthesized
catgagatggtggacgagga

SEQ ID NO: 511 - DNA, 20 bp, Artificial Sequence
  chemically synthesized
atgagatggtggacgaggaa

SEQ ID NO: 512 - DNA, 20 bp, Artificial Sequence
  chemically synthesized
tgagatggtggacgaggaag

SEQ ID NO: 513 - DNA, 20 bp, Artificial Sequence
  chemically synthesized
gagatggtggacgaggaagg

SEQ ID NO: 514 - DNA, 20 bp, Artificial Sequence
  chemically synthesized
tggtggacgaggaaggggga

SEQ ID NO: 515 - DNA, 20 bp, Artificial Sequence
  chemically synthesized
ggtggacgaggaagggggac

SEQ ID NO: 516 - DNA, 20 bp, Artificial Sequence
  chemically synthesized
gtggacgaggaagggggaca

SEQ ID NO: 517 - DNA, 20 bp, Artificial Sequence
  chemically synthesized
gacgaggaagggggacaggg

SEQ ID NO: 518 - DNA, 20 bp, Artificial Sequence
  chemically synthesized
gaagggggacagggaagcct

SEQ ID NO: 519 - DNA, 20 bp, Artificial Sequence
  chemically synthesized
ggaagcctgagcgcctctcc

SEQ ID NO: 520 - DNA, 20 bp, Artificial Sequence
  chemically synthesized
gaagcctgagcgcctctcct

SEQ ID NO: 521 - DNA, 20 bp, Artificial Sequence
  chemically synthesized
gcgcctctcctgggcttgcc

SEQ ID NO: 522 - DNA, 20 bp, Artificial Sequence
  chemically synthesized
cgcctctcctgggcttgcca

SEQ ID NO: 523 - DNA, 20 bp, Artificial Sequence
  chemically synthesized
gcttgccaaggactcaaacc

SEQ ID NO: 524 - DNA, 20 bp, Artificial Sequence
  chemically synthesized
tgccaaggactcaaacccag

SEQ ID NO: 525 - DNA, 20 bp, Artificial Sequence
  chemically synthesized
aggactcaaacccagaagcc

SEQ ID NO: 526 - DNA, 20 bp, Artificial Sequence
  chemically synthesized
gactcaaacccagaagccca

SEQ ID NO: 527 - DNA, 20 bp, Artificial Sequence
  chemically synthesized
tcaaacccagaagcccagag

SEQ ID NO: 528 - DNA, 20 bp, Artificial Sequence
  chemically synthesized
caaacccagaagcccagagc

SEQ ID NO: 529 - DNA, 20 bp, Artificial Sequence
  chemically synthesized
aaacccagaagcccagagca

SEQ ID NO: 530 - DNA, 20 bp, Artificial Sequence
  chemically synthesized
agaagcccagagcagggcct

SEQ ID NO: 531 - DNA, 20 bp, Artificial Sequence
  chemically synthesized
gaagcccagagcagggcctt

SEQ ID NO: 532 - DNA, 20 bp, Artificial Sequence
  chemically synthesized
aagcccagagcagggcctta

SEQ ID NO: 533 - DNA, 20 bp, Artificial Sequence
  chemically synthesized
cccagagcagggccttaggg

SEQ ID NO: 534 - DNA, 20 bp, Artificial Sequence
  chemically synthesized
agagcagggccttagggaag

SEQ ID NO: 535 - DNA, 20 bp, Artificial Sequence
  chemically synthesized
gagcagggccttagggaagc

SEQ ID NO: 536 - DNA, 20 bp, Artificial Sequence
  chemically synthesized
agggaagcgggaccctgctc

SEQ ID NO: 537 - DNA, 20 bp, Artificial Sequence
  chemically synthesized
gggaagcgggaccctgctct

SEQ ID NO: 538 - DNA, 20 bp, Artificial Sequence
  chemically synthesized
aagcgggaccctgctctggg

SEQ ID NO: 539 - DNA, 20 bp, Artificial Sequence
  chemically synthesized
gcgggaccctgctctgggcg

SEQ ID NO: 540 - DNA, 20 bp, Artificial Sequence
  chemically synthesized
cgggaccctgctctgggcgg

SEQ ID NO: 541 - DNA, 20 bp, Artificial Sequence
  chemically synthesized
ctgggcggaggaatatgtcc

SEQ ID NO: 542 - DNA, 20 bp, Artificial Sequence
  chemically synthesized
gcggaggaatatgtcccaga

SEQ ID NO: 543 - DNA, 20 bp, Artificial Sequence
  chemically synthesized
gaatatgtcccagatagcac

SEQ ID NO: 544 - DNA, 20 bp, Artificial Sequence
  chemically synthesized
aatatgtcccagatagcact

SEQ ID NO: 545 - DNA, 20 bp, Artificial Sequence
  chemically synthesized
atatgtcccagatagcactg

SEQ ID NO: 546 - DNA, 20 bp, Artificial Sequence
  chemically synthesized
gatagcactggggactcttt

SEQ ID NO: 547 - DNA, 20 bp, Artificial Sequence
  chemically synthesized
atagcactggggactcttta

SEQ ID NO: 548 - DNA, 20 bp, Artificial Sequence
  chemically synthesized
cactggggactctttaagga

SEQ ID NO: 549 - DNA, 20 bp, Artificial Sequence
  chemically synthesized
tggggactctttaaggaaag

SEQ ID NO: 550 - DNA, 20 bp, Artificial Sequence
  chemically synthesized
ggggactctttaaggaaaga

SEQ ID NO: 551 - DNA, 20 bp, Artificial Sequence
  chemically synthesized
actctttaaggaaagaagga

SEQ ID NO: 552 - DNA, 20 bp, Artificial Sequence
  chemically synthesized
tctttaaggaaagaaggatg

SEQ ID NO: 553 - DNA, 20 bp, Artificial Sequence
  chemically synthesized
taaggaaagaaggatggaga

SEQ ID NO: 554 - DNA, 20 bp, Artificial Sequence
  chemically synthesized
aggaaagaaggatggagaaa

SEQ ID NO: 555 - DNA, 20 bp, Artificial Sequence
  chemically synthesized
aagaaggatggagaaagaga

SEQ ID NO: 556 - DNA, 20 bp, Artificial Sequence
  chemically synthesized
agaaggatggagaaagagaa

SEQ ID NO: 557 - DNA, 20 bp, Artificial Sequence
  chemically synthesized
gaaggatggagaaagagaaa

SEQ ID NO: 558 - DNA, 20 bp, Artificial Sequence
  chemically synthesized
aggatggagaaagagaaagg

SEQ ID NO: 559 - DNA, 20 bp, Artificial Sequence
  chemically synthesized
atggagaaagagaaagggag

SEQ ID NO: 560 - DNA, 20 bp, Artificial Sequence
  chemically synthesized
ggagaaagagaaagggagta

SEQ ID NO: 561 - DNA, 20 bp, Artificial Sequence
  chemically synthesized
gagaaagagaaagggagtag

SEQ ID NO: 562 - DNA, 20 bp, Artificial Sequence
  chemically synthesized
aaagagaaagggagtagagg

SEQ ID NO: 563 - DNA, 20 bp, Artificial Sequence
  chemically synthesized
gagtagaggcggccacgacc

SEQ ID NO: 564 - DNA, 20 bp, Artificial Sequence
  chemically synthesized
gccacgacctggtgaacacc

SEQ ID NO: 565 - DNA, 20 bp, Artificial Sequence
  chemically synthesized
ccacgacctggtgaacacct

SEQ ID NO: 566 - DNA, 20 bp, Artificial Sequence
  chemically synthesized
taggacgcaccattctcaca

SEQ ID NO: 567 - DNA, 20 bp, Artificial Sequence
  chemically synthesized
aggacgcaccattctcacaa

SEQ ID NO: 568 - DNA, 20 bp, Artificial Sequence
  chemically synthesized
ggacgcaccattctcacaaa

SEQ ID NO: 569 - DNA, 20 bp, Artificial Sequence
  chemically synthesized
acgcaccattctcacaaagg

SEQ ID NO: 570 - DNA, 20 bp, Artificial Sequence
  chemically synthesized
cacaaagggagttttccaca

SEQ ID NO: 571 - DNA, 20 bp, Artificial Sequence
  chemically synthesized
ggacacccccctcctcacca

SEQ ID NO: 572 - DNA, 20 bp, Artificial Sequence
  chemically synthesized
cctcctcaccacagccctgc

SEQ ID NO: 573 - DNA, 20 bp, Artificial Sequence
  chemically synthesized
ctcctcaccacagccctgcc

SEQ ID NO: 574 - DNA, 20 bp, Artificial Sequence
  chemically synthesized
tcaccacagccctgccagga

SEQ ID NO: 575 - DNA, 20 bp, Artificial Sequence
  chemically synthesized
caccacagccctgccaggac

SEQ ID NO: 576 - DNA, 20 bp, Artificial Sequence
  chemically synthesized
accacagccctgccaggacg

SEQ ID NO: 577 - DNA, 20 bp, Artificial Sequence
  chemically synthesized
cagccctgccaggacggggc

SEQ ID NO: 578 - DNA, 20 bp, Artificial Sequence
  chemically synthesized
gccaggacggggctggctac

SEQ ID NO: 579 - DNA, 20 bp, Artificial Sequence
  chemically synthesized
tggctactggccttatctca

SEQ ID NO: 580 - DNA, 20 bp, Artificial Sequence
  chemically synthesized
ggctactggccttatctcac

SEQ ID NO: 581 - DNA, 20 bp, Artificial Sequence
  chemically synthesized
tcacaggtaaaactgacgca

SEQ ID NO: 582 - DNA, 20 bp, Artificial Sequence
  chemically synthesized
acaggtaaaactgacgcacg

SEQ ID NO: 583 - DNA, 20 bp, Artificial Sequence
  chemically synthesized
caggtaaaactgacgcacgg

SEQ ID NO: 584 - DNA, 20 bp, Artificial Sequence
  chemically synthesized
cacggaggaacaatataaat

SEQ ID NO: 585 - DNA, 20 bp, Artificial Sequence
  chemically synthesized
acggaggaacaatataaatt

SEQ ID NO: 586 - DNA, 20 bp, Artificial Sequence
  chemically synthesized
cggaggaacaatataaattg

SEQ ID NO: 587 - DNA, 20 bp, Artificial Sequence
  chemically synthesized
gaacaatataaattggggac

SEQ ID NO: 588 - DNA, 20 bp, Artificial Sequence
  chemically synthesized
aatataaattggggactaga

SEQ ID NO: 589 - DNA, 20 bp, Artificial Sequence
  chemically synthesized
atataaattggggactagaa

SEQ ID NO: 590 - DNA, 20 bp, Artificial Sequence
  chemically synthesized
aattggggactagaaaggtg

SEQ ID NO: 591 - DNA, 20 bp, Artificial Sequence
  chemically synthesized
ttggggactagaaaggtgaa

SEQ ID NO: 592 - DNA, 20 bp, Artificial Sequence
  chemically synthesized
actagaaaggtgaagagcca

SEQ ID NO: 593 - DNA, 20 bp, Artificial Sequence
  chemically synthesized
gaaaggtgaagagccaaagt

SEQ ID NO: 594 - DNA, 20 bp, Artificial Sequence
  chemically synthesized
gaagagccaaagttagaact

SEQ ID NO: 595 - DNA, 20 bp, Artificial Sequence
  chemically synthesized
aagagccaaagttagaactc

SEQ ID NO: 596 - DNA, 20 bp, Artificial Sequence
  chemically synthesized
ttccaaactgcttctcctct

SEQ ID NO: 597 - DNA, 20 bp, Artificial Sequence
  chemically synthesized
tccaaactgcttctcctctt

SEQ ID NO: 598 - DNA, 20 bp, Artificial Sequence
  chemically synthesized
aaactgcttctcctcttggg

SEQ ID NO: 599 - DNA, 20 bp, Artificial Sequence
  chemically synthesized
cttctcctcttgggaagtgt

SEQ ID NO: 600 - DNA, 20 bp, Artificial Sequence
  chemically synthesized
ttctcctcttgggaagtgta

SEQ ID NO: 601 - DNA, 20 bp, Artificial Sequence
  chemically synthesized
tcctcttgggaagtgtaagg

SEQ ID NO: 602 - DNA, 20 bp, Artificial Sequence
  chemically synthesized
tgggaagtgtaaggaagctg

SEQ ID NO: 603 - DNA, 20 bp, Artificial Sequence
  chemically synthesized
gtgtaaggaagctgcagcac

SEQ ID NO: 604 - DNA, 20 bp, Artificial Sequence
  chemically synthesized
tgtaaggaagctgcagcacc

SEQ ID NO: 605 - DNA, 20 bp, Artificial Sequence
  chemically synthesized
ggaagctgcagcaccaggat

SEQ ID NO: 606 - DNA, 20 bp, Artificial Sequence
  chemically synthesized
ccaggatcagtgaaacgcac

SEQ ID NO: 607 - DNA, 20 bp, Artificial Sequence
  chemically synthesized
gatcagtgaaacgcaccaga

SEQ ID NO: 608 - DNA, 20 bp, Artificial Sequence
  chemically synthesized
aacgcaccagacggccgcgt

SEQ ID NO: 609 - DNA, 20 bp, Artificial Sequence
  chemically synthesized
cgcaccagacggccgcgtca

SEQ ID NO: 610 - DNA, 20 bp, Artificial Sequence
  chemically synthesized
accagacggccgcgtcagag

SEQ ID NO: 611 - DNA, 20 bp, Artificial Sequence
  chemically synthesized
acggccgcgtcagagcagct

SEQ ID NO: 612 - DNA, 20 bp, Artificial Sequence
  chemically synthesized
cggccgcgtcagagcagctc

SEQ ID NO: 613 - DNA, 20 bp, Artificial Sequence
  chemically synthesized
cgtcagagcagctcaggttc

SEQ ID NO: 614 - DNA, 20 bp, Artificial Sequence
  chemically synthesized
gtcagagcagctcaggttct

SEQ ID NO: 615 - DNA, 20 bp, Artificial Sequence
  chemically synthesized
cagagcagctcaggttctgg

SEQ ID NO: 616 - DNA, 20 bp, Artificial Sequence
  chemically synthesized
gagcagctcaggttctggga

SEQ ID NO: 617 - DNA, 20 bp, Artificial Sequence
  chemically synthesized
agcagctcaggttctgggag

SEQ ID NO: 618 - DNA, 20 bp, Artificial Sequence
  chemically synthesized
gcagctcaggttctgggaga

SEQ ID NO: 619 - DNA, 20 bp, Artificial Sequence
  chemically synthesized
gctcaggttctgggagaggg

SEQ ID NO: 620 - DNA, 20 bp, Artificial Sequence
  chemically synthesized
ggttctgggagagggtagcg

SEQ ID NO: 621 - DNA, 20 bp, Artificial Sequence
  chemically synthesized
gttctgggagagggtagcgc

SEQ ID NO: 622 - DNA, 20 bp, Artificial Sequence
  chemically synthesized
ttctgggagagggtagcgca

SEQ ID NO: 623 - DNA, 20 bp, Artificial Sequence
  chemically synthesized
tgggagagggtagcgcaggg

SEQ ID NO: 624 - DNA, 20 bp, Artificial Sequence
  chemically synthesized
ggtagcgcagggtggccact

SEQ ID NO: 625 - DNA, 20 bp, Artificial Sequence
  chemically synthesized
gcagggtggccactgagaac

SEQ ID NO: 626 - DNA, 20 bp, Artificial Sequence
  chemically synthesized
cagggtggccactgagaacc

SEQ ID NO: 627 - DNA, 20 bp, Artificial Sequence
  chemically synthesized
ggtggccactgagaaccggg

SEQ ID NO: 628 - DNA, 20 bp, Artificial Sequence
  chemically synthesized
gtggccactgagaaccgggc

SEQ ID NO: 629 - DNA, 20 bp, Artificial Sequence
  chemically synthesized
cttccctcccaccccctgcc

SEQ ID NO: 630 - DNA, 20 bp, Artificial Sequence
  chemically synthesized
ccctgccaagctctccctcc

SEQ ID NO: 631 - DNA, 20 bp, Artificial Sequence
  chemically synthesized
cctgccaagctctccctccc

SEQ ID NO: 632 - DNA, 20 bp, Artificial Sequence
  chemically synthesized
ctccctcccaggatcctctc

SEQ ID NO: 633 - DNA, 20 bp, Artificial Sequence
  chemically synthesized
atcctctctggctccatcgt

SEQ ID NO: 634 - DNA, 20 bp, Artificial Sequence
  chemically synthesized
gctccatcgtaagcaaacct

SEQ ID NO: 635 - DNA, 20 bp, Artificial Sequence
  chemically synthesized
tccatcgtaagcaaacctta

SEQ ID NO: 636 - DNA, 20 bp, Artificial Sequence
  chemically synthesized
ccatcgtaagcaaaccttag

SEQ ID NO: 637 - DNA, 20 bp, Artificial Sequence
  chemically synthesized
taagcaaaccttagaggttc

SEQ ID NO: 638 - DNA, 20 bp, Artificial Sequence
  chemically synthesized
caaaccttagaggttctggc

SEQ ID NO: 639 - DNA, 20 bp, Artificial Sequence
  chemically synthesized
aaaccttagaggttctggca

SEQ ID NO: 640 - DNA, 20 bp, Artificial Sequence
  chemically synthesized
accttagaggttctggcaag

SEQ ID NO: 641 - DNA, 20 bp, Artificial Sequence
  chemically synthesized
cttagaggttctggcaagga

SEQ ID NO: 642 - DNA, 20 bp, Artificial Sequence
  chemically synthesized
tagaggttctggcaaggaga

SEQ ID NO: 643 - DNA, 20 bp, Artificial Sequence
  chemically synthesized
ggttctggcaaggagagaga

SEQ ID NO: 644 - DNA, 20 bp, Artificial Sequence
  chemically synthesized
ggcaaggagagagatggctc

SEQ ID NO: 645 - DNA, 20 bp, Artificial Sequence
  chemically synthesized
gcaaggagagagatggctcc

SEQ ID NO: 646 - DNA, 20 bp, Artificial Sequence
  chemically synthesized
agagagatggctccaggaaa

SEQ ID NO: 647 - DNA, 20 bp, Artificial Sequence
  chemically synthesized
gagagatggctccaggaaat

SEQ ID NO: 648 - DNA, 20 bp, Artificial Sequence
  chemically synthesized
agagatggctccaggaaatg

SEQ ID NO: 649 - DNA, 20 bp, Artificial Sequence
  chemically synthesized
gagatggctccaggaaatgg

SEQ ID NO: 650 - DNA, 20 bp, Artificial Sequence
  chemically synthesized
aggaaatgggggtgtgtcac

SEQ ID NO: 651 - DNA, 20 bp, Artificial Sequence
  chemically synthesized
atgggggtgtgtcaccagat

SEQ ID NO: 652 - DNA, 20 bp, Artificial Sequence
  chemically synthesized
tgggggtgtgtcaccagata

SEQ ID NO: 653 - DNA, 20 bp, Artificial Sequence
  chemically synthesized
cagataaggaatctgcctaa

SEQ ID NO: 654 - DNA, 20 bp, Artificial Sequence
  chemically synthesized
agataaggaatctgcctaac

SEQ ID NO: 655 - DNA, 20 bp, Artificial Sequence
  chemically synthesized
ataaggaatctgcctaacag

SEQ ID NO: 656 - DNA, 20 bp, Artificial Sequence
  chemically synthesized
taaggaatctgcctaacagg

SEQ ID NO: 657 - DNA, 20 bp, Artificial Sequence
  chemically synthesized
ggaatctgcctaacaggagg

SEQ ID NO: 658 - DNA, 20 bp, Artificial Sequence
  chemically synthesized
gaatctgcctaacaggaggt

SEQ ID NO: 659 - DNA, 20 bp, Artificial Sequence
  chemically synthesized
aatctgcctaacaggaggtg

SEQ ID NO: 660 - DNA, 20 bp, Artificial Sequence
  chemically synthesized
atctgcctaacaggaggtgg

SEQ ID NO: 661 - DNA, 20 bp, Artificial Sequence
  chemically synthesized
gcctaacaggaggtgggggt

SEQ ID NO: 662 - DNA, 20 bp, Artificial Sequence
  chemically synthesized
gtgggggttagacccaatat

SEQ ID NO: 663 - DNA, 20 bp, Artificial Sequence
  chemically synthesized
tgggggttagacccaatatc

SEQ ID NO: 664 - DNA, 20 bp, Artificial Sequence
  chemically synthesized
ggggttagacccaatatcag

SEQ ID NO: 665 - DNA, 20 bp, Artificial Sequence
  chemically synthesized
tagacccaatatcaggagac

SEQ ID NO: 666 - DNA, 20 bp, Artificial Sequence
  chemically synthesized
agacccaatatcaggagact

SEQ ID NO: 667 - DNA, 20 bp, Artificial Sequence
  chemically synthesized
cccaatatcaggagactagg

SEQ ID NO: 668 - DNA, 20 bp, Artificial Sequence
  chemically synthesized
ccaatatcaggagactagga

SEQ ID NO: 669 - DNA, 20 bp, Artificial Sequence
  chemically synthesized
aatatcaggagactaggaag

SEQ ID NO: 670 - DNA, 20 bp, Artificial Sequence
  chemically synthesized
atatcaggagactaggaagg

SEQ ID NO: 671 - DNA, 20 bp, Artificial Sequence
  chemically synthesized
atcaggagactaggaaggag

SEQ ID NO: 672 - DNA, 20 bp, Artificial Sequence
  chemically synthesized
tcaggagactaggaaggagg

SEQ ID NO: 673 - DNA, 20 bp, Artificial Sequence
  chemically synthesized
gactaggaaggaggaggcct

SEQ ID NO: 674 - DNA, 20 bp, Artificial Sequence
  chemically synthesized
actaggaaggaggaggccta

SEQ ID NO: 675 - DNA, 20 bp, Artificial Sequence
  chemically synthesized
ggaaggaggaggcctaagga

SEQ ID NO: 676 - DNA, 20 bp, Artificial Sequence
  chemically synthesized
gaaggaggaggcctaaggat

SEQ ID NO: 677 - DNA, 20 bp, Artificial Sequence
  chemically synthesized
aaggaggaggcctaaggatg

SEQ ID NO: 678 - DNA, 20 bp, Artificial Sequence
  chemically synthesized
tctgtcaccaatcctgtccc

SEQ ID NO: 679 - DNA, 20 bp, Artificial Sequence
  chemically synthesized
gtcaccaatcctgtccctag

SEQ ID NO: 680 - DNA, 20 bp, Artificial Sequence
  chemically synthesized
tgtccctagtggccccactg

SEQ ID NO: 681 - DNA, 20 bp, Artificial Sequence
  chemically synthesized
gtccctagtggccccactgt

SEQ ID NO: 682 - DNA, 20 bp, Artificial Sequence
  chemically synthesized
tccctagtggccccactgtg

SEQ ID NO: 683 - DNA, 20 bp, Artificial Sequence
  chemically synthesized
ctagtggccccactgtgggg

SEQ ID NO: 684 - DNA, 20 bp, Artificial Sequence
  chemically synthesized
agtggccccactgtggggtg

SEQ ID NO: 685 - DNA, 20 bp, Artificial Sequence
  chemically synthesized
gtggccccactgtggggtgg

SEQ ID NO: 686 - DNA, 20 bp, Artificial Sequence
  chemically synthesized
tggccccactgtggggtgga

SEQ ID NO: 687 - DNA, 20 bp, Artificial Sequence
  chemically synthesized
ggccccactgtggggtggag

SEQ ID NO: 688 - DNA, 20 bp, Artificial Sequence
  chemically synthesized
ccactgtggggtggagggga

SEQ ID NO: 689 - DNA, 20 bp, Artificial Sequence
  chemically synthesized
ggggtggaggggacagataa

SEQ ID NO: 690 - DNA, 20 bp, Artificial Sequence
  chemically synthesized
aggggacagataaaagtacc

SEQ ID NO: 691 - DNA, 20 bp, Artificial Sequence
  chemically synthesized
cagataaaagtacccagaac

SEQ ID NO: 692 - DNA, 20 bp, Artificial Sequence
  chemically synthesized
gataaaagtacccagaacca

SEQ ID NO: 693 - DNA, 20 bp, Artificial Sequence
  chemically synthesized
agaaccagagccacattaac

SEQ ID NO: 694 - DNA, 20 bp, Artificial Sequence
  chemically synthesized
agagccacattaaccggccc

SEQ ID NO: 695 - DNA, 20 bp, Artificial Sequence
  chemically synthesized
gagccacattaaccggccct

SEQ ID NO: 696 - DNA, 20 bp, Artificial Sequence
  chemically synthesized
ttaaccggccctgggaatat

SEQ ID NO: 697 - DNA, 20 bp, Artificial Sequence
  chemically synthesized
taaccggccctgggaatata

SEQ ID NO: 698 - DNA, 20 bp, Artificial Sequence
  chemically synthesized
ccggccctgggaatataagg

SEQ ID NO: 699 - DNA, 20 bp, Artificial Sequence
  chemically synthesized
ctgggaatataaggtggtcc

SEQ ID NO: 700 - DNA, 20 bp, Artificial Sequence
  chemically synthesized
aatataaggtggtcccagct

SEQ ID NO: 701 - DNA, 20 bp, Artificial Sequence
  chemically synthesized
atataaggtggtcccagctc

SEQ ID NO: 702 - DNA, 20 bp, Artificial Sequence
  chemically synthesized
tataaggtggtcccagctcg

SEQ ID NO: 703 - DNA, 20 bp, Artificial Sequence
  chemically synthesized
gtggtcccagctcggggaca

SEQ ID NO: 704 - DNA, 20 bp, Artificial Sequence
  chemically synthesized
tggtcccagctcggggacac

SEQ ID NO: 705 - DNA, 20 bp, Artificial Sequence
  chemically synthesized
gctcggggacacaggatccc

SEQ ID NO: 706 - DNA, 20 bp, Artificial Sequence
  chemically synthesized
tcggggacacaggatccctg

SEQ ID NO: 707 - DNA, 20 bp, Artificial Sequence
  chemically synthesized
cggggacacaggatccctgg

SEQ ID NO: 708 - DNA, 20 bp, Artificial Sequence
  chemically synthesized
ggacacaggatccctggagg

SEQ ID NO: 709 - DNA, 20 bp, Artificial Sequence
  chemically synthesized
gcagcaaacatgctgtcctg

SEQ ID NO: 710 - DNA, 20 bp, Artificial Sequence
  chemically synthesized
gcaaacatgctgtcctgaag

SEQ ID NO: 711 - DNA, 20 bp, Artificial Sequence
  chemically synthesized
atgctgtcctgaagtggaca

SEQ ID NO: 712 - DNA, 20 bp, Artificial Sequence
  chemically synthesized
tgctgtcctgaagtggacat

SEQ ID NO: 713 - DNA, 20 bp, Artificial Sequence
  chemically synthesized
gctgtcctgaagtggacata

SEQ ID NO: 714 - DNA, 20 bp, Artificial Sequence
  chemically synthesized
ctgtcctgaagtggacatag

SEQ ID NO: 715 - DNA, 20 bp, Artificial Sequence
  chemically synthesized
ctgaagtggacataggggcc

SEQ ID NO: 716 - DNA, 20 bp, Artificial Sequence
  chemically synthesized
tgaagtggacataggggccc

SEQ ID NO: 717 - DNA, 20 bp, Artificial Sequence
  chemically synthesized
gtggacataggggcccgggt

SEQ ID NO: 718 - DNA, 20 bp, Artificial Sequence
  chemically synthesized
ggacataggggcccgggttg

SEQ ID NO: 719 - DNA, 20 bp, Artificial Sequence
  chemically synthesized
gacataggggcccgggttgg

SEQ ID NO: 720 - DNA, 20 bp, Artificial Sequence
  chemically synthesized
ataggggcccgggttggagg

SEQ ID NO: 721 - DNA, 20 bp, Artificial Sequence
  chemically synthesized
ggggcccgggttggaggaag

SEQ ID NO: 722 - DNA, 20 bp, Artificial Sequence
  chemically synthesized
ccgggttggaggaagaagac

SEQ ID NO: 723 - DNA, 20 bp, Artificial Sequence
  chemically synthesized
ttggaggaagaagactagct

SEQ ID NO: 724 - DNA, 20 bp, Artificial Sequence
  chemically synthesized
aagaagactagctgagctct

SEQ ID NO: 725 - DNA, 20 bp, Artificial Sequence
  chemically synthesized
tagctgagctctcggacccc

SEQ ID NO: 726 - DNA, 20 bp, Artificial Sequence
  chemically synthesized
ctgagctctcggacccctgg

SEQ ID NO: 727 - DNA, 20 bp, Artificial Sequence
  chemically synthesized
acccctggaagatgccatga

SEQ ID NO: 728 - DNA, 20 bp, Artificial Sequence
  chemically synthesized
cccctggaagatgccatgac

SEQ ID NO: 729 - DNA, 20 bp, Artificial Sequence
  chemically synthesized
ccctggaagatgccatgaca

SEQ ID NO: 730 - DNA, 20 bp, Artificial Sequence
  chemically synthesized
cctggaagatgccatgacag

SEQ ID NO: 731 - DNA, 20 bp, Artificial Sequence
  chemically synthesized
ctggaagatgccatgacagg

SEQ ID NO: 732 - DNA, 20 bp, Artificial Sequence
  chemically synthesized
aagatgccatgacagggggc

SEQ ID NO: 733 - DNA, 20 bp, Artificial Sequence
  chemically synthesized
atgccatgacagggggctgg

SEQ ID NO: 734 - DNA, 20 bp, Artificial Sequence
  chemically synthesized
gccatgacagggggctggaa

SEQ ID NO: 735 - DNA, 20 bp, Artificial Sequence
  chemically synthesized
tgacagggggctggaagagc

SEQ ID NO: 736 - DNA, 20 bp, Artificial Sequence
  chemically synthesized
gggggctggaagagctagca

SEQ ID NO: 737 - DNA, 20 bp, Artificial Sequence
  chemically synthesized
ctggaagagctagcacagac

SEQ ID NO: 738 - DNA, 20 bp, Artificial Sequence
  chemically synthesized
ggaagagctagcacagacta

SEQ ID NO: 739 - DNA, 20 bp, Artificial Sequence
  chemically synthesized
aagagctagcacagactaga

SEQ ID NO: 740 - DNA, 20 bp, Artificial Sequence
  chemically synthesized
agagctagcacagactagag

SEQ ID NO: 741 - DNA, 20 bp, Artificial Sequence
  chemically synthesized
ctagcacagactagagaggt

SEQ ID NO: 742 - DNA, 20 bp, Artificial Sequence
  chemically synthesized
tagcacagactagagaggta

SEQ ID NO: 743 - DNA, 20 bp, Artificial Sequence
  chemically synthesized
agcacagactagagaggtaa

SEQ ID NO: 744 - DNA, 20 bp, Artificial Sequence
  chemically synthesized
gcacagactagagaggtaag

SEQ ID NO: 745 - DNA, 20 bp, Artificial Sequence
  chemically synthesized
cacagactagagaggtaagg

SEQ ID NO: 746 - DNA, 20 bp, Artificial Sequence
  chemically synthesized
acagactagagaggtaaggg

SEQ ID NO: 747 - DNA, 20 bp, Artificial Sequence
  chemically synthesized
gactagagaggtaagggggg

SEQ ID NO: 748 - DNA, 20 bp, Artificial Sequence
  chemically synthesized
actagagaggtaaggggggt

SEQ ID NO: 749 - DNA, 20 bp, Artificial Sequence
  chemically synthesized
ctagagaggtaaggggggta

SEQ ID NO: 750 - DNA, 20 bp, Artificial Sequence
  chemically synthesized
tagagaggtaaggggggtag

SEQ ID NO: 751 - DNA, 20 bp, Artificial Sequence
  chemically synthesized
gagaggtaaggggggtaggg

SEQ ID NO: 752 - DNA, 20 bp, Artificial Sequence
  chemically synthesized
taggggagctgcccaaatga

SEQ ID NO: 753 - DNA, 20 bp, Artificial Sequence
  chemically synthesized
aggggagctgcccaaatgaa

SEQ ID NO: 754 - DNA, 20 bp, Artificial Sequence
  chemically synthesized
gggagctgcccaaatgaaag

SEQ ID NO: 755 - DNA, 20 bp, Artificial Sequence
  chemically synthesized
gctgcccaaatgaaaggagt

SEQ ID NO: 756 - DNA, 20 bp, Artificial Sequence
  chemically synthesized
tgcccaaatgaaaggagtga

SEQ ID NO: 757 - DNA, 20 bp, Artificial Sequence
  chemically synthesized
gcccaaatgaaaggagtgag

SEQ ID NO: 758 - DNA, 20 bp, Artificial Sequence
  chemically synthesized
tgagaggtgacccgaatcca

SEQ ID NO: 759 - DNA, 20 bp, Artificial Sequence
  chemically synthesized
gagaggtgacccgaatccac

SEQ ID NO: 760 - DNA, 20 bp, Artificial Sequence
  chemically synthesized
gaggtgacccgaatccacag

SEQ ID NO: 761 - DNA, 20 bp, Artificial Sequence
  chemically synthesized
gacccgaatccacaggagaa

SEQ ID NO: 762 - DNA, 20 bp, Artificial Sequence
  chemically synthesized
acccgaatccacaggagaac

SEQ ID NO: 763 - DNA, 20 bp, Artificial Sequence
  chemically synthesized
cccgaatccacaggagaacg

SEQ ID NO: 764 - DNA, 20 bp, Artificial Sequence
  chemically synthesized
ccacaggagaacggggtgtc

SEQ ID NO: 765 - DNA, 20 bp, Artificial Sequence
  chemically synthesized
cacaggagaacggggtgtcc

SEQ ID NO: 766 - DNA, 20 bp, Artificial Sequence
  chemically synthesized
gagaacggggtgtccaggca

SEQ ID NO: 767 - DNA, 20 bp, Artificial Sequence
  chemically synthesized
acggggtgtccaggcaaaga

SEQ ID NO: 768 - DNA, 20 bp, Artificial Sequence
  chemically synthesized
ggtgtccaggcaaagaaagc

SEQ ID NO: 769 - DNA, 20 bp, Artificial Sequence
  chemically synthesized
tgtccaggcaaagaaagcaa

SEQ ID NO: 770 - DNA, 20 bp, Artificial Sequence
  chemically synthesized
gtccaggcaaagaaagcaag

SEQ ID NO: 771 - DNA, 20 bp, Artificial Sequence
  chemically synthesized
aggcaaagaaagcaagagga

SEQ ID NO: 772 - DNA, 20 bp, Artificial Sequence
  chemically synthesized
gcaaagaaagcaagaggatg

SEQ ID NO: 773 - DNA, 20 bp, Artificial Sequence
  chemically synthesized
aaagaaagcaagaggatgga

SEQ ID NO: 774 - DNA, 20 bp, Artificial Sequence
  chemically synthesized
aagaaagcaagaggatggag

SEQ ID NO: 775 - DNA, 20 bp, Artificial Sequence
  chemically synthesized
aaagcaagaggatggagagg

SEQ ID NO: 776 - DNA, 20 bp, Artificial Sequence
  chemically synthesized
agaggatggagaggtggcta

SEQ ID NO: 777 - DNA, 20 bp, Artificial Sequence
  chemically synthesized
gatggagaggtggctaaagc

SEQ ID NO: 778 - DNA, 20 bp, Artificial Sequence
  chemically synthesized
atggagaggtggctaaagcc

SEQ ID NO: 779 - DNA, 20 bp, Artificial Sequence
  chemically synthesized
tggagaggtggctaaagcca

SEQ ID NO: 780 - DNA, 20 bp, Artificial Sequence
  chemically synthesized
gagaggtggctaaagccagg

SEQ ID NO: 781 - DNA, 20 bp, Artificial Sequence
  chemically synthesized
ggtggctaaagccagggaga

SEQ ID NO: 782 - DNA, 20 bp, Artificial Sequence
  chemically synthesized
gtggctaaagccagggagac

SEQ ID NO: 783 - DNA, 20 bp, Artificial Sequence
  chemically synthesized
tggctaaagccagggagacg

SEQ ID NO: 784 - DNA, 20 bp, Artificial Sequence
  chemically synthesized
gccagggagacggggtactt

SEQ ID NO: 785 - DNA, 20 bp, Artificial Sequence
  chemically synthesized
ccagggagacggggtacttt

SEQ ID NO: 786 - DNA, 20 bp, Artificial Sequence
  chemically synthesized
cagggagacggggtactttg

SEQ ID NO: 787 - DNA, 20 bp, Artificial Sequence
  chemically synthesized
cggggtactttggggttgtc

SEQ ID NO: 788 - DNA, 20 bp, Artificial Sequence
  chemically synthesized
tttggggttgtccagaaaaa

SEQ ID NO: 789 - DNA, 20 bp, Artificial Sequence
  chemically synthesized
ccagaaaaacggtgatgatg

SEQ ID NO: 790 - DNA, 20 bp, Artificial Sequence
  chemically synthesized
cagaaaaacggtgatgatgc

SEQ ID NO: 791 - DNA, 20 bp, Artificial Sequence
  chemically synthesized
cggtgatgatgcaggcctac

SEQ ID NO: 792 - DNA, 20 bp, Artificial Sequence
  chemically synthesized
tgatgatgcaggcctacaag

SEQ ID NO: 793 - DNA, 20 bp, Artificial Sequence
  chemically synthesized
gatgatgcaggcctacaaga

SEQ ID NO: 794 - DNA, 20 bp, Artificial Sequence
  chemically synthesized
atgatgcaggcctacaagaa

SEQ ID NO: 795 - DNA, 20 bp, Artificial Sequence
  chemically synthesized
tgatgcaggcctacaagaag

SEQ ID NO: 796 - DNA, 20 bp, Artificial Sequence
  chemically synthesized
atgcaggcctacaagaaggg

SEQ ID NO: 797 - DNA, 20 bp, Artificial Sequence
  chemically synthesized
tgcaggcctacaagaagggg

SEQ ID NO: 798 - DNA, 20 bp, Artificial Sequence
  chemically synthesized
aggcctacaagaaggggagg

SEQ ID NO: 799 - DNA, 20 bp, Artificial Sequence
  chemically synthesized
ggcctacaagaaggggaggc

SEQ ID NO: 800 - DNA, 20 bp, Artificial Sequence
  chemically synthesized
aagaaggggaggcgggacgc

SEQ ID NO: 801 - DNA, 20 bp, Artificial Sequence
  chemically synthesized
agaaggggaggcgggacgca

SEQ ID NO: 802 - DNA, 20 bp, Artificial Sequence
  chemically synthesized
gaaggggaggcgggacgcaa

SEQ ID NO: 803 - DNA, 20 bp, Artificial Sequence
  chemically synthesized
aggggaggcgggacgcaagg

SEQ ID NO: 804 - DNA, 20 bp, Artificial Sequence
  chemically synthesized
gacgcaagggagacatccgt

SEQ ID NO: 805 - DNA, 20 bp, Artificial Sequence
  chemically synthesized
cgcaagggagacatccgtcg

SEQ ID NO: 806 - DNA, 20 bp, Artificial Sequence
  chemically synthesized
aagggagacatccgtcggag

SEQ ID NO: 807 - DNA, 20 bp, Artificial Sequence
  chemically synthesized
agggagacatccgtcggaga

SEQ ID NO: 808 - DNA, 20 bp, Artificial Sequence
  chemically synthesized
ccgtcggagaaggccatcct

SEQ ID NO: 809 - DNA, 20 bp, Artificial Sequence
  chemically synthesized
agaaggccatcctaagaaac

SEQ ID NO: 810 - DNA, 20 bp, Artificial Sequence
  chemically synthesized
aaggccatcctaagaaacga

SEQ ID NO: 811 - DNA, 20 bp, Artificial Sequence
  chemically synthesized
ccatcctaagaaacgagaga

SEQ ID NO: 812 - DNA, 20 bp, Artificial Sequence
  chemically synthesized
ctaagaaacgagagatggca

SEQ ID NO: 813 - DNA, 20 bp, Artificial Sequence
  chemically synthesized
taagaaacgagagatggcac

SEQ ID NO: 814 - DNA, 20 bp, Artificial Sequence
  chemically synthesized
acgagagatggcacaggccc

SEQ ID NO: 815 - DNA, 20 bp, Artificial Sequence
  chemically synthesized
agagatggcacaggccccag

SEQ ID NO: 816 - DNA, 20 bp, Artificial Sequence
  chemically synthesized
gagatggcacaggccccaga

SEQ ID NO: 817 - DNA, 20 bp, Artificial Sequence
  chemically synthesized
gatggcacaggccccagaag

SEQ ID NO: 818 - DNA, 20 bp, Artificial Sequence
  chemically synthesized
ggcacaggccccagaaggag

SEQ ID NO: 819 - DNA, 20 bp, Artificial Sequence
  chemically synthesized
gcacaggccccagaaggaga

SEQ ID NO: 820 - DNA, 20 bp, Artificial Sequence
  chemically synthesized
ggccccagaaggagaaggaa

SEQ ID NO: 821 - DNA, 20 bp, Artificial Sequence
  chemically synthesized
gccccagaaggagaaggaaa

SEQ ID NO: 822 - DNA, 20 bp, Artificial Sequence
  chemically synthesized
ccccagaaggagaaggaaaa

SEQ ID NO: 823 - DNA, 20 bp, Artificial Sequence
  chemically synthesized
aggagaaggaaaagggaacc

SEQ ID NO: 824 - DNA, 20 bp, Artificial Sequence
  chemically synthesized
gaaggaaaagggaacccagc

SEQ ID NO: 825 - DNA, 20 bp, Artificial Sequence
  chemically synthesized
aaaagggaacccagcgagtg

SEQ ID NO: 826 - DNA, 20 bp, Artificial Sequence
  chemically synthesized
gggaacccagcgagtgaaga

SEQ ID NO: 827 - DNA, 20 bp, Artificial Sequence
  chemically synthesized
cccagcgagtgaagacggca

SEQ ID NO: 828 - DNA, 20 bp, Artificial Sequence
  chemically synthesized
ccagcgagtgaagacggcat

SEQ ID NO: 829 - DNA, 20 bp, Artificial Sequence
  chemically synthesized
cagcgagtgaagacggcatg

SEQ ID NO: 830 - DNA, 20 bp, Artificial Sequence
  chemically synthesized
gagtgaagacggcatggggt

SEQ ID NO: 831 - DNA, 20 bp, Artificial Sequence
  chemically synthesized
agtgaagacggcatggggtt

SEQ ID NO: 832 - DNA, 20 bp, Artificial Sequence
  chemically synthesized
aagacggcatggggttgggt

SEQ ID NO: 833 - DNA, 20 bp, Artificial Sequence
  chemically synthesized
agacggcatggggttgggtg

SEQ ID NO: 834 - DNA, 20 bp, Artificial Sequence
  chemically synthesized
gacggcatggggttgggtga

SEQ ID NO: 835 - DNA, 20 bp, Artificial Sequence
  chemically synthesized
cggcatggggttgggtgagg

SEQ ID NO: 836 - DNA, 20 bp, Artificial Sequence
  chemically synthesized
ggcatggggttgggtgaggg

SEQ ID NO: 837 - DNA, 20 bp, Artificial Sequence
  chemically synthesized
catggggttgggtgagggag

SEQ ID NO: 838 - DNA, 20 bp, Artificial Sequence
  chemically synthesized
tggggttgggtgagggagga

SEQ ID NO: 839 - DNA, 20 bp, Artificial Sequence
  chemically synthesized
ggtgagggaggagagatgcc

SEQ ID NO: 840 - DNA, 20 bp, Artificial Sequence
  chemically synthesized
tgagggaggagagatgcccg

SEQ ID NO: 841 - DNA, 20 bp, Artificial Sequence
  chemically synthesized
agggaggagagatgcccgga

SEQ ID NO: 842 - DNA, 20 bp, Artificial Sequence
  chemically synthesized
gggaggagagatgcccggag

SEQ ID NO: 843 - DNA, 20 bp, Artificial Sequence
  chemically synthesized
agagatgcccggagaggacc

SEQ ID NO: 844 - DNA, 20 bp, Artificial Sequence
  chemically synthesized
gcccggagaggacccagaca

SEQ ID NO: 845 - DNA, 20 bp, Artificial Sequence
  chemically synthesized
cccggagaggacccagacac

SEQ ID NO: 846 - DNA, 20 bp, Artificial Sequence
  chemically synthesized
ccggagaggacccagacacg

SEQ ID NO: 847 - DNA, 20 bp, Artificial Sequence
  chemically synthesized
ggagaggacccagacacggg

SEQ ID NO: 848 - DNA, 20 bp, Artificial Sequence
  chemically synthesized
gagaggacccagacacgggg

SEQ ID NO: 849 - DNA, 20 bp, Artificial Sequence
  chemically synthesized
agacacggggaggatccgct

SEQ ID NO: 850 - DNA, 20 bp, Artificial Sequence
  chemically synthesized
acacggggaggatccgctca

SEQ ID NO: 851 - DNA, 20 bp, Artificial Sequence
  chemically synthesized
cacggggaggatccgctcag

SEQ ID NO: 852 - DNA, 20 bp, Artificial Sequence
  chemically synthesized
tccgctcagaggacatcacg

SEQ ID NO: 853 - DNA, 20 bp, Artificial Sequence
  chemically synthesized
tcagaggacatcacgtggtg

SEQ ID NO: 854 - DNA, 20 bp, Artificial Sequence
  chemically synthesized
acatcacgtggtgcagcgcc

SEQ ID NO: 855 - DNA, 20 bp, Artificial Sequence
  chemically synthesized
tcacgtggtgcagcgccgag

SEQ ID NO: 856 - DNA, 20 bp, Artificial Sequence
  chemically synthesized
cacgtggtgcagcgccgaga

SEQ ID NO: 857 - DNA, 20 bp, Artificial Sequence
  chemically synthesized
gtggtgcagcgccgagaagg

SEQ ID NO: 858 - DNA, 20 bp, Artificial Sequence
  chemically synthesized
gcgccgagaaggaagtgctc

SEQ ID NO: 859 - DNA, 20 bp, Artificial Sequence
  chemically synthesized
cgagaaggaagtgctccgga

SEQ ID NO: 860 - DNA, 20 bp, Artificial Sequence
  chemically synthesized
agaaggaagtgctccggaaa

SEQ ID NO: 861 - DNA, 20 bp, Artificial Sequence
  chemically synthesized
tgctccggaaagagcatcct

SEQ ID NO: 862 - DNA, 20 bp, Artificial Sequence
  chemically synthesized
gctccggaaagagcatcctt

SEQ ID NO: 863 - DNA, 20 bp, Artificial Sequence
  chemically synthesized
ccggaaagagcatccttggg

SEQ ID NO: 864 - DNA, 20 bp, Artificial Sequence
  chemically synthesized
agcatccttgggcagcaaca

SEQ ID NO: 865 - DNA, 20 bp, Artificial Sequence
  chemically synthesized
atccttgggcagcaacacag

SEQ ID NO: 866 - DNA, 20 bp, Artificial Sequence
  chemically synthesized
ccttgggcagcaacacagca

SEQ ID NO: 867 - DNA, 20 bp, Artificial Sequence
  chemically synthesized
ttgggcagcaacacagcaga

SEQ ID NO: 868 - DNA, 20 bp, Artificial Sequence
  chemically synthesized
gcagcaacacagcagagagc

SEQ ID NO: 869 - DNA, 20 bp, Artificial Sequence
  chemically synthesized
cagcaacacagcagagagca

SEQ ID NO: 870 - DNA, 20 bp, Artificial Sequence
  chemically synthesized
agcaacacagcagagagcaa

SEQ ID NO: 871 - DNA, 20 bp, Artificial Sequence
  chemically synthesized
gcaacacagcagagagcaag

SEQ ID NO: 872 - DNA, 20 bp, Artificial Sequence
  chemically synthesized
acacagcagagagcaagggg

SEQ ID NO: 873 - DNA, 20 bp, Artificial Sequence
  chemically synthesized
acagcagagagcaaggggaa

SEQ ID NO: 874 - DNA, 20 bp, Artificial Sequence
  chemically synthesized
cagcagagagcaaggggaag

SEQ ID NO: 875 - DNA, 20 bp, Artificial Sequence
  chemically synthesized
agcagagagcaaggggaaga

SEQ ID NO: 876 - DNA, 20 bp, Artificial Sequence
  chemically synthesized
cagagagcaaggggaagagg

SEQ ID NO: 877 - DNA, 20 bp, Artificial Sequence
  chemically synthesized
agagcaaggggaagagggag

SEQ ID NO: 878 - DNA, 20 bp, Artificial Sequence
  chemically synthesized
agcaaggggaagagggagtg

SEQ ID NO: 879 - DNA, 20 bp, Artificial Sequence
  chemically synthesized
gcaaggggaagagggagtgg

SEQ ID NO: 880 - DNA, 20 bp, Artificial Sequence
  chemically synthesized
aggggaagagggagtggagg

SEQ ID NO: 881 - DNA, 20 bp, Artificial Sequence
  chemically synthesized
gaagagggagtggaggaaga

SEQ ID NO: 882 - DNA, 20 bp, Artificial Sequence
  chemically synthesized
gtggaggaagacggaacctg

SEQ ID NO: 883 - DNA, 20 bp, Artificial Sequence
  chemically synthesized
tggaggaagacggaacctga

SEQ ID NO: 884 - DNA, 20 bp, Artificial Sequence
  chemically synthesized
gaggaagacggaacctgaag

SEQ ID NO: 885 - DNA, 20 bp, Artificial Sequence
  chemically synthesized
aggaagacggaacctgaagg

SEQ ID NO: 886 - DNA, 20 bp, Artificial Sequence
  chemically synthesized
aagacggaacctgaaggagg

SEQ ID NO: 887 - DNA, 20 bp, Artificial Sequence
  chemically synthesized
acggaacctgaaggaggcgg

SEQ ID NO: 888 - DNA, 20 bp, Artificial Sequence
  chemically synthesized
cggaacctgaaggaggcggc

SEQ ID NO: 889 - DNA, 20 bp, Artificial Sequence
  chemically synthesized
ggaacctgaaggaggcggca

SEQ ID NO: 890 - DNA, 20 bp, Artificial Sequence
  chemically synthesized
acctgaaggaggcggcaggg

SEQ ID NO: 891 - DNA, 20 bp, Artificial Sequence
  chemically synthesized
cctgaaggaggcggcaggga

SEQ ID NO: 892 - DNA, 20 bp, Artificial Sequence
  chemically synthesized
ggaggcggcagggaaggatc

SEQ ID NO: 893 - DNA, 20 bp, Artificial Sequence
  chemically synthesized
gaggcggcagggaaggatct

SEQ ID NO: 894 - DNA, 20 bp, Artificial Sequence
  chemically synthesized
cggcagggaaggatctgggc

SEQ ID NO: 895 - DNA, 20 bp, Artificial Sequence
  chemically synthesized
ggaaggatctgggccagccg

SEQ ID NO: 896 - DNA, 20 bp, Artificial Sequence
  chemically synthesized
aaggatctgggccagccgta

SEQ ID NO: 897 - DNA, 20 bp, Artificial Sequence
  chemically synthesized
aggatctgggccagccgtag

SEQ ID NO: 898 - DNA, 20 bp, Artificial Sequence
  chemically synthesized
ggccagccgtagaggtgacc

SEQ ID NO: 899 - DNA, 20 bp, Artificial Sequence
  chemically synthesized
gccagccgtagaggtgaccc

SEQ ID NO: 900 - DNA, 20 bp, Artificial Sequence
  chemically synthesized
gtagaggtgacccaggccac

SEQ ID NO: 901 - DNA, 20 bp, Artificial Sequence
  chemically synthesized
gtgacccaggccacaagctg

SEQ ID NO: 902 - DNA, 20 bp, Artificial Sequence
  chemically synthesized
cccaggccacaagctgcaga

SEQ ID NO: 903 - DNA, 20 bp, Artificial Sequence
  chemically synthesized
ggccacaagctgcagacaga

SEQ ID NO: 904 - DNA, 20 bp, Artificial Sequence
  chemically synthesized
cacaagctgcagacagaaag

SEQ ID NO: 905 - DNA, 20 bp, Artificial Sequence
  chemically synthesized
gctgcagacagaaagcggca

SEQ ID NO: 906 - DNA, 20 bp, Artificial Sequence
  chemically synthesized
ctgcagacagaaagcggcac

SEQ ID NO: 907 - DNA, 20 bp, Artificial Sequence
  chemically synthesized
gacagaaagcggcacaggcc

SEQ ID NO: 908 - DNA, 20 bp, Artificial Sequence
  chemically synthesized
acagaaagcggcacaggccc

SEQ ID NO: 909 - DNA, 20 bp, Artificial Sequence
  chemically synthesized
cagaaagcggcacaggccca

SEQ ID NO: 910 - DNA, 20 bp, Artificial Sequence
  chemically synthesized
agaaagcggcacaggcccag

SEQ ID NO: 911 - DNA, 20 bp, Artificial Sequence
  chemically synthesized
aaagcggcacaggcccaggg

SEQ ID NO: 912 - DNA, 20 bp, Artificial Sequence
  chemically synthesized
agcggcacaggcccagggga

SEQ ID NO: 913 - DNA, 20 bp, Artificial Sequence
  chemically synthesized
caggcccaggggagagaatg

SEQ ID NO: 914 - DNA, 20 bp, Artificial Sequence
  chemically synthesized
aggcccaggggagagaatgc

SEQ ID NO: 915 - DNA, 20 bp, Artificial Sequence
  chemically synthesized
ccaggggagagaatgcaggt

SEQ ID NO: 916 - DNA, 20 bp, Artificial Sequence
  chemically synthesized
aggggagagaatgcaggtca

SEQ ID NO: 917 - DNA, 20 bp, Artificial Sequence
  chemically synthesized
gagagaatgcaggtcagaga

SEQ ID NO: 918 - DNA, 20 bp, Artificial Sequence
  chemically synthesized
agaatgcaggtcagagaaag

SEQ ID NO: 919 - DNA, 20 bp, Artificial Sequence
  chemically synthesized
gaatgcaggtcagagaaagc

SEQ ID NO: 920 - DNA, 20 bp, Artificial Sequence
  chemically synthesized
cagagaaagcaggacctgcc

SEQ ID NO: 921 - DNA, 20 bp, Artificial Sequence
  chemically synthesized
agagaaagcaggacctgcct

SEQ ID NO: 922 - DNA, 20 bp, Artificial Sequence
  chemically synthesized
gaaagcaggacctgcctggg

SEQ ID NO: 923 - DNA, 20 bp, Artificial Sequence
  chemically synthesized
aaagcaggacctgcctggga

SEQ ID NO: 924 - DNA, 20 bp, Artificial Sequence
  chemically synthesized
aagcaggacctgcctgggaa

SEQ ID NO: 925 - DNA, 20 bp, Artificial Sequence
  chemically synthesized
agcaggacctgcctgggaag

SEQ ID NO: 926 - DNA, 20 bp, Artificial Sequence
  chemically synthesized
acctgcctgggaaggggaaa

SEQ ID NO: 927 - DNA, 20 bp, Artificial Sequence
  chemically synthesized
tgcctgggaaggggaaacag

SEQ ID NO: 928 - DNA, 20 bp, Artificial Sequence
  chemically synthesized
gcctgggaaggggaaacagt

SEQ ID NO: 929 - DNA, 20 bp, Artificial Sequence
  chemically synthesized
gggaaggggaaacagtgggc

SEQ ID NO: 930 - DNA, 20 bp, Artificial Sequence
  chemically synthesized
gaaggggaaacagtgggcca

SEQ ID NO: 931 - DNA, 20 bp, Artificial Sequence
  chemically synthesized
aaggggaaacagtgggccag

SEQ ID NO: 932 - DNA, 20 bp, Artificial Sequence
  chemically synthesized
gggaaacagtgggccagagg

SEQ ID NO: 933 - DNA, 20 bp, Artificial Sequence
  chemically synthesized
acagtgggccagaggcggcg

SEQ ID NO: 934 - DNA, 20 bp, Artificial Sequence
  chemically synthesized
gtgggccagaggcggcgcag

SEQ ID NO: 935 - DNA, 20 bp, Artificial Sequence
  chemically synthesized
gccagaggcggcgcagaagc

SEQ ID NO: 936 - DNA, 20 bp, Artificial Sequence
  chemically synthesized
agaggcggcgcagaagccag

SEQ ID NO: 937 - DNA, 20 bp, Artificial Sequence
  chemically synthesized
aggcggcgcagaagccagta

SEQ ID NO: 938 - DNA, 20 bp, Artificial Sequence
  chemically synthesized
gcagaagccagtagagctca

SEQ ID NO: 939 - DNA, 20 bp, Artificial Sequence
  chemically synthesized
gaagccagtagagctcaaag

SEQ ID NO: 940 - DNA, 20 bp, Artificial Sequence
  chemically synthesized
cagtagagctcaaagtggtc

SEQ ID NO: 941 - DNA, 20 bp, Artificial Sequence
  chemically synthesized
agctcaaagtggtccggact

SEQ ID NO: 942 - DNA, 20 bp, Artificial Sequence
  chemically synthesized
gctcaaagtggtccggactc

SEQ ID NO: 943 - DNA, 20 bp, Artificial Sequence
  chemically synthesized
tcaaagtggtccggactcag

SEQ ID NO: 944 - DNA, 20 bp, Artificial Sequence
  chemically synthesized
aaagtggtccggactcagga

SEQ ID NO: 945 - DNA, 20 bp, Artificial Sequence
  chemically synthesized
agtggtccggactcaggaga

SEQ ID NO: 946 - DNA, 20 bp, Artificial Sequence
  chemically synthesized
gtccggactcaggagagaga

SEQ ID NO: 947 - DNA, 20 bp, Artificial Sequence
  chemically synthesized
cggactcaggagagagacgg

SEQ ID NO: 948 - DNA, 20 bp, Artificial Sequence
  chemically synthesized
caggagagagacggcagcgt

SEQ ID NO: 949 - DNA, 20 bp, Artificial Sequence
  chemically synthesized
ggagagagacggcagcgtta

SEQ ID NO: 950 - DNA, 20 bp, Artificial Sequence
  chemically synthesized
gagagagacggcagcgttag

SEQ ID NO: 951 - DNA, 20 bp, Artificial Sequence
  chemically synthesized
agagagacggcagcgttaga

SEQ ID NO: 952 - DNA, 20 bp, Artificial Sequence
  chemically synthesized
gagacggcagcgttagaggg

SEQ ID NO: 953 - DNA, 20 bp, Artificial Sequence
  chemically synthesized
gacggcagcgttagagggca

SEQ ID NO: 954 - DNA, 20 bp, Artificial Sequence
  chemically synthesized
agcgttagagggcagagttc

SEQ ID NO: 955 - DNA, 20 bp, Artificial Sequence
  chemically synthesized
gttagagggcagagttccgg

SEQ ID NO: 956 - DNA, 20 bp, Artificial Sequence
  chemically synthesized
agggcagagttccggcggca

SEQ ID NO: 957 - DNA, 20 bp, Artificial Sequence
  chemically synthesized
cagagttccggcggcacagc

SEQ ID NO: 958 - DNA, 20 bp, Artificial Sequence
  chemically synthesized
agagttccggcggcacagca

SEQ ID NO: 959 - DNA, 20 bp, Artificial Sequence
  chemically synthesized
gagttccggcggcacagcaa

SEQ ID NO: 960 - DNA, 20 bp, Artificial Sequence
  chemically synthesized
ggcggcacagcaagggcact

SEQ ID NO: 961 - DNA, 20 bp, Artificial Sequence
  chemically synthesized
gcggcacagcaagggcactc

SEQ ID NO: 962 - DNA, 20 bp, Artificial Sequence
  chemically synthesized
cggcacagcaagggcactcg

SEQ ID NO: 963 - DNA, 20 bp, Artificial Sequence
  chemically synthesized
ggcacagcaagggcactcgg

SEQ ID NO: 964 - DNA, 20 bp, Artificial Sequence
  chemically synthesized
cagcaagggcactcgggggc

SEQ ID NO: 965 - DNA, 20 bp, Artificial Sequence
  chemically synthesized
gcaagggcactcgggggcga

SEQ ID NO: 966 - DNA, 20 bp, Artificial Sequence
  chemically synthesized
caagggcactcgggggcgag

SEQ ID NO: 967 - DNA, 20 bp, Artificial Sequence
  chemically synthesized
agggcactcgggggcgagag

SEQ ID NO: 968 - DNA, 20 bp, Artificial Sequence
  chemically synthesized
gggcactcgggggcgagagg

SEQ ID NO: 969 - DNA, 20 bp, Artificial Sequence
  chemically synthesized
ggcactcgggggcgagagga

SEQ ID NO: 970 - DNA, 20 bp, Artificial Sequence
  chemically synthesized
actcgggggcgagaggaggg

SEQ ID NO: 971 - DNA, 20 bp, Artificial Sequence
  chemically synthesized
ggcgagaggagggcagcgca

SEQ ID NO: 972 - DNA, 20 bp, Artificial Sequence
  chemically synthesized
agggcagcgcaaagtgacaa

SEQ ID NO: 973 - DNA, 20 bp, Artificial Sequence
  chemically synthesized
cagcgcaaagtgacaatggc

SEQ ID NO: 974 - DNA, 20 bp, Artificial Sequence
  chemically synthesized
agcgcaaagtgacaatggcc

SEQ ID NO: 975 - DNA, 20 bp, Artificial Sequence
  chemically synthesized
gcgcaaagtgacaatggcca

SEQ ID NO: 976 - DNA, 20 bp, Artificial Sequence
  chemically synthesized
aaagtgacaatggccagggc

SEQ ID NO: 977 - DNA, 20 bp, Artificial Sequence
  chemically synthesized
aagtgacaatggccagggcc

SEQ ID NO: 978 - DNA, 20 bp, Artificial Sequence
  chemically synthesized
tgacaatggccagggccagg

SEQ ID NO: 979 - DNA, 20 bp, Artificial Sequence
  chemically synthesized
aatggccagggccaggcaga

SEQ ID NO: 980 - DNA, 20 bp, Artificial Sequence
  chemically synthesized
ccagggccaggcagatagac

SEQ ID NO: 981 - DNA, 20 bp, Artificial Sequence
  chemically synthesized
ccaggcagatagaccagact

SEQ ID NO: 982 - DNA, 20 bp, Artificial Sequence
  chemically synthesized
agatagaccagactgagcta

SEQ ID NO: 983 - DNA, 20 bp, Artificial Sequence
  chemically synthesized
gatagaccagactgagctat

SEQ ID NO: 984 - DNA, 20 bp, Artificial Sequence
  chemically synthesized
tagaccagactgagctatgg

SEQ ID NO: 985 - DNA, 20 bp, Artificial Sequence
  chemically synthesized
ccagactgagctatgggagc

SEQ ID NO: 986 - DNA, 20 bp, Artificial Sequence
  chemically synthesized
ctgagctatgggagctggct

SEQ ID NO: 987 - DNA, 20 bp, Artificial Sequence
  chemically synthesized
tgagctatgggagctggctc

SEQ ID NO: 988 - DNA, 20 bp, Artificial Sequence
  chemically synthesized
tatgggagctggctcaggtt

SEQ ID NO: 989 - DNA, 20 bp, Artificial Sequence
  chemically synthesized
atgggagctggctcaggttc

SEQ ID NO: 990 - DNA, 20 bp, Artificial Sequence
  chemically synthesized
gggagctggctcaggttcag

SEQ ID NO: 991 - DNA, 20 bp, Artificial Sequence
  chemically synthesized
gagctggctcaggttcagga

SEQ ID NO: 992 - DNA, 20 bp, Artificial Sequence
  chemically synthesized
agctggctcaggttcaggag

SEQ ID NO: 993 - DNA, 20 bp, Artificial Sequence
  chemically synthesized
gctggctcaggttcaggaga

SEQ ID NO: 994 - DNA, 20 bp, Artificial Sequence
  chemically synthesized
ggctcaggttcaggagaggg

SEQ ID NO: 995 - DNA, 20 bp, Artificial Sequence
  chemically synthesized
gctcaggttcaggagagggc

SEQ ID NO: 996 - DNA, 20 bp, Artificial Sequence
  chemically synthesized
ctcaggttcaggagagggca

SEQ ID NO: 997 - DNA, 20 bp, Artificial Sequence
  chemically synthesized
aggttcaggagagggcaggg

SEQ ID NO: 998 - DNA, 20 bp, Artificial Sequence
  chemically synthesized
ggttcaggagagggcagggc

SEQ ID NO: 999 - DNA, 20 bp, Artificial Sequence
  chemically synthesized
gttcaggagagggcagggca

SEQ ID NO: 1000 - DNA, 20 bp, Artificial Sequence
  chemically synthesized
caggagagggcagggcaggg

SEQ ID NO: 1001 - DNA, 20 bp, Artificial Sequence
  chemically synthesized
aggagagggcagggcaggga

SEQ ID NO: 1002 - DNA, 20 bp, Artificial Sequence
  chemically synthesized
gagagggcagggcagggaag

SEQ ID NO: 1003 - DNA, 20 bp, Artificial Sequence
  chemically synthesized
gcagggcagggaaggagaca

SEQ ID NO: 1004 - DNA, 20 bp, Artificial Sequence
  chemically synthesized
gcagggaaggagacaaagtc

SEQ ID NO: 1005 - DNA, 20 bp, Artificial Sequence
  chemically synthesized
cagggaaggagacaaagtcc

SEQ ID NO: 1006 - DNA, 20 bp, Artificial Sequence
  chemically synthesized
aaggagacaaagtccaggac

SEQ ID NO: 1007 - DNA, 20 bp, Artificial Sequence
  chemically synthesized
agacaaagtccaggaccggc

SEQ ID NO: 1008 - DNA, 20 bp, Artificial Sequence
  chemically synthesized
acaaagtccaggaccggctg

SEQ ID NO: 1009 - DNA, 20 bp, Artificial Sequence
  chemically synthesized
caaagtccaggaccggctgg

SEQ ID NO: 1010 - DNA, 20 bp, Artificial Sequence
  chemically synthesized
aaagtccaggaccggctgga

SEQ ID NO: 1011 - DNA, 20 bp, Artificial Sequence
  chemically synthesized
aagtccaggaccggctggag

SEQ ID NO: 1012 - DNA, 20 bp, Artificial Sequence
  chemically synthesized
cggctggaggggctcaacat

SEQ ID NO: 1013 - DNA, 20 bp, Artificial Sequence
  chemically synthesized
ctggaggggctcaacatcgg

SEQ ID NO: 1014 - DNA, 20 bp, Artificial Sequence
  chemically synthesized
ggaggggctcaacatcggaa

SEQ ID NO: 1015 - DNA, 20 bp, Artificial Sequence
  chemically synthesized
gaggggctcaacatcggaag

SEQ ID NO: 1016 - DNA, 20 bp, Artificial Sequence
  chemically synthesized
aggggctcaacatcggaaga

SEQ ID NO: 1017 - DNA, 20 bp, Artificial Sequence
  chemically synthesized
ggggctcaacatcggaagag

SEQ ID NO: 1018 - DNA, 20 bp, Artificial Sequence
  chemically synthesized
gctcaacatcggaagagggg

SEQ ID NO: 1019 - DNA, 20 bp, Artificial Sequence
  chemically synthesized
acatcggaagaggggaagtc

SEQ ID NO: 1020 - DNA, 20 bp, Artificial Sequence
  chemically synthesized
catcggaagaggggaagtcg

SEQ ID NO: 1021 - DNA, 20 bp, Artificial Sequence
  chemically synthesized
atcggaagaggggaagtcga

SEQ ID NO: 1022 - DNA, 20 bp, Artificial Sequence
  chemically synthesized
cggaagaggggaagtcgagg

SEQ ID NO: 1023 - DNA, 20 bp, Artificial Sequence
  chemically synthesized
ggaagaggggaagtcgaggg

SEQ ID NO: 1024 - DNA, 20 bp, Artificial Sequence
  chemically synthesized
gaagaggggaagtcgaggga

SEQ ID NO: 1025 - DNA, 20 bp, Artificial Sequence
  chemically synthesized
aggggaagtcgagggaggga

SEQ ID NO: 1026 - DNA, 20 bp, Artificial Sequence
  chemically synthesized
gaagtcgagggagggatggt

SEQ ID NO: 1027 - DNA, 20 bp, Artificial Sequence
  chemically synthesized
aagtcgagggagggatggta

SEQ ID NO: 1028 - DNA, 20 bp, Artificial Sequence
  chemically synthesized
gtcgagggagggatggtaag

SEQ ID NO: 1029 - DNA, 20 bp, Artificial Sequence
  chemically synthesized
tcgagggagggatggtaagg

SEQ ID NO: 1030 - DNA, 20 bp, Artificial Sequence
  chemically synthesized
ggatggtaaggaggactgca

SEQ ID NO: 1031 - DNA, 20 bp, Artificial Sequence
  chemically synthesized
gatggtaaggaggactgcat

SEQ ID NO: 1032 - DNA, 20 bp, Artificial Sequence
  chemically synthesized
gtaaggaggactgcatgggt

SEQ ID NO: 1033 - DNA, 20 bp, Artificial Sequence
  chemically synthesized
gaggactgcatgggtcagca

SEQ ID NO: 1034 - DNA, 20 bp, Artificial Sequence
  chemically synthesized
aggactgcatgggtcagcac

SEQ ID NO: 1035 - DNA, 20 bp, Artificial Sequence
  chemically synthesized
tgggtcagcacaggctgcca

SEQ ID NO: 1036 - DNA, 20 bp, Artificial Sequence
  chemically synthesized
tcagcacaggctgccaaagc

SEQ ID NO: 1037 - DNA, 20 bp, Artificial Sequence
  chemically synthesized
cagcacaggctgccaaagcc

SEQ ID NO: 1038 - DNA, 20 bp, Artificial Sequence
  chemically synthesized
agcacaggctgccaaagcca

SEQ ID NO: 1039 - DNA, 20 bp, Artificial Sequence
  chemically synthesized
caggctgccaaagccagggc

SEQ ID NO: 1040 - DNA, 20 bp, Artificial Sequence
  chemically synthesized
gccaaagccagggccagtta

SEQ ID NO: 1041 - DNA, 20 bp, Artificial Sequence
  chemically synthesized
cagttaaagcgactccaatg

SEQ ID NO: 1042 - DNA, 20 bp, Artificial Sequence
  chemically synthesized
ttaaagcgactccaatgcgg

SEQ ID NO: 1043 - DNA, 20 bp, Artificial Sequence
  chemically synthesized
aaagcgactccaatgcggaa

SEQ ID NO: 1044 - DNA, 20 bp, Artificial Sequence
  chemically synthesized
agcgactccaatgcggaaga

SEQ ID NO: 1045 - DNA, 20 bp, Artificial Sequence
  chemically synthesized
gactccaatgcggaagagag

SEQ ID NO: 1046 - DNA, 20 bp, Artificial Sequence
  chemically synthesized
actccaatgcggaagagagt

SEQ ID NO: 1047 - DNA, 20 bp, Artificial Sequence
  chemically synthesized
atgcggaagagagtaggtcg

SEQ ID NO: 1048 - DNA, 20 bp, Artificial Sequence
  chemically synthesized
tgcggaagagagtaggtcga

SEQ ID NO: 1049 - DNA, 20 bp, Artificial Sequence
  chemically synthesized
gcggaagagagtaggtcgaa

SEQ ID NO: 1050 - DNA, 20 bp, Artificial Sequence
  chemically synthesized
cggaagagagtaggtcgaag

SEQ ID NO: 1051 - DNA, 20 bp, Artificial Sequence
  chemically synthesized
gagagtaggtcgaaggggaa

SEQ ID NO: 1052 - DNA, 20 bp, Artificial Sequence
  chemically synthesized
gtaggtcgaaggggaatggt

SEQ ID NO: 1053 - DNA, 20 bp, Artificial Sequence
  chemically synthesized
taggtcgaaggggaatggta

SEQ ID NO: 1054 - DNA, 20 bp, Artificial Sequence
  chemically synthesized
ggtcgaaggggaatggtaag

SEQ ID NO: 1055 - DNA, 20 bp, Artificial Sequence
  chemically synthesized
gtcgaaggggaatggtaagg

SEQ ID NO: 1056 - DNA, 20 bp, Artificial Sequence
  chemically synthesized
aggggaatggtaaggaggcc

SEQ ID NO: 1057 - DNA, 20 bp, Artificial Sequence
  chemically synthesized
ggggaatggtaaggaggcct

SEQ ID NO: 1058 - DNA, 20 bp, Artificial Sequence
  chemically synthesized
gggaatggtaaggaggcctg

SEQ ID NO: 1059 - DNA, 20 bp, Artificial Sequence
  chemically synthesized
aatggtaaggaggcctgggg

SEQ ID NO: 1060 - DNA, 20 bp, Artificial Sequence
  chemically synthesized
tggtaaggaggcctggggca

SEQ ID NO: 1061 - DNA, 20 bp, Artificial Sequence
  chemically synthesized
taaggaggcctggggcagag

SEQ ID NO: 1062 - DNA, 20 bp, Artificial Sequence
  chemically synthesized
gaggcctggggcagagtggt

SEQ ID NO: 1063 - DNA, 20 bp, Artificial Sequence
  chemically synthesized
ctggggcagagtggtcagca

SEQ ID NO: 1064 - DNA, 20 bp, Artificial Sequence
  chemically synthesized
ggggcagagtggtcagcaca

SEQ ID NO: 1065 - DNA, 20 bp, Artificial Sequence
  chemically synthesized
gcagagtggtcagcacagag

SEQ ID NO: 1066 - DNA, 20 bp, Artificial Sequence
  chemically synthesized
gtggtcagcacagagtggct

SEQ ID NO: 1067 - DNA, 20 bp, Artificial Sequence
  chemically synthesized
cagcacagagtggctaagcc

SEQ ID NO: 1068 - DNA, 20 bp, Artificial Sequence
  chemically synthesized
agcacagagtggctaagccc

SEQ ID NO: 1069 - DNA, 20 bp, Artificial Sequence
  chemically synthesized
gcacagagtggctaagccca

SEQ ID NO: 1070 - DNA, 20 bp, Artificial Sequence
  chemically synthesized
agagtggctaagcccagggc

SEQ ID NO: 1071 - DNA, 20 bp, Artificial Sequence
  chemically synthesized
gctaagcccagggccagttg

SEQ ID NO: 1072 - DNA, 20 bp, Artificial Sequence
  chemically synthesized
aagcccagggccagttgaag

SEQ ID NO: 1073 - DNA, 20 bp, Artificial Sequence
  chemically synthesized
cagttgaagcggctccaatt

SEQ ID NO: 1074 - DNA, 20 bp, Artificial Sequence
  chemically synthesized
ttgaagcggctccaattcgg

SEQ ID NO: 1075 - DNA, 20 bp, Artificial Sequence
  chemically synthesized
aagcggctccaattcggaag

SEQ ID NO: 1076 - DNA, 20 bp, Artificial Sequence
  chemically synthesized
agcggctccaattcggaagt

SEQ ID NO: 1077 - DNA, 20 bp, Artificial Sequence
  chemically synthesized
gcggctccaattcggaagtg

SEQ ID NO: 1078 - DNA, 20 bp, Artificial Sequence
  chemically synthesized
gctccaattcggaagtgggg

SEQ ID NO: 1079 - DNA, 20 bp, Artificial Sequence
  chemically synthesized
attcggaagtggggtggtcg

SEQ ID NO: 1080 - DNA, 20 bp, Artificial Sequence
  chemically synthesized
ttcggaagtggggtggtcga

SEQ ID NO: 1081 - DNA, 20 bp, Artificial Sequence
  chemically synthesized
tcggaagtggggtggtcgaa

SEQ ID NO: 1082 - DNA, 20 bp, Artificial Sequence
  chemically synthesized
cggaagtggggtggtcgaag

SEQ ID NO: 1083 - DNA, 20 bp, Artificial Sequence
  chemically synthesized
gtggggtggtcgaaggggaa

SEQ ID NO: 1084 - DNA, 20 bp, Artificial Sequence
  chemically synthesized
ggtggtcgaaggggaatggt

SEQ ID NO: 1085 - DNA, 20 bp, Artificial Sequence
  chemically synthesized
gtggtcgaaggggaatggta

SEQ ID NO: 1086 - DNA, 20 bp, Artificial Sequence
  chemically synthesized
tggtcgaaggggaatggtaa

SEQ ID NO: 1087 - DNA, 20 bp, Artificial Sequence
  chemically synthesized
ggtcgaaggggaatggtaag

SEQ ID NO: 1088 - DNA, 20 bp, Artificial Sequence
  chemically synthesized
gtcgaaggggaatggtaagg

SEQ ID NO: 1089 - DNA, 20 bp, Artificial Sequence
  chemically synthesized
aggggaatggtaagggggac

SEQ ID NO: 1090 - DNA, 20 bp, Artificial Sequence
  chemically synthesized
ggggaatggtaagggggact

SEQ ID NO: 1091 - DNA, 20 bp, Artificial Sequence
  chemically synthesized
aatggtaagggggactggga

SEQ ID NO: 1092 - DNA, 20 bp, Artificial Sequence
  chemically synthesized
atggtaagggggactgggac

SEQ ID NO: 1093 - DNA, 20 bp, Artificial Sequence
  chemically synthesized
tggtaagggggactgggacg

SEQ ID NO: 1094 - DNA, 20 bp, Artificial Sequence
  chemically synthesized
gggggactgggacggggtgt

SEQ ID NO: 1095 - DNA, 20 bp, Artificial Sequence
  chemically synthesized
actgggacggggtgtcagca

SEQ ID NO: 1096 - DNA, 20 bp, Artificial Sequence
  chemically synthesized
ctgggacggggtgtcagcat

SEQ ID NO: 1097 - DNA, 20 bp, Artificial Sequence
  chemically synthesized
tgggacggggtgtcagcata

SEQ ID NO: 1098 - DNA, 20 bp, Artificial Sequence
  chemically synthesized
gacggggtgtcagcataggg

SEQ ID NO: 1099 - DNA, 20 bp, Artificial Sequence
  chemically synthesized
ggtgtcagcatagggtggca

SEQ ID NO: 1100 - DNA, 20 bp, Artificial Sequence
  chemically synthesized
cagcatagggtggcaaagcc

SEQ ID NO: 1101 - DNA, 20 bp, Artificial Sequence
  chemically synthesized
agcatagggtggcaaagccc

SEQ ID NO: 1102 - DNA, 20 bp, Artificial Sequence
  chemically synthesized
gcatagggtggcaaagccca

SEQ ID NO: 1103 - DNA, 20 bp, Artificial Sequence
  chemically synthesized
agggtggcaaagcccagggc

SEQ ID NO: 1104 - DNA, 20 bp, Artificial Sequence
  chemically synthesized
gggtggcaaagcccagggcc

SEQ ID NO: 1105 - DNA, 20 bp, Artificial Sequence
  chemically synthesized
aagcccagggccaggaacga

SEQ ID NO: 1106 - DNA, 20 bp, Artificial Sequence
  chemically synthesized
agcccagggccaggaacgac

SEQ ID NO: 1107 - DNA, 20 bp, Artificial Sequence
  chemically synthesized
gcccagggccaggaacgacg

SEQ ID NO: 1108 - DNA, 20 bp, Artificial Sequence
  chemically synthesized
cagggccaggaacgacgggg

SEQ ID NO: 1109 - DNA, 20 bp, Artificial Sequence
  chemically synthesized
caggaacgacggggcggatc

SEQ ID NO: 1110 - DNA, 20 bp, Artificial Sequence
  chemically synthesized
acgacggggcggatcgagac

SEQ ID NO: 1111 - DNA, 20 bp, Artificial Sequence
  chemically synthesized
gggcggatcgagactggcaa

SEQ ID NO: 1112 - DNA, 20 bp, Artificial Sequence
  chemically synthesized
ggcggatcgagactggcaac

SEQ ID NO: 1113 - DNA, 20 bp, Artificial Sequence
  chemically synthesized
gcggatcgagactggcaacg

SEQ ID NO: 1114 - DNA, 20 bp, Artificial Sequence
  chemically synthesized
gatcgagactggcaacgggg

SEQ ID NO: 1115 - DNA, 20 bp, Artificial Sequence
  chemically synthesized
atcgagactggcaacgggga

SEQ ID NO: 1116 - DNA, 20 bp, Artificial Sequence
  chemically synthesized
cgagactggcaacggggaag

SEQ ID NO: 1117 - DNA, 20 bp, Artificial Sequence
  chemically synthesized
gagactggcaacggggaagg

SEQ ID NO: 1118 - DNA, 20 bp, Artificial Sequence
  chemically synthesized
aacggggaaggaggatgccc

SEQ ID NO: 1119 - DNA, 20 bp, Artificial Sequence
  chemically synthesized
acggggaaggaggatgcccc

SEQ ID NO: 1120 - DNA, 20 bp, Artificial Sequence
  chemically synthesized
gggaaggaggatgccccagg

SEQ ID NO: 1121 - DNA, 20 bp, Artificial Sequence
  chemically synthesized
ggaggatgccccaggtggcg

SEQ ID NO: 1122 - DNA, 20 bp, Artificial Sequence
  chemically synthesized
ggatgccccaggtggcgcag

SEQ ID NO: 1123 - DNA, 20 bp, Artificial Sequence
  chemically synthesized
atgccccaggtggcgcagca

SEQ ID NO: 1124 - DNA, 20 bp, Artificial Sequence
  chemically synthesized
tgccccaggtggcgcagcag

SEQ ID NO: 1125 - DNA, 20 bp, Artificial Sequence
  chemically synthesized
gccccaggtggcgcagcaga

SEQ ID NO: 1126 - DNA, 20 bp, Artificial Sequence
  chemically synthesized
ccaggtggcgcagcagaggg

SEQ ID NO: 1127 - DNA, 20 bp, Artificial Sequence
  chemically synthesized
ggcgcagcagagggtggacc

SEQ ID NO: 1128 - DNA, 20 bp, Artificial Sequence
  chemically synthesized
gcagagggtggacctggccc

SEQ ID NO: 1129 - DNA, 20 bp, Artificial Sequence
  chemically synthesized
cagagggtggacctggcccc

SEQ ID NO: 1130 - DNA, 20 bp, Artificial Sequence
  chemically synthesized
gagggtggacctggccccgg

SEQ ID NO: 1131 - DNA, 20 bp, Artificial Sequence
  chemically synthesized
gacctggccccgggagacgc

SEQ ID NO: 1132 - DNA, 20 bp, Artificial Sequence
  chemically synthesized
acctggccccgggagacgcc

SEQ ID NO: 1133 - DNA, 20 bp, Artificial Sequence
  chemically synthesized
tggccccgggagacgccggg

SEQ ID NO: 1134 - DNA, 20 bp, Artificial Sequence
  chemically synthesized
ggccccgggagacgccgggc

SEQ ID NO: 1135 - DNA, 20 bp, Artificial Sequence
  chemically synthesized
gccccgggagacgccgggcg

SEQ ID NO: 1136 - DNA, 20 bp, Artificial Sequence
  chemically synthesized
ccccgggagacgccgggcgg

SEQ ID NO: 1137 - DNA, 20 bp, Artificial Sequence
  chemically synthesized
cccgggagacgccgggcggg

SEQ ID NO: 1138 - DNA, 20 bp, Artificial Sequence
  chemically synthesized
ccgggcggggggcgctgacc

SEQ ID NO: 1139 - DNA, 20 bp, Artificial Sequence
  chemically synthesized
cggggggcgctgacctggtg

SEQ ID NO: 1140 - DNA, 20 bp, Artificial Sequence
  chemically synthesized
ggggggcgctgacctggtgc

SEQ ID NO: 1141 - DNA, 20 bp, Artificial Sequence
  chemically synthesized
gggggcgctgacctggtgca

SEQ ID NO: 1142 - DNA, 20 bp, Artificial Sequence
  chemically synthesized
gtgcagggcgctgataccgt

SEQ ID NO: 1143 - DNA, 20 bp, Artificial Sequence
  chemically synthesized
ggcgctgataccgtcggcgt

SEQ ID NO: 1144 - DNA, 20 bp, Artificial Sequence
  chemically synthesized
gctgataccgtcggcgttgg

SEQ ID NO: 1145 - DNA, 20 bp, Artificial Sequence
  chemically synthesized
tgataccgtcggcgttggtg

SEQ ID NO: 1146 - DNA, 20 bp, Artificial Sequence
  chemically synthesized
ccgtcggcgttggtggagtc

SEQ ID NO: 1147 - DNA, 20 bp, Artificial Sequence
  chemically synthesized
ggcgttggtggagtccagca

SEQ ID NO: 1148 - DNA, 20 bp, Artificial Sequence
  chemically synthesized
tggtggagtccagcacggcg

SEQ ID NO: 1149 - DNA, 20 bp, Artificial Sequence
  chemically synthesized
ggtggagtccagcacggcgc

SEQ ID NO: 1150 - DNA, 20 bp, Artificial Sequence
  chemically synthesized
ggagtccagcacggcgcggg

SEQ ID NO: 1151 - DNA, 20 bp, Artificial Sequence
  chemically synthesized
gagtccagcacggcgcgggc

SEQ ID NO: 1152 - DNA, 20 bp, Artificial Sequence
  chemically synthesized
tccagcacggcgcgggcggg

SEQ ID NO: 1153 - DNA, 20 bp, Artificial Sequence
  chemically synthesized
agcacggcgcgggcgggcgg

SEQ ID NO: 1154 - DNA, 20 bp, Artificial Sequence
  chemically synthesized
ggcgcgggcgggcggcggcg

SEQ ID NO: 1155 - DNA, 20 bp, Artificial Sequence
  chemically synthesized
gcgggcgggcggcggcgcgg

SEQ ID NO: 1156 - DNA, 20 bp, Artificial Sequence
  chemically synthesized
cgggcgggcggcggcgcggc

SEQ ID NO: 1157 - DNA, 20 bp, Artificial Sequence
  chemically synthesized
gggcgggcggcggcgcggcg

SEQ ID NO: 1158 - DNA, 20 bp, Artificial Sequence
  chemically synthesized
ggcggcggcgcggcggggtc

SEQ ID NO: 1159 - DNA, 20 bp, Artificial Sequence
  chemically synthesized
cggcgcggcggggtcgagct

SEQ ID NO: 1160 - DNA, 20 bp, Artificial Sequence
  chemically synthesized
ggcggggtcgagctcggcgc

SEQ ID NO: 1161 - DNA, 20 bp, Artificial Sequence
  chemically synthesized
gcggggtcgagctcggcgcc

SEQ ID NO: 1162 - DNA, 20 bp, Artificial Sequence
  chemically synthesized
cggggtcgagctcggcgccg

SEQ ID NO: 1163 - DNA, 20 bp, Artificial Sequence
  chemically synthesized
gtcgagctcggcgccggggc

SEQ ID NO: 1164 - DNA, 20 bp, Artificial Sequence
  chemically synthesized
tcgagctcggcgccggggcc

SEQ ID NO: 1165 - DNA, 20 bp, Artificial Sequence
  chemically synthesized
cgagctcggcgccggggcca

SEQ ID NO: 1166 - DNA, 20 bp, Artificial Sequence
  chemically synthesized
ctcggcgccggggccagggt

SEQ ID NO: 1167 - DNA, 20 bp, Artificial Sequence
  chemically synthesized
ggcgccggggccagggtcgg

SEQ ID NO: 1168 - DNA, 20 bp, Artificial Sequence
  chemically synthesized
gggccagggtcggcggcgcg

SEQ ID NO: 1169 - DNA, 20 bp, Artificial Sequence
  chemically synthesized
gggtcggcggcgcgcagcat

SEQ ID NO: 1170 - DNA, 20 bp, Artificial Sequence
  chemically synthesized
agcatcagacgcgcctcgtc

SEQ ID NO: 1171 - DNA, 20 bp, Artificial Sequence
  chemically synthesized
gcatcagacgcgcctcgtcc

SEQ ID NO: 1172 - DNA, 20 bp, Artificial Sequence
  chemically synthesized
cgtccaggtcgccgcccgca

SEQ ID NO: 1173 - DNA, 20 bp, Artificial Sequence
  chemically synthesized
gtccaggtcgccgcccgcac

SEQ ID NO: 1174 - DNA, 20 bp, Artificial Sequence
  chemically synthesized
tcgccgcccgcacaggccgc

SEQ ID NO: 1175 - DNA, 20 bp, Artificial Sequence
  chemically synthesized
cgccgcccgcacaggccgcc

SEQ ID NO: 1176 - DNA, 20 bp, Artificial Sequence
  chemically synthesized
cgcacaggccgccaggaact

SEQ ID NO: 1177 - DNA, 20 bp, Artificial Sequence
  chemically synthesized
acaggccgccaggaactcgg

SEQ ID NO: 1178 - DNA, 20 bp, Artificial Sequence
  chemically synthesized
ggaactcggcggcgcgctcg

SEQ ID NO: 1179 - DNA, 20 bp, Artificial Sequence
  chemically synthesized
actcggcggcgcgctcgaag

SEQ ID NO: 1180 - DNA, 20 bp, Artificial Sequence
  chemically synthesized
ggcggcgcgctcgaagcgga

SEQ ID NO: 1181 - DNA, 20 bp, Artificial Sequence
  chemically synthesized
cgcgctcgaagcggacggtg

SEQ ID NO: 1182 - DNA, 20 bp, Artificial Sequence
  chemically synthesized
gcgctcgaagcggacggtgc

SEQ ID NO: 1183 - DNA, 20 bp, Artificial Sequence
  chemically synthesized
cgaagcggacggtgcgggcg

SEQ ID NO: 1184 - DNA, 20 bp, Artificial Sequence
  chemically synthesized
ggtgcgggcgcggcgctctc

SEQ ID NO: 1185 - DNA, 20 bp, Artificial Sequence
  chemically synthesized
gtgcgggcgcggcgctctcc

SEQ ID NO: 1186 - DNA, 20 bp, Artificial Sequence
  chemically synthesized
tgcgggcgcggcgctctccg

SEQ ID NO: 1187 - DNA, 20 bp, Artificial Sequence
  chemically synthesized
ggcgcggcgctctccggggc

SEQ ID NO: 1188 - DNA, 20 bp, Artificial Sequence
  chemically synthesized
gcgcggcgctctccggggcc

SEQ ID NO: 1189 - DNA, 20 bp, Artificial Sequence
  chemically synthesized
gcgctctccggggccaggct

SEQ ID NO: 1190 - DNA, 20 bp, Artificial Sequence
  chemically synthesized
gcccgcgccccccactgccg

SEQ ID NO: 1191 - DNA, 20 bp, Artificial Sequence
  chemically synthesized
gctgctcccgtcgccgctcc

SEQ ID NO: 1192 - DNA, 20 bp, Artificial Sequence
  chemically synthesized
ctgctcccgtcgccgctccc

SEQ ID NO: 1193 - DNA, 20 bp, Artificial Sequence
  chemically synthesized
ctcccgtcgccgctcccggg

SEQ ID NO: 1194 - DNA, 20 bp, Artificial Sequence
  chemically synthesized
gcagccgccgccgccgcccc

SEQ ID NO: 1195 - DNA, 20 bp, Artificial Sequence
  chemically synthesized
cagccgccgccgccgccccc

SEQ ID NO: 1196 - DNA, 20 bp, Artificial Sequence
  chemically synthesized
cgccgccgccgcccccgggc

SEQ ID NO: 1197 - DNA, 20 bp, Artificial Sequence
  chemically synthesized
gccgcccccgggccagccgc

SEQ ID NO: 1198 - DNA, 20 bp, Artificial Sequence
  chemically synthesized
ccgcccccgggccagccgcc

SEQ ID NO: 1199 - DNA, 20 bp, Artificial Sequence
  chemically synthesized
agccgccgggccatcctctc

SEQ ID NO: 1200 - DNA, 20 bp, Artificial Sequence
  chemically synthesized
catcgcaccgcccgcccgcc

SEQ ID NO: 1201 - DNA, 20 bp, Artificial Sequence
  chemically synthesized
gcaccgcccgcccgcccagc

SEQ ID NO: 1202 - DNA, 20 bp, Artificial Sequence
  chemically synthesized
cgcccgcccgcccagcgagc

SEQ ID NO: 1203 - DNA, 20 bp, Artificial Sequence
  chemically synthesized
cgcccgcccagcgagcgagc

SEQ ID NO: 1204 - DNA, 20 bp, Artificial Sequence
  chemically synthesized
ccagcgagcgagcgagcgcc

SEQ ID NO: 1205 - DNA, 20 bp, Artificial Sequence
  chemically synthesized
tggtggcggcggttggggct

SEQ ID NO: 1206 - DNA, 20 bp, Artificial Sequence
  chemically synthesized
ctcggcgctcgctcgctcgc

SEQ ID NO: 1207 - DNA, 20 bp, Artificial Sequence
  chemically synthesized
tcggcgctcgctcgctcgct

SEQ ID NO: 1208 - DNA, 20 bp, Artificial Sequence
  chemically synthesized
gcgctcgctcgctcgctggg

SEQ ID NO: 1209 - DNA, 20 bp, Artificial Sequence
  chemically synthesized
cgctcgctcgctcgctgggc

SEQ ID NO: 1210 - DNA, 20 bp, Artificial Sequence
  chemically synthesized
tcgctcgctcgctgggcggg

SEQ ID NO: 1211 - DNA, 20 bp, Artificial Sequence
  chemically synthesized
cgctcgctcgctgggcgggc

SEQ ID NO: 1212 - DNA, 20 bp, Artificial Sequence
  chemically synthesized
tcgctcgctgggcgggcggg

SEQ ID NO: 1213 - DNA, 20 bp, Artificial Sequence
  chemically synthesized
cgggcgggcggtgcgatgtc

SEQ ID NO: 1214 - DNA, 20 bp, Artificial Sequence
  chemically synthesized
ggcgggcggtgcgatgtccg

SEQ ID NO: 1215 - DNA, 20 bp, Artificial Sequence
  chemically synthesized
cgggcggtgcgatgtccgga

SEQ ID NO: 1216 - DNA, 20 bp, Artificial Sequence
  chemically synthesized
gggcggtgcgatgtccggag

SEQ ID NO: 1217 - DNA, 20 bp, Artificial Sequence
  chemically synthesized
ggtgcgatgtccggagagga

SEQ ID NO: 1218 - DNA, 20 bp, Artificial Sequence
  chemically synthesized
gatgtccggagaggatggcc

SEQ ID NO: 1219 - DNA, 20 bp, Artificial Sequence
  chemically synthesized
gtccggagaggatggcccgg

SEQ ID NO: 1220 - DNA, 20 bp, Artificial Sequence
  chemically synthesized
ggagaggatggcccggcggc

SEQ ID NO: 1221 - DNA, 20 bp, Artificial Sequence
  chemically synthesized
ggatggcccggcggctggcc

SEQ ID NO: 1222 - DNA, 20 bp, Artificial Sequence
  chemically synthesized
gatggcccggcggctggccc

SEQ ID NO: 1223 - DNA, 20 bp, Artificial Sequence
  chemically synthesized
atggcccggcggctggcccg

SEQ ID NO: 1224 - DNA, 20 bp, Artificial Sequence
  chemically synthesized
tggcccggcggctggcccgg

SEQ ID NO: 1225 - DNA, 20 bp, Artificial Sequence
  chemically synthesized
cccggcggctggcccggggg

SEQ ID NO: 1226 - DNA, 20 bp, Artificial Sequence
  chemically synthesized
ggcggctggcccgggggcgg

SEQ ID NO: 1227 - DNA, 20 bp, Artificial Sequence
  chemically synthesized
ggctggcccgggggcggcgg

SEQ ID NO: 1228 - DNA, 20 bp, Artificial Sequence
  chemically synthesized
tggcccgggggcggcggcgg

SEQ ID NO: 1229 - DNA, 20 bp, Artificial Sequence
  chemically synthesized
gggcggcggcggcggctgcc

SEQ ID NO: 1230 - DNA, 20 bp, Artificial Sequence
  chemically synthesized
ggcggcggcggcggctgccc

SEQ ID NO: 1231 - DNA, 20 bp, Artificial Sequence
  chemically synthesized
cggcggcggcggctgcccgg

SEQ ID NO: 1232 - DNA, 20 bp, Artificial Sequence
  chemically synthesized
cggcggcggctgcccgggag

SEQ ID NO: 1233 - DNA, 20 bp, Artificial Sequence
  chemically synthesized
cggctgcccgggagcggcga

SEQ ID NO: 1234 - DNA, 20 bp, Artificial Sequence
  chemically synthesized
ggctgcccgggagcggcgac

SEQ ID NO: 1235 - DNA, 20 bp, Artificial Sequence
  chemically synthesized
ctgcccgggagcggcgacgg

SEQ ID NO: 1236 - DNA, 20 bp, Artificial Sequence
  chemically synthesized
cccgggagcggcgacgggag

SEQ ID NO: 1237 - DNA, 20 bp, Artificial Sequence
  chemically synthesized
agcggcgacgggagcagctg

SEQ ID NO: 1238 - DNA, 20 bp, Artificial Sequence
  chemically synthesized
ggcgacgggagcagctgcgg

SEQ ID NO: 1239 - DNA, 20 bp, Artificial Sequence
  chemically synthesized
gacgggagcagctgcggcag

SEQ ID NO: 1240 - DNA, 20 bp, Artificial Sequence
  chemically synthesized
acgggagcagctgcggcagt

SEQ ID NO: 1241 - DNA, 20 bp, Artificial Sequence
  chemically synthesized
cgggagcagctgcggcagtg

SEQ ID NO: 1242 - DNA, 20 bp, Artificial Sequence
  chemically synthesized
gggagcagctgcggcagtgg

SEQ ID NO: 1243 - DNA, 20 bp, Artificial Sequence
  chemically synthesized
ggagcagctgcggcagtggg

SEQ ID NO: 1244 - DNA, 20 bp, Artificial Sequence
  chemically synthesized
agctgcggcagtggggggcg

SEQ ID NO: 1245 - DNA, 20 bp, Artificial Sequence
  chemically synthesized
gctgcggcagtggggggcgc

SEQ ID NO: 1246 - DNA, 20 bp, Artificial Sequence
  chemically synthesized
gcggcagtggggggcgcggg

SEQ ID NO: 1247 - DNA, 20 bp, Artificial Sequence
  chemically synthesized
cggcagtggggggcgcgggc

SEQ ID NO: 1248 - DNA, 20 bp, Artificial Sequence
  chemically synthesized
ggggggcgcgggcgggcgcc

SEQ ID NO: 1249 - DNA, 20 bp, Artificial Sequence
  chemically synthesized
gcgcgggcgggcgccgagcc

SEQ ID NO: 1250 - DNA, 20 bp, Artificial Sequence
  chemically synthesized
gcgggcgccgagcctggccc

SEQ ID NO: 1251 - DNA, 20 bp, Artificial Sequence
  chemically synthesized
gggcgccgagcctggccccg

SEQ ID NO: 1252 - DNA, 20 bp, Artificial Sequence
  chemically synthesized
gcgccgagcctggccccgga

SEQ ID NO: 1253 - DNA, 20 bp, Artificial Sequence
  chemically synthesized
gcgcccgcaccgtccgcttc

SEQ ID NO: 1254 - DNA, 20 bp, Artificial Sequence
  chemically synthesized
tccgcttcgagcgcgccgcc

SEQ ID NO: 1255 - DNA, 20 bp, Artificial Sequence
  chemically synthesized
cgagcgcgccgccgagttcc

SEQ ID NO: 1256 - DNA, 20 bp, Artificial Sequence
  chemically synthesized
gcgcgccgccgagttcctgg

SEQ ID NO: 1257 - DNA, 20 bp, Artificial Sequence
  chemically synthesized
cgagttcctggcggcctgtg

SEQ ID NO: 1258 - DNA, 20 bp, Artificial Sequence
  chemically synthesized
gagttcctggcggcctgtgc

SEQ ID NO: 1259 - DNA, 20 bp, Artificial Sequence
  chemically synthesized
ttcctggcggcctgtgcggg

SEQ ID NO: 1260 - DNA, 20 bp, Artificial Sequence
  chemically synthesized
ggcctgtgcgggcggcgacc

SEQ ID NO: 1261 - DNA, 20 bp, Artificial Sequence
  chemically synthesized
gtgcgggcggcgacctggac

SEQ ID NO: 1262 - DNA, 20 bp, Artificial Sequence
  chemically synthesized
tgcgggcggcgacctggacg

SEQ ID NO: 1263 - DNA, 20 bp, Artificial Sequence
  chemically synthesized
atgctgcgcgccgccgaccc

SEQ ID NO: 1264 - DNA, 20 bp, Artificial Sequence
  chemically synthesized
cgcgccgccgaccctggccc

SEQ ID NO: 1265 - DNA, 20 bp, Artificial Sequence
  chemically synthesized
ccgaccctggccccggcgcc

SEQ ID NO: 1266 - DNA, 20 bp, Artificial Sequence
  chemically synthesized
gccgcccgcccgcgccgtgc

SEQ ID NO: 1267 - DNA, 20 bp, Artificial Sequence
  chemically synthesized
ctggactccaccaacgccga

SEQ ID NO: 1268 - DNA, 20 bp, Artificial Sequence
  chemically synthesized
tccaccaacgccgacggtat

SEQ ID NO: 1269 - DNA, 20 bp, Artificial Sequence
  chemically synthesized
acggtatcagcgccctgcac

SEQ ID NO: 1270 - DNA, 20 bp, Artificial Sequence
  chemically synthesized
cggtatcagcgccctgcacc

SEQ ID NO: 1271 - DNA, 20 bp, Artificial Sequence
  chemically synthesized
atcagcgccctgcaccaggt

SEQ ID NO: 1272 - DNA, 20 bp, Artificial Sequence
  chemically synthesized
ccaggtcagcgccccccgcc

SEQ ID NO: 1273 - DNA, 20 bp, Artificial Sequence
  chemically synthesized
gccccccgcccggcgtctcc

SEQ ID NO: 1274 - DNA, 20 bp, Artificial Sequence
  chemically synthesized
ccccccgcccggcgtctccc

SEQ ID NO: 1275 - DNA, 20 bp, Artificial Sequence
  chemically synthesized
cccccgcccggcgtctcccg

SEQ ID NO: 1276 - DNA, 20 bp, Artificial Sequence
  chemically synthesized
cgcccggcgtctcccggggc

SEQ ID NO: 1277 - DNA, 20 bp, Artificial Sequence
  chemically synthesized
gcccggcgtctcccggggcc

SEQ ID NO: 1278 - DNA, 20 bp, Artificial Sequence
  chemically synthesized
ccaccctctgctgcgccacc

SEQ ID NO: 1279 - DNA, 20 bp, Artificial Sequence
  chemically synthesized
caccctctgctgcgccacct

SEQ ID NO: 1280 - DNA, 20 bp, Artificial Sequence
  chemically synthesized
accctctgctgcgccacctg

SEQ ID NO: 1281 - DNA, 20 bp, Artificial Sequence
  chemically synthesized
gcatcctccttccccgttgc

SEQ ID NO: 1282 - DNA, 20 bp, Artificial Sequence
  chemically synthesized
tcgatccgccccgtcgttcc

SEQ ID NO: 1283 - DNA, 20 bp, Artificial Sequence
  chemically synthesized
cgccccgtcgttcctggccc

SEQ ID NO: 1284 - DNA, 20 bp, Artificial Sequence
  chemically synthesized
gccccgtcgttcctggccct

SEQ ID NO: 1285 - DNA, 20 bp, Artificial Sequence
  chemically synthesized
cctatgctgacaccccgtcc

SEQ ID NO: 1286 - DNA, 20 bp, Artificial Sequence
  chemically synthesized
cgaccaccccacttccgaat

SEQ ID NO: 1287 - DNA, 20 bp, Artificial Sequence
  chemically synthesized
accaccccacttccgaattg

SEQ ID NO: 1288 - DNA, 20 bp, Artificial Sequence
  chemically synthesized
cgaattggagccgcttcaac

SEQ ID NO: 1289 - DNA, 20 bp, Artificial Sequence
  chemically synthesized
ggagccgcttcaactggccc

SEQ ID NO: 1290 - DNA, 20 bp, Artificial Sequence
  chemically synthesized
gagccgcttcaactggccct

SEQ ID NO: 1291 - DNA, 20 bp, Artificial Sequence
  chemically synthesized
gcttcaactggccctgggct

SEQ ID NO: 1292 - DNA, 20 bp, Artificial Sequence
  chemically synthesized
ctgtgctgaccactctgccc

SEQ ID NO: 1293 - DNA, 20 bp, Artificial Sequence
  chemically synthesized
tgtgctgaccactctgcccc

SEQ ID NO: 1294 - DNA, 20 bp, Artificial Sequence
  chemically synthesized
cgacctactctcttccgcat

SEQ ID NO: 1295 - DNA, 20 bp, Artificial Sequence
  chemically synthesized
acctactctcttccgcattg

SEQ ID NO: 1296 - DNA, 20 bp, Artificial Sequence
  chemically synthesized
cgcattggagtcgctttaac

SEQ ID NO: 1297 - DNA, 20 bp, Artificial Sequence
  chemically synthesized
ggagtcgctttaactggccc

SEQ ID NO: 1298 - DNA, 20 bp, Artificial Sequence
  chemically synthesized
gctttaactggccctggctt

SEQ ID NO: 1299 - DNA, 20 bp, Artificial Sequence
  chemically synthesized
ttaactggccctggctttgg

SEQ ID NO: 1300 - DNA, 20 bp, Artificial Sequence
  chemically synthesized
gcagcctgtgctgacccatg

SEQ ID NO: 1301 - DNA, 20 bp, Artificial Sequence
  chemically synthesized
acttcccctcttccgatgtt

SEQ ID NO: 1302 - DNA, 20 bp, Artificial Sequence
  chemically synthesized
cttccgatgttgagcccctc

SEQ ID NO: 1303 - DNA, 20 bp, Artificial Sequence
  chemically synthesized
cgatgttgagcccctccagc

SEQ ID NO: 1304 - DNA, 20 bp, Artificial Sequence
  chemically synthesized
tgagcccctccagccggtcc

SEQ ID NO: 1305 - DNA, 20 bp, Artificial Sequence
  chemically synthesized
ccctgccctctcctgaacct

SEQ ID NO: 1306 - DNA, 20 bp, Artificial Sequence
  chemically synthesized
gccctctcctgaacctgagc

SEQ ID NO: 1307 - DNA, 20 bp, Artificial Sequence
  chemically synthesized
tgaacctgagccagctccca

SEQ ID NO: 1308 - DNA, 20 bp, Artificial Sequence
  chemically synthesized
ctgagccagctcccatagct

SEQ ID NO: 1309 - DNA, 20 bp, Artificial Sequence
  chemically synthesized
ccagctcccatagctcagtc

SEQ ID NO: 1310 - DNA, 20 bp, Artificial Sequence
  chemically synthesized
ctcagtctggtctatctgcc

SEQ ID NO: 1311 - DNA, 20 bp, Artificial Sequence
  chemically synthesized
ctggtctatctgcctggccc

SEQ ID NO: 1312 - DNA, 20 bp, Artificial Sequence
  chemically synthesized
gctgccctcctctcgccccc

SEQ ID NO: 1313 - DNA, 20 bp, Artificial Sequence
  chemically synthesized
gagtgcccttgctgtgccgc

SEQ ID NO: 1314 - DNA, 20 bp, Artificial Sequence
  chemically synthesized
aacgctgccgtctctctcct

SEQ ID NO: 1315 - DNA, 20 bp, Artificial Sequence
  chemically synthesized
tgccgtctctctcctgagtc

SEQ ID NO: 1316 - DNA, 20 bp, Artificial Sequence
  chemically synthesized
tcctgagtccggaccacttt

SEQ ID NO: 1317 - DNA, 20 bp, Artificial Sequence
  chemically synthesized
cggaccactttgagctctac

SEQ ID NO: 1318 - DNA, 20 bp, Artificial Sequence
  chemically synthesized
actggcttctgcgccgcctc

SEQ ID NO: 1319 - DNA, 20 bp, Artificial Sequence
  chemically synthesized
ggcccactgtttccccttcc

SEQ ID NO: 1320 - DNA, 20 bp, Artificial Sequence
  chemically synthesized
gcccactgtttccccttccc

SEQ ID NO: 1321 - DNA, 20 bp, Artificial Sequence
  chemically synthesized
cactgtttccccttcccagg

SEQ ID NO: 1322 - DNA, 20 bp, Artificial Sequence
  chemically synthesized
actgtttccccttcccaggc

SEQ ID NO: 1323 - DNA, 20 bp, Artificial Sequence
  chemically synthesized
ctgacctgcattctctcccc

SEQ ID NO: 1324 - DNA, 20 bp, Artificial Sequence
  chemically synthesized
tgacctgcattctctcccct

SEQ ID NO: 1325 - DNA, 20 bp, Artificial Sequence
  chemically synthesized
cctgtgccgctttctgtctg

SEQ ID NO: 1326 - DNA, 20 bp, Artificial Sequence
  chemically synthesized
cgctttctgtctgcagcttg

SEQ ID NO: 1327 - DNA, 20 bp, Artificial Sequence
  chemically synthesized
tctgtctgcagcttgtggcc

SEQ ID NO: 1328 - DNA, 20 bp, Artificial Sequence
  chemically synthesized
ctgtctgcagcttgtggcct

SEQ ID NO: 1329 - DNA, 20 bp, Artificial Sequence
  chemically synthesized
tgtggcctgggtcacctcta

SEQ ID NO: 1330 - DNA, 20 bp, Artificial Sequence
  chemically synthesized
gcctgggtcacctctacggc

SEQ ID NO: 1331 - DNA, 20 bp, Artificial Sequence
  chemically synthesized
ggtcacctctacggctggcc

SEQ ID NO: 1332 - DNA, 20 bp, Artificial Sequence
  chemically synthesized
tccttccctgccgcctcctt

SEQ ID NO: 1333 - DNA, 20 bp, Artificial Sequence
  chemically synthesized
ccttccctgccgcctccttc

SEQ ID NO: 1334 - DNA, 20 bp, Artificial Sequence
  chemically synthesized
tctctgctgtgttgctgccc

SEQ ID NO: 1335 - DNA, 20 bp, Artificial Sequence
  chemically synthesized
ctctgctgtgttgctgccca

SEQ ID NO: 1336 - DNA, 20 bp, Artificial Sequence
  chemically synthesized
ctgcccaaggatgctctttc

SEQ ID NO: 1337 - DNA, 20 bp, Artificial Sequence
  chemically synthesized
gcccaaggatgctctttccg

SEQ ID NO: 1338 - DNA, 20 bp, Artificial Sequence
  chemically synthesized
tttccggagcacttccttct

SEQ ID NO: 1339 - DNA, 20 bp, Artificial Sequence
  chemically synthesized
tgcaccacgtgatgtcctct

SEQ ID NO: 1340 - DNA, 20 bp, Artificial Sequence
  chemically synthesized
accacgtgatgtcctctgag

SEQ ID NO: 1341 - DNA, 20 bp, Artificial Sequence
  chemically synthesized
gagcggatcctccccgtgtc

SEQ ID NO: 1342 - DNA, 20 bp, Artificial Sequence
  chemically synthesized
agcggatcctccccgtgtct

SEQ ID NO: 1343 - DNA, 20 bp, Artificial Sequence
  chemically synthesized
ccccgtgtctgggtcctctc

SEQ ID NO: 1344 - DNA, 20 bp, Artificial Sequence
  chemically synthesized
cccgtgtctgggtcctctcc

SEQ ID NO: 1345 - DNA, 20 bp, Artificial Sequence
  chemically synthesized
cccatgccgtcttcactcgc

SEQ ID NO: 1346 - DNA, 20 bp, Artificial Sequence
  chemically synthesized
ccatgccgtcttcactcgct

SEQ ID NO: 1347 - DNA, 20 bp, Artificial Sequence
  chemically synthesized
ttcccttttccttctccttc

SEQ ID NO: 1348 - DNA, 20 bp, Artificial Sequence
  chemically synthesized
tcccttttccttctccttct

SEQ ID NO: 1349 - DNA, 20 bp, Artificial Sequence
  chemically synthesized
cccttttccttctccttctg

SEQ ID NO: 1350 - DNA, 20 bp, Artificial Sequence
  chemically synthesized
ctgtgccatctctcgtttct

SEQ ID NO: 1351 - DNA, 20 bp, Artificial Sequence
  chemically synthesized
tgtgccatctctcgtttctt

SEQ ID NO: 1352 - DNA, 20 bp, Artificial Sequence
  chemically synthesized
ccatctctcgtttcttagga

SEQ ID NO: 1353 - DNA, 20 bp, Artificial Sequence
  chemically synthesized
cttaggatggccttctccga

SEQ ID NO: 1354 - DNA, 20 bp, Artificial Sequence
  chemically synthesized
cgtcccgcctccccttcttg

SEQ ID NO: 1355 - DNA, 20 bp, Artificial Sequence
  chemically synthesized
gtcccgcctccccttcttgt

SEQ ID NO: 1356 - DNA, 20 bp, Artificial Sequence
  chemically synthesized
ctgcatcatcaccgtttttc

SEQ ID NO: 1357 - DNA, 20 bp, Artificial Sequence
  chemically synthesized
cgtttttctggacaacccca

SEQ ID NO: 1358 - DNA, 20 bp, Artificial Sequence
  chemically synthesized
cccaaagtaccccgtctccc

SEQ ID NO: 1359 - DNA, 20 bp, Artificial Sequence
  chemically synthesized
gtaccccgtctccctggctt

SEQ ID NO: 1360 - DNA, 20 bp, Artificial Sequence
  chemically synthesized
atcctcttgctttctttgcc

SEQ ID NO: 1361 - DNA, 20 bp, Artificial Sequence
  chemically synthesized
ctggacaccccgttctcctg

SEQ ID NO: 1362 - DNA, 20 bp, Artificial Sequence
  chemically synthesized
accccgttctcctgtggatt

SEQ ID NO: 1363 - DNA, 20 bp, Artificial Sequence
  chemically synthesized
ccccgttctcctgtggattc

SEQ ID NO: 1364 - DNA, 20 bp, Artificial Sequence
  chemically synthesized
cacctctcactcctttcatt

SEQ ID NO: 1365 - DNA, 20 bp, Artificial Sequence
  chemically synthesized
acctctcactcctttcattt

SEQ ID NO: 1366 - DNA, 20 bp, Artificial Sequence
  chemically synthesized
tctcactcctttcatttggg

SEQ ID NO: 1367 - DNA, 20 bp, Artificial Sequence
  chemically synthesized
ccctaccccccttacctctc

SEQ ID NO: 1368 - DNA, 20 bp, Artificial Sequence
  chemically synthesized
cttacctctctagtctgtgc

SEQ ID NO: 1369 - DNA, 20 bp, Artificial Sequence
  chemically synthesized
ctagtctgtgctagctcttc

SEQ ID NO: 1370 - DNA, 20 bp, Artificial Sequence
  chemically synthesized
gctcttccagccccctgtca

SEQ ID NO: 1371 - DNA, 20 bp, Artificial Sequence
  chemically synthesized
ccccctgtcatggcatcttc

SEQ ID NO: 1372 - DNA, 20 bp, Artificial Sequence
  chemically synthesized
cccctgtcatggcatcttcc

SEQ ID NO: 1373 - DNA, 20 bp, Artificial Sequence
  chemically synthesized
ccctgtcatggcatcttcca

SEQ ID NO: 1374 - DNA, 20 bp, Artificial Sequence
  chemically synthesized
cctgtcatggcatcttccag

SEQ ID NO: 1375 - DNA, 20 bp, Artificial Sequence
  chemically synthesized
atggcatcttccaggggtcc

SEQ ID NO: 1376 - DNA, 20 bp, Artificial Sequence
  chemically synthesized
ggcatcttccaggggtccga

SEQ ID NO: 1377 - DNA, 20 bp, Artificial Sequence
  chemically synthesized
cttccaggggtccgagagct

SEQ ID NO: 1378 - DNA, 20 bp, Artificial Sequence
  chemically synthesized
caggggtccgagagctcagc

SEQ ID NO: 1379 - DNA, 20 bp, Artificial Sequence
  chemically synthesized
ctagtcttcttcctccaacc

SEQ ID NO: 1380 - DNA, 20 bp, Artificial Sequence
  chemically synthesized
tagtcttcttcctccaaccc

SEQ ID NO: 1381 - DNA, 20 bp, Artificial Sequence
  chemically synthesized
ccgggcccctatgtccactt

SEQ ID NO: 1382 - DNA, 20 bp, Artificial Sequence
  chemically synthesized
cgggcccctatgtccacttc

SEQ ID NO: 1383 - DNA, 20 bp, Artificial Sequence
  chemically synthesized
cccctatgtccacttcagga

SEQ ID NO: 1384 - DNA, 20 bp, Artificial Sequence
  chemically synthesized
gacagcatgtttgctgcctc

SEQ ID NO: 1385 - DNA, 20 bp, Artificial Sequence
  chemically synthesized
acagcatgtttgctgcctcc

SEQ ID NO: 1386 - DNA, 20 bp, Artificial Sequence
  chemically synthesized
cagcatgtttgctgcctcca

SEQ ID NO: 1387 - DNA, 20 bp, Artificial Sequence
  chemically synthesized
tccagggatcctgtgtcccc

SEQ ID NO: 1388 - DNA, 20 bp, Artificial Sequence
  chemically synthesized
gggatcctgtgtccccgagc

SEQ ID NO: 1389 - DNA, 20 bp, Artificial Sequence
  chemically synthesized
ggatcctgtgtccccgagct

SEQ ID NO: 1390 - DNA, 20 bp, Artificial Sequence
  chemically synthesized
ctgggaccaccttatattcc

SEQ ID NO: 1391 - DNA, 20 bp, Artificial Sequence
  chemically synthesized
tgggaccaccttatattccc

SEQ ID NO: 1392 - DNA, 20 bp, Artificial Sequence
  chemically synthesized
gggaccaccttatattccca

SEQ ID NO: 1393 - DNA, 20 bp, Artificial Sequence
  chemically synthesized
ccaccttatattcccagggc

SEQ ID NO: 1394 - DNA, 20 bp, Artificial Sequence
  chemically synthesized
attcccagggccggttaatg

SEQ ID NO: 1395 - DNA, 20 bp, Artificial Sequence
  chemically synthesized
agggccggttaatgtggctc

SEQ ID NO: 1396 - DNA, 20 bp, Artificial Sequence
  chemically synthesized
ggttaatgtggctctggttc

SEQ ID NO: 1397 - DNA, 20 bp, Artificial Sequence
  chemically synthesized
gttaatgtggctctggttct

SEQ ID NO: 1398 - DNA, 20 bp, Artificial Sequence
  chemically synthesized
tatctgtcccctccacccca

SEQ ID NO: 1399 - DNA, 20 bp, Artificial Sequence
  chemically synthesized
ctgtcccctccaccccacag

SEQ ID NO: 1400 - DNA, 20 bp, Artificial Sequence
  chemically synthesized
tgtcccctccaccccacagt

SEQ ID NO: 1401 - DNA, 20 bp, Artificial Sequence
  chemically synthesized
gtcccctccaccccacagtg

SEQ ID NO: 1402 - DNA, 20 bp, Artificial Sequence
  chemically synthesized
ccaccccacagtggggccac

SEQ ID NO: 1403 - DNA, 20 bp, Artificial Sequence
  chemically synthesized
caccccacagtggggccact

SEQ ID NO: 1404 - DNA, 20 bp, Artificial Sequence
  chemically synthesized
accccacagtggggccacta

SEQ ID NO: 1405 - DNA, 20 bp, Artificial Sequence
  chemically synthesized
cacagtggggccactaggga

SEQ ID NO: 1406 - DNA, 20 bp, Artificial Sequence
  chemically synthesized
acagtggggccactagggac

SEQ ID NO: 1407 - DNA, 20 bp, Artificial Sequence
  chemically synthesized
ggggccactagggacaggat

SEQ ID NO: 1408 - DNA, 20 bp, Artificial Sequence
  chemically synthesized
actagggacaggattggtga

SEQ ID NO: 1409 - DNA, 20 bp, Artificial Sequence
  chemically synthesized
ggacaggattggtgacagaa

SEQ ID NO: 1410 - DNA, 20 bp, Artificial Sequence
  chemically synthesized
tgacagaaaagccccatcct

SEQ ID NO: 1411 - DNA, 20 bp, Artificial Sequence
  chemically synthesized
gacagaaaagccccatcctt

SEQ ID NO: 1412 - DNA, 20 bp, Artificial Sequence
  chemically synthesized
tccttaggcctcctccttcc

SEQ ID NO: 1413 - DNA, 20 bp, Artificial Sequence
  chemically synthesized
ccttcctagtctcctgatat

SEQ ID NO: 1414 - DNA, 20 bp, Artificial Sequence
  chemically synthesized
cttcctagtctcctgatatt

SEQ ID NO: 1415 - DNA, 20 bp, Artificial Sequence
  chemically synthesized
gtctaacccccacctcctgt

SEQ ID NO: 1416 - DNA, 20 bp, Artificial Sequence
  chemically synthesized
tctaacccccacctcctgtt

SEQ ID NO: 1417 - DNA, 20 bp, Artificial Sequence
  chemically synthesized
aacccccacctcctgttagg

SEQ ID NO: 1418 - DNA, 20 bp, Artificial Sequence
  chemically synthesized
tgttaggcagattccttatc

SEQ ID NO: 1419 - DNA, 20 bp, Artificial Sequence
  chemically synthesized
ggtgacacacccccatttcc

SEQ ID NO: 1420 - DNA, 20 bp, Artificial Sequence
  chemically synthesized
tgacacacccccatttcctg

SEQ ID NO: 1421 - DNA, 20 bp, Artificial Sequence
  chemically synthesized
ggagccatctctctccttgc

SEQ ID NO: 1422 - DNA, 20 bp, Artificial Sequence
  chemically synthesized
ctctccttgccagaacctct

SEQ ID NO: 1423 - DNA, 20 bp, Artificial Sequence
  chemically synthesized
tctccttgccagaacctcta

SEQ ID NO: 1424 - DNA, 20 bp, Artificial Sequence
  chemically synthesized
cctctaaggtttgcttacga

SEQ ID NO: 1425 - DNA, 20 bp, Artificial Sequence
  chemically synthesized
tctaaggtttgcttacgatg

SEQ ID NO: 1426 - DNA, 20 bp, Artificial Sequence
  chemically synthesized
aggtttgcttacgatggagc

SEQ ID NO: 1427 - DNA, 20 bp, Artificial Sequence
  chemically synthesized
gtttgcttacgatggagcca

SEQ ID NO: 1428 - DNA, 20 bp, Artificial Sequence
  chemically synthesized
ttgcttacgatggagccaga

SEQ ID NO: 1429 - DNA, 20 bp, Artificial Sequence
  chemically synthesized
tgcttacgatggagccagag

SEQ ID NO: 1430 - DNA, 20 bp, Artificial Sequence
  chemically synthesized
gatggagccagagaggatcc

SEQ ID NO: 1431 - DNA, 20 bp, Artificial Sequence
  chemically synthesized
atggagccagagaggatcct

SEQ ID NO: 1432 - DNA, 20 bp, Artificial Sequence
  chemically synthesized
ggagccagagaggatcctgg

SEQ ID NO: 1433 - DNA, 20 bp, Artificial Sequence
  chemically synthesized
gagccagagaggatcctggg

SEQ ID NO: 1434 - DNA, 20 bp, Artificial Sequence
  chemically synthesized
agccagagaggatcctggga

SEQ ID NO: 1435 - DNA, 20 bp, Artificial Sequence
  chemically synthesized
ccagagaggatcctgggagg

SEQ ID NO: 1436 - DNA, 20 bp, Artificial Sequence
  chemically synthesized
agagaggatcctgggaggga

SEQ ID NO: 1437 - DNA, 20 bp, Artificial Sequence
  chemically synthesized
ggatcctgggagggagagct

SEQ ID NO: 1438 - DNA, 20 bp, Artificial Sequence
  chemically synthesized
tcctgggagggagagcttgg

SEQ ID NO: 1439 - DNA, 20 bp, Artificial Sequence
  chemically synthesized
cctgggagggagagcttggc

SEQ ID NO: 1440 - DNA, 20 bp, Artificial Sequence
  chemically synthesized
ctgggagggagagcttggca

SEQ ID NO: 1441 - DNA, 20 bp, Artificial Sequence
  chemically synthesized
tgggagggagagcttggcag

SEQ ID NO: 1442 - DNA, 20 bp, Artificial Sequence
  chemically synthesized
gggagggagagcttggcagg

SEQ ID NO: 1443 - DNA, 20 bp, Artificial Sequence
  chemically synthesized
agggagagcttggcaggggg

SEQ ID NO: 1444 - DNA, 20 bp, Artificial Sequence
  chemically synthesized
gggagagcttggcagggggt

SEQ ID NO: 1445 - DNA, 20 bp, Artificial Sequence
  chemically synthesized
gagagcttggcagggggtgg

SEQ ID NO: 1446 - DNA, 20 bp, Artificial Sequence
  chemically synthesized
agagcttggcagggggtggg

SEQ ID NO: 1447 - DNA, 20 bp, Artificial Sequence
  chemically synthesized
gagcttggcagggggtggga

SEQ ID NO: 1448 - DNA, 20 bp, Artificial Sequence
  chemically synthesized
cttggcagggggtgggaggg

SEQ ID NO: 1449 - DNA, 20 bp, Artificial Sequence
  chemically synthesized
ttggcagggggtgggaggga

SEQ ID NO: 1450 - DNA, 20 bp, Artificial Sequence
  chemically synthesized
tggcagggggtgggagggaa

SEQ ID NO: 1451 - DNA, 20 bp, Artificial Sequence
  chemically synthesized
ggcagggggtgggagggaag

SEQ ID NO: 1452 - DNA, 20 bp, Artificial Sequence
  chemically synthesized
gcagggggtgggagggaagg

SEQ ID NO: 1453 - DNA, 20 bp, Artificial Sequence
  chemically synthesized
cagggggtgggagggaaggg

SEQ ID NO: 1454 - DNA, 20 bp, Artificial Sequence
  chemically synthesized
agggggtgggagggaagggg

SEQ ID NO: 1455 - DNA, 20 bp, Artificial Sequence
  chemically synthesized
ggggggatgcgtgacctgcc

SEQ ID NO: 1456 - DNA, 20 bp, Artificial Sequence
  chemically synthesized
tgcgtgacctgcccggttct

SEQ ID NO: 1457 - DNA, 20 bp, Artificial Sequence
  chemically synthesized
gtgacctgcccggttctcag

SEQ ID NO: 1458 - DNA, 20 bp, Artificial Sequence
  chemically synthesized
caccctgcgctaccctctcc

SEQ ID NO: 1459 - DNA, 20 bp, Artificial Sequence
  chemically synthesized
gctaccctctcccagaacct

SEQ ID NO: 1460 - DNA, 20 bp, Artificial Sequence
  chemically synthesized
gaacctgagctgctctgacg

SEQ ID NO: 1461 - DNA, 20 bp, Artificial Sequence
  chemically synthesized
gctgctctgacgcggccgtc

SEQ ID NO: 1462 - DNA, 20 bp, Artificial Sequence
  chemically synthesized
ctggtgcgtttcactgatcc

SEQ ID NO: 1463 - DNA, 20 bp, Artificial Sequence
  chemically synthesized
tttcactgatcctggtgctg

SEQ ID NO: 1464 - DNA, 20 bp, Artificial Sequence
  chemically synthesized
gcagcttccttacacttccc

SEQ ID NO: 1465 - DNA, 20 bp, Artificial Sequence
  chemically synthesized
agcttccttacacttcccaa

SEQ ID NO: 1466 - DNA, 20 bp, Artificial Sequence
  chemically synthesized
gcttccttacacttcccaag

SEQ ID NO: 1467 - DNA, 20 bp, Artificial Sequence
  chemically synthesized
ttccttacacttcccaagag

SEQ ID NO: 1468 - DNA, 20 bp, Artificial Sequence
  chemically synthesized
cttacacttcccaagaggag

SEQ ID NO: 1469 - DNA, 20 bp, Artificial Sequence
  chemically synthesized
acacttcccaagaggagaag

SEQ ID NO: 1470 - DNA, 20 bp, Artificial Sequence
  chemically synthesized
tcccaagaggagaagcagtt

SEQ ID NO: 1471 - DNA, 20 bp, Artificial Sequence
  chemically synthesized
gcagtttggaaaaacaaaat

SEQ ID NO: 1472 - DNA, 20 bp, Artificial Sequence
  chemically synthesized
tggaaaaacaaaatcagaat

SEQ ID NO: 1473 - DNA, 20 bp, Artificial Sequence
  chemically synthesized
aaaacaaaatcagaataagt

SEQ ID NO: 1474 - DNA, 20 bp, Artificial Sequence
  chemically synthesized
aatcagaataagttggtcct

SEQ ID NO: 1475 - DNA, 20 bp, Artificial Sequence
  chemically synthesized
ttggtcctgagttctaactt

SEQ ID NO: 1476 - DNA, 20 bp, Artificial Sequence
  chemically synthesized
actttggctcttcacctttc

SEQ ID NO: 1477 - DNA, 20 bp, Artificial Sequence
  chemically synthesized
tatattgttcctccgtgcgt

SEQ ID NO: 1478 - DNA, 20 bp, Artificial Sequence
  chemically synthesized
cgtgcgtcagttttacctgt

SEQ ID NO: 1479 - DNA, 20 bp, Artificial Sequence
  chemically synthesized
gtcagttttacctgtgagat

SEQ ID NO: 1480 - DNA, 20 bp, Artificial Sequence
  chemically synthesized
tcagttttacctgtgagata

SEQ ID NO: 1481 - DNA, 20 bp, Artificial Sequence
  chemically synthesized
ttttacctgtgagataaggc

SEQ ID NO: 1482 - DNA, 20 bp, Artificial Sequence
  chemically synthesized
tacctgtgagataaggccag

SEQ ID NO: 1483 - DNA, 20 bp, Artificial Sequence
  chemically synthesized
tgtgagataaggccagtagc

SEQ ID NO: 1484 - DNA, 20 bp, Artificial Sequence
  chemically synthesized
gccagtagccagccccgtcc

SEQ ID NO: 1485 - DNA, 20 bp, Artificial Sequence
  chemically synthesized
agtagccagccccgtcctgg

SEQ ID NO: 1486 - DNA, 20 bp, Artificial Sequence
  chemically synthesized
gtagccagccccgtcctggc

SEQ ID NO: 1487 - DNA, 20 bp, Artificial Sequence
  chemically synthesized
tagccagccccgtcctggca

SEQ ID NO: 1488 - DNA, 20 bp, Artificial Sequence
  chemically synthesized
gccccgtcctggcagggctg

SEQ ID NO: 1489 - DNA, 20 bp, Artificial Sequence
  chemically synthesized
cgtcctggcagggctgtggt

SEQ ID NO: 1490 - DNA, 20 bp, Artificial Sequence
  chemically synthesized
gtcctggcagggctgtggtg

SEQ ID NO: 1491 - DNA, 20 bp, Artificial Sequence
  chemically synthesized
cctggcagggctgtggtgag

SEQ ID NO: 1492 - DNA, 20 bp, Artificial Sequence
  chemically synthesized
ctggcagggctgtggtgagg

SEQ ID NO: 1493 - DNA, 20 bp, Artificial Sequence
  chemically synthesized
tggcagggctgtggtgagga

SEQ ID NO: 1494 - DNA, 20 bp, Artificial Sequence
  chemically synthesized
ggcagggctgtggtgaggag

SEQ ID NO: 1495 - DNA, 20 bp, Artificial Sequence
  chemically synthesized
gcagggctgtggtgaggagg

SEQ ID NO: 1496 - DNA, 20 bp, Artificial Sequence
  chemically synthesized
cagggctgtggtgaggaggg

SEQ ID NO: 1497 - DNA, 20 bp, Artificial Sequence
  chemically synthesized
tgaggaggggggtgtccgtg

SEQ ID NO: 1498 - DNA, 20 bp, Artificial Sequence
  chemically synthesized
gtgtggaaaactccctttgt

SEQ ID NO: 1499 - DNA, 20 bp, Artificial Sequence
  chemically synthesized
gaaaactccctttgtgagaa

SEQ ID NO: 1500 - DNA, 20 bp, Artificial Sequence
  chemically synthesized
tttgtgagaatggtgcgtcc

SEQ ID NO: 1501 - DNA, 20 bp, Artificial Sequence
  chemically synthesized
ttgtgagaatggtgcgtcct

SEQ ID NO: 1502 - DNA, 20 bp, Artificial Sequence
  chemically synthesized
ggtgcgtcctaggtgttcac

SEQ ID NO: 1503 - DNA, 20 bp, Artificial Sequence
  chemically synthesized
gtgcgtcctaggtgttcacc

SEQ ID NO: 1504 - DNA, 20 bp, Artificial Sequence
  chemically synthesized
cctaggtgttcaccaggtcg

SEQ ID NO: 1505 - DNA, 20 bp, Artificial Sequence
  chemically synthesized
tctccatccttctttcctta

SEQ ID NO: 1506 - DNA, 20 bp, Artificial Sequence
  chemically synthesized
tccatccttctttccttaaa

SEQ ID NO: 1507 - DNA, 20 bp, Artificial Sequence
  chemically synthesized
ttctttccttaaagagtccc

SEQ ID NO: 1508 - DNA, 20 bp, Artificial Sequence
  chemically synthesized
aaagagtccccagtgctatc

SEQ ID NO: 1509 - DNA, 20 bp, Artificial Sequence
  chemically synthesized
aagagtccccagtgctatct

SEQ ID NO: 1510 - DNA, 20 bp, Artificial Sequence
  chemically synthesized
ctgggacatattcctccgcc

SEQ ID NO: 1511 - DNA, 20 bp, Artificial Sequence
  chemically synthesized
gggacatattcctccgccca

SEQ ID NO: 1512 - DNA, 20 bp, Artificial Sequence
  chemically synthesized
acatattcctccgcccagag

SEQ ID NO: 1513 - DNA, 20 bp, Artificial Sequence
  chemically synthesized
catattcctccgcccagagc

SEQ ID NO: 1514 - DNA, 20 bp, Artificial Sequence
  chemically synthesized
atattcctccgcccagagca

SEQ ID NO: 1515 - DNA, 20 bp, Artificial Sequence
  chemically synthesized
gagcagggtcccgcttccct

SEQ ID NO: 1516 - DNA, 20 bp, Artificial Sequence
  chemically synthesized
agcagggtcccgcttcccta

SEQ ID NO: 1517 - DNA, 20 bp, Artificial Sequence
  chemically synthesized
gcttccctaaggccctgctc

SEQ ID NO: 1518 - DNA, 20 bp, Artificial Sequence
  chemically synthesized
cttccctaaggccctgctct

SEQ ID NO: 1519 - DNA, 20 bp, Artificial Sequence
  chemically synthesized
aaggccctgctctgggcttc

SEQ ID NO: 1520 - DNA, 20 bp, Artificial Sequence
  chemically synthesized
aggccctgctctgggcttct

SEQ ID NO: 1521 - DNA, 20 bp, Artificial Sequence
  chemically synthesized
tgctctgggcttctgggttt

SEQ ID NO: 1522 - DNA, 20 bp, Artificial Sequence
  chemically synthesized
ggcttctgggtttgagtcct

SEQ ID NO: 1523 - DNA, 20 bp, Artificial Sequence
  chemically synthesized
tctgggtttgagtccttggc

SEQ ID NO: 1524 - DNA, 20 bp, Artificial Sequence
  chemically synthesized
gtttgagtccttggcaagcc

SEQ ID NO: 1525 - DNA, 20 bp, Artificial Sequence
  chemically synthesized
tttgagtccttggcaagccc

SEQ ID NO: 1526 - DNA, 20 bp, Artificial Sequence
  chemically synthesized
tgagtccttggcaagcccag

SEQ ID NO: 1527 - DNA, 20 bp, Artificial Sequence
  chemically synthesized
agtccttggcaagcccagga

SEQ ID NO: 1528 - DNA, 20 bp, Artificial Sequence
  chemically synthesized
gtccttggcaagcccaggag

SEQ ID NO: 1529 - DNA, 20 bp, Artificial Sequence
  chemically synthesized
gcaagcccaggagaggcgct

SEQ ID NO: 1530 - DNA, 20 bp, Artificial Sequence
  chemically synthesized
caagcccaggagaggcgctc

SEQ ID NO: 1531 - DNA, 20 bp, Artificial Sequence
  chemically synthesized
cgtccaccatctcatgcccc

SEQ ID NO: 1532 - DNA, 20 bp, Artificial Sequence
  chemically synthesized
gctctcctgccccttcccta

SEQ ID NO: 1533 - DNA, 20 bp, Artificial Sequence
  chemically synthesized
ctctcctgccccttccctac

SEQ ID NO: 1534 - DNA, 20 bp, Artificial Sequence
  chemically synthesized
tctcctgccccttccctaca

SEQ ID NO: 1535 - DNA, 20 bp, Artificial Sequence
  chemically synthesized
ctcctgccccttccctacag

SEQ ID NO: 1536 - DNA, 20 bp, Artificial Sequence
  chemically synthesized
cccttccctacaggggttcc

SEQ ID NO: 1537 - DNA, 20 bp, Artificial Sequence
  chemically synthesized
gggttcctggctctgctctt

SEQ ID NO: 1538 - DNA, 20 bp, Artificial Sequence
  chemically synthesized
ctggctctgctcttcagact

SEQ ID NO: 1539 - DNA, 20 bp, Artificial Sequence
  chemically synthesized
cccccttcccctgcatcccc

SEQ ID NO: 1540 - DNA, 20 bp, Artificial Sequence
  chemically synthesized
cccttcccctgcatccccca

SEQ ID NO: 1541 - DNA, 20 bp, Artificial Sequence
  chemically synthesized
ccttcccctgcatcccccag

SEQ ID NO: 1542 - DNA, 20 bp, Artificial Sequence
  chemically synthesized
cctgcatcccccagaggccc

SEQ ID NO: 1543 - DNA, 20 bp, Artificial Sequence
  chemically synthesized
ctgcatcccccagaggcccc

SEQ ID NO: 1544 - DNA, 20 bp, Artificial Sequence
  chemically synthesized
gaggccccaggccacctact

SEQ ID NO: 1545 - DNA, 20 bp, Artificial Sequence
  chemically synthesized
cccaggccacctacttggcc

SEQ ID NO: 1546 - DNA, 20 bp, Artificial Sequence
  chemically synthesized
ctacttggcctggaccccac

SEQ ID NO: 1547 - DNA, 20 bp, Artificial Sequence
  chemically synthesized
acttggcctggaccccacga

SEQ ID NO: 1548 - DNA, 20 bp, Artificial Sequence
  chemically synthesized
cttggcctggaccccacgag

SEQ ID NO: 1549 - DNA, 20 bp, Artificial Sequence
  chemically synthesized
gaccccacgagaggccaccc

SEQ ID NO: 1550 - DNA, 20 bp, Artificial Sequence
  chemically synthesized
gccaccccagccctgtctac

SEQ ID NO: 1551 - DNA, 20 bp, Artificial Sequence
  chemically synthesized
ccaccccagccctgtctacc

SEQ ID NO: 1552 - DNA, 20 bp, Artificial Sequence
  chemically synthesized
ctgtctaccaggctgccttt

SEQ ID NO: 1553 - DNA, 20 bp, Artificial Sequence
  chemically synthesized
tgtctaccaggctgcctttt

SEQ ID NO: 1554 - DNA, 20 bp, Artificial Sequence
  chemically synthesized
ctaccaggctgccttttggg

SEQ ID NO: 1555 - DNA, 20 bp, Artificial Sequence
  chemically synthesized
ggtggattctcctccaactg

SEQ ID NO: 1556 - DNA, 20 bp, Artificial Sequence
  chemically synthesized
gtggattctcctccaactgt

SEQ ID NO: 1557 - DNA, 20 bp, Artificial Sequence
  chemically synthesized
tggattctcctccaactgtg

SEQ ID NO: 1558 - DNA, 20 bp, Artificial Sequence
  chemically synthesized
ccaactgtggggtgactgct

SEQ ID NO: 1559 - DNA, 20 bp, Artificial Sequence
  chemically synthesized
tgcttggcaaactcactctt

SEQ ID NO: 1560 - DNA, 20 bp, Artificial Sequence
  chemically synthesized
gcttggcaaactcactcttc

SEQ ID NO: 1561 - DNA, 20 bp, Artificial Sequence
  chemically synthesized
cttggcaaactcactcttcg

SEQ ID NO: 1562 - DNA, 20 bp, Artificial Sequence
  chemically synthesized
actcactcttcggggtatcc

SEQ ID NO: 1563 - DNA, 20 bp, Artificial Sequence
  chemically synthesized
ctcactcttcggggtatccc

SEQ ID NO: 1564 - DNA, 20 bp, Artificial Sequence
  chemically synthesized
cactcttcggggtatcccag

SEQ ID NO: 1565 - DNA, 20 bp, Artificial Sequence
  chemically synthesized
actcttcggggtatcccagg

SEQ ID NO: 1566 - DNA, 20 bp, Artificial Sequence
  chemically synthesized
tcggggtatcccaggaggcc

SEQ ID NO: 1567 - DNA, 20 bp, Artificial Sequence
  chemically synthesized
ggggtatcccaggaggcctg

SEQ ID NO: 1568 - DNA, 20 bp, Artificial Sequence
  chemically synthesized
tcccaggaggcctggagcat

SEQ ID NO: 1569 - DNA, 20 bp, Artificial Sequence
  chemically synthesized
cccaggaggcctggagcatt

SEQ ID NO: 1570 - DNA, 20 bp, Artificial Sequence
  chemically synthesized
ccaggaggcctggagcattg

SEQ ID NO: 1571 - DNA, 20 bp, Artificial Sequence
  chemically synthesized
ggaggcctggagcattgggg

SEQ ID NO: 1572 - DNA, 20 bp, Artificial Sequence
  chemically synthesized
gaggcctggagcattggggt

SEQ ID NO: 1573 - DNA, 20 bp, Artificial Sequence
  chemically synthesized
cctggagcattggggtgggc

SEQ ID NO: 1574 - DNA, 20 bp, Artificial Sequence
  chemically synthesized
ctggagcattggggtgggct

SEQ ID NO: 1575 - DNA, 20 bp, Artificial Sequence
  chemically synthesized
tggagcattggggtgggctg

SEQ ID NO: 1576 - DNA, 20 bp, Artificial Sequence
  chemically synthesized
cattggggtgggctggggtt

SEQ ID NO: 1577 - DNA, 20 bp, Artificial Sequence
  chemically synthesized
ttggggtgggctggggttca

SEQ ID NO: 1578 - DNA, 20 bp, Artificial Sequence
  chemically synthesized
ggggtgggctggggttcaga

SEQ ID NO: 1579 - DNA, 20 bp, Artificial Sequence
  chemically synthesized
gggtgggctggggttcagag

SEQ ID NO: 1580 - DNA, 20 bp, Artificial Sequence
  chemically synthesized
gtgggctggggttcagagag

SEQ ID NO: 1581 - DNA, 20 bp, Artificial Sequence
  chemically synthesized
tgggctggggttcagagagg

SEQ ID NO: 1582 - DNA, 20 bp, Artificial Sequence
  chemically synthesized
gggctggggttcagagagga

SEQ ID NO: 1583 - DNA, 20 bp, Artificial Sequence
  chemically synthesized
gagaggagggattcccttct

SEQ ID NO: 1584 - DNA, 20 bp, Artificial Sequence
  chemically synthesized
agaggagggattcccttctc

SEQ ID NO: 1585 - DNA, 20 bp, Artificial Sequence
  chemically synthesized
gattcccttctcaggttacg

SEQ ID NO: 1586 - DNA, 20 bp, Artificial Sequence
  chemically synthesized
ccttctcaggttacgtggcc

SEQ ID NO: 1587 - DNA, 20 bp, Artificial Sequence
  chemically synthesized
tctcaggttacgtggccaag

SEQ ID NO: 1588 - DNA, 20 bp, Artificial Sequence
  chemically synthesized
caggttacgtggccaagaag

SEQ ID NO: 1589 - DNA, 20 bp, Artificial Sequence
  chemically synthesized
aggttacgtggccaagaagc

SEQ ID NO: 1590 - DNA, 20 bp, Artificial Sequence
  chemically synthesized
ggttacgtggccaagaagca

SEQ ID NO: 1591 - DNA, 20 bp, Artificial Sequence
  chemically synthesized
gttacgtggccaagaagcag

SEQ ID NO: 1592 - DNA, 20 bp, Artificial Sequence
  chemically synthesized
tacgtggccaagaagcaggg

SEQ ID NO: 1593 - DNA, 20 bp, Artificial Sequence
  chemically synthesized
tggccaagaagcaggggagc

SEQ ID NO: 1594 - DNA, 20 bp, Artificial Sequence
  chemically synthesized
ggccaagaagcaggggagct

SEQ ID NO: 1595 - DNA, 20 bp, Artificial Sequence
  chemically synthesized
agaagcaggggagctgggtt

SEQ ID NO: 1596 - DNA, 20 bp, Artificial Sequence
  chemically synthesized
gaagcaggggagctgggttt

SEQ ID NO: 1597 - DNA, 20 bp, Artificial Sequence
  chemically synthesized
caggggagctgggtttgggt

SEQ ID NO: 1598 - DNA, 20 bp, Artificial Sequence
  chemically synthesized
aggggagctgggtttgggtc

SEQ ID NO: 1599 - DNA, 20 bp, Artificial Sequence
  chemically synthesized
agctgggtttgggtcaggtc

SEQ ID NO: 1600 - DNA, 20 bp, Artificial Sequence
  chemically synthesized
gctgggtttgggtcaggtct

SEQ ID NO: 1601 - DNA, 20 bp, Artificial Sequence
  chemically synthesized
gtttgggtcaggtctgggtg

SEQ ID NO: 1602 - DNA, 20 bp, Artificial Sequence
  chemically synthesized
tttgggtcaggtctgggtgt

SEQ ID NO: 1603 - DNA, 20 bp, Artificial Sequence
  chemically synthesized
ttgggtcaggtctgggtgtg

SEQ ID NO: 1604 - DNA, 20 bp, Artificial Sequence
  chemically synthesized
aggtctgggtgtggggtgac

SEQ ID NO: 1605 - DNA, 20 bp, Artificial Sequence
  chemically synthesized
accagcttatgctgtttgcc

SEQ ID NO: 1606 - DNA, 20 bp, Artificial Sequence
  chemically synthesized
ccagcttatgctgtttgccc

SEQ ID NO: 1607 - DNA, 20 bp, Artificial Sequence
  chemically synthesized
cttatgctgtttgcccagga

SEQ ID NO: 1608 - DNA, 20 bp, Artificial Sequence
  chemically synthesized
gctgtttgcccaggacagcc

SEQ ID NO: 1609 - DNA, 20 bp, Artificial Sequence
  chemically synthesized
tgcccaggacagcctagttt

SEQ ID NO: 1610 - DNA, 20 bp, Artificial Sequence
  chemically synthesized
agttttagcactgaaaccct

SEQ ID NO: 1611 - DNA, 20 bp, Artificial Sequence
  chemically synthesized
agcactgaaaccctcagtcc

SEQ ID NO: 1612 - DNA, 20 bp, Artificial Sequence
  chemically synthesized
gcactgaaaccctcagtcct

SEQ ID NO: 1613 - DNA, 20 bp, Artificial Sequence
  chemically synthesized
aaccctcagtcctaggaaaa

SEQ ID NO: 1614 - DNA, 20 bp, Artificial Sequence
  chemically synthesized
accctcagtcctaggaaaac

SEQ ID NO: 1615 - DNA, 20 bp, Artificial Sequence
  chemically synthesized
ccctcagtcctaggaaaaca

SEQ ID NO: 1616 - DNA, 20 bp, Artificial Sequence
  chemically synthesized
cagtcctaggaaaacaggga

SEQ ID NO: 1617 - DNA, 20 bp, Artificial Sequence
  chemically synthesized
cctaggaaaacagggatggt

SEQ ID NO: 1618 - DNA, 20 bp, Artificial Sequence
  chemically synthesized
ggatggttggtcactgtctc

SEQ ID NO: 1619 - DNA, 20 bp, Artificial Sequence
  chemically synthesized
gatggttggtcactgtctct

SEQ ID NO: 1620 - DNA, 20 bp, Artificial Sequence
  chemically synthesized
tctgggtgactcttgattcc

SEQ ID NO: 1621 - DNA, 20 bp, Artificial Sequence
  chemically synthesized
ggtgactcttgattcccggc

SEQ ID NO: 1622 - DNA, 20 bp, Artificial Sequence
  chemically synthesized
tcccggccagtttctccacc

SEQ ID NO: 1623 - DNA, 20 bp, Artificial Sequence
  chemically synthesized
cccggccagtttctccacct

SEQ ID NO: 1624 - DNA, 20 bp, Artificial Sequence
  chemically synthesized
ccggccagtttctccacctg

SEQ ID NO: 1625 - DNA, 20 bp, Artificial Sequence
  chemically synthesized
tctcgtcctgcatccttctc

SEQ ID NO: 1626 - DNA, 20 bp, Artificial Sequence
  chemically synthesized
ctcgtcctgcatccttctcc

SEQ ID NO: 1627 - DNA, 20 bp, Artificial Sequence
  chemically synthesized
gtcctgcatccttctccagg

SEQ ID NO: 1628 - DNA, 20 bp, Artificial Sequence
  chemically synthesized
tcctgcatccttctccaggc

SEQ ID NO: 1629 - DNA, 20 bp, Artificial Sequence
  chemically synthesized
ccttctccaggcaggtcccc

SEQ ID NO: 1630 - DNA, 20 bp, Artificial Sequence
  chemically synthesized
caagcatcgcccccctgctg

SEQ ID NO: 1631 - DNA, 20 bp, Artificial Sequence
  chemically synthesized
cccctgctgtggctgttccc

SEQ ID NO: 1632 - DNA, 20 bp, Artificial Sequence
  chemically synthesized
tgtggctgttcccaagttct

SEQ ID NO: 1633 - DNA, 20 bp, Artificial Sequence
  chemically synthesized
gtggctgttcccaagttctt

SEQ ID NO: 1634 - DNA, 20 bp, Artificial Sequence
  chemically synthesized
tggctgttcccaagttctta

SEQ ID NO: 1635 - DNA, 20 bp, Artificial Sequence
  chemically synthesized
agttcttagggtaccccacg

SEQ ID NO: 1636 - DNA, 20 bp, Artificial Sequence
  chemically synthesized
gttcttagggtaccccacgt

SEQ ID NO: 1637 - DNA, 20 bp, Artificial Sequence
  chemically synthesized
acgtgggtttatcaaccact

SEQ ID NO: 1638 - DNA, 20 bp, Artificial Sequence
  chemically synthesized
gggtttatcaaccacttggt

SEQ ID NO: 1639 - DNA, 20 bp, Artificial Sequence
  chemically synthesized
ggtttatcaaccacttggtg

SEQ ID NO: 1640 - DNA, 20 bp, Artificial Sequence
  chemically synthesized
tatcaaccacttggtgaggc

SEQ ID NO: 1641 - DNA, 20 bp, Artificial Sequence
  chemically synthesized
ttcctgcaccccaattgcct

SEQ ID NO: 1642 - DNA, 20 bp, Artificial Sequence
  chemically synthesized
ctgcaccccaattgccttag

SEQ ID NO: 1643 - DNA, 20 bp, Artificial Sequence
  chemically synthesized
accccaattgccttagtggc

SEQ ID NO: 1644 - DNA, 20 bp, Artificial Sequence
  chemically synthesized
ccccaattgccttagtggct

SEQ ID NO: 1645 - DNA, 20 bp, Artificial Sequence
  chemically synthesized
cccaattgccttagtggcta

SEQ ID NO: 1646 - DNA, 20 bp, Artificial Sequence
  chemically synthesized
ccaattgccttagtggctag

SEQ ID NO: 1647 - DNA, 20 bp, Artificial Sequence
  chemically synthesized
caattgccttagtggctagg

SEQ ID NO: 1648 - DNA, 20 bp, Artificial Sequence
  chemically synthesized
tgccttagtggctagggggt

SEQ ID NO: 1649 - DNA, 20 bp, Artificial Sequence
  chemically synthesized
gccttagtggctagggggtt

SEQ ID NO: 1650 - DNA, 20 bp, Artificial Sequence
  chemically synthesized
ccttagtggctagggggttg

SEQ ID NO: 1651 - DNA, 20 bp, Artificial Sequence
  chemically synthesized
cttagtggctagggggttgg

SEQ ID NO: 1652 - DNA, 20 bp, Artificial Sequence
  chemically synthesized
gtggctagggggttgggggc

SEQ ID NO: 1653 - DNA, 20 bp, Artificial Sequence
  chemically synthesized
ggctagggggttgggggcta

SEQ ID NO: 1654 - DNA, 20 bp, Artificial Sequence
  chemically synthesized
tagggggttgggggctagag

SEQ ID NO: 1655 - DNA, 20 bp, Artificial Sequence
  chemically synthesized
agggggttgggggctagagt

SEQ ID NO: 1656 - DNA, 20 bp, Artificial Sequence
  chemically synthesized
ggggttgggggctagagtag

SEQ ID NO: 1657 - DNA, 20 bp, Artificial Sequence
  chemically synthesized
gggttgggggctagagtagg

SEQ ID NO: 1658 - DNA, 20 bp, Artificial Sequence
  chemically synthesized
ggttgggggctagagtagga

SEQ ID NO: 1659 - DNA, 20 bp, Artificial Sequence
  chemically synthesized
gttgggggctagagtaggag

SEQ ID NO: 1660 - DNA, 20 bp, Artificial Sequence
  chemically synthesized
ggggctagagtaggaggggc

SEQ ID NO: 1661 - DNA, 20 bp, Artificial Sequence
  chemically synthesized
ggctagagtaggaggggctg

SEQ ID NO: 1662 - DNA, 20 bp, Artificial Sequence
  chemically synthesized
agagtaggaggggctggagc

SEQ ID NO: 1663 - DNA, 20 bp, Artificial Sequence
  chemically synthesized
gagtaggaggggctggagcc

SEQ ID NO: 1664 - DNA, 20 bp, Artificial Sequence
  chemically synthesized
ggggctggagccaggattct

SEQ ID NO: 1665 - DNA, 20 bp, Artificial Sequence
  chemically synthesized
gggctggagccaggattctt

SEQ ID NO: 1666 - DNA, 20 bp, Artificial Sequence
  chemically synthesized
ggctggagccaggattctta

SEQ ID NO: 1667 - DNA, 20 bp, Artificial Sequence
  chemically synthesized
ccaggattcttagggctgaa

SEQ ID NO: 1668 - DNA, 20 bp, Artificial Sequence
  chemically synthesized
aggattcttagggctgaaca

SEQ ID NO: 1669 - DNA, 20 bp, Artificial Sequence
  chemically synthesized
attcttagggctgaacagag

SEQ ID NO: 1670 - DNA, 20 bp, Artificial Sequence
  chemically synthesized
tcttagggctgaacagagaa

SEQ ID NO: 1671 - DNA, 20 bp, Artificial Sequence
  chemically synthesized
agggctgaacagagaagagc

SEQ ID NO: 1672 - DNA, 20 bp, Artificial Sequence
  chemically synthesized
gggctgaacagagaagagct

SEQ ID NO: 1673 - DNA, 20 bp, Artificial Sequence
  chemically synthesized
ggctgaacagagaagagctg

SEQ ID NO: 1674 - DNA, 20 bp, Artificial Sequence
  chemically synthesized
gctgaacagagaagagctgg

SEQ ID NO: 1675 - DNA, 20 bp, Artificial Sequence
  chemically synthesized
acagagaagagctgggggcc

SEQ ID NO: 1676 - DNA, 20 bp, Artificial Sequence
  chemically synthesized
cagagaagagctgggggcct

SEQ ID NO: 1677 - DNA, 20 bp, Artificial Sequence
  chemically synthesized
gagctgggggcctgggctcc

SEQ ID NO: 1678 - DNA, 20 bp, Artificial Sequence
  chemically synthesized
agctgggggcctgggctcct

SEQ ID NO: 1679 - DNA, 20 bp, Artificial Sequence
  chemically synthesized
gggcctgggctcctgggttt

SEQ ID NO: 1680 - DNA, 20 bp, Artificial Sequence
  chemically synthesized
gcctgggctcctgggtttga

SEQ ID NO: 1681 - DNA, 20 bp, Artificial Sequence
  chemically synthesized
ctgggctcctgggtttgaga

SEQ ID NO: 1682 - DNA, 20 bp, Artificial Sequence
  chemically synthesized
tgggctcctgggtttgagag

SEQ ID NO: 1683 - DNA, 20 bp, Artificial Sequence
  chemically synthesized
ggctcctgggtttgagagag

SEQ ID NO: 1684 - DNA, 20 bp, Artificial Sequence
  chemically synthesized
gctcctgggtttgagagagg

SEQ ID NO: 1685 - DNA, 20 bp, Artificial Sequence
  chemically synthesized
ctcctgggtttgagagagga

SEQ ID NO: 1686 - DNA, 20 bp, Artificial Sequence
  chemically synthesized
tcctgggtttgagagaggag

SEQ ID NO: 1687 - DNA, 20 bp, Artificial Sequence
  chemically synthesized
gggtttgagagaggaggggc

SEQ ID NO: 1688 - DNA, 20 bp, Artificial Sequence
  chemically synthesized
ggtttgagagaggaggggct

SEQ ID NO: 1689 - DNA, 20 bp, Artificial Sequence
  chemically synthesized
gtttgagagaggaggggctg

SEQ ID NO: 1690 - DNA, 20 bp, Artificial Sequence
  chemically synthesized
agagaggaggggctggggcc

SEQ ID NO: 1691 - DNA, 20 bp, Artificial Sequence
  chemically synthesized
ggggctggggcctggactcc

SEQ ID NO: 1692 - DNA, 20 bp, Artificial Sequence
  chemically synthesized
gggctggggcctggactcct

SEQ ID NO: 1693 - DNA, 20 bp, Artificial Sequence
  chemically synthesized
gggcctggactcctgggtcc

SEQ ID NO: 1694 - DNA, 20 bp, Artificial Sequence
  chemically synthesized
ggcctggactcctgggtccg

SEQ ID NO: 1695 - DNA, 20 bp, Artificial Sequence
  chemically synthesized
gcctggactcctgggtccga

SEQ ID NO: 1696 - DNA, 20 bp, Artificial Sequence
  chemically synthesized
ctggactcctgggtccgagg

SEQ ID NO: 1697 - DNA, 20 bp, Artificial Sequence
  chemically synthesized
tggactcctgggtccgaggg

SEQ ID NO: 1698 - DNA, 20 bp, Artificial Sequence
  chemically synthesized
gactcctgggtccgagggag

SEQ ID NO: 1699 - DNA, 20 bp, Artificial Sequence
  chemically synthesized
actcctgggtccgagggagg

SEQ ID NO: 1700 - DNA, 20 bp, Artificial Sequence
  chemically synthesized
ctcctgggtccgagggagga

SEQ ID NO: 1701 - DNA, 20 bp, Artificial Sequence
  chemically synthesized
tcctgggtccgagggaggag

SEQ ID NO: 1702 - DNA, 20 bp, Artificial Sequence
  chemically synthesized
gggtccgagggaggaggggc

SEQ ID NO: 1703 - DNA, 20 bp, Artificial Sequence
  chemically synthesized
ggtccgagggaggaggggct

SEQ ID NO: 1704 - DNA, 20 bp, Artificial Sequence
  chemically synthesized
gtccgagggaggaggggctg

SEQ ID NO: 1705 - DNA, 20 bp, Artificial Sequence
  chemically synthesized
agggaggaggggctggggcc

SEQ ID NO: 1706 - DNA, 20 bp, Artificial Sequence
  chemically synthesized
ggggctggggcctggactcc

SEQ ID NO: 1707 - DNA, 20 bp, Artificial Sequence
  chemically synthesized
gggctggggcctggactcct

SEQ ID NO: 1708 - DNA, 20 bp, Artificial Sequence
  chemically synthesized
gggcctggactcctgggtct

SEQ ID NO: 1709 - DNA, 20 bp, Artificial Sequence
  chemically synthesized
ggcctggactcctgggtctg

SEQ ID NO: 1710 - DNA, 20 bp, Artificial Sequence
  chemically synthesized
gcctggactcctgggtctga

SEQ ID NO: 1711 - DNA, 20 bp, Artificial Sequence
  chemically synthesized
tggactcctgggtctgaggg

SEQ ID NO: 1712 - DNA, 20 bp, Artificial Sequence
  chemically synthesized
gactcctgggtctgagggtg

SEQ ID NO: 1713 - DNA, 20 bp, Artificial Sequence
  chemically synthesized
actcctgggtctgagggtgg

SEQ ID NO: 1714 - DNA, 20 bp, Artificial Sequence
  chemically synthesized
ctcctgggtctgagggtgga

SEQ ID NO: 1715 - DNA, 20 bp, Artificial Sequence
  chemically synthesized
gggtctgagggtggagggac

SEQ ID NO: 1716 - DNA, 20 bp, Artificial Sequence
  chemically synthesized
ggtctgagggtggagggact

SEQ ID NO: 1717 - DNA, 20 bp, Artificial Sequence
  chemically synthesized
gtctgagggtggagggactg

SEQ ID NO: 1718 - DNA, 20 bp, Artificial Sequence
  chemically synthesized
tctgagggtggagggactgg

SEQ ID NO: 1719 - DNA, 20 bp, Artificial Sequence
  chemically synthesized
gggtggagggactgggggcc

SEQ ID NO: 1720 - DNA, 20 bp, Artificial Sequence
  chemically synthesized
ggactgggggcctggactcc

SEQ ID NO: 1721 - DNA, 20 bp, Artificial Sequence
  chemically synthesized
gactgggggcctggactcct

SEQ ID NO: 1722 - DNA, 20 bp, Artificial Sequence
  chemically synthesized
gggcctggactcctgggtcc

SEQ ID NO: 1723 - DNA, 20 bp, Artificial Sequence
  chemically synthesized
ggcctggactcctgggtccg

SEQ ID NO: 1724 - DNA, 20 bp, Artificial Sequence
  chemically synthesized
gcctggactcctgggtccga

SEQ ID NO: 1725 - DNA, 20 bp, Artificial Sequence
  chemically synthesized
ctggactcctgggtccgagg

SEQ ID NO: 1726 - DNA, 20 bp, Artificial Sequence
  chemically synthesized
tggactcctgggtccgaggg

SEQ ID NO: 1727 - DNA, 20 bp, Artificial Sequence
  chemically synthesized
gactcctgggtccgagggag

SEQ ID NO: 1728 - DNA, 20 bp, Artificial Sequence
  chemically synthesized
actcctgggtccgagggagg

SEQ ID NO: 1729 - DNA, 20 bp, Artificial Sequence
  chemically synthesized
ctcctgggtccgagggagga

SEQ ID NO: 1730 - DNA, 20 bp, Artificial Sequence
  chemically synthesized
tcctgggtccgagggaggag

SEQ ID NO: 1731 - DNA, 20 bp, Artificial Sequence
  chemically synthesized
gggtccgagggaggaggggc

SEQ ID NO: 1732 - DNA, 20 bp, Artificial Sequence
  chemically synthesized
ggtccgagggaggaggggct

SEQ ID NO: 1733 - DNA, 20 bp, Artificial Sequence
  chemically synthesized
gtccgagggaggaggggctg

SEQ ID NO: 1734 - DNA, 20 bp, Artificial Sequence
  chemically synthesized
agggaggaggggctggggcc

SEQ ID NO: 1735 - DNA, 20 bp, Artificial Sequence
  chemically synthesized
ggggctggggcctggactcg

SEQ ID NO: 1736 - DNA, 20 bp, Artificial Sequence
  chemically synthesized
gggctggggcctggactcgt

SEQ ID NO: 1737 - DNA, 20 bp, Artificial Sequence
  chemically synthesized
gggcctggactcgtgggtct

SEQ ID NO: 1738 - DNA, 20 bp, Artificial Sequence
  chemically synthesized
ggcctggactcgtgggtctg

SEQ ID NO: 1739 - DNA, 20 bp, Artificial Sequence
  chemically synthesized
gcctggactcgtgggtctga

SEQ ID NO: 1740 - DNA, 20 bp, Artificial Sequence
  chemically synthesized
ctggactcgtgggtctgagg

SEQ ID NO: 1741 - DNA, 20 bp, Artificial Sequence
  chemically synthesized
tggactcgtgggtctgaggg

SEQ ID NO: 1742 - DNA, 20 bp, Artificial Sequence
  chemically synthesized
gactcgtgggtctgagggag

SEQ ID NO: 1743 - DNA, 20 bp, Artificial Sequence
  chemically synthesized
actcgtgggtctgagggagg

SEQ ID NO: 1744 - DNA, 20 bp, Artificial Sequence
  chemically synthesized
ctcgtgggtctgagggagga

SEQ ID NO: 1745 - DNA, 20 bp, Artificial Sequence
  chemically synthesized
tcgtgggtctgagggaggag

SEQ ID NO: 1746 - DNA, 20 bp, Artificial Sequence
  chemically synthesized
gggtctgagggaggaggggc

SEQ ID NO: 1747 - DNA, 20 bp, Artificial Sequence
  chemically synthesized
ggtctgagggaggaggggct

SEQ ID NO: 1748 - DNA, 20 bp, Artificial Sequence
  chemically synthesized
gtctgagggaggaggggctg

SEQ ID NO: 1749 - DNA, 20 bp, Artificial Sequence
  chemically synthesized
tctgagggaggaggggctgg

SEQ ID NO: 1750 - DNA, 20 bp, Artificial Sequence
  chemically synthesized
gggaggaggggctgggggcc

SEQ ID NO: 1751 - DNA, 20 bp, Artificial Sequence
  chemically synthesized
gggctgggggcctggacttc

SEQ ID NO: 1752 - DNA, 20 bp, Artificial Sequence
  chemically synthesized
ggctgggggcctggacttct

SEQ ID NO: 1753 - DNA, 20 bp, Artificial Sequence
  chemically synthesized
gggcctggacttctgggtct

SEQ ID NO: 1754 - DNA, 20 bp, Artificial Sequence
  chemically synthesized
ggcctggacttctgggtctt

SEQ ID NO: 1755 - DNA, 20 bp, Artificial Sequence
  chemically synthesized
gcctggacttctgggtctta

SEQ ID NO: 1756 - DNA, 20 bp, Artificial Sequence
  chemically synthesized
ctggacttctgggtcttagg

SEQ ID NO: 1757 - DNA, 20 bp, Artificial Sequence
  chemically synthesized
tggacttctgggtcttaggg

SEQ ID NO: 1758 - DNA, 20 bp, Artificial Sequence
  chemically synthesized
acttctgggtcttagggagg

SEQ ID NO: 1759 - DNA, 20 bp, Artificial Sequence
  chemically synthesized
cttctgggtcttagggaggc

SEQ ID NO: 1760 - DNA, 20 bp, Artificial Sequence
  chemically synthesized
ttctgggtcttagggaggcg

SEQ ID NO: 1761 - DNA, 20 bp, Artificial Sequence
  chemically synthesized
gggtcttagggaggcggggc

SEQ ID NO: 1762 - DNA, 20 bp, Artificial Sequence
  chemically synthesized
ggtcttagggaggcggggct

SEQ ID NO: 1763 - DNA, 20 bp, Artificial Sequence
  chemically synthesized
tagggaggcggggctgggcc

SEQ ID NO: 1764 - DNA, 20 bp, Artificial Sequence
  chemically synthesized
cggggctgggcctggacccc

SEQ ID NO: 1765 - DNA, 20 bp, Artificial Sequence
  chemically synthesized
ggggctgggcctggacccct

SEQ ID NO: 1766 - DNA, 20 bp, Artificial Sequence
  chemically synthesized
cctggacccctgggtctgaa

SEQ ID NO: 1767 - DNA, 20 bp, Artificial Sequence
  chemically synthesized
ctggacccctgggtctgaat

SEQ ID NO: 1768 - DNA, 20 bp, Artificial Sequence
  chemically synthesized
tggacccctgggtctgaatg

SEQ ID NO: 1769 - DNA, 20 bp, Artificial Sequence
  chemically synthesized
gacccctgggtctgaatggg

SEQ ID NO: 1770 - DNA, 20 bp, Artificial Sequence
  chemically synthesized
cccctgggtctgaatgggga

SEQ ID NO: 1771 - DNA, 20 bp, Artificial Sequence
  chemically synthesized
ccctgggtctgaatggggag

SEQ ID NO: 1772 - DNA, 20 bp, Artificial Sequence
  chemically synthesized
gggtctgaatggggagaggc

SEQ ID NO: 1773 - DNA, 20 bp, Artificial Sequence
  chemically synthesized
ggtctgaatggggagaggct

SEQ ID NO: 1774 - DNA, 20 bp, Artificial Sequence
  chemically synthesized
gtctgaatggggagaggctg

SEQ ID NO: 1775 - DNA, 20 bp, Artificial Sequence
  chemically synthesized
tctgaatggggagaggctgg

SEQ ID NO: 1776 - DNA, 20 bp, Artificial Sequence
  chemically synthesized
atggggagaggctgggggcc

SEQ ID NO: 1777 - DNA, 20 bp, Artificial Sequence
  chemically synthesized
gggcctggactccttcatct

SEQ ID NO: 1778 - DNA, 20 bp, Artificial Sequence
  chemically synthesized
ggcctggactccttcatctg

SEQ ID NO: 1779 - DNA, 20 bp, Artificial Sequence
  chemically synthesized
gcctggactccttcatctga

SEQ ID NO: 1780 - DNA, 20 bp, Artificial Sequence
  chemically synthesized
tggactccttcatctgaggg

SEQ ID NO: 1781 - DNA, 20 bp, Artificial Sequence
  chemically synthesized
actccttcatctgagggcgg

SEQ ID NO: 1782 - DNA, 20 bp, Artificial Sequence
  chemically synthesized
ctccttcatctgagggcgga

SEQ ID NO: 1783 - DNA, 20 bp, Artificial Sequence
  chemically synthesized
tccttcatctgagggcggaa

SEQ ID NO: 1784 - DNA, 20 bp, Artificial Sequence
  chemically synthesized
tcatctgagggcggaagggc

SEQ ID NO: 1785 - DNA, 20 bp, Artificial Sequence
  chemically synthesized
catctgagggcggaagggct

SEQ ID NO: 1786 - DNA, 20 bp, Artificial Sequence
  chemically synthesized
atctgagggcggaagggctg

SEQ ID NO: 1787 - DNA, 20 bp, Artificial Sequence
  chemically synthesized
agggcggaagggctggggcc

SEQ ID NO: 1788 - DNA, 20 bp, Artificial Sequence
  chemically synthesized
agggctggggcctggcctcc

SEQ ID NO: 1789 - DNA, 20 bp, Artificial Sequence
  chemically synthesized
gggctggggcctggcctcct

SEQ ID NO: 1790 - DNA, 20 bp, Artificial Sequence
  chemically synthesized
gcctggcctcctgggttgaa

SEQ ID NO: 1791 - DNA, 20 bp, Artificial Sequence
  chemically synthesized
cctggcctcctgggttgaat

SEQ ID NO: 1792 - DNA, 20 bp, Artificial Sequence
  chemically synthesized
ctggcctcctgggttgaatg

SEQ ID NO: 1793 - DNA, 20 bp, Artificial Sequence
  chemically synthesized
ggcctcctgggttgaatggg

SEQ ID NO: 1794 - DNA, 20 bp, Artificial Sequence
  chemically synthesized
gcctcctgggttgaatgggg

SEQ ID NO: 1795 - DNA, 20 bp, Artificial Sequence
  chemically synthesized
cctcctgggttgaatgggga

SEQ ID NO: 1796 - DNA, 20 bp, Artificial Sequence
  chemically synthesized
ctcctgggttgaatggggag

SEQ ID NO: 1797 - DNA, 20 bp, Artificial Sequence
  chemically synthesized
tgggttgaatggggaggggt

SEQ ID NO: 1798 - DNA, 20 bp, Artificial Sequence
  chemically synthesized
gggttgaatggggaggggtt

SEQ ID NO: 1799 - DNA, 20 bp, Artificial Sequence
  chemically synthesized
gaatggggaggggttgggcc

SEQ ID NO: 1800 - DNA, 20 bp, Artificial Sequence
  chemically synthesized
gaggggttgggcctggactc

SEQ ID NO: 1801 - DNA, 20 bp, Artificial Sequence
  chemically synthesized
ggggttgggcctggactctg

SEQ ID NO: 1802 - DNA, 20 bp, Artificial Sequence
  chemically synthesized
ggcctggactctggagtccc

SEQ ID NO: 1803 - DNA, 20 bp, Artificial Sequence
  chemically synthesized
actctggagtccctggtgcc

SEQ ID NO: 1804 - DNA, 20 bp, Artificial Sequence
  chemically synthesized
ctctggagtccctggtgccc

SEQ ID NO: 1805 - DNA, 20 bp, Artificial Sequence
  chemically synthesized
agtccctggtgcccaggcct

SEQ ID NO: 1806 - DNA, 20 bp, Artificial Sequence
  chemically synthesized
gtccctggtgcccaggcctc

SEQ ID NO: 1807 - DNA, 20 bp, Artificial Sequence
  chemically synthesized
caggcctcaggcatctttca

SEQ ID NO: 1808 - DNA, 20 bp, Artificial Sequence
  chemically synthesized
aggcctcaggcatctttcac

SEQ ID NO: 1809 - DNA, 20 bp, Artificial Sequence
  chemically synthesized
ggcctcaggcatctttcaca

SEQ ID NO: 1810 - DNA, 20 bp, Artificial Sequence
  chemically synthesized
tttcacagggatgcctgtac

SEQ ID NO: 1811 - DNA, 20 bp, Artificial Sequence
  chemically synthesized
ttcacagggatgcctgtact

SEQ ID NO: 1812 - DNA, 20 bp, Artificial Sequence
  chemically synthesized
acagggatgcctgtactggg

SEQ ID NO: 1813 - DNA, 20 bp, Artificial Sequence
  chemically synthesized
cagggatgcctgtactgggc

SEQ ID NO: 1814 - DNA, 20 bp, Artificial Sequence
  chemically synthesized
tgtactgggcaggtccttga

SEQ ID NO: 1815 - DNA, 20 bp, Artificial Sequence
  chemically synthesized
gtactgggcaggtccttgaa

SEQ ID NO: 1816 - DNA, 20 bp, Artificial Sequence
  chemically synthesized
tactgggcaggtccttgaaa

SEQ ID NO: 1817 - DNA, 20 bp, Artificial Sequence
  chemically synthesized
gggcaggtccttgaaaggga

SEQ ID NO: 1818 - DNA, 20 bp, Artificial Sequence
  chemically synthesized
ggcaggtccttgaaagggaa

SEQ ID NO: 1819 - DNA, 20 bp, Artificial Sequence
  chemically synthesized
tcccctatcgccatgacaac

SEQ ID NO: 1820 - DNA, 20 bp, Artificial Sequence
  chemically synthesized
cccctatcgccatgacaact

SEQ ID NO: 1821 - DNA, 20 bp, Artificial Sequence
  chemically synthesized
ctatcgccatgacaactggg

SEQ ID NO: 1822 - DNA, 20 bp, Artificial Sequence
  chemically synthesized
acaactgggtggaaataaac

SEQ ID NO: 1823 - DNA, 20 bp, Artificial Sequence
  chemically synthesized
tgggtggaaataaacgagcc

SEQ ID NO: 1824 - DNA, 20 bp, Artificial Sequence
  chemically synthesized
agccgagttcatcccgttcc

SEQ ID NO: 1825 - DNA, 20 bp, Artificial Sequence
  chemically synthesized
gccgagttcatcccgttccc

SEQ ID NO: 1826 - DNA, 20 bp, Artificial Sequence
  chemically synthesized
ccgagttcatcccgttccca

SEQ ID NO: 1827 - DNA, 20 bp, Artificial Sequence
  chemically synthesized
tcccgttcccagggcacgtg

SEQ ID NO: 1828 - DNA, 20 bp, Artificial Sequence
  chemically synthesized
gggcacgtgcggccccttca

SEQ ID NO: 1829 - DNA, 20 bp, Artificial Sequence
  chemically synthesized
gtgcggccccttcacagccc

SEQ ID NO: 1830 - DNA, 20 bp, Artificial Sequence
  chemically synthesized
tttccatgacctcatgctct

SEQ ID NO: 1831 - DNA, 20 bp, Artificial Sequence
  chemically synthesized
cctcatgctcttggccctcg

SEQ ID NO: 1832 - DNA, 20 bp, Artificial Sequence
  chemically synthesized
tagctccctcccgcctcctc

SEQ ID NO: 1833 - DNA, 20 bp, Artificial Sequence
  chemically synthesized
tccctcccgcctcctccaga

SEQ ID NO: 1834 - DNA, 20 bp, Artificial Sequence
  chemically synthesized
ccctcccgcctcctccagat

SEQ ID NO: 1835 - DNA, 20 bp, Artificial Sequence
  chemically synthesized
tcccgcctcctccagatggg

SEQ ID NO: 1836 - DNA, 20 bp, Artificial Sequence
  chemically synthesized
ctcctccagatgggcagctt

SEQ ID NO: 1837 - DNA, 20 bp, Artificial Sequence
  chemically synthesized
cctccagatgggcagctttg

SEQ ID NO: 1838 - DNA, 20 bp, Artificial Sequence
  chemically synthesized
tccagatgggcagctttgga

SEQ ID NO: 1839 - DNA, 20 bp, Artificial Sequence
  chemically synthesized
ccagatgggcagctttggag

SEQ ID NO: 1840 - DNA, 20 bp, Artificial Sequence
  chemically synthesized
atgggcagctttggagaggt

SEQ ID NO: 1841 - DNA, 20 bp, Artificial Sequence
  chemically synthesized
tgggcagctttggagaggtg

SEQ ID NO: 1842 - DNA, 20 bp, Artificial Sequence
  chemically synthesized
gggcagctttggagaggtga

SEQ ID NO: 1843 - DNA, 20 bp, Artificial Sequence
  chemically synthesized
ctttggagaggtgagggact

SEQ ID NO: 1844 - DNA, 20 bp, Artificial Sequence
  chemically synthesized
tttggagaggtgagggactt

SEQ ID NO: 1845 - DNA, 20 bp, Artificial Sequence
  chemically synthesized
ttggagaggtgagggacttg

SEQ ID NO: 1846 - DNA, 20 bp, Artificial Sequence
  chemically synthesized
tggagaggtgagggacttgg

SEQ ID NO: 1847 - DNA, 20 bp, Artificial Sequence
  chemically synthesized
ggagaggtgagggacttggg

SEQ ID NO: 1848 - DNA, 20 bp, Artificial Sequence
  chemically synthesized
ttggggggtaatttatcccg

SEQ ID NO: 1849 - DNA, 20 bp, Artificial Sequence
  chemically synthesized
ggtaatttatcccgtggatc

SEQ ID NO: 1850 - DNA, 20 bp, Artificial Sequence
  chemically synthesized
gtaatttatcccgtggatct

SEQ ID NO: 1851 - DNA, 20 bp, Artificial Sequence
  chemically synthesized
aatttatcccgtggatctag

SEQ ID NO: 1852 - DNA, 20 bp, Artificial Sequence
  chemically synthesized
atcccgtggatctaggagtt

SEQ ID NO: 1853 - DNA, 20 bp, Artificial Sequence
  chemically synthesized
gtttagcttcactccttcct

SEQ ID NO: 1854 - DNA, 20 bp, Artificial Sequence
  chemically synthesized
cttcactccttcctcagctc

SEQ ID NO: 1855 - DNA, 20 bp, Artificial Sequence
  chemically synthesized
ctccttcctcagctccagtt

SEQ ID NO: 1856 - DNA, 20 bp, Artificial Sequence
  chemically synthesized
tccttcctcagctccagttc

SEQ ID NO: 1857 - DNA, 20 bp, Artificial Sequence
  chemically synthesized
ctcagctccagttcaggtcc

SEQ ID NO: 1858 - DNA, 20 bp, Artificial Sequence
  chemically synthesized
cagctccagttcaggtcccg

SEQ ID NO: 1859 - DNA, 20 bp, Artificial Sequence
  chemically synthesized
ttcaggtcccggagcccacc

SEQ ID NO: 1860 - DNA, 20 bp, Artificial Sequence
  chemically synthesized
ggagcccacccagtgtccac

SEQ ID NO: 1861 - DNA, 20 bp, Artificial Sequence
  chemically synthesized
gagcccacccagtgtccaca

SEQ ID NO: 1862 - DNA, 20 bp, Artificial Sequence
  chemically synthesized
cacccagtgtccacaaggcc

SEQ ID NO: 1863 - DNA, 20 bp, Artificial Sequence
  chemically synthesized
acccagtgtccacaaggcct

SEQ ID NO: 1864 - DNA, 20 bp, Artificial Sequence
  chemically synthesized
cccagtgtccacaaggcctg

SEQ ID NO: 1865 - DNA, 20 bp, Artificial Sequence
  chemically synthesized
gtgtccacaaggcctggggc

SEQ ID NO: 1866 - DNA, 20 bp, Artificial Sequence
  chemically synthesized
aagtccctcctccgaccccc

SEQ ID NO: 1867 - DNA, 20 bp, Artificial Sequence
  chemically synthesized
tcctccgaccccctggactt

SEQ ID NO: 1868 - DNA, 20 bp, Artificial Sequence
  chemically synthesized
acttcggcttttgtcccccc

SEQ ID NO: 1869 - DNA, 20 bp, Artificial Sequence
  chemically synthesized
gcttttgtccccccaagttt

SEQ ID NO: 1870 - DNA, 20 bp, Artificial Sequence
  chemically synthesized
cccccaagttttggacccct

SEQ ID NO: 1871 - DNA, 20 bp, Artificial Sequence
  chemically synthesized
ccccaagttttggaccccta

SEQ ID NO: 1872 - DNA, 20 bp, Artificial Sequence
  chemically synthesized
cccaagttttggacccctaa

SEQ ID NO: 1873 - DNA, 20 bp, Artificial Sequence
  chemically synthesized
aagttttggacccctaaggg

SEQ ID NO: 1874 - DNA, 20 bp, Artificial Sequence
  chemically synthesized
tggacccctaagggaagaat

SEQ ID NO: 1875 - DNA, 20 bp, Artificial Sequence
  chemically synthesized
cctaagggaagaatgagaaa

SEQ ID NO: 1876 - DNA, 20 bp, Artificial Sequence
  chemically synthesized
aagggaagaatgagaaacgg

SEQ ID NO: 1877 - DNA, 20 bp, Artificial Sequence
  chemically synthesized
tgagaaacggtggcccgtgt

SEQ ID NO: 1878 - DNA, 20 bp, Artificial Sequence
  chemically synthesized
cggtggcccgtgtcagcccc

SEQ ID NO: 1879 - DNA, 20 bp, Artificial Sequence
  chemically synthesized
cccgtgtcagcccctggctg

SEQ ID NO: 1880 - DNA, 20 bp, Artificial Sequence
  chemically synthesized
ccgtgtcagcccctggctgc

SEQ ID NO: 1881 - DNA, 20 bp, Artificial Sequence
  chemically synthesized
cgtgtcagcccctggctgca

SEQ ID NO: 1882 - DNA, 20 bp, Artificial Sequence
  chemically synthesized
cctggctgcagggccccgtg

SEQ ID NO: 1883 - DNA, 20 bp, Artificial Sequence
  chemically synthesized
tggctgcagggccccgtgca

SEQ ID NO: 1884 - DNA, 20 bp, Artificial Sequence
  chemically synthesized
ggctgcagggccccgtgcag

SEQ ID NO: 1885 - DNA, 20 bp, Artificial Sequence
  chemically synthesized
gctgcagggccccgtgcaga

SEQ ID NO: 1886 - DNA, 20 bp, Artificial Sequence
  chemically synthesized
ctgcagggccccgtgcagag

SEQ ID NO: 1887 - DNA, 20 bp, Artificial Sequence
  chemically synthesized
tgcagggccccgtgcagagg

SEQ ID NO: 1888 - DNA, 20 bp, Artificial Sequence
  chemically synthesized
gccccgtgcagagggggcct

SEQ ID NO: 1889 - DNA, 20 bp, Artificial Sequence
  chemically synthesized
cagagggggcctcagtgaac

SEQ ID NO: 1890 - DNA, 20 bp, Artificial Sequence
  chemically synthesized
gagggggcctcagtgaactg

SEQ ID NO: 1891 - DNA, 20 bp, Artificial Sequence
  chemically synthesized
ctcagtgaactggagtgtga

SEQ ID NO: 1892 - DNA, 20 bp, Artificial Sequence
  chemically synthesized
tgaactggagtgtgacagcc

SEQ ID NO: 1893 - DNA, 20 bp, Artificial Sequence
  chemically synthesized
gaactggagtgtgacagcct

SEQ ID NO: 1894 - DNA, 20 bp, Artificial Sequence
  chemically synthesized
aactggagtgtgacagcctg

SEQ ID NO: 1895 - DNA, 20 bp, Artificial Sequence
  chemically synthesized
gagtgtgacagcctggggcc

SEQ ID NO: 1896 - DNA, 20 bp, Artificial Sequence
  chemically synthesized
agtgtgacagcctggggccc

SEQ ID NO: 1897 - DNA, 20 bp, Artificial Sequence
  chemically synthesized
cagcctggggcccaggcaca

SEQ ID NO: 1898 - DNA, 20 bp, Artificial Sequence
  chemically synthesized
agcctggggcccaggcacac

SEQ ID NO: 1899 - DNA, 20 bp, Artificial Sequence
  chemically synthesized
ggcccaggcacacaggtgtg

SEQ ID NO: 1900 - DNA, 20 bp, Artificial Sequence
  chemically synthesized
gtgcagctgtctcacccctc

SEQ ID NO: 1901 - DNA, 20 bp, Artificial Sequence
  chemically synthesized
tgcagctgtctcacccctct

SEQ ID NO: 1902 - DNA, 20 bp, Artificial Sequence
  chemically synthesized
cagctgtctcacccctctgg

SEQ ID NO: 1903 - DNA, 20 bp, Artificial Sequence
  chemically synthesized
acccctctgggagtcccgcc

SEQ ID NO: 1904 - DNA, 20 bp, Artificial Sequence
  chemically synthesized
cccctctgggagtcccgccc

SEQ ID NO: 1905 - DNA, 20 bp, Artificial Sequence
  chemically synthesized
ggagtcccgcccaggcccct

SEQ ID NO: 1906 - DNA, 20 bp, Artificial Sequence
  chemically synthesized
ccaggcccctgagtctgtcc

SEQ ID NO: 1907 - DNA, 20 bp, Artificial Sequence
  chemically synthesized
cccctgagtctgtcccagca

SEQ ID NO: 1908 - DNA, 20 bp, Artificial Sequence
  chemically synthesized
ccctgagtctgtcccagcac

SEQ ID NO: 1909 - DNA, 20 bp, Artificial Sequence
  chemically synthesized
cctgagtctgtcccagcaca

SEQ ID NO: 1910 - DNA, 20 bp, Artificial Sequence
  chemically synthesized
gagtctgtcccagcacaggg

SEQ ID NO: 1911 - DNA, 20 bp, Artificial Sequence
  chemically synthesized
tggccttcctccaccctgca

SEQ ID NO: 1912 - DNA, 20 bp, Artificial Sequence
  chemically synthesized
tcctccaccctgcatagccc

SEQ ID NO: 1913 - DNA, 20 bp, Artificial Sequence
  chemically synthesized
cctccaccctgcatagccct

SEQ ID NO: 1914 - DNA, 20 bp, Artificial Sequence
  chemically synthesized
cctgcatagccctgggccca

SEQ ID NO: 1915 - DNA, 20 bp, Artificial Sequence
  chemically synthesized
ggcccacggcttcgttcctg

SEQ ID NO: 1916 - DNA, 20 bp, Artificial Sequence
  chemically synthesized
cccacggcttcgttcctgca

SEQ ID NO: 1917 - DNA, 20 bp, Artificial Sequence
  chemically synthesized
cgttcctgcagagtatctgc

SEQ ID NO: 1918 - DNA, 20 bp, Artificial Sequence
  chemically synthesized
gttcctgcagagtatctgct

SEQ ID NO: 1919 - DNA, 20 bp, Artificial Sequence
  chemically synthesized
ttcctgcagagtatctgctg

SEQ ID NO: 1920 - DNA, 20 bp, Artificial Sequence
  chemically synthesized
ctgcagagtatctgctgggg

SEQ ID NO: 1921 - DNA, 20 bp, Artificial Sequence
  chemically synthesized
tatctgctggggtggtttcc

SEQ ID NO: 1922 - DNA, 20 bp, Artificial Sequence
  chemically synthesized
tggtttccgagcttgaccct

SEQ ID NO: 1923 - DNA, 20 bp, Artificial Sequence
  chemically synthesized
tttccgagcttgacccttgg

SEQ ID NO: 1924 - DNA, 20 bp, Artificial Sequence
  chemically synthesized
ttccgagcttgacccttgga

SEQ ID NO: 1925 - DNA, 20 bp, Artificial Sequence
  chemically synthesized
gcttgacccttggaaggacc

SEQ ID NO: 1926 - DNA, 20 bp, Artificial Sequence
  chemically synthesized
gacccttggaaggacctggc

SEQ ID NO: 1927 - DNA, 20 bp, Artificial Sequence
  chemically synthesized
acccttggaaggacctggct

SEQ ID NO: 1928 - DNA, 20 bp, Artificial Sequence
  chemically synthesized
ggaaggacctggctgggttt

SEQ ID NO: 1929 - DNA, 20 bp, Artificial Sequence
  chemically synthesized
gaaggacctggctgggttta

SEQ ID NO: 1930 - DNA, 20 bp, Artificial Sequence
  chemically synthesized
ggacctggctgggtttaagg

SEQ ID NO: 1931 - DNA, 20 bp, Artificial Sequence
  chemically synthesized
gacctggctgggtttaaggc

SEQ ID NO: 1932 - DNA, 20 bp, Artificial Sequence
  chemically synthesized
cctggctgggtttaaggcag

SEQ ID NO: 1933 - DNA, 20 bp, Artificial Sequence
  chemically synthesized
ctggctgggtttaaggcagg

SEQ ID NO: 1934 - DNA, 20 bp, Artificial Sequence
  chemically synthesized
tggctgggtttaaggcagga

SEQ ID NO: 1935 - DNA, 20 bp, Artificial Sequence
  chemically synthesized
ggctgggtttaaggcaggag

SEQ ID NO: 1936 - DNA, 20 bp, Artificial Sequence
  chemically synthesized
gggtttaaggcaggaggggc

SEQ ID NO: 1937 - DNA, 20 bp, Artificial Sequence
  chemically synthesized
ggtttaaggcaggaggggct

SEQ ID NO: 1938 - DNA, 20 bp, Artificial Sequence
  chemically synthesized
gtttaaggcaggaggggctg

SEQ ID NO: 1939 - DNA, 20 bp, Artificial Sequence
  chemically synthesized
tttaaggcaggaggggctgg

SEQ ID NO: 1940 - DNA, 20 bp, Artificial Sequence
  chemically synthesized
aggcaggaggggctgggggc

SEQ ID NO: 1941 - DNA, 20 bp, Artificial Sequence
  chemically synthesized
ggcaggaggggctgggggcc

SEQ ID NO: 1942 - DNA, 20 bp, Artificial Sequence
  chemically synthesized
gggctgggggccaggactcc

SEQ ID NO: 1943 - DNA, 20 bp, Artificial Sequence
  chemically synthesized
ggccaggactcctggctctg

SEQ ID NO: 1944 - DNA, 20 bp, Artificial Sequence
  chemically synthesized
gccaggactcctggctctga

SEQ ID NO: 1945 - DNA, 20 bp, Artificial Sequence
  chemically synthesized
caggactcctggctctgaag

SEQ ID NO: 1946 - DNA, 20 bp, Artificial Sequence
  chemically synthesized
aggactcctggctctgaagg

SEQ ID NO: 1947 - DNA, 20 bp, Artificial Sequence
  chemically synthesized
gactcctggctctgaaggag

SEQ ID NO: 1948 - DNA, 20 bp, Artificial Sequence
  chemically synthesized
actcctggctctgaaggagg

SEQ ID NO: 1949 - DNA, 20 bp, Artificial Sequence
  chemically synthesized
ctcctggctctgaaggagga

SEQ ID NO: 1950 - DNA, 20 bp, Artificial Sequence
  chemically synthesized
tcctggctctgaaggaggag

SEQ ID NO: 1951 - DNA, 20 bp, Artificial Sequence
  chemically synthesized
ggctctgaaggaggaggggc

SEQ ID NO: 1952 - DNA, 20 bp, Artificial Sequence
  chemically synthesized
aggggctggaacctcttccc

SEQ ID NO: 1953 - DNA, 20 bp, Artificial Sequence
  chemically synthesized
tggaacctcttccctagtct

SEQ ID NO: 1954 - DNA, 20 bp, Artificial Sequence
  chemically synthesized
ctcttccctagtctgagcac

SEQ ID NO: 1955 - DNA, 20 bp, Artificial Sequence
  chemically synthesized
ttccctagtctgagcactgg

SEQ ID NO: 1956 - DNA, 20 bp, Artificial Sequence
  chemically synthesized
agcactggaagcgccacctg

SEQ ID NO: 1957 - DNA, 20 bp, Artificial Sequence
  chemically synthesized
gcactggaagcgccacctgt

SEQ ID NO: 1958 - DNA, 20 bp, Artificial Sequence
  chemically synthesized
ctggaagcgccacctgtggg

SEQ ID NO: 1959 - DNA, 20 bp, Artificial Sequence
  chemically synthesized
gcgccacctgtgggtggtga

SEQ ID NO: 1960 - DNA, 20 bp, Artificial Sequence
  chemically synthesized
cgccacctgtgggtggtgac

SEQ ID NO: 1961 - DNA, 20 bp, Artificial Sequence
  chemically synthesized
gccacctgtgggtggtgacg

SEQ ID NO: 1962 - DNA, 20 bp, Artificial Sequence
  chemically synthesized
ccacctgtgggtggtgacgg

SEQ ID NO: 1963 - DNA, 20 bp, Artificial Sequence
  chemically synthesized
gggggttttgccgtgtctaa

SEQ ID NO: 1964 - DNA, 20 bp, Artificial Sequence
  chemically synthesized
ggggttttgccgtgtctaac

SEQ ID NO: 1965 - DNA, 20 bp, Artificial Sequence
  chemically synthesized
cgtgtctaacaggtaccatg

SEQ ID NO: 1966 - DNA, 20 bp, Artificial Sequence
  chemically synthesized
gtgtctaacaggtaccatgt

SEQ ID NO: 1967 - DNA, 20 bp, Artificial Sequence
  chemically synthesized
tgtctaacaggtaccatgtg

SEQ ID NO: 1968 - DNA, 20 bp, Artificial Sequence
  chemically synthesized
ccatgtggggttcccgcacc

SEQ ID NO: 1969 - DNA, 20 bp, Artificial Sequence
  chemically synthesized
tggggttcccgcacccagat

SEQ ID NO: 1970 - DNA, 20 bp, Artificial Sequence
  chemically synthesized
ggttcccgcacccagatgag

SEQ ID NO: 1971 - DNA, 20 bp, Artificial Sequence
  chemically synthesized
ccccgttcacttcctgtttg

SEQ ID NO: 1972 - DNA, 20 bp, Artificial Sequence
  chemically synthesized
gttcacttcctgtttgcaga

SEQ ID NO: 1973 - DNA, 20 bp, Artificial Sequence
  chemically synthesized
acttcctgtttgcagatagc

SEQ ID NO: 1974 - DNA, 20 bp, Artificial Sequence
  chemically synthesized
cttcctgtttgcagatagcc

SEQ ID NO: 1975 - DNA, 20 bp, Artificial Sequence
  chemically synthesized
tcctgtttgcagatagccag

SEQ ID NO: 1976 - DNA, 20 bp, Artificial Sequence
  chemically synthesized
gatagccaggagtcctttcg

SEQ ID NO: 1977 - DNA, 20 bp, Artificial Sequence
  chemically synthesized
gtcctttcgtggtttccact

SEQ ID NO: 1978 - DNA, 20 bp, Artificial Sequence
  chemically synthesized
gtggtttccactgagcactg

SEQ ID NO: 1979 - DNA, 20 bp, Artificial Sequence
  chemically synthesized
tggtttccactgagcactga

SEQ ID NO: 1980 - DNA, 20 bp, Artificial Sequence
  chemically synthesized
tccactgagcactgaaggcc

SEQ ID NO: 1981 - DNA, 20 bp, Artificial Sequence
  chemically synthesized
ctgagcactgaaggcctggc

SEQ ID NO: 1982 - DNA, 20 bp, Artificial Sequence
  chemically synthesized
ggcctggccggcctgaccac

SEQ ID NO: 1983 - DNA, 20 bp, Artificial Sequence
  chemically synthesized
gcctggccggcctgaccact

SEQ ID NO: 1984 - DNA, 20 bp, Artificial Sequence
  chemically synthesized
cggcctgaccactgggcaac

SEQ ID NO: 1985 - DNA, 20 bp, Artificial Sequence
  chemically synthesized
ggcctgaccactgggcaacc

SEQ ID NO: 1986 - DNA, 20 bp, Artificial Sequence
  chemically synthesized
gcaaccaggcgtatcttaaa

SEQ ID NO: 1987 - DNA, 20 bp, Artificial Sequence
  chemically synthesized
ccaggcgtatcttaaacagc

SEQ ID NO: 1988 - DNA, 20 bp, Artificial Sequence
  chemically synthesized
ggcgtatcttaaacagccag

SEQ ID NO: 1989 - DNA, 20 bp, Artificial Sequence
  chemically synthesized
tatcttaaacagccagtggc

SEQ ID NO: 1990 - DNA, 20 bp, Artificial Sequence
  chemically synthesized
tcttaaacagccagtggcca

SEQ ID NO: 1991 - DNA, 20 bp, Artificial Sequence
  chemically synthesized
cttaaacagccagtggccag

SEQ ID NO: 1992 - DNA, 20 bp, Artificial Sequence
  chemically synthesized
agccagtggccagaggctgt

SEQ ID NO: 1993 - DNA, 20 bp, Artificial Sequence
  chemically synthesized
gccagtggccagaggctgtt

SEQ ID NO: 1994 - DNA, 20 bp, Artificial Sequence
  chemically synthesized
ggtcattttccccactgtcc

SEQ ID NO: 1995 - DNA, 20 bp, Artificial Sequence
  chemically synthesized
ctgtcctagcaccgtgtccc

SEQ ID NO: 1996 - DNA, 20 bp, Artificial Sequence
  chemically synthesized
tgtccctggatctgttttcg

SEQ ID NO: 1997 - DNA, 20 bp, Artificial Sequence
  chemically synthesized
tctgttttcgtggctccctc

SEQ ID NO: 1998 - DNA, 20 bp, Artificial Sequence
  chemically synthesized
tgttttcgtggctccctctg

SEQ ID NO: 1999 - DNA, 20 bp, Artificial Sequence
  chemically synthesized
cctctggagtcccgacttgc

SEQ ID NO: 2000 - DNA, 20 bp, Artificial Sequence
  chemically synthesized
ctctggagtcccgacttgct

SEQ ID NO: 2001 - DNA, 20 bp, Artificial Sequence
  chemically synthesized
cccgacttgctgggacaccg

SEQ ID NO: 2002 - DNA, 20 bp, Artificial Sequence
  chemically synthesized
acttgctgggacaccgtggc

SEQ ID NO: 2003 - DNA, 20 bp, Artificial Sequence
  chemically synthesized
cttgctgggacaccgtggct

SEQ ID NO: 2004 - DNA, 20 bp, Artificial Sequence
  chemically synthesized
ttgctgggacaccgtggctg

SEQ ID NO: 2005 - DNA, 20 bp, Artificial Sequence
  chemically synthesized
ctgggacaccgtggctgggg

SEQ ID NO: 2006 - DNA, 20 bp, Artificial Sequence
  chemically synthesized
tgggacaccgtggctggggt

SEQ ID NO: 2007 - DNA, 20 bp, Artificial Sequence
  chemically synthesized
caccgtggctggggtaggtg

SEQ ID NO: 2008 - DNA, 20 bp, Artificial Sequence
  chemically synthesized
gctggggtaggtgcggctga

SEQ ID NO: 2009 - DNA, 20 bp, Artificial Sequence
  chemically synthesized
tgacggctgtttcccacccc

SEQ ID NO: 2010 - DNA, 20 bp, Artificial Sequence
  chemically synthesized
gacggctgtttcccaccccc

SEQ ID NO: 2011 - DNA, 20 bp, Artificial Sequence
  chemically synthesized
acccccaggcctgcattgat

SEQ ID NO: 2012 - DNA, 20 bp, Artificial Sequence
  chemically synthesized
ggcctgcattgatgagaacc

SEQ ID NO: 2013 - DNA, 20 bp, Artificial Sequence
  chemically synthesized
cctgcattgatgagaacctg

SEQ ID NO: 2014 - DNA, 20 bp, Artificial Sequence
  chemically synthesized
ctgcattgatgagaacctgg

SEQ ID NO: 2015 - DNA, 20 bp, Artificial Sequence
  chemically synthesized
cattgatgagaacctggagg

SEQ ID NO: 2016 - DNA, 20 bp, Artificial Sequence
  chemically synthesized
cctggaggtggtgcgcttct

SEQ ID NO: 2017 - DNA, 20 bp, Artificial Sequence
  chemically synthesized
ggaggtggtgcgcttcttgg

SEQ ID NO: 2018 - DNA, 20 bp, Artificial Sequence
  chemically synthesized
aggtggtgcgcttcttggtg

SEQ ID NO: 2019 - DNA, 20 bp, Artificial Sequence
  chemically synthesized
tggtgcgcttcttggtggag

SEQ ID NO: 2020 - DNA, 20 bp, Artificial Sequence
  chemically synthesized
ggtgcgcttcttggtggagc

SEQ ID NO: 2021 - DNA, 20 bp, Artificial Sequence
  chemically synthesized
gtgcgcttcttggtggagca

SEQ ID NO: 2022 - DNA, 20 bp, Artificial Sequence
  chemically synthesized
agcagggcgccactgtgaac

SEQ ID NO: 2023 - DNA, 20 bp, Artificial Sequence
  chemically synthesized
gcagggcgccactgtgaacc

SEQ ID NO: 2024 - DNA, 20 bp, Artificial Sequence
  chemically synthesized
gggcgccactgtgaaccagg

SEQ ID NO: 2025 - DNA, 20 bp, Artificial Sequence
  chemically synthesized
ctgtgaaccaggcagacaac

SEQ ID NO: 2026 - DNA, 20 bp, Artificial Sequence
  chemically synthesized
tgtgaaccaggcagacaacg

SEQ ID NO: 2027 - DNA, 20 bp, Artificial Sequence
  chemically synthesized
gtgaaccaggcagacaacga

SEQ ID NO: 2028 - DNA, 20 bp, Artificial Sequence
  chemically synthesized
accaggcagacaacgagggc

SEQ ID NO: 2029 - DNA, 20 bp, Artificial Sequence
  chemically synthesized
gggctggacgccactgcacg

SEQ ID NO: 2030 - DNA, 20 bp, Artificial Sequence
  chemically synthesized
ctgcacgtggccgcctcctg

SEQ ID NO: 2031 - DNA, 20 bp, Artificial Sequence
  chemically synthesized
ggccgcctcctgtggctacc

SEQ ID NO: 2032 - DNA, 20 bp, Artificial Sequence
  chemically synthesized
tgtggctacctagatatcgc

SEQ ID NO: 2033 - DNA, 20 bp, Artificial Sequence
  chemically synthesized
gttctcatcaatgcaggcct

SEQ ID NO: 2034 - DNA, 20 bp, Artificial Sequence
  chemically synthesized
gaagggagggggcttctcat

SEQ ID NO: 2035 - DNA, 20 bp, Artificial Sequence
  chemically synthesized
gcccctcctccttcagagcc

SEQ ID NO: 2036 - DNA, 20 bp, Artificial Sequence
  chemically synthesized
aaacccagccaggtccttcc

SEQ ID NO: 2037 - DNA, 20 bp, Artificial Sequence
  chemically synthesized
gccgtgggcccagggctatg

SEQ ID NO: 2038 - DNA, 20 bp, Artificial Sequence
  chemically synthesized
ggcctgggcgggactcccag

SEQ ID NO: 2039 - DNA, 20 bp, Artificial Sequence
  chemically synthesized
ccgtttctcattcttccctt

SEQ ID NO: 2040 - DNA, 20 bp, Artificial Sequence
  chemically synthesized
gggacaaaagccgaagtcca

SEQ ID NO: 2041 - DNA, 20 bp, Artificial Sequence
  chemically synthesized
tgccccaggccttgtggaca

SEQ ID NO: 2042 - DNA, 20 bp, Artificial Sequence
  chemically synthesized
acctgaactggagctgagga

SEQ ID NO: 2043 - DNA, 20 bp, Artificial Sequence
  chemically synthesized
aagctaaactcctagatcca

SEQ ID NO: 2044 - DNA, 20 bp, Artificial Sequence
  chemically synthesized
ggccgcacgtgccctgggaa

SEQ ID NO: 2045 - DNA, 20 bp, Artificial Sequence
  chemically synthesized
ggcctgggcaccagggactc

SEQ ID NO: 2046 - DNA, 20 bp, Artificial Sequence
  chemically synthesized
gcccttccgccctcagatga

SEQ ID NO: 2047 - DNA, 20 bp, Artificial Sequence
  chemically synthesized
gcctctccccattcagaccc

SEQ ID NO: 2048 - DNA, 20 bp, Artificial Sequence
  chemically synthesized
gcccctcctccctcagaccc

SEQ ID NO: 2049 - DNA, 20 bp, Artificial Sequence
  chemically synthesized
gcccctcctccctcggaccc

SEQ ID NO: 2050 - DNA, 20 bp, Artificial Sequence
  chemically synthesized
gtccctccaccctcagaccc

SEQ ID NO: 2051 - DNA, 20 bp, Artificial Sequence
  chemically synthesized
gcccctcctccctcggaccc

SEQ ID NO: 2052 - DNA, 20 bp, Artificial Sequence
  chemically synthesized
gctcttctctgttcagccct

SEQ ID NO: 2053 - DNA, 20 bp, Artificial Sequence
  chemically synthesized
cccctagccactaaggcaat

SEQ ID NO: 2054 - DNA, 20 bp, Artificial Sequence
  chemically synthesized
cactaaggcaattggggtgc

SEQ ID NO: 2055 - DNA, 20 bp, Artificial Sequence
  chemically synthesized
ttggggtgcaggaatggggg

SEQ ID NO: 2056 - DNA, 20 bp, Artificial Sequence
  chemically synthesized
aagtggttgataaacccacg

SEQ ID NO: 2057 - DNA, 20 bp, Artificial Sequence
  chemically synthesized
gcttggggacctgcctggag

SEQ ID NO: 2058 - DNA, 20 bp, Artificial Sequence
  chemically synthesized
cccaggtggagaaactggcc

SEQ ID NO: 2059 - DNA, 20 bp, Artificial Sequence
  chemically synthesized
ggagaaactggccgggaatc

SEQ ID NO: 2060 - DNA, 20 bp, Artificial Sequence
  chemically synthesized
atccctgttttcctaggact

SEQ ID NO: 2061 - DNA, 20 bp, Artificial Sequence
  chemically synthesized
ttggccacgtaacctgagaa

SEQ ID NO: 2062 - DNA, 20 bp, Artificial Sequence
  chemically synthesized
ccccaatgctccaggcctcc

SEQ ID NO: 2063 - DNA, 20 bp, Artificial Sequence
  chemically synthesized
aggcctcctgggataccccg

SEQ ID NO: 2064 - DNA, 20 bp, Artificial Sequence
  chemically synthesized
ctcctgggataccccgaaga

SEQ ID NO: 2065 - DNA, 20 bp, Artificial Sequence
  chemically synthesized
cagtcaccccacagttggag

SEQ ID NO: 2066 - DNA, 20 bp, Artificial Sequence
  chemically synthesized
ggcagcctggtagacagggc

SEQ ID NO: 2067 - DNA, 20 bp, Artificial Sequence
  chemically synthesized
agggctggggtggcctctcg

SEQ ID NO: 2068 - DNA, 20 bp, Artificial Sequence
  chemically synthesized
taggtggcctggggcctctg

SEQ ID NO: 2069 - DNA, 20 bp, Artificial Sequence
  chemically synthesized
tctgggggatgcaggggaag

SEQ ID NO: 2070 - DNA, 20 bp, Artificial Sequence
  chemically synthesized
gaagggggatgcaggggaac

SEQ ID NO: 2071 - DNA, 20 bp, Artificial Sequence
  chemically synthesized
cgggaccctgctctgggcgg

SEQ ID NO: 2072 - DNA, 20 bp, Artificial Sequence
  chemically synthesized
tggggactctttaaggaaag

SEQ ID NO: 2073 - DNA, 20 bp, Artificial Sequence
  chemically synthesized
gaaggatggagaaagagaaa

SEQ ID NO: 2074 - DNA, 20 bp, Artificial Sequence
  chemically synthesized
ggacgcaccattctcacaaa

SEQ ID NO: 2075 - DNA, 20 bp, Artificial Sequence
  chemically synthesized
gtgtaaggaagctgcagcac

SEQ ID NO: 2076 - DNA, 20 bp, Artificial Sequence
  chemically synthesized
gagcagctcaggttctggga

SEQ ID NO: 2077 - DNA, 20 bp, Artificial Sequence
  chemically synthesized
ggttctgggagagggtagcg

SEQ ID NO: 2078 - DNA, 20 bp, Artificial Sequence
  chemically synthesized
ccctgccaagctctccctcc

SEQ ID NO: 2079 - DNA, 20 bp, Artificial Sequence
  chemically synthesized
gagagatggctccaggaaat

SEQ ID NO: 2080 - DNA, 20 bp, Artificial Sequence
  chemically synthesized
tgggggtgtgtcaccagata

SEQ ID NO: 2081 - DNA, 20 bp, Artificial Sequence
  chemically synthesized
gaatctgcctaacaggaggt

SEQ ID NO: 2082 - DNA, 20 bp, Artificial Sequence
  chemically synthesized
gactaggaaggaggaggcct

SEQ ID NO: 2083 - DNA, 20 bp, Artificial Sequence
  chemically synthesized
tgtccctagtggccccactg

SEQ ID NO: 2084 - DNA, 20 bp, Artificial Sequence
  chemically synthesized
gagccacattaaccggccct

SEQ ID NO: 2085 - DNA, 20 bp, Artificial Sequence
  chemically synthesized
gtggtcccagctcggggaca

SEQ ID NO: 2086 - DNA, 20 bp, Artificial Sequence
  chemically synthesized
cctgaagtggacataggggc

SEQ ID NO: 2087 - DNA, 20 bp, Artificial Sequence
  chemically synthesized
gcacagactagagaggtaag

SEQ ID NO: 2088 - DNA, 20 bp, Artificial Sequence
  chemically synthesized
aggggagctgcccaaatgaa

SEQ ID NO: 2089 - DNA, 20 bp, Artificial Sequence
  chemically synthesized
tgaaaggagtgagaggtgac

SEQ ID NO: 2090 - DNA, 20 bp, Artificial Sequence
  chemically synthesized
gacccgaatccacaggagaa

SEQ ID NO: 2091 - DNA, 20 bp, Artificial Sequence
  chemically synthesized
tgtccaggcaaagaaagcaa

SEQ ID NO: 2092 - DNA, 20 bp, Artificial Sequence
  chemically synthesized
ggtggctaaagccagggaga

SEQ ID NO: 2093 - DNA, 20 bp, Artificial Sequence
  chemically synthesized
gccagggagacggggtactt

SEQ ID NO: 2094 - DNA, 20 bp, Artificial Sequence
  chemically synthesized
gagaaggaaaagggaaccca

SEQ ID NO: 2095 - DNA, 20 bp, Artificial Sequence
  chemically synthesized
cccagcgagtgaagacggca

SEQ ID NO: 2096 - DNA, 20 bp, Artificial Sequence
  chemically synthesized
cgagtgaagacggcatgggg

SEQ ID NO: 2097 - DNA, 20 bp, Artificial Sequence
  chemically synthesized
ggagaggacccagacacggg

SEQ ID NO: 2098 - DNA, 20 bp, Artificial Sequence
  chemically synthesized
agcagagagcaaggggaaga

SEQ ID NO: 2099 - DNA, 20 bp, Artificial Sequence
  chemically synthesized
acctgaaggaggcggcaggg

SEQ ID NO: 2100 - DNA, 20 bp, Artificial Sequence
  chemically synthesized
agcggcacaggcccagggga

SEQ ID NO: 2101 - DNA, 20 bp, Artificial Sequence
  chemically synthesized
gagacggcagcgttagaggg

SEQ ID NO: 2102 - DNA, 20 bp, Artificial Sequence
  chemically synthesized
ggaagaggggaagtcgaggg

SEQ ID NO: 2103 - DNA, 20 bp, Artificial Sequence
  chemically synthesized
gggatggtaaggaggactgc

SEQ ID NO: 2104 - DNA, 20 bp, Artificial Sequence
  chemically synthesized
aaagcgactccaatgcggaa

SEQ ID NO: 2105 - DNA, 20 bp, Artificial Sequence
  chemically synthesized
cggaagagagtaggtcgaag

SEQ ID NO: 2106 - DNA, 20 bp, Artificial Sequence
  chemically synthesized
aatggtaaggaggcctgggg

SEQ ID NO: 2107 - DNA, 20 bp, Artificial Sequence
  chemically synthesized
ctggggcagagtggtcagca

SEQ ID NO: 2108 - DNA, 20 bp, Artificial Sequence
  chemically synthesized
aagcggctccaattcggaag

SEQ ID NO: 2109 - DNA, 20 bp, Artificial Sequence
  chemically synthesized
cggaagtggggtggtcgaag

SEQ ID NO: 2110 - DNA, 20 bp, Artificial Sequence
  chemically synthesized
aatggtaagggggactggga

SEQ ID NO: 2111 - DNA, 20 bp, Artificial Sequence
  chemically synthesized
actgggacggggtgtcagca

SEQ ID NO: 2112 - DNA, 20 bp, Artificial Sequence
  chemically synthesized
ccagggccaggaacgacggg

SEQ ID NO: 2113 - DNA, 20 bp, Artificial Sequence
  chemically synthesized
cgagactggcaacggggaag

SEQ ID NO: 2114 - DNA, 20 bp, Artificial Sequence
  chemically synthesized
atgccccaggtggcgcagca

SEQ ID NO: 2115 - DNA, 20 bp, Artificial Sequence
  chemically synthesized
gctgataccgtcggcgttgg

SEQ ID NO: 2116 - DNA, 20 bp, Artificial Sequence
  chemically synthesized
gcgggcgggcggcggcgcgg

SEQ ID NO: 2117 - DNA, 20 bp, Artificial Sequence
  chemically synthesized
gtcgagctcggcgccggggc

SEQ ID NO: 2118 - DNA, 20 bp, Artificial Sequence
  chemically synthesized
cgggcggtgcgatgtccgga

SEQ ID NO: 2119 - DNA, 20 bp, Artificial Sequence
  chemically synthesized
cgtccgcttcgagcgcgccg

SEQ ID NO: 2120 - DNA, 20 bp, Artificial Sequence
  chemically synthesized
ccccttcgaccaccccactt

SEQ ID NO: 2121 - DNA, 20 bp, Artificial Sequence
  chemically synthesized
cgacctactctcttccgcat

SEQ ID NO: 2122 - DNA, 20 bp, Artificial Sequence
  chemically synthesized
gcgctgccctcctctcgccc

SEQ ID NO: 2123 - DNA, 20 bp, Artificial Sequence
  chemically synthesized
ctaacgctgccgtctctctc

SEQ ID NO: 2124 - DNA, 20 bp, Artificial Sequence
  chemically synthesized
ttctgtctgcagcttgtggc

SEQ ID NO: 2125 - DNA, 20 bp, Artificial Sequence
  chemically synthesized
tctctgctgtgttgctgccc

SEQ ID NO: 2126 - DNA, 20 bp, Artificial Sequence
  chemically synthesized
caccacgtgatgtcctctga

SEQ ID NO: 2127 - DNA, 20 bp, Artificial Sequence
  chemically synthesized
tgagcggatcctccccgtgt

SEQ ID NO: 2128 - DNA, 20 bp, Artificial Sequence
  chemically synthesized
ccccatgccgtcttcactcg

SEQ ID NO: 2129 - DNA, 20 bp, Artificial Sequence
  chemically synthesized
ctgtgccatctctcgtttct

SEQ ID NO: 2130 - DNA, 20 bp, Artificial Sequence
  chemically synthesized
tcttaggatggccttctccg

SEQ ID NO: 2131 - DNA, 20 bp, Artificial Sequence
  chemically synthesized
cctggacaccccgttctcct

SEQ ID NO: 2132 - DNA, 20 bp, Artificial Sequence
  chemically synthesized
caccccgttctcctgtggat

SEQ ID NO: 2133 - DNA, 20 bp, Artificial Sequence
  chemically synthesized
cccctgtcatggcatcttcc

SEQ ID NO: 2134 - DNA, 20 bp, Artificial Sequence
  chemically synthesized
acagcatgtttgctgcctcc

SEQ ID NO: 2135 - DNA, 20 bp, Artificial Sequence
  chemically synthesized
cggttaatgtggctctggtt

SEQ ID NO: 2136 - DNA, 20 bp, Artificial Sequence
  chemically synthesized
cacagtggggccactaggga

SEQ ID NO: 2137 - DNA, 20 bp, Artificial Sequence
  chemically synthesized
tccttcctagtctcctgata

SEQ ID NO: 2138 - DNA, 20 bp, Artificial Sequence
  chemically synthesized
ttgcttacgatggagccaga

SEQ ID NO: 2139 - DNA, 20 bp, Artificial Sequence
  chemically synthesized
ctgggagggagagcttggca

SEQ ID NO: 2140 - DNA, 20 bp, Artificial Sequence
  chemically synthesized
cagggggtgggagggaaggg

SEQ ID NO: 2141 - DNA, 20 bp, Artificial Sequence
  chemically synthesized
gcagtttggaaaaacaaaat

SEQ ID NO: 2142 - DNA, 20 bp, Artificial Sequence
  chemically synthesized
aaaatcagaataagttggtc

SEQ ID NO: 2143 - DNA, 20 bp, Artificial Sequence
  chemically synthesized
ggcagggctgtggtgaggag

SEQ ID NO: 2144 - DNA, 20 bp, Artificial Sequence
  chemically synthesized
gtgtggaaaactccctttgt

SEQ ID NO: 2145 - DNA, 20 bp, Artificial Sequence
  chemically synthesized
tctccatccttctttcctta

SEQ ID NO: 2146 - DNA, 20 bp, Artificial Sequence
  chemically synthesized
acatattcctccgcccagag

SEQ ID NO: 2147 - DNA, 20 bp, Artificial Sequence
  chemically synthesized
taaggccctgctctgggctt

SEQ ID NO: 2148 - DNA, 20 bp, Artificial Sequence
  chemically synthesized
cctgctctgggcttctgggt

SEQ ID NO: 2149 - DNA, 20 bp, Artificial Sequence
  chemically synthesized
ctctcctgccccttccctac

SEQ ID NO: 2150 - DNA, 20 bp, Artificial Sequence
  chemically synthesized
cctgtctaccaggctgcctt

SEQ ID NO: 2151 - DNA, 20 bp, Artificial Sequence
  chemically synthesized
tctaccaggctgccttttgg

SEQ ID NO: 2152 - DNA, 20 bp, Artificial Sequence
  chemically synthesized
ggtggattctcctccaactg

SEQ ID NO: 2153 - DNA, 20 bp, Artificial Sequence
  chemically synthesized
tgcttggcaaactcactctt

SEQ ID NO: 2154 - DNA, 20 bp, Artificial Sequence
  chemically synthesized
tcccaggaggcctggagcat

SEQ ID NO: 2155 - DNA, 20 bp, Artificial Sequence
  chemically synthesized
cctggagcattggggtgggc

SEQ ID NO: 2156 - DNA, 20 bp, Artificial Sequence
  chemically synthesized
tgggctggggttcagagagg

SEQ ID NO: 2157 - DNA, 20 bp, Artificial Sequence
  chemically synthesized
gtggccaagaagcaggggag

SEQ ID NO: 2158 - DNA, 20 bp, Artificial Sequence
  chemically synthesized
aagaagcaggggagctgggt

SEQ ID NO: 2159 - DNA, 20 bp, Artificial Sequence
  chemically synthesized
gagctgggtttgggtcaggt

SEQ ID NO: 2160 - DNA, 20 bp, Artificial Sequence
  chemically synthesized
gtttgggtcaggtctgggtg

SEQ ID NO: 2161 - DNA, 20 bp, Artificial Sequence
  chemically synthesized
accctcagtcctaggaaaac

SEQ ID NO: 2162 - DNA, 20 bp, Artificial Sequence
  chemically synthesized
gggatggttggtcactgtct

SEQ ID NO: 2163 - DNA, 20 bp, Artificial Sequence
  chemically synthesized
tgtggctgttcccaagttct

SEQ ID NO: 2164 - DNA, 20 bp, Artificial Sequence
  chemically synthesized
aagttcttagggtaccccac

SEQ ID NO: 2165 - DNA, 20 bp, Artificial Sequence
  chemically synthesized
cccaattgccttagtggcta

SEQ ID NO: 2166 - DNA, 20 bp, Artificial Sequence
  chemically synthesized
gtggctagggggttgggggc

SEQ ID NO: 2167 - DNA, 20 bp, Artificial Sequence
  chemically synthesized
agagtaggaggggctggagc

SEQ ID NO: 2168 - DNA, 20 bp, Artificial Sequence
  chemically synthesized
agagctgggggcctgggctc

SEQ ID NO: 2169 - DNA, 20 bp, Artificial Sequence
  chemically synthesized
aggggctggggcctggactc

SEQ ID NO: 2170 - DNA, 20 bp, Artificial Sequence
  chemically synthesized
aggggctggggcctggactc

SEQ ID NO: 2171 - DNA, 20 bp, Artificial Sequence
  chemically synthesized
gggcctggactcctgggtct

SEQ ID NO: 2172 - DNA, 20 bp, Artificial Sequence
  chemically synthesized
gggactgggggcctggactc

SEQ ID NO: 2173 - DNA, 20 bp, Artificial Sequence
  chemically synthesized
aggggctggggcctggactc

SEQ ID NO: 2174 - DNA, 20 bp, Artificial Sequence
  chemically synthesized
ggggctgggggcctggactt

SEQ ID NO: 2175 - DNA, 20 bp, Artificial Sequence
  chemically synthesized
gcggggctgggcctggaccc

SEQ ID NO: 2176 - DNA, 20 bp, Artificial Sequence
  chemically synthesized
ctgggcctggacccctgggt

SEQ ID NO: 2177 - DNA, 20 bp, Artificial Sequence
  chemically synthesized
aagggctggggcctggcctc

SEQ ID NO: 2178 - DNA, 20 bp, Artificial Sequence
  chemically synthesized
ctggggcctggcctcctggg

SEQ ID NO: 2179 - DNA, 20 bp, Artificial Sequence
  chemically synthesized
gcctcctgggttgaatgggg

SEQ ID NO: 2180 - DNA, 20 bp, Artificial Sequence
  chemically synthesized
gaggggttgggcctggactc

SEQ ID NO: 2181 - DNA, 20 bp, Artificial Sequence
  chemically synthesized
aggcctcaggcatctttcac

SEQ ID NO: 2182 - DNA, 20 bp, Artificial Sequence
  chemically synthesized
ctcccctatcgccatgacaa

SEQ ID NO: 2183 - DNA, 20 bp, Artificial Sequence
  chemically synthesized
actgggtggaaataaacgag

SEQ ID NO: 2184 - DNA, 20 bp, Artificial Sequence
  chemically synthesized
acgtgcggccccttcacagc

SEQ ID NO: 2185 - DNA, 20 bp, Artificial Sequence
  chemically synthesized
ttggagaggtgagggacttg

SEQ ID NO: 2186 - DNA, 20 bp, Artificial Sequence
  chemically synthesized
cttggggggtaatttatccc

SEQ ID NO: 2187 - DNA, 20 bp, Artificial Sequence
  chemically synthesized
gtaatttatcccgtggatct

SEQ ID NO: 2188 - DNA, 20 bp, Artificial Sequence
  chemically synthesized
aagttttggacccctaaggg

SEQ ID NO: 2189 - DNA, 20 bp, Artificial Sequence
  chemically synthesized
cagagggggcctcagtgaac

SEQ ID NO: 2190 - DNA, 20 bp, Artificial Sequence
  chemically synthesized
tgcagctgtctcacccctct

SEQ ID NO: 2191 - DNA, 20 bp, Artificial Sequence
  chemically synthesized
tgggagtcccgcccaggccc

SEQ ID NO: 2192 - DNA, 20 bp, Artificial Sequence
  chemically synthesized
cccctgagtctgtcccagca

SEQ ID NO: 2193 - DNA, 20 bp, Artificial Sequence
  chemically synthesized
ggcccacggcttcgttcctg

SEQ ID NO: 2194 - DNA, 20 bp, Artificial Sequence
  chemically synthesized
cgttcctgcagagtatctgc

SEQ ID NO: 2195 - DNA, 20 bp, Artificial Sequence
  chemically synthesized
tgacccttggaaggacctgg

SEQ ID NO: 2196 - DNA, 20 bp, Artificial Sequence
  chemically synthesized
gagcactggaagcgccacct

SEQ ID NO: 2197 - DNA, 20 bp, Artificial Sequence
  chemically synthesized
cgccacctgtgggtggtgac

SEQ ID NO: 2198 - DNA, 20 bp, Artificial Sequence
  chemically synthesized
cgtgtctaacaggtaccatg

SEQ ID NO: 2199 - DNA, 20 bp, Artificial Sequence
  chemically synthesized
cttcctgtttgcagatagcc

SEQ ID NO: 2200 - DNA, 20 bp, Artificial Sequence
  chemically synthesized
cagccagtggccagaggctg

SEQ ID NO: 2201 - DNA, 20 bp, Artificial Sequence
  chemically synthesized
actgtcctagcaccgtgtcc

SEQ ID NO: 2202 - DNA, 20 bp, Artificial Sequence
  chemically synthesized
tctgttttcgtggctccctc

SEQ ID NO: 2203 - DNA, 20 bp, Artificial Sequence
  chemically synthesized
acttgctgggacaccgtggc

SEQ ID NO: 2204 - DNA, 20 bp, Artificial Sequence
  chemically synthesized
agctcttctctgttcagccc

SEQ ID NO: 2205 - DNA, 20 bp, Artificial Sequence
  chemically synthesized
gcctggagaaggatgcagga

SEQ ID NO: 2206 - DNA, 20 bp, Artificial Sequence
  chemically synthesized
cgagaaacacagccccaggt

SEQ ID NO: 2207 - DNA, 20 bp, Artificial Sequence
  chemically synthesized
gcagtcaccccacagttgga

SEQ ID NO: 2208 - DNA, 20 bp, Artificial Sequence
  chemically synthesized
ctctttaaggaaagaaggat

SEQ ID NO: 2209 - DNA, 20 bp, Artificial Sequence
  chemically synthesized
aaggaaagaaggatggagaa

SEQ ID NO: 2210 - DNA, 20 bp, Artificial Sequence
  chemically synthesized
ggaacaatataaattgggga

SEQ ID NO: 2211 - DNA, 20 bp, Artificial Sequence
  chemically synthesized
ggagaacggggtgtccaggc

SEQ ID NO: 2212 - DNA, 20 bp, Artificial Sequence
  chemically synthesized
acggggtactttggggttgt

SEQ ID NO: 2213 - DNA, 20 bp, Artificial Sequence
  chemically synthesized
tccgtcggagaaggccatcc

SEQ ID NO: 2214 - DNA, 20 bp, Artificial Sequence
  chemically synthesized
acccaggccacaagctgcag

SEQ ID NO: 2215 - DNA, 20 bp, Artificial Sequence
  chemically synthesized
aagcggcacaggcccagggg

SEQ ID NO: 2216 - DNA, 20 bp, Artificial Sequence
  chemically synthesized
caggggagagaatgcaggtc

SEQ ID NO: 2217 - DNA, 20 bp, Artificial Sequence
  chemically synthesized
cactagggacaggattggtg

SEQ ID NO: 2218 - DNA, 20 bp, Artificial Sequence
  chemically synthesized
agcagtttggaaaaacaaaa

SEQ ID NO: 2219 - DNA, 20 bp, Artificial Sequence
  chemically synthesized
cgtgtggaaaactccctttg

SEQ ID NO: 2220 - DNA, 20 bp, Artificial Sequence
  chemically synthesized
caagttttggacccctaagg

SEQ ID NO: 2221 - DNA, 20 bp, Artificial Sequence
  chemically synthesized
ttggacccctaagggaagaa

SEQ ID NO: 2222 - DNA, 20 bp, Artificial Sequence
  chemically synthesized
gggactccagagggagccac

SEQ ID NO: 2223 - DNA, 20 bp, Artificial Sequence
  chemically synthesized
atggtacctgttagacacgg

SEQ ID NO: 2224 - DNA, 20 bp, Artificial Sequence
  chemically synthesized
tcattcttcccttaggggtc

SEQ ID NO: 2225 - DNA, 20 bp, Artificial Sequence
  chemically synthesized
aggactgagggtttcagtgc

SEQ ID NO: 2226 - DNA, 20 bp, Artificial Sequence
  chemically synthesized
tactggccttatctcacagg

SEQ ID NO: 2227 - DNA, 20 bp, Artificial Sequence
  chemically synthesized
ggtactttggggttgtccag

SEQ ID NO: 2228 - DNA, 20 bp, Artificial Sequence
  chemically synthesized
caagaggagaagcagtttgg

SEQ ID NO: 2229 - DNA, 20 bp, Artificial Sequence
  chemically synthesized
aggaggggggtgtccgtgtg

SEQ ID NO: 2230 - DNA, 20 bp, Artificial Sequence
  chemically synthesized
actgaaaccctcagtcctag

SEQ ID NO: 2231 - DNA, 20 bp, Artificial Sequence
  chemically synthesized
cccaacagcctctggccact

SEQ ID NO: 2232 - DNA, 20 bp, Artificial Sequence
  chemically synthesized
ggaagtgaacggggaaggga

SEQ ID NO: 2233 - DNA, 20 bp, Artificial Sequence
  chemically synthesized
cccccgtcaccacccacagg

SEQ ID NO: 2234 - DNA, 20 bp, Artificial Sequence
  chemically synthesized
agccaggggctgacacgggc

SEQ ID NO: 2235 - DNA, 20 bp, Artificial Sequence
  chemically synthesized
ctgggaacgggatgaactcg

SEQ ID NO: 2236 - DNA, 20 bp, Artificial Sequence
  chemically synthesized
gaacagccacagcagggggg

SEQ ID NO: 2237 - DNA, 20 bp, Artificial Sequence
  chemically synthesized
cagagacagtgaccaaccat

SEQ ID NO: 2238 - DNA, 20 bp, Artificial Sequence
  chemically synthesized
atccctgttttcctaggact

SEQ ID NO: 2239 - DNA, 20 bp, Artificial Sequence
  chemically synthesized
acctgacccaaacccagctc

SEQ ID NO: 2240 - DNA, 20 bp, Artificial Sequence
  chemically synthesized
ctcctgggataccccgaaga

SEQ ID NO: 2241 - DNA, 20 bp, Artificial Sequence
  chemically synthesized
gggaagcctgagcgcctctc

SEQ ID NO: 2242 - DNA, 20 bp, Artificial Sequence
  chemically synthesized
ggacgcaccattctcacaaa

SEQ ID NO: 2243 - DNA, 20 bp, Artificial Sequence
  chemically synthesized
tagaactcaggaccaactta

SEQ ID NO: 2244 - DNA, 20 bp, Artificial Sequence
  chemically synthesized
tcaggaccaacttattctga

SEQ ID NO: 2245 - DNA, 20 bp, Artificial Sequence
  chemically synthesized
attctgattttgtttttcca

SEQ ID NO: 2246 - DNA, 20 bp, Artificial Sequence
  chemically synthesized
ggaaggaggaggcctaagga

SEQ ID NO: 2247 - DNA, 20 bp, Artificial Sequence
  chemically synthesized
gagagcgccgcgcccgcacc

SEQ ID NO: 2248 - DNA, 20 bp, Artificial Sequence
  chemically synthesized
ccgccccgtcgttcctggcc

SEQ ID NO: 2249 - DNA, 20 bp, Artificial Sequence
  chemically synthesized
ccaccccacttccgaattgg

SEQ ID NO: 2250 - DNA, 20 bp, Artificial Sequence
  chemically synthesized
tggagccgcttcaactggcc

SEQ ID NO: 2251 - DNA, 20 bp, Artificial Sequence
  chemically synthesized
cctactctcttccgcattgg

SEQ ID NO: 2252 - DNA, 20 bp, Artificial Sequence
  chemically synthesized
ttggagtcgctttaactggc

SEQ ID NO: 2253 - DNA, 20 bp, Artificial Sequence
  chemically synthesized
tccggaccactttgagctct

SEQ ID NO: 2254 - DNA, 20 bp, Artificial Sequence
  chemically synthesized
cttctgcgccgcctctggcc

SEQ ID NO: 2255 - DNA, 20 bp, Artificial Sequence
  chemically synthesized
gtttccccttcccaggcagg

SEQ ID NO: 2256 - DNA, 20 bp, Artificial Sequence
  chemically synthesized
cattctctcccctgggcctg

SEQ ID NO: 2257 - DNA, 20 bp, Artificial Sequence
  chemically synthesized
ggcctgtgccgctttctgtc

SEQ ID NO: 2258 - DNA, 20 bp, Artificial Sequence
  chemically synthesized
cttctggggcctgtgccatc

SEQ ID NO: 2259 - DNA, 20 bp, Artificial Sequence
  chemically synthesized
ttcttgtaggcctgcatcat

SEQ ID NO: 2260 - DNA, 20 bp, Artificial Sequence
  chemically synthesized
accccaaagtaccccgtctc

SEQ ID NO: 2261 - DNA, 20 bp, Artificial Sequence
  chemically synthesized
ctttagccacctctccatcc

SEQ ID NO: 2262 - DNA, 20 bp, Artificial Sequence
  chemically synthesized
gcctggacaccccgttctcc

SEQ ID NO: 2263 - DNA, 20 bp, Artificial Sequence
  chemically synthesized
cctatgtccacttcaggaca

SEQ ID NO: 2264 - DNA, 20 bp, Artificial Sequence
  chemically synthesized
ccacagtggggccactaggg

SEQ ID NO: 2265 - DNA, 20 bp, Artificial Sequence
  chemically synthesized
ctaacccccacctcctgtta

SEQ ID NO: 2266 - DNA, 20 bp, Artificial Sequence
  chemically synthesized
tctctccttgccagaacctc

SEQ ID NO: 2267 - DNA, 20 bp, Artificial Sequence
  chemically synthesized
tccttgccagaacctctaag

SEQ ID NO: 2268 - DNA, 20 bp, Artificial Sequence
  chemically synthesized
ccagagaggatcctgggagg

SEQ ID NO: 2269 - DNA, 20 bp, Artificial Sequence
  chemically synthesized
tgctctgacgcggccgtctg

SEQ ID NO: 2270 - DNA, 20 bp, Artificial Sequence
  chemically synthesized
cgtttcactgatcctggtgc

SEQ ID NO: 2271 - DNA, 20 bp, Artificial Sequence
  chemically synthesized
ttacacttcccaagaggaga

SEQ ID NO: 2272 - DNA, 20 bp, Artificial Sequence
  chemically synthesized
tttatattgttcctccgtgc

SEQ ID NO: 2273 - DNA, 20 bp, Artificial Sequence
  chemically synthesized
ttcctccgcccagagcaggg

SEQ ID NO: 2274 - DNA, 20 bp, Artificial Sequence
  chemically synthesized
cgcttccctaaggccctgct

SEQ ID NO: 2275 - DNA, 20 bp, Artificial Sequence
  chemically synthesized
taaggccctgctctgggctt

SEQ ID NO: 2276 - DNA, 20 bp, Artificial Sequence
  chemically synthesized
ggcaagcccaggagaggcgc

SEQ ID NO: 2277 - DNA, 20 bp, Artificial Sequence
  chemically synthesized
gtctaccaggctgccttttg

SEQ ID NO: 2278 - DNA, 20 bp, Artificial Sequence
  chemically synthesized
ttctcctccaactgtggggt

SEQ ID NO: 2279 - DNA, 20 bp, Artificial Sequence
  chemically synthesized
gtgggctggggttcagagag

SEQ ID NO: 2280 - DNA, 20 bp, Artificial Sequence
  chemically synthesized
gtggccaagaagcaggggag

SEQ ID NO: 2281 - DNA, 20 bp, Artificial Sequence
  chemically synthesized
tcaggtctgggtgtggggtg

SEQ ID NO: 2282 - DNA, 20 bp, Artificial Sequence
  chemically synthesized
ggtgtggggtgaccagctta

SEQ ID NO: 2283 - DNA, 20 bp, Artificial Sequence
  chemically synthesized
atgctgtttgcccaggacag

SEQ ID NO: 2284 - DNA, 20 bp, Artificial Sequence
  chemically synthesized
ggtcactgtctctgggtgac

SEQ ID NO: 2285 - DNA, 20 bp, Artificial Sequence
  chemically synthesized
tgggtgactcttgattcccg

SEQ ID NO: 2286 - DNA, 20 bp, Artificial Sequence
  chemically synthesized
gccagtttctccacctgggg

SEQ ID NO: 2287 - DNA, 20 bp, Artificial Sequence
  chemically synthesized
aagttcttagggtaccccac

SEQ ID NO: 2288 - DNA, 20 bp, Artificial Sequence
  chemically synthesized
tagagtaggaggggctggag

SEQ ID NO: 2289 - DNA, 20 bp, Artificial Sequence
  chemically synthesized
agagctgggggcctgggctc

SEQ ID NO: 2290 - DNA, 20 bp, Artificial Sequence
  chemically synthesized
acgtgcggccccttcacagc

SEQ ID NO: 2291 - DNA, 20 bp, Artificial Sequence
  chemically synthesized
cctcccgcctcctccagatg

SEQ ID NO: 2292 - DNA, 20 bp, Artificial Sequence
  chemically synthesized
gtaatttatcccgtggatct

SEQ ID NO: 2293 - DNA, 20 bp, Artificial Sequence
  chemically synthesized
ttatcccgtggatctaggag

SEQ ID NO: 2294 - DNA, 20 bp, Artificial Sequence
  chemically synthesized
cctcctccgaccccctggac

SEQ ID NO: 2295 - DNA, 20 bp, Artificial Sequence
  chemically synthesized
ggacttcggcttttgtcccc

SEQ ID NO: 2296 - DNA, 20 bp, Artificial Sequence
  chemically synthesized
accctgcatagccctgggcc

SEQ ID NO: 2297 - DNA, 20 bp, Artificial Sequence
  chemically synthesized
tcctgcagagtatctgctgg

SEQ ID NO: 2298 - DNA, 20 bp, Artificial Sequence
  chemically synthesized
agtatctgctggggtggttt

SEQ ID NO: 2299 - DNA, 20 bp, Artificial Sequence
  chemically synthesized
tgacccttggaaggacctgg

SEQ ID NO: 2300 - DNA, 20 bp, Artificial Sequence
  chemically synthesized
cgccacctgtgggtggtgac

SEQ ID NO: 2301 - DNA, 20 bp, Artificial Sequence
  chemically synthesized
ccctcccttccccgttcact

SEQ ID NO: 2302 - DNA, 20 bp, Artificial Sequence
  chemically synthesized
cagatagccaggagtccttt

SEQ ID NO: 2303 - DNA, 20 bp, Artificial Sequence
  chemically synthesized
tcctagcaccgtgtccctgg

SEQ ID NO: 2304 - DNA, 20 bp, Artificial Sequence
  chemically synthesized
ctggggtaggtgcggctgac

SEQ ID NO: 2305 - DNA, 20 bp, Artificial Sequence
  chemically synthesized
ttgatgagaacctggaggtg

SEQ ID NO: 2306 - DNA, 22 bp, Artificial Sequence
  chemically synthesized
gcgatatctaggtagccacagg

SEQ ID NO: 2307 - DNA, 22 bp, Artificial Sequence
  chemically synthesized
ggtagccacaggaggcggccac

SEQ ID NO: 2308 - DNA, 22 bp, Artificial Sequence
  chemically synthesized
gttgtctgcctggttcacagtg

SEQ ID NO: 2309 - DNA, 22 bp, Artificial Sequence
  chemically synthesized
tctgcctggttcacagtggcgc

SEQ ID NO: 2310 - DNA, 22 bp, Artificial Sequence
  chemically synthesized
cctggttcacagtggcgccctg

SEQ ID NO: 2311 - DNA, 22 bp, Artificial Sequence
  chemically synthesized
gttcacagtggcgccctgctcc

SEQ ID NO: 2312 - DNA, 22 bp, Artificial Sequence
  chemically synthesized
acagtggcgccctgctccacca

SEQ ID NO: 2313 - DNA, 22 bp, Artificial Sequence
  chemically synthesized
ctccaccaagaagcgcaccacc

SEQ ID NO: 2314 - DNA, 22 bp, Artificial Sequence
  chemically synthesized
caccaagaagcgcaccacctcc

SEQ ID NO: 2315 - DNA, 22 bp, Artificial Sequence
  chemically synthesized
caggttctcatcaatgcaggcc

SEQ ID NO: 2316 - DNA, 22 bp, Artificial Sequence
  chemically synthesized
tcatcaatgcaggcctgggggt

SEQ ID NO: 2317 - DNA, 22 bp, Artificial Sequence
  chemically synthesized
atcaatgcaggcctgggggtgg

SEQ ID NO: 2318 - DNA, 22 bp, Artificial Sequence
  chemically synthesized
ggggtgggaaacagccgtcagc

SEQ ID NO: 2319 - DNA, 22 bp, Artificial Sequence
  chemically synthesized
ccccagccacggtgtcccagca

SEQ ID NO: 2320 - DNA, 22 bp, Artificial Sequence
  chemically synthesized
cagagggagccacgaaaacaga

SEQ ID NO: 2321 - DNA, 22 bp, Artificial Sequence
  chemically synthesized
ggacagtggggaaaatgaccca

SEQ ID NO: 2322 - DNA, 22 bp, Artificial Sequence
  chemically synthesized
tggccactggctgtttaagata

SEQ ID NO: 2323 - DNA, 22 bp, Artificial Sequence
  chemically synthesized
gccactggctgtttaagatacg

SEQ ID NO: 2324 - DNA, 22 bp, Artificial Sequence
  chemically synthesized
gctgtttaagatacgcctggtt

SEQ ID NO: 2325 - DNA, 22 bp, Artificial Sequence
  chemically synthesized
tttaagatacgcctggttgccc

SEQ ID NO: 2326 - DNA, 22 bp, Artificial Sequence
  chemically synthesized
aagatacgcctggttgcccagt

SEQ ID NO: 2327 - DNA, 22 bp, Artificial Sequence
  chemically synthesized
agatacgcctggttgcccagtg

SEQ ID NO: 2328 - DNA, 22 bp, Artificial Sequence
  chemically synthesized
gttgcccagtggtcaggccggc

SEQ ID NO: 2329 - DNA, 22 bp, Artificial Sequence
  chemically synthesized
cccagtggtcaggccggccagg

SEQ ID NO: 2330 - DNA, 22 bp, Artificial Sequence
  chemically synthesized
cagtgctcagtggaaaccacga

SEQ ID NO: 2331 - DNA, 22 bp, Artificial Sequence
  chemically synthesized
agtgctcagtggaaaccacgaa

SEQ ID NO: 2332 - DNA, 22 bp, Artificial Sequence
  chemically synthesized
agtggaaaccacgaaaggactc

SEQ ID NO: 2333 - DNA, 22 bp, Artificial Sequence
  chemically synthesized
ctggctatctgcaaacaggaag

SEQ ID NO: 2334 - DNA, 22 bp, Artificial Sequence
  chemically synthesized
gctatctgcaaacaggaagtga

SEQ ID NO: 2335 - DNA, 22 bp, Artificial Sequence
  chemically synthesized
tctgcaaacaggaagtgaacgg

SEQ ID NO: 2336 - DNA, 22 bp, Artificial Sequence
  chemically synthesized
caaacaggaagtgaacggggaa

SEQ ID NO: 2337 - DNA, 22 bp, Artificial Sequence
  chemically synthesized
ctcatctgggtgcgggaacccc

SEQ ID NO: 2338 - DNA, 22 bp, Artificial Sequence
  chemically synthesized
tcatctgggtgcgggaacccca

SEQ ID NO: 2339 - DNA, 22 bp, Artificial Sequence
  chemically synthesized
atctgggtgcgggaaccccaca

SEQ ID NO: 2340 - DNA, 22 bp, Artificial Sequence
  chemically synthesized
ggtgcgggaaccccacatggta

SEQ ID NO: 2341 - DNA, 22 bp, Artificial Sequence
  chemically synthesized
ttagacacggcaaaacccccgt

SEQ ID NO: 2342 - DNA, 22 bp, Artificial Sequence
  chemically synthesized
gacacggcaaaacccccgtcac

SEQ ID NO: 2343 - DNA, 22 bp, Artificial Sequence
  chemically synthesized
ccagtgctcagactagggaaga

SEQ ID NO: 2344 - DNA, 22 bp, Artificial Sequence
  chemically synthesized
cagtgctcagactagggaagag

SEQ ID NO: 2345 - DNA, 22 bp, Artificial Sequence
  chemically synthesized
agactagggaagaggttccagc

SEQ ID NO: 2346 - DNA, 22 bp, Artificial Sequence
  chemically synthesized
gggaagaggttccagcccctcc

SEQ ID NO: 2347 - DNA, 22 bp, Artificial Sequence
  chemically synthesized
cagcccctcctccttcagagcc

SEQ ID NO: 2348 - DNA, 22 bp, Artificial Sequence
  chemically synthesized
ctccttcagagccaggagtcct

SEQ ID NO: 2349 - DNA, 22 bp, Artificial Sequence
  chemically synthesized
cttcagagccaggagtcctggc

SEQ ID NO: 2350 - DNA, 22 bp, Artificial Sequence
  chemically synthesized
cagagccaggagtcctggcccc

SEQ ID NO: 2351 - DNA, 22 bp, Artificial Sequence
  chemically synthesized
agagccaggagtcctggccccc

SEQ ID NO: 2352 - DNA, 22 bp, Artificial Sequence
  chemically synthesized
gcccccagcccctcctgcctta

SEQ ID NO: 2353 - DNA, 22 bp, Artificial Sequence
  chemically synthesized
ctgccttaaacccagccaggtc

SEQ ID NO: 2354 - DNA, 22 bp, Artificial Sequence
  chemically synthesized
ccttaaacccagccaggtcctt

SEQ ID NO: 2355 - DNA, 22 bp, Artificial Sequence
  chemically synthesized
aaacccagccaggtccttccaa

SEQ ID NO: 2356 - DNA, 22 bp, Artificial Sequence
  chemically synthesized
aacccagccaggtccttccaag

SEQ ID NO: 2357 - DNA, 22 bp, Artificial Sequence
  chemically synthesized
ccaagggtcaagctcggaaacc

SEQ ID NO: 2358 - DNA, 22 bp, Artificial Sequence
  chemically synthesized
caagggtcaagctcggaaacca

SEQ ID NO: 2359 - DNA, 22 bp, Artificial Sequence
  chemically synthesized
ggaaaccaccccagcagatact

SEQ ID NO: 2360 - DNA, 22 bp, Artificial Sequence
  chemically synthesized
tgcaggaacgaagccgtgggcc

SEQ ID NO: 2361 - DNA, 22 bp, Artificial Sequence
  chemically synthesized
caggaacgaagccgtgggccca

SEQ ID NO: 2362 - DNA, 22 bp, Artificial Sequence
  chemically synthesized
tgcagggtggaggaaggccacc

SEQ ID NO: 2363 - DNA, 22 bp, Artificial Sequence
  chemically synthesized
tgctgggacagactcaggggcc

SEQ ID NO: 2364 - DNA, 22 bp, Artificial Sequence
  chemically synthesized
ggacagactcaggggcctgggc

SEQ ID NO: 2365 - DNA, 22 bp, Artificial Sequence
  chemically synthesized
aggggcctgggcgggactccca

SEQ ID NO: 2366 - DNA, 22 bp, Artificial Sequence
  chemically synthesized
ggcgggactcccagaggggtga

SEQ ID NO: 2367 - DNA, 22 bp, Artificial Sequence
  chemically synthesized
ccagaggggtgagacagctgca

SEQ ID NO: 2368 - DNA, 22 bp, Artificial Sequence
  chemically synthesized
cacacctgtgtgcctgggcccc

SEQ ID NO: 2369 - DNA, 22 bp, Artificial Sequence
  chemically synthesized
tgtgcctgggccccaggctgtc

SEQ ID NO: 2370 - DNA, 22 bp, Artificial Sequence
  chemically synthesized
ggccccaggctgtcacactcca

SEQ ID NO: 2371 - DNA, 22 bp, Artificial Sequence
  chemically synthesized
tcacactccagttcactgaggc

SEQ ID NO: 2372 - DNA, 22 bp, Artificial Sequence
  chemically synthesized
cagttcactgaggccccctctg

SEQ ID NO: 2373 - DNA, 22 bp, Artificial Sequence
  chemically synthesized
actgaggccccctctgcacggg

SEQ ID NO: 2374 - DNA, 22 bp, Artificial Sequence
  chemically synthesized
aggccccctctgcacggggccc

SEQ ID NO: 2375 - DNA, 22 bp, Artificial Sequence
  chemically synthesized
tgcacggggccctgcagccagg

SEQ ID NO: 2376 - DNA, 22 bp, Artificial Sequence
  chemically synthesized
cacggggccctgcagccagggg

SEQ ID NO: 2377 - DNA, 22 bp, Artificial Sequence
  chemically synthesized
cagccaggggctgacacgggcc

SEQ ID NO: 2378 - DNA, 22 bp, Artificial Sequence
  chemically synthesized
acacgggccaccgtttctcatt

SEQ ID NO: 2379 - DNA, 22 bp, Artificial Sequence
  chemically synthesized
ctcattcttcccttaggggtcc

SEQ ID NO: 2380 - DNA, 22 bp, Artificial Sequence
  chemically synthesized
tcattcttcccttaggggtcca

SEQ ID NO: 2381 - DNA, 22 bp, Artificial Sequence
  chemically synthesized
attcttcccttaggggtccaaa

SEQ ID NO: 2382 - DNA, 22 bp, Artificial Sequence
  chemically synthesized
ttcccttaggggtccaaaactt

SEQ ID NO: 2383 - DNA, 22 bp, Artificial Sequence
  chemically synthesized
cccttaggggtccaaaacttgg

SEQ ID NO: 2384 - DNA, 22 bp, Artificial Sequence
  chemically synthesized
ccttaggggtccaaaacttggg

SEQ ID NO: 2385 - DNA, 22 bp, Artificial Sequence
  chemically synthesized
aggggtccaaaacttgggggga

SEQ ID NO: 2386 - DNA, 22 bp, Artificial Sequence
  chemically synthesized
ggggtccaaaacttggggggac

SEQ ID NO: 2387 - DNA, 22 bp, Artificial Sequence
  chemically synthesized
ggggggacaaaagccgaagtcc

SEQ ID NO: 2388 - DNA, 22 bp, Artificial Sequence
  chemically synthesized
gggggacaaaagccgaagtcca

SEQ ID NO: 2389 - DNA, 22 bp, Artificial Sequence
  chemically synthesized
gccccaggccttgtggacactg

SEQ ID NO: 2390 - DNA, 22 bp, Artificial Sequence
  chemically synthesized
ccccaggccttgtggacactgg

SEQ ID NO: 2391 - DNA, 22 bp, Artificial Sequence
  chemically synthesized
gtggacactgggtgggctccgg

SEQ ID NO: 2392 - DNA, 22 bp, Artificial Sequence
  chemically synthesized
tggacactgggtgggctccggg

SEQ ID NO: 2393 - DNA, 22 bp, Artificial Sequence
  chemically synthesized
ggtgggctccgggacctgaact

SEQ ID NO: 2394 - DNA, 22 bp, Artificial Sequence
  chemically synthesized
cgggacctgaactggagctgag

SEQ ID NO: 2395 - DNA, 22 bp, Artificial Sequence
  chemically synthesized
aactggagctgaggaaggagtg

SEQ ID NO: 2396 - DNA, 22 bp, Artificial Sequence
  chemically synthesized
gagctgaggaaggagtgaagct

SEQ ID NO: 2397 - DNA, 22 bp, Artificial Sequence
  chemically synthesized
aggaaggagtgaagctaaactc

SEQ ID NO: 2398 - DNA, 22 bp, Artificial Sequence
  chemically synthesized
aactcctagatccacgggataa

SEQ ID NO: 2399 - DNA, 22 bp, Artificial Sequence
  chemically synthesized
ctagatccacgggataaattac

SEQ ID NO: 2400 - DNA, 22 bp, Artificial Sequence
  chemically synthesized
gatccacgggataaattacccc

SEQ ID NO: 2401 - DNA, 22 bp, Artificial Sequence
  chemically synthesized
ccccccaagtccctcacctctc

SEQ ID NO: 2402 - DNA, 22 bp, Artificial Sequence
  chemically synthesized
acctctccaaagctgcccatct

SEQ ID NO: 2403 - DNA, 22 bp, Artificial Sequence
  chemically synthesized
tccaaagctgcccatctggagg

SEQ ID NO: 2404 - DNA, 22 bp, Artificial Sequence
  chemically synthesized
caaagctgcccatctggaggag

SEQ ID NO: 2405 - DNA, 22 bp, Artificial Sequence
  chemically synthesized
cccatctggaggaggcgggagg

SEQ ID NO: 2406 - DNA, 22 bp, Artificial Sequence
  chemically synthesized
gaggaggcgggagggagctacg

SEQ ID NO: 2407 - DNA, 22 bp, Artificial Sequence
  chemically synthesized
cgagggccaagagcatgaggtc

SEQ ID NO: 2408 - DNA, 22 bp, Artificial Sequence
  chemically synthesized
gggctgtgaaggggccgcacgt

SEQ ID NO: 2409 - DNA, 22 bp, Artificial Sequence
  chemically synthesized
tgaaggggccgcacgtgccctg

SEQ ID NO: 2410 - DNA, 22 bp, Artificial Sequence
  chemically synthesized
ggaacgggatgaactcggctcg

SEQ ID NO: 2411 - DNA, 22 bp, Artificial Sequence
  chemically synthesized
ggctcgtttatttccacccagt

SEQ ID NO: 2412 - DNA, 22 bp, Artificial Sequence
  chemically synthesized
gtttatttccacccagttgtca

SEQ ID NO: 2413 - DNA, 22 bp, Artificial Sequence
  chemically synthesized
atttccacccagttgtcatggc

SEQ ID NO: 2414 - DNA, 22 bp, Artificial Sequence
  chemically synthesized
tttccacccagttgtcatggcg

SEQ ID NO: 2415 - DNA, 22 bp, Artificial Sequence
  chemically synthesized
ccacccagttgtcatggcgata

SEQ ID NO: 2416 - DNA, 22 bp, Artificial Sequence
  chemically synthesized
cacccagttgtcatggcgatag

SEQ ID NO: 2417 - DNA, 22 bp, Artificial Sequence
  chemically synthesized
tcatggcgataggggagggggg

SEQ ID NO: 2418 - DNA, 22 bp, Artificial Sequence
  chemically synthesized
tccctttcaaggacctgcccag

SEQ ID NO: 2419 - DNA, 22 bp, Artificial Sequence
  chemically synthesized
ccctttcaaggacctgcccagt

SEQ ID NO: 2420 - DNA, 22 bp, Artificial Sequence
  chemically synthesized
cctttcaaggacctgcccagta

SEQ ID NO: 2421 - DNA, 22 bp, Artificial Sequence
  chemically synthesized
tcaaggacctgcccagtacagg

SEQ ID NO: 2422 - DNA, 22 bp, Artificial Sequence
  chemically synthesized
caaggacctgcccagtacaggc

SEQ ID NO: 2423 - DNA, 22 bp, Artificial Sequence
  chemically synthesized
aaggacctgcccagtacaggca

SEQ ID NO: 2424 - DNA, 22 bp, Artificial Sequence
  chemically synthesized
cccagtacaggcatccctgtga

SEQ ID NO: 2425 - DNA, 22 bp, Artificial Sequence
  chemically synthesized
tgaaagatgcctgaggcctggg

SEQ ID NO: 2426 - DNA, 22 bp, Artificial Sequence
  chemically synthesized
aggcctgggcaccagggactcc

SEQ ID NO: 2427 - DNA, 22 bp, Artificial Sequence
  chemically synthesized
ggcaccagggactccagagtcc

SEQ ID NO: 2428 - DNA, 22 bp, Artificial Sequence
  chemically synthesized
cagagtccaggcccaacccctc

SEQ ID NO: 2429 - DNA, 22 bp, Artificial Sequence
  chemically synthesized
cccattcaacccaggaggccag

SEQ ID NO: 2430 - DNA, 22 bp, Artificial Sequence
  chemically synthesized
aacccaggaggccaggccccag

SEQ ID NO: 2431 - DNA, 22 bp, Artificial Sequence
  chemically synthesized
ccgccctcagatgaaggagtcc

SEQ ID NO: 2432 - DNA, 22 bp, Artificial Sequence
  chemically synthesized
cgccctcagatgaaggagtcca

SEQ ID NO: 2433 - DNA, 22 bp, Artificial Sequence
  chemically synthesized
agatgaaggagtccaggccccc

SEQ ID NO: 2434 - DNA, 22 bp, Artificial Sequence
  chemically synthesized
tccccattcagacccaggggtc

SEQ ID NO: 2435 - DNA, 22 bp, Artificial Sequence
  chemically synthesized
cccattcagacccaggggtcca

SEQ ID NO: 2436 - DNA, 22 bp, Artificial Sequence
  chemically synthesized
agacccaggggtccaggcccag

SEQ ID NO: 2437 - DNA, 22 bp, Artificial Sequence
  chemically synthesized
cctaagacccagaagtccaggc

SEQ ID NO: 2438 - DNA, 22 bp, Artificial Sequence
  chemically synthesized
agacccagaagtccaggccccc

SEQ ID NO: 2439 - DNA, 22 bp, Artificial Sequence
  chemically synthesized
ctccctcagacccacgagtcca

SEQ ID NO: 2440 - DNA, 22 bp, Artificial Sequence
  chemically synthesized
cctcagacccacgagtccaggc

SEQ ID NO: 2441 - DNA, 22 bp, Artificial Sequence
  chemically synthesized
agacccacgagtccaggcccca

SEQ ID NO: 2442 - DNA, 22 bp, Artificial Sequence
  chemically synthesized
ctccctcggacccaggagtcca

SEQ ID NO: 2443 - DNA, 22 bp, Artificial Sequence
  chemically synthesized
cctcggacccaggagtccaggc

SEQ ID NO: 2444 - DNA, 22 bp, Artificial Sequence
  chemically synthesized
ggacccaggagtccaggccccc

SEQ ID NO: 2445 - DNA, 22 bp, Artificial Sequence
  chemically synthesized
caccctcagacccaggagtcca

SEQ ID NO: 2446 - DNA, 22 bp, Artificial Sequence
  chemically synthesized
agacccaggagtccaggcccca

SEQ ID NO: 2447 - DNA, 22 bp, Artificial Sequence
  chemically synthesized
ctccctcggacccaggagtcca

SEQ ID NO: 2448 - DNA, 22 bp, Artificial Sequence
  chemically synthesized
cctcggacccaggagtccaggc

SEQ ID NO: 2449 - DNA, 22 bp, Artificial Sequence
  chemically synthesized
ggacccaggagtccaggcccca

SEQ ID NO: 2450 - DNA, 22 bp, Artificial Sequence
  chemically synthesized
ctctctcaaacccaggagccca

SEQ ID NO: 2451 - DNA, 22 bp, Artificial Sequence
  chemically synthesized
tctcaaacccaggagcccaggc

SEQ ID NO: 2452 - DNA, 22 bp, Artificial Sequence
  chemically synthesized
tcaaacccaggagcccaggccc

SEQ ID NO: 2453 - DNA, 22 bp, Artificial Sequence
  chemically synthesized
aaacccaggagcccaggccccc

SEQ ID NO: 2454 - DNA, 22 bp, Artificial Sequence
  chemically synthesized
ttctctgttcagccctaagaat

SEQ ID NO: 2455 - DNA, 22 bp, Artificial Sequence
  chemically synthesized
ctctgttcagccctaagaatcc

SEQ ID NO: 2456 - DNA, 22 bp, Artificial Sequence
  chemically synthesized
tctgttcagccctaagaatcct

SEQ ID NO: 2457 - DNA, 22 bp, Artificial Sequence
  chemically synthesized
tgttcagccctaagaatcctgg

SEQ ID NO: 2458 - DNA, 22 bp, Artificial Sequence
  chemically synthesized
ttcagccctaagaatcctggct

SEQ ID NO: 2459 - DNA, 22 bp, Artificial Sequence
  chemically synthesized
agccctaagaatcctggctcca

SEQ ID NO: 2460 - DNA, 22 bp, Artificial Sequence
  chemically synthesized
agaatcctggctccagcccctc

SEQ ID NO: 2461 - DNA, 22 bp, Artificial Sequence
  chemically synthesized
gctccagcccctcctactctag

SEQ ID NO: 2462 - DNA, 22 bp, Artificial Sequence
  chemically synthesized
cagcccctcctactctagcccc

SEQ ID NO: 2463 - DNA, 22 bp, Artificial Sequence
  chemically synthesized
ctactctagcccccaaccccct

SEQ ID NO: 2464 - DNA, 22 bp, Artificial Sequence
  chemically synthesized
ctctagcccccaaccccctagc

SEQ ID NO: 2465 - DNA, 22 bp, Artificial Sequence
  chemically synthesized
tagcccccaaccccctagccac

SEQ ID NO: 2466 - DNA, 22 bp, Artificial Sequence
  chemically synthesized
gcccccaaccccctagccacta

SEQ ID NO: 2467 - DNA, 22 bp, Artificial Sequence
  chemically synthesized
gccactaaggcaattggggtgc

SEQ ID NO: 2468 - DNA, 22 bp, Artificial Sequence
  chemically synthesized
aggcaattggggtgcaggaatg

SEQ ID NO: 2469 - DNA, 22 bp, Artificial Sequence
  chemically synthesized
gggtgcaggaatgggggcaggg

SEQ ID NO: 2470 - DNA, 22 bp, Artificial Sequence
  chemically synthesized
accaagtggttgataaacccac

SEQ ID NO: 2471 - DNA, 22 bp, Artificial Sequence
  chemically synthesized
ataaacccacgtggggtaccct

SEQ ID NO: 2472 - DNA, 22 bp, Artificial Sequence
  chemically synthesized
agaacttgggaacagccacagc

SEQ ID NO: 2473 - DNA, 22 bp, Artificial Sequence
  chemically synthesized
gggaacagccacagcagggggg

SEQ ID NO: 2474 - DNA, 22 bp, Artificial Sequence
  chemically synthesized
ggaacagccacagcaggggggc

SEQ ID NO: 2475 - DNA, 22 bp, Artificial Sequence
  chemically synthesized
ggggacctgcctggagaaggat

SEQ ID NO: 2476 - DNA, 22 bp, Artificial Sequence
  chemically synthesized
gggacctgcctggagaaggatg

SEQ ID NO: 2477 - DNA, 22 bp, Artificial Sequence
  chemically synthesized
cctggagaaggatgcaggacga

SEQ ID NO: 2478 - DNA, 22 bp, Artificial Sequence
  chemically synthesized
gagaaggatgcaggacgagaaa

SEQ ID NO: 2479 - DNA, 22 bp, Artificial Sequence
  chemically synthesized
gccgggaatcaagagtcaccca

SEQ ID NO: 2480 - DNA, 22 bp, Artificial Sequence
  chemically synthesized
ttttcctaggactgagggtttc

SEQ ID NO: 2481 - DNA, 22 bp, Artificial Sequence
  chemically synthesized
tcctaggactgagggtttcagt

SEQ ID NO: 2482 - DNA, 22 bp, Artificial Sequence
  chemically synthesized
cctaggactgagggtttcagtg

SEQ ID NO: 2483 - DNA, 22 bp, Artificial Sequence
  chemically synthesized
ctaggactgagggtttcagtgc

SEQ ID NO: 2484 - DNA, 22 bp, Artificial Sequence
  chemically synthesized
ggactgagggtttcagtgctaa

SEQ ID NO: 2485 - DNA, 22 bp, Artificial Sequence
  chemically synthesized
agggtttcagtgctaaaactag

SEQ ID NO: 2486 - DNA, 22 bp, Artificial Sequence
  chemically synthesized
cagtgctaaaactaggctgtcc

SEQ ID NO: 2487 - DNA, 22 bp, Artificial Sequence
  chemically synthesized
agtgctaaaactaggctgtcct

SEQ ID NO: 2488 - DNA, 22 bp, Artificial Sequence
  chemically synthesized
aaactaggctgtcctgggcaaa

SEQ ID NO: 2489 - DNA, 22 bp, Artificial Sequence
  chemically synthesized
ggctgtcctgggcaaacagcat

SEQ ID NO: 2490 - DNA, 22 bp, Artificial Sequence
  chemically synthesized
tcctgggcaaacagcataagct

SEQ ID NO: 2491 - DNA, 22 bp, Artificial Sequence
  chemically synthesized
ggcaaacagcataagctggtca

SEQ ID NO: 2492 - DNA, 22 bp, Artificial Sequence
  chemically synthesized
gtcaccccacacccagacctga

SEQ ID NO: 2493 - DNA, 22 bp, Artificial Sequence
  chemically synthesized
acccaaacccagctcccctgct

SEQ ID NO: 2494 - DNA, 22 bp, Artificial Sequence
  chemically synthesized
ccctgcttcttggccacgtaac

SEQ ID NO: 2495 - DNA, 22 bp, Artificial Sequence
  chemically synthesized
cttcttggccacgtaacctgag

SEQ ID NO: 2496 - DNA, 22 bp, Artificial Sequence
  chemically synthesized
cttggccacgtaacctgagaag

SEQ ID NO: 2497 - DNA, 22 bp, Artificial Sequence
  chemically synthesized
ttggccacgtaacctgagaagg

SEQ ID NO: 2498 - DNA, 22 bp, Artificial Sequence
  chemically synthesized
ggccacgtaacctgagaaggga

SEQ ID NO: 2499 - DNA, 22 bp, Artificial Sequence
  chemically synthesized
gccacgtaacctgagaagggaa

SEQ ID NO: 2500 - DNA, 22 bp, Artificial Sequence
  chemically synthesized
agaagggaatccctcctctctg

SEQ ID NO: 2501 - DNA, 22 bp, Artificial Sequence
  chemically synthesized
ctctctgaaccccagcccaccc

SEQ ID NO: 2502 - DNA, 22 bp, Artificial Sequence
  chemically synthesized
tctgaaccccagcccaccccaa

SEQ ID NO: 2503 - DNA, 22 bp, Artificial Sequence
  chemically synthesized
tgaaccccagcccaccccaatg

SEQ ID NO: 2504 - DNA, 22 bp, Artificial Sequence
  chemically synthesized
aaccccagcccaccccaatgct

SEQ ID NO: 2505 - DNA, 22 bp, Artificial Sequence
  chemically synthesized
caggcctcctgggataccccga

SEQ ID NO: 2506 - DNA, 22 bp, Artificial Sequence
  chemically synthesized
ctgggataccccgaagagtgag

SEQ ID NO: 2507 - DNA, 22 bp, Artificial Sequence
  chemically synthesized
ggataccccgaagagtgagttt

SEQ ID NO: 2508 - DNA, 22 bp, Artificial Sequence
  chemically synthesized
gccaagcagtcaccccacagtt

SEQ ID NO: 2509 - DNA, 22 bp, Artificial Sequence
  chemically synthesized
ccaagcagtcaccccacagttg

SEQ ID NO: 2510 - DNA, 22 bp, Artificial Sequence
  chemically synthesized
gaggagaatccacccaaaaggc

SEQ ID NO: 2511 - DNA, 22 bp, Artificial Sequence
  chemically synthesized
gtagacagggctggggtggcct

SEQ ID NO: 2512 - DNA, 22 bp, Artificial Sequence
  chemically synthesized
gggtggcctctcgtggggtcca

SEQ ID NO: 2513 - DNA, 22 bp, Artificial Sequence
  chemically synthesized
tcgtggggtccaggccaagtag

SEQ ID NO: 2514 - DNA, 22 bp, Artificial Sequence
  chemically synthesized
gtggggtccaggccaagtaggt

SEQ ID NO: 2515 - DNA, 22 bp, Artificial Sequence
  chemically synthesized
gggcctctgggggatgcagggg

SEQ ID NO: 2516 - DNA, 22 bp, Artificial Sequence
  chemically synthesized
tgggggatgcaggggaaggggg

SEQ ID NO: 2517 - DNA, 22 bp, Artificial Sequence
  chemically synthesized
ggggatgcaggggaagggggat

SEQ ID NO: 2518 - DNA, 22 bp, Artificial Sequence
  chemically synthesized
agtctgaagagcagagccagga

SEQ ID NO: 2519 - DNA, 22 bp, Artificial Sequence
  chemically synthesized
aagagcagagccaggaacccct

SEQ ID NO: 2520 - DNA, 22 bp, Artificial Sequence
  chemically synthesized
tagggaaggggcaggagagcca

SEQ ID NO: 2521 - DNA, 22 bp, Artificial Sequence
  chemically synthesized
agcgcctctcctgggcttgcca

SEQ ID NO: 2522 - DNA, 22 bp, Artificial Sequence
  chemically synthesized
tcctgggcttgccaaggactca

SEQ ID NO: 2523 - DNA, 22 bp, Artificial Sequence
  chemically synthesized
ctgggcttgccaaggactcaaa

SEQ ID NO: 2524 - DNA, 22 bp, Artificial Sequence
  chemically synthesized
ggcttgccaaggactcaaaccc

SEQ ID NO: 2525 - DNA, 22 bp, Artificial Sequence
  chemically synthesized
gccaaggactcaaacccagaag

SEQ ID NO: 2526 - DNA, 22 bp, Artificial Sequence
  chemically synthesized
ccaaggactcaaacccagaagc

SEQ ID NO: 2527 - DNA, 22 bp, Artificial Sequence
  chemically synthesized
aaacccagaagcccagagcagg

SEQ ID NO: 2528 - DNA, 22 bp, Artificial Sequence
  chemically synthesized
agggaagcgggaccctgctctg

SEQ ID NO: 2529 - DNA, 22 bp, Artificial Sequence
  chemically synthesized
gggaagcgggaccctgctctgg

SEQ ID NO: 2530 - DNA, 22 bp, Artificial Sequence
  chemically synthesized
ctctgggcggaggaatatgtcc

SEQ ID NO: 2531 - DNA, 22 bp, Artificial Sequence
  chemically synthesized
tgggcggaggaatatgtcccag

SEQ ID NO: 2532 - DNA, 22 bp, Artificial Sequence
  chemically synthesized
ggcggaggaatatgtcccagat

SEQ ID NO: 2533 - DNA, 22 bp, Artificial Sequence
  chemically synthesized
gggactctttaaggaaagaagg

SEQ ID NO: 2534 - DNA, 22 bp, Artificial Sequence
  chemically synthesized
tttaaggaaagaaggatggaga

SEQ ID NO: 2535 - DNA, 22 bp, Artificial Sequence
  chemically synthesized
taaggaaagaaggatggagaaa

SEQ ID NO: 2536 - DNA, 22 bp, Artificial Sequence
  chemically synthesized
aaggaaagaaggatggagaaag

SEQ ID NO: 2537 - DNA, 22 bp, Artificial Sequence
  chemically synthesized
aggaaagaaggatggagaaaga

SEQ ID NO: 2538 - DNA, 22 bp, Artificial Sequence
  chemically synthesized
gtgaacacctaggacgcaccat

SEQ ID NO: 2539 - DNA, 22 bp, Artificial Sequence
  chemically synthesized
ggacgcaccattctcacaaagg

SEQ ID NO: 2540 - DNA, 22 bp, Artificial Sequence
  chemically synthesized
tcacaaagggagttttccacac

SEQ ID NO: 2541 - DNA, 22 bp, Artificial Sequence
  chemically synthesized
acaaagggagttttccacacgg

SEQ ID NO: 2542 - DNA, 22 bp, Artificial Sequence
  chemically synthesized
tccacacggacacccccctcct

SEQ ID NO: 2543 - DNA, 22 bp, Artificial Sequence
  chemically synthesized
ccacacggacacccccctcctc

SEQ ID NO: 2544 - DNA, 22 bp, Artificial Sequence
  chemically synthesized
cacacggacacccccctcctca

SEQ ID NO: 2545 - DNA, 22 bp, Artificial Sequence
  chemically synthesized
ctcaccacagccctgccaggac

SEQ ID NO: 2546 - DNA, 22 bp, Artificial Sequence
  chemically synthesized
accacagccctgccaggacggg

SEQ ID NO: 2547 - DNA, 22 bp, Artificial Sequence
  chemically synthesized
ccaggacggggctggctactgg

SEQ ID NO: 2548 - DNA, 22 bp, Artificial Sequence
  chemically synthesized
gctactggccttatctcacagg

SEQ ID NO: 2549 - DNA, 22 bp, Artificial Sequence
  chemically synthesized
ctggccttatctcacaggtaaa

SEQ ID NO: 2550 - DNA, 22 bp, Artificial Sequence
  chemically synthesized
gccttatctcacaggtaaaact

SEQ ID NO: 2551 - DNA, 22 bp, Artificial Sequence
  chemically synthesized
atctcacaggtaaaactgacgc

SEQ ID NO: 2552 - DNA, 22 bp, Artificial Sequence
  chemically synthesized
tctcacaggtaaaactgacgca

SEQ ID NO: 2553 - DNA, 22 bp, Artificial Sequence
  chemically synthesized
acaggtaaaactgacgcacgga

SEQ ID NO: 2554 - DNA, 22 bp, Artificial Sequence
  chemically synthesized
acgcacggaggaacaatataaa

SEQ ID NO: 2555 - DNA, 22 bp, Artificial Sequence
  chemically synthesized
gggactagaaaggtgaagagcc

SEQ ID NO: 2556 - DNA, 22 bp, Artificial Sequence
  chemically synthesized
gaaaggtgaagagccaaagtta

SEQ ID NO: 2557 - DNA, 22 bp, Artificial Sequence
  chemically synthesized
gaactcaggaccaacttattct

SEQ ID NO: 2558 - DNA, 22 bp, Artificial Sequence
  chemically synthesized
aggaccaacttattctgatttt

SEQ ID NO: 2559 - DNA, 22 bp, Artificial Sequence
  chemically synthesized
attctgattttgtttttccaaa

SEQ ID NO: 2560 - DNA, 22 bp, Artificial Sequence
  chemically synthesized
ttctgattttgtttttccaaac

SEQ ID NO: 2561 - DNA, 22 bp, Artificial Sequence
  chemically synthesized
tgattttgtttttccaaactgc

SEQ ID NO: 2562 - DNA, 22 bp, Artificial Sequence
  chemically synthesized
attttgtttttccaaactgctt

SEQ ID NO: 2563 - DNA, 22 bp, Artificial Sequence
  chemically synthesized
tgtttttccaaactgcttctcc

SEQ ID NO: 2564 - DNA, 22 bp, Artificial Sequence
  chemically synthesized
gtttttccaaactgcttctcct

SEQ ID NO: 2565 - DNA, 22 bp, Artificial Sequence
  chemically synthesized
tttttccaaactgcttctcctc

SEQ ID NO: 2566 - DNA, 22 bp, Artificial Sequence
  chemically synthesized
ttccaaactgcttctcctcttg

SEQ ID NO: 2567 - DNA, 22 bp, Artificial Sequence
  chemically synthesized
tccaaactgcttctcctcttgg

SEQ ID NO: 2568 - DNA, 22 bp, Artificial Sequence
  chemically synthesized
ccaaactgcttctcctcttggg

SEQ ID NO: 2569 - DNA, 22 bp, Artificial Sequence
  chemically synthesized
caaactgcttctcctcttggga

SEQ ID NO: 2570 - DNA, 22 bp, Artificial Sequence
  chemically synthesized
cttctcctcttgggaagtgtaa

SEQ ID NO: 2571 - DNA, 22 bp, Artificial Sequence
  chemically synthesized
ctcctcttgggaagtgtaagga

SEQ ID NO: 2572 - DNA, 22 bp, Artificial Sequence
  chemically synthesized
tcctcttgggaagtgtaaggaa

SEQ ID NO: 2573 - DNA, 22 bp, Artificial Sequence
  chemically synthesized
ctcttgggaagtgtaaggaagc

SEQ ID NO: 2574 - DNA, 22 bp, Artificial Sequence
  chemically synthesized
ttgggaagtgtaaggaagctgc

SEQ ID NO: 2575 - DNA, 22 bp, Artificial Sequence
  chemically synthesized
gggaagtgtaaggaagctgcag

SEQ ID NO: 2576 - DNA, 22 bp, Artificial Sequence
  chemically synthesized
ggaagtgtaaggaagctgcagc

SEQ ID NO: 2577 - DNA, 22 bp, Artificial Sequence
  chemically synthesized
cagcaccaggatcagtgaaacg

SEQ ID NO: 2578 - DNA, 22 bp, Artificial Sequence
  chemically synthesized
aggttctgggagagggtagcgc

SEQ ID NO: 2579 - DNA, 22 bp, Artificial Sequence
  chemically synthesized
tgggagagggtagcgcagggtg

SEQ ID NO: 2580 - DNA, 22 bp, Artificial Sequence
  chemically synthesized
ggagagggtagcgcagggtggc

SEQ ID NO: 2581 - DNA, 22 bp, Artificial Sequence
  chemically synthesized
agaaccgggcaggtcacgcatc

SEQ ID NO: 2582 - DNA, 22 bp, Artificial Sequence
  chemically synthesized
ccctcccaccccctgccaagct

SEQ ID NO: 2583 - DNA, 22 bp, Artificial Sequence
  chemically synthesized
cctcccaccccctgccaagctc

SEQ ID NO: 2584 - DNA, 22 bp, Artificial Sequence
  chemically synthesized
ccaccccctgccaagctctccc

SEQ ID NO: 2585 - DNA, 22 bp, Artificial Sequence
  chemically synthesized
ccaagctctccctcccaggatc

SEQ ID NO: 2586 - DNA, 22 bp, Artificial Sequence
  chemically synthesized
tccctcccaggatcctctctgg

SEQ ID NO: 2587 - DNA, 22 bp, Artificial Sequence
  chemically synthesized
cctcccaggatcctctctggct

SEQ ID NO: 2588 - DNA, 22 bp, Artificial Sequence
  chemically synthesized
ccaggatcctctctggctccat

SEQ ID NO: 2589 - DNA, 22 bp, Artificial Sequence
  chemically synthesized
tctggctccatcgtaagcaaac

SEQ ID NO: 2590 - DNA, 22 bp, Artificial Sequence
  chemically synthesized
tggctccatcgtaagcaaacct

SEQ ID NO: 2591 - DNA, 22 bp, Artificial Sequence
  chemically synthesized
gctccatcgtaagcaaacctta

SEQ ID NO: 2592 - DNA, 22 bp, Artificial Sequence
  chemically synthesized
catcgtaagcaaaccttagagg

SEQ ID NO: 2593 - DNA, 22 bp, Artificial Sequence
  chemically synthesized
agaggttctggcaaggagagag

SEQ ID NO: 2594 - DNA, 22 bp, Artificial Sequence
  chemically synthesized
gaggttctggcaaggagagaga

SEQ ID NO: 2595 - DNA, 22 bp, Artificial Sequence
  chemically synthesized
tggcaaggagagagatggctcc

SEQ ID NO: 2596 - DNA, 22 bp, Artificial Sequence
  chemically synthesized
gcaaggagagagatggctccag

SEQ ID NO: 2597 - DNA, 22 bp, Artificial Sequence
  chemically synthesized
caggaaatgggggtgtgtcacc

SEQ ID NO: 2598 - DNA, 22 bp, Artificial Sequence
  chemically synthesized
cctaacaggaggtgggggttag

SEQ ID NO: 2599 - DNA, 22 bp, Artificial Sequence
  chemically synthesized
acaggaggtgggggttagaccc

SEQ ID NO: 2600 - DNA, 22 bp, Artificial Sequence
  chemically synthesized
gacccaatatcaggagactagg

SEQ ID NO: 2601 - DNA, 22 bp, Artificial Sequence
  chemically synthesized
ggaaggaggaggcctaaggatg

SEQ ID NO: 2602 - DNA, 22 bp, Artificial Sequence
  chemically synthesized
aggatggggcttttctgtcacc

SEQ ID NO: 2603 - DNA, 22 bp, Artificial Sequence
  chemically synthesized
ttctgtcaccaatcctgtccct

SEQ ID NO: 2604 - DNA, 22 bp, Artificial Sequence
  chemically synthesized
tctgtcaccaatcctgtcccta

SEQ ID NO: 2605 - DNA, 22 bp, Artificial Sequence
  chemically synthesized
ctgtcaccaatcctgtccctag

SEQ ID NO: 2606 - DNA, 22 bp, Artificial Sequence
  chemically synthesized
tgtcaccaatcctgtccctagt

SEQ ID NO: 2607 - DNA, 22 bp, Artificial Sequence
  chemically synthesized
tcaccaatcctgtccctagtgg

SEQ ID NO: 2608 - DNA, 22 bp, Artificial Sequence
  chemically synthesized
tccctagtggccccactgtggg

SEQ ID NO: 2609 - DNA, 22 bp, Artificial Sequence
  chemically synthesized
gtggccccactgtggggtggag

SEQ ID NO: 2610 - DNA, 22 bp, Artificial Sequence
  chemically synthesized
tggggtggaggggacagataaa

SEQ ID NO: 2611 - DNA, 22 bp, Artificial Sequence
  chemically synthesized
accggccctgggaatataaggt

SEQ ID NO: 2612 - DNA, 22 bp, Artificial Sequence
  chemically synthesized
ggaatataaggtggtcccagct

SEQ ID NO: 2613 - DNA, 22 bp, Artificial Sequence
  chemically synthesized
ggggacacaggatccctggagg

SEQ ID NO: 2614 - DNA, 22 bp, Artificial Sequence
  chemically synthesized
gaggcagcaaacatgctgtcct

SEQ ID NO: 2615 - DNA, 22 bp, Artificial Sequence
  chemically synthesized
tcctgaagtggacataggggcc

SEQ ID NO: 2616 - DNA, 22 bp, Artificial Sequence
  chemically synthesized
aagtggacataggggcccgggt

SEQ ID NO: 2617 - DNA, 22 bp, Artificial Sequence
  chemically synthesized
gaggaagaagactagctgagct

SEQ ID NO: 2618 - DNA, 22 bp, Artificial Sequence
  chemically synthesized
gctgagctctcggacccctgga

SEQ ID NO: 2619 - DNA, 22 bp, Artificial Sequence
  chemically synthesized
agctctcggacccctggaagat

SEQ ID NO: 2620 - DNA, 22 bp, Artificial Sequence
  chemically synthesized
tcggacccctggaagatgccat

SEQ ID NO: 2621 - DNA, 22 bp, Artificial Sequence
  chemically synthesized
ggacccctggaagatgccatga

SEQ ID NO: 2622 - DNA, 22 bp, Artificial Sequence
  chemically synthesized
gaagatgccatgacagggggct

SEQ ID NO: 2623 - DNA, 22 bp, Artificial Sequence
  chemically synthesized
gaagagctagcacagactagag

SEQ ID NO: 2624 - DNA, 22 bp, Artificial Sequence
  chemically synthesized
gcacagactagagaggtaaggg

SEQ ID NO: 2625 - DNA, 22 bp, Artificial Sequence
  chemically synthesized
gagaggtaaggggggtagggga

SEQ ID NO: 2626 - DNA, 22 bp, Artificial Sequence
  chemically synthesized
cccaaatgaaaggagtgagagg

SEQ ID NO: 2627 - DNA, 22 bp, Artificial Sequence
  chemically synthesized
aagccagggagacggggtactt

SEQ ID NO: 2628 - DNA, 22 bp, Artificial Sequence
  chemically synthesized
tggggttgtccagaaaaacggt

SEQ ID NO: 2629 - DNA, 22 bp, Artificial Sequence
  chemically synthesized
ggggttgtccagaaaaacggtg

SEQ ID NO: 2630 - DNA, 22 bp, Artificial Sequence
  chemically synthesized
gggttgtccagaaaaacggtga

SEQ ID NO: 2631 - DNA, 22 bp, Artificial Sequence
  chemically synthesized
tccagaaaaacggtgatgatgc

SEQ ID NO: 2632 - DNA, 22 bp, Artificial Sequence
  chemically synthesized
caagaaggggaggcgggacgca

SEQ ID NO: 2633 - DNA, 22 bp, Artificial Sequence
  chemically synthesized
agaaacgagagatggcacaggc

SEQ ID NO: 2634 - DNA, 22 bp, Artificial Sequence
  chemically synthesized
ggtgagggaggagagatgcccg

SEQ ID NO: 2635 - DNA, 22 bp, Artificial Sequence
  chemically synthesized
agaggacatcacgtggtgcagc

SEQ ID NO: 2636 - DNA, 22 bp, Artificial Sequence
  chemically synthesized
cggaaagagcatccttgggcag

SEQ ID NO: 2637 - DNA, 22 bp, Artificial Sequence
  chemically synthesized
gggcagcaacacagcagagagc

SEQ ID NO: 2638 - DNA, 22 bp, Artificial Sequence
  chemically synthesized
ggcagcaacacagcagagagca

SEQ ID NO: 2639 - DNA, 22 bp, Artificial Sequence
  chemically synthesized
aaggaggcggcagggaaggatc

SEQ ID NO: 2640 - DNA, 22 bp, Artificial Sequence
  chemically synthesized
ggccagccgtagaggtgaccca

SEQ ID NO: 2641 - DNA, 22 bp, Artificial Sequence
  chemically synthesized
cagacagaaagcggcacaggcc

SEQ ID NO: 2642 - DNA, 22 bp, Artificial Sequence
  chemically synthesized
cctgggaaggggaaacagtggg

SEQ ID NO: 2643 - DNA, 22 bp, Artificial Sequence
  chemically synthesized
ggaaggggaaacagtgggccag

SEQ ID NO: 2644 - DNA, 22 bp, Artificial Sequence
  chemically synthesized
aaagtggtccggactcaggaga

SEQ ID NO: 2645 - DNA, 22 bp, Artificial Sequence
  chemically synthesized
aggagagagacggcagcgttag

SEQ ID NO: 2646 - DNA, 22 bp, Artificial Sequence
  chemically synthesized
gagggcagagttccggcggcac

SEQ ID NO: 2647 - DNA, 22 bp, Artificial Sequence
  chemically synthesized
cggcggcacagcaagggcactc

SEQ ID NO: 2648 - DNA, 22 bp, Artificial Sequence
  chemically synthesized
gggggcgagaggagggcagcgc

SEQ ID NO: 2649 - DNA, 22 bp, Artificial Sequence
  chemically synthesized
agctatgggagctggctcaggt

SEQ ID NO: 2650 - DNA, 22 bp, Artificial Sequence
  chemically synthesized
tgggagctggctcaggttcagg

SEQ ID NO: 2651 - DNA, 22 bp, Artificial Sequence
  chemically synthesized
gctcaggttcaggagagggcag

SEQ ID NO: 2652 - DNA, 22 bp, Artificial Sequence
  chemically synthesized
aggttcaggagagggcagggca

SEQ ID NO: 2653 - DNA, 22 bp, Artificial Sequence
  chemically synthesized
aggagagggcagggcagggaag

SEQ ID NO: 2654 - DNA, 22 bp, Artificial Sequence
  chemically synthesized
gaggggctcaacatcggaagag

SEQ ID NO: 2655 - DNA, 22 bp, Artificial Sequence
  chemically synthesized
aacatcggaagaggggaagtcg

SEQ ID NO: 2656 - DNA, 22 bp, Artificial Sequence
  chemically synthesized
catgggtcagcacaggctgcca

SEQ ID NO: 2657 - DNA, 22 bp, Artificial Sequence
  chemically synthesized
ccaaagccagggccagttaaag

SEQ ID NO: 2658 - DNA, 22 bp, Artificial Sequence
  chemically synthesized
aagcgactccaatgcggaagag

SEQ ID NO: 2659 - DNA, 22 bp, Artificial Sequence
  chemically synthesized
caatgcggaagagagtaggtcg

SEQ ID NO: 2660 - DNA, 22 bp, Artificial Sequence
  chemically synthesized
gggcagagtggtcagcacagag

SEQ ID NO: 2661 - DNA, 22 bp, Artificial Sequence
  chemically synthesized
agcccagggccagttgaagcgg

SEQ ID NO: 2662 - DNA, 22 bp, Artificial Sequence
  chemically synthesized
aagcggctccaattcggaagtg

SEQ ID NO: 2663 - DNA, 22 bp, Artificial Sequence
  chemically synthesized
caattcggaagtggggtggtcg

SEQ ID NO: 2664 - DNA, 22 bp, Artificial Sequence
  chemically synthesized
ggaagtggggtggtcgaagggg

SEQ ID NO: 2665 - DNA, 22 bp, Artificial Sequence
  chemically synthesized
ggacggggtgtcagcatagggt

SEQ ID NO: 2666 - DNA, 22 bp, Artificial Sequence
  chemically synthesized
gcaacggggaaggaggatgccc

SEQ ID NO: 2667 - DNA, 22 bp, Artificial Sequence
  chemically synthesized
gccccgggagacgccgggcggg

SEQ ID NO: 2668 - DNA, 22 bp, Artificial Sequence
  chemically synthesized
acctggtgcagggcgctgatac

SEQ ID NO: 2669 - DNA, 22 bp, Artificial Sequence
  chemically synthesized
gtgcagggcgctgataccgtcg

SEQ ID NO: 2670 - DNA, 22 bp, Artificial Sequence
  chemically synthesized
ataccgtcggcgttggtggagt

SEQ ID NO: 2671 - DNA, 22 bp, Artificial Sequence
  chemically synthesized
gtggagtccagcacggcgcggg

SEQ ID NO: 2672 - DNA, 22 bp, Artificial Sequence
  chemically synthesized
ggcgccggggccagggtcggcg

SEQ ID NO: 2673 - DNA, 22 bp, Artificial Sequence
  chemically synthesized
gtccaggtcgccgcccgcacag

SEQ ID NO: 2674 - DNA, 22 bp, Artificial Sequence
  chemically synthesized
ggcggcgcgctcgaagcggacg

SEQ ID NO: 2675 - DNA, 22 bp, Artificial Sequence
  chemically synthesized
gaagcggacggtgcgggcgcgg

SEQ ID NO: 2676 - DNA, 22 bp, Artificial Sequence
  chemically synthesized
tccggggccaggctcggcgccc

SEQ ID NO: 2677 - DNA, 22 bp, Artificial Sequence
  chemically synthesized
cggggccaggctcggcgcccgc

SEQ ID NO: 2678 - DNA, 22 bp, Artificial Sequence
  chemically synthesized
ggcgcccgcccgcgccccccac

SEQ ID NO: 2679 - DNA, 22 bp, Artificial Sequence
  chemically synthesized
ccgcagctgctcccgtcgccgc

SEQ ID NO: 2680 - DNA, 22 bp, Artificial Sequence
  chemically synthesized
ctcccgtcgccgctcccgggca

SEQ ID NO: 2681 - DNA, 22 bp, Artificial Sequence
  chemically synthesized
ccgtcgccgctcccgggcagcc

SEQ ID NO: 2682 - DNA, 22 bp, Artificial Sequence
  chemically synthesized
ccgggcagccgccgccgccgcc

SEQ ID NO: 2683 - DNA, 22 bp, Artificial Sequence
  chemically synthesized
tccggacatcgcaccgcccgcc

SEQ ID NO: 2684 - DNA, 22 bp, Artificial Sequence
  chemically synthesized
cggacatcgcaccgcccgcccg

SEQ ID NO: 2685 - DNA, 22 bp, Artificial Sequence
  chemically synthesized
gggctcggcgctcgctcgctcg

SEQ ID NO: 2686 - DNA, 22 bp, Artificial Sequence
  chemically synthesized
ggcgctcgctcgctcgctgggc

SEQ ID NO: 2687 - DNA, 22 bp, Artificial Sequence
  chemically synthesized
gctcgctcgctgggcgggcggg

SEQ ID NO: 2688 - DNA, 22 bp, Artificial Sequence
  chemically synthesized
gctcgctgggcgggcgggcggt

SEQ ID NO: 2689 - DNA, 22 bp, Artificial Sequence
  chemically synthesized
gctgggcgggcgggcggtgcga

SEQ ID NO: 2690 - DNA, 22 bp, Artificial Sequence
  chemically synthesized
ggcgggcgggcggtgcgatgtc

SEQ ID NO: 2691 - DNA, 22 bp, Artificial Sequence
  chemically synthesized
gcccgggggcggcggcggcggc

SEQ ID NO: 2692 - DNA, 22 bp, Artificial Sequence
  chemically synthesized
cccgggagcggcgacgggagca

SEQ ID NO: 2693 - DNA, 22 bp, Artificial Sequence
  chemically synthesized
cggcagtggggggcgcgggcgg

SEQ ID NO: 2694 - DNA, 22 bp, Artificial Sequence
  chemically synthesized
gccccggagagcgccgcgcccg

SEQ ID NO: 2695 - DNA, 22 bp, Artificial Sequence
  chemically synthesized
cgagcgcgccgccgagttcctg

SEQ ID NO: 2696 - DNA, 22 bp, Artificial Sequence
  chemically synthesized
gagcgcgccgccgagttcctgg

SEQ ID NO: 2697 - DNA, 22 bp, Artificial Sequence
  chemically synthesized
ctggcggcctgtgcgggcggcg

SEQ ID NO: 2698 - DNA, 22 bp, Artificial Sequence
  chemically synthesized
gcggcctgtgcgggcggcgacc

SEQ ID NO: 2699 - DNA, 22 bp, Artificial Sequence
  chemically synthesized
tgcgggcggcgacctggacgag

SEQ ID NO: 2700 - DNA, 22 bp, Artificial Sequence
  chemically synthesized
gacgaggcgcgtctgatgctgc

SEQ ID NO: 2701 - DNA, 22 bp, Artificial Sequence
  chemically synthesized
atgctgcgcgccgccgaccctg

SEQ ID NO: 2702 - DNA, 22 bp, Artificial Sequence
  chemically synthesized
cgcgccgccgaccctggccccg

SEQ ID NO: 2703 - DNA, 22 bp, Artificial Sequence
  chemically synthesized
gccccggcgccgagctcgaccc

SEQ ID NO: 2704 - DNA, 22 bp, Artificial Sequence
  chemically synthesized
gaccccgccgcgccgccgcccg

SEQ ID NO: 2705 - DNA, 22 bp, Artificial Sequence
  chemically synthesized
gactccaccaacgccgacggta

SEQ ID NO: 2706 - DNA, 22 bp, Artificial Sequence
  chemically synthesized
caccaacgccgacggtatcagc

SEQ ID NO: 2707 - DNA, 22 bp, Artificial Sequence
  chemically synthesized
caccaggtcagcgccccccgcc

SEQ ID NO: 2708 - DNA, 22 bp, Artificial Sequence
  chemically synthesized
ccggggccaggtccaccctctg

SEQ ID NO: 2709 - DNA, 22 bp, Artificial Sequence
  chemically synthesized
tgctgcgccacctggggcatcc

SEQ ID NO: 2710 - DNA, 22 bp, Artificial Sequence
  chemically synthesized
ctgcgccacctggggcatcctc

SEQ ID NO: 2711 - DNA, 22 bp, Artificial Sequence
  chemically synthesized
cgccacctggggcatcctcctt

SEQ ID NO: 2712 - DNA, 22 bp, Artificial Sequence
  chemically synthesized
gggcatcctccttccccgttgc

SEQ ID NO: 2713 - DNA, 22 bp, Artificial Sequence
  chemically synthesized
cttccccgttgccagtctcgat

SEQ ID NO: 2714 - DNA, 22 bp, Artificial Sequence
  chemically synthesized
ccccgttgccagtctcgatccg

SEQ ID NO: 2715 - DNA, 22 bp, Artificial Sequence
  chemically synthesized
cccgttgccagtctcgatccgc

SEQ ID NO: 2716 - DNA, 22 bp, Artificial Sequence
  chemically synthesized
ccagtctcgatccgccccgtcg

SEQ ID NO: 2717 - DNA, 22 bp, Artificial Sequence
  chemically synthesized
gatccgccccgtcgttcctggc

SEQ ID NO: 2718 - DNA, 22 bp, Artificial Sequence
  chemically synthesized
ctggccctgggctttgccaccc

SEQ ID NO: 2719 - DNA, 22 bp, Artificial Sequence
  chemically synthesized
gccctgggctttgccaccctat

SEQ ID NO: 2720 - DNA, 22 bp, Artificial Sequence
  chemically synthesized
ggctttgccaccctatgctgac

SEQ ID NO: 2721 - DNA, 22 bp, Artificial Sequence
  chemically synthesized
tgccaccctatgctgacacccc

SEQ ID NO: 2722 - DNA, 22 bp, Artificial Sequence
  chemically synthesized
gccaccctatgctgacaccccg

SEQ ID NO: 2723 - DNA, 22 bp, Artificial Sequence
  chemically synthesized
ccaccctatgctgacaccccgt

SEQ ID NO: 2724 - DNA, 22 bp, Artificial Sequence
  chemically synthesized
tgctgacaccccgtcccagtcc

SEQ ID NO: 2725 - DNA, 22 bp, Artificial Sequence
  chemically synthesized
acaccccgtcccagtccccctt

SEQ ID NO: 2726 - DNA, 22 bp, Artificial Sequence
  chemically synthesized
accattccccttcgaccacccc

SEQ ID NO: 2727 - DNA, 22 bp, Artificial Sequence
  chemically synthesized
ccattccccttcgaccacccca

SEQ ID NO: 2728 - DNA, 22 bp, Artificial Sequence
  chemically synthesized
cccttcgaccaccccacttccg

SEQ ID NO: 2729 - DNA, 22 bp, Artificial Sequence
  chemically synthesized
cgaccaccccacttccgaattg

SEQ ID NO: 2730 - DNA, 22 bp, Artificial Sequence
  chemically synthesized
gaccaccccacttccgaattgg

SEQ ID NO: 2731 - DNA, 22 bp, Artificial Sequence
  chemically synthesized
ccgaattggagccgcttcaact

SEQ ID NO: 2732 - DNA, 22 bp, Artificial Sequence
  chemically synthesized
cgaattggagccgcttcaactg

SEQ ID NO: 2733 - DNA, 22 bp, Artificial Sequence
  chemically synthesized
gagccgcttcaactggccctgg

SEQ ID NO: 2734 - DNA, 22 bp, Artificial Sequence
  chemically synthesized
caactggccctgggcttagcca

SEQ ID NO: 2735 - DNA, 22 bp, Artificial Sequence
  chemically synthesized
aactggccctgggcttagccac

SEQ ID NO: 2736 - DNA, 22 bp, Artificial Sequence
  chemically synthesized
gccctgggcttagccactctgt

SEQ ID NO: 2737 - DNA, 22 bp, Artificial Sequence
  chemically synthesized
ggcttagccactctgtgctgac

SEQ ID NO: 2738 - DNA, 22 bp, Artificial Sequence
  chemically synthesized
agccactctgtgctgaccactc

SEQ ID NO: 2739 - DNA, 22 bp, Artificial Sequence
  chemically synthesized
gccactctgtgctgaccactct

SEQ ID NO: 2740 - DNA, 22 bp, Artificial Sequence
  chemically synthesized
tgtgctgaccactctgccccag

SEQ ID NO: 2741 - DNA, 22 bp, Artificial Sequence
  chemically synthesized
tgctgaccactctgccccaggc

SEQ ID NO: 2742 - DNA, 22 bp, Artificial Sequence
  chemically synthesized
accactctgccccaggcctcct

SEQ ID NO: 2743 - DNA, 22 bp, Artificial Sequence
  chemically synthesized
tgccccaggcctccttaccatt

SEQ ID NO: 2744 - DNA, 22 bp, Artificial Sequence
  chemically synthesized
ccccaggcctccttaccattcc

SEQ ID NO: 2745 - DNA, 22 bp, Artificial Sequence
  chemically synthesized
cttaccattccccttcgaccta

SEQ ID NO: 2746 - DNA, 22 bp, Artificial Sequence
  chemically synthesized
accattccccttcgacctactc

SEQ ID NO: 2747 - DNA, 22 bp, Artificial Sequence
  chemically synthesized
ccattccccttcgacctactct

SEQ ID NO: 2748 - DNA, 22 bp, Artificial Sequence
  chemically synthesized
cccttcgacctactctcttccg

SEQ ID NO: 2749 - DNA, 22 bp, Artificial Sequence
  chemically synthesized
cgacctactctcttccgcattg

SEQ ID NO: 2750 - DNA, 22 bp, Artificial Sequence
  chemically synthesized
gacctactctcttccgcattgg

SEQ ID NO: 2751 - DNA, 22 bp, Artificial Sequence
  chemically synthesized
ctctcttccgcattggagtcgc

SEQ ID NO: 2752 - DNA, 22 bp, Artificial Sequence
  chemically synthesized
tcttccgcattggagtcgcttt

SEQ ID NO: 2753 - DNA, 22 bp, Artificial Sequence
  chemically synthesized
ttccgcattggagtcgctttaa

SEQ ID NO: 2754 - DNA, 22 bp, Artificial Sequence
  chemically synthesized
ccgcattggagtcgctttaact

SEQ ID NO: 2755 - DNA, 22 bp, Artificial Sequence
  chemically synthesized
cgcattggagtcgctttaactg

SEQ ID NO: 2756 - DNA, 22 bp, Artificial Sequence
  chemically synthesized
gagtcgctttaactggccctgg

SEQ ID NO: 2757 - DNA, 22 bp, Artificial Sequence
  chemically synthesized
taactggccctggctttggcag

SEQ ID NO: 2758 - DNA, 22 bp, Artificial Sequence
  chemically synthesized
aactggccctggctttggcagc

SEQ ID NO: 2759 - DNA, 22 bp, Artificial Sequence
  chemically synthesized
actggccctggctttggcagcc

SEQ ID NO: 2760 - DNA, 22 bp, Artificial Sequence
  chemically synthesized
gccctggctttggcagcctgtg

SEQ ID NO: 2761 - DNA, 22 bp, Artificial Sequence
  chemically synthesized
gctttggcagcctgtgctgacc

SEQ ID NO: 2762 - DNA, 22 bp, Artificial Sequence
  chemically synthesized
tggcagcctgtgctgacccatg

SEQ ID NO: 2763 - DNA, 22 bp, Artificial Sequence
  chemically synthesized
ggcagcctgtgctgacccatgc

SEQ ID NO: 2764 - DNA, 22 bp, Artificial Sequence
  chemically synthesized
gcagcctgtgctgacccatgca

SEQ ID NO: 2765 - DNA, 22 bp, Artificial Sequence
  chemically synthesized
tgctgacccatgcagtcctcct

SEQ ID NO: 2766 - DNA, 22 bp, Artificial Sequence
  chemically synthesized
acccatgcagtcctccttacca

SEQ ID NO: 2767 - DNA, 22 bp, Artificial Sequence
  chemically synthesized
cttaccatccctccctcgactt

SEQ ID NO: 2768 - DNA, 22 bp, Artificial Sequence
  chemically synthesized
accatccctccctcgacttccc

SEQ ID NO: 2769 - DNA, 22 bp, Artificial Sequence
  chemically synthesized
ccatccctccctcgacttcccc

SEQ ID NO: 2770 - DNA, 22 bp, Artificial Sequence
  chemically synthesized
cctcgacttcccctcttccgat

SEQ ID NO: 2771 - DNA, 22 bp, Artificial Sequence
  chemically synthesized
gacttcccctcttccgatgttg

SEQ ID NO: 2772 - DNA, 22 bp, Artificial Sequence
  chemically synthesized
cccctcttccgatgttgagccc

SEQ ID NO: 2773 - DNA, 22 bp, Artificial Sequence
  chemically synthesized
ccctcttccgatgttgagcccc

SEQ ID NO: 2774 - DNA, 22 bp, Artificial Sequence
  chemically synthesized
ttccgatgttgagcccctccag

SEQ ID NO: 2775 - DNA, 22 bp, Artificial Sequence
  chemically synthesized
ccgatgttgagcccctccagcc

SEQ ID NO: 2776 - DNA, 22 bp, Artificial Sequence
  chemically synthesized
cgatgttgagcccctccagccg

SEQ ID NO: 2777 - DNA, 22 bp, Artificial Sequence
  chemically synthesized
agcccctccagccggtcctgga

SEQ ID NO: 2778 - DNA, 22 bp, Artificial Sequence
  chemically synthesized
cagccggtcctggactttgtct

SEQ ID NO: 2779 - DNA, 22 bp, Artificial Sequence
  chemically synthesized
gactttgtctccttccctgccc

SEQ ID NO: 2780 - DNA, 22 bp, Artificial Sequence
  chemically synthesized
tgtctccttccctgccctgccc

SEQ ID NO: 2781 - DNA, 22 bp, Artificial Sequence
  chemically synthesized
gtctccttccctgccctgccct

SEQ ID NO: 2782 - DNA, 22 bp, Artificial Sequence
  chemically synthesized
tctccttccctgccctgccctc

SEQ ID NO: 2783 - DNA, 22 bp, Artificial Sequence
  chemically synthesized
cttccctgccctgccctctcct

SEQ ID NO: 2784 - DNA, 22 bp, Artificial Sequence
  chemically synthesized
ccctgccctgccctctcctgaa

SEQ ID NO: 2785 - DNA, 22 bp, Artificial Sequence
  chemically synthesized
cctgccctgccctctcctgaac

SEQ ID NO: 2786 - DNA, 22 bp, Artificial Sequence
  chemically synthesized
ccctgccctctcctgaacctga

SEQ ID NO: 2787 - DNA, 22 bp, Artificial Sequence
  chemically synthesized
ccctctcctgaacctgagccag

SEQ ID NO: 2788 - DNA, 22 bp, Artificial Sequence
  chemically synthesized
tcctgaacctgagccagctccc

SEQ ID NO: 2789 - DNA, 22 bp, Artificial Sequence
  chemically synthesized
ctgaacctgagccagctcccat

SEQ ID NO: 2790 - DNA, 22 bp, Artificial Sequence
  chemically synthesized
aacctgagccagctcccatagc

SEQ ID NO: 2791 - DNA, 22 bp, Artificial Sequence
  chemically synthesized
agccagctcccatagctcagtc

SEQ ID NO: 2792 - DNA, 22 bp, Artificial Sequence
  chemically synthesized
ccatagctcagtctggtctatc

SEQ ID NO: 2793 - DNA, 22 bp, Artificial Sequence
  chemically synthesized
agtctggtctatctgcctggcc

SEQ ID NO: 2794 - DNA, 22 bp, Artificial Sequence
  chemically synthesized
gtctatctgcctggccctggcc

SEQ ID NO: 2795 - DNA, 22 bp, Artificial Sequence
  chemically synthesized
tctgcctggccctggccattgt

SEQ ID NO: 2796 - DNA, 22 bp, Artificial Sequence
  chemically synthesized
cctggccctggccattgtcact

SEQ ID NO: 2797 - DNA, 22 bp, Artificial Sequence
  chemically synthesized
gccctggccattgtcactttgc

SEQ ID NO: 2798 - DNA, 22 bp, Artificial Sequence
  chemically synthesized
gccattgtcactttgcgctgcc

SEQ ID NO: 2799 - DNA, 22 bp, Artificial Sequence
  chemically synthesized
tcactttgcgctgccctcctct

SEQ ID NO: 2800 - DNA, 22 bp, Artificial Sequence
  chemically synthesized
tgcgctgccctcctctcgcccc

SEQ ID NO: 2801 - DNA, 22 bp, Artificial Sequence
  chemically synthesized
gcgctgccctcctctcgccccc

SEQ ID NO: 2802 - DNA, 22 bp, Artificial Sequence
  chemically synthesized
cgctgccctcctctcgcccccg

SEQ ID NO: 2803 - DNA, 22 bp, Artificial Sequence
  chemically synthesized
ccctcctctcgcccccgagtgc

SEQ ID NO: 2804 - DNA, 22 bp, Artificial Sequence
  chemically synthesized
ctctcgcccccgagtgcccttg

SEQ ID NO: 2805 - DNA, 22 bp, Artificial Sequence
  chemically synthesized
tcgcccccgagtgcccttgctg

SEQ ID NO: 2806 - DNA, 22 bp, Artificial Sequence
  chemically synthesized
gcccccgagtgcccttgctgtg

SEQ ID NO: 2807 - DNA, 22 bp, Artificial Sequence
  chemically synthesized
gctgtgccgccggaactctgcc

SEQ ID NO: 2808 - DNA, 22 bp, Artificial Sequence
  chemically synthesized
ctgtgccgccggaactctgccc

SEQ ID NO: 2809 - DNA, 22 bp, Artificial Sequence
  chemically synthesized
tgccgccggaactctgccctct

SEQ ID NO: 2810 - DNA, 22 bp, Artificial Sequence
  chemically synthesized
tgccctctaacgctgccgtctc

SEQ ID NO: 2811 - DNA, 22 bp, Artificial Sequence
  chemically synthesized
ccctctaacgctgccgtctctc

SEQ ID NO: 2812 - DNA, 22 bp, Artificial Sequence
  chemically synthesized
taacgctgccgtctctctcctg

SEQ ID NO: 2813 - DNA, 22 bp, Artificial Sequence
  chemically synthesized
acgctgccgtctctctcctgag

SEQ ID NO: 2814 - DNA, 22 bp, Artificial Sequence
  chemically synthesized
ccgtctctctcctgagtccgga

SEQ ID NO: 2815 - DNA, 22 bp, Artificial Sequence
  chemically synthesized
tctcctgagtccggaccacttt

SEQ ID NO: 2816 - DNA, 22 bp, Artificial Sequence
  chemically synthesized
tcctgagtccggaccactttga

SEQ ID NO: 2817 - DNA, 22 bp, Artificial Sequence
  chemically synthesized
ctgagtccggaccactttgagc

SEQ ID NO: 2818 - DNA, 22 bp, Artificial Sequence
  chemically synthesized
agtccggaccactttgagctct

SEQ ID NO: 2819 - DNA, 22 bp, Artificial Sequence
  chemically synthesized
tgagctctactggcttctgcgc

SEQ ID NO: 2820 - DNA, 22 bp, Artificial Sequence
  chemically synthesized
gagctctactggcttctgcgcc

SEQ ID NO: 2821 - DNA, 22 bp, Artificial Sequence
  chemically synthesized
agctctactggcttctgcgccg

SEQ ID NO: 2822 - DNA, 22 bp, Artificial Sequence
  chemically synthesized
tactggcttctgcgccgcctct

SEQ ID NO: 2823 - DNA, 22 bp, Artificial Sequence
  chemically synthesized
ctggcttctgcgccgcctctgg

SEQ ID NO: 2824 - DNA, 22 bp, Artificial Sequence
  chemically synthesized
gcttctgcgccgcctctggccc

SEQ ID NO: 2825 - DNA, 22 bp, Artificial Sequence
  chemically synthesized
ctgcgccgcctctggcccactg

SEQ ID NO: 2826 - DNA, 22 bp, Artificial Sequence
  chemically synthesized
tgcgccgcctctggcccactgt

SEQ ID NO: 2827 - DNA, 22 bp, Artificial Sequence
  chemically synthesized
cgccgcctctggcccactgttt

SEQ ID NO: 2828 - DNA, 22 bp, Artificial Sequence
  chemically synthesized
tggcccactgtttccccttccc

SEQ ID NO: 2829 - DNA, 22 bp, Artificial Sequence
  chemically synthesized
gcccactgtttccccttcccag

SEQ ID NO: 2830 - DNA, 22 bp, Artificial Sequence
  chemically synthesized
tttccccttcccaggcaggtcc

SEQ ID NO: 2831 - DNA, 22 bp, Artificial Sequence
  chemically synthesized
ccccttcccaggcaggtcctgc

SEQ ID NO: 2832 - DNA, 22 bp, Artificial Sequence
  chemically synthesized
cccttcccaggcaggtcctgct

SEQ ID NO: 2833 - DNA, 22 bp, Artificial Sequence
  chemically synthesized
cccaggcaggtcctgctttctc

SEQ ID NO: 2834 - DNA, 22 bp, Artificial Sequence
  chemically synthesized
ccaggcaggtcctgctttctct

SEQ ID NO: 2835 - DNA, 22 bp, Artificial Sequence
  chemically synthesized
ctttctctgacctgcattctct

SEQ ID NO: 2836 - DNA, 22 bp, Artificial Sequence
  chemically synthesized
tctctgacctgcattctctccc

SEQ ID NO: 2837 - DNA, 22 bp, Artificial Sequence
  chemically synthesized
ctctgacctgcattctctcccc

SEQ ID NO: 2838 - DNA, 22 bp, Artificial Sequence
  chemically synthesized
tctgacctgcattctctcccct

SEQ ID NO: 2839 - DNA, 22 bp, Artificial Sequence
  chemically synthesized
tgacctgcattctctcccctgg

SEQ ID NO: 2840 - DNA, 22 bp, Artificial Sequence
  chemically synthesized
acctgcattctctcccctgggc

SEQ ID NO: 2841 - DNA, 22 bp, Artificial Sequence
  chemically synthesized
cattctctcccctgggcctgtg

SEQ ID NO: 2842 - DNA, 22 bp, Artificial Sequence
  chemically synthesized
tctcccctgggcctgtgccgct

SEQ ID NO: 2843 - DNA, 22 bp, Artificial Sequence
  chemically synthesized
tcccctgggcctgtgccgcttt

SEQ ID NO: 2844 - DNA, 22 bp, Artificial Sequence
  chemically synthesized
ccctgggcctgtgccgctttct

SEQ ID NO: 2845 - DNA, 22 bp, Artificial Sequence
  chemically synthesized
ggcctgtgccgctttctgtctg

SEQ ID NO: 2846 - DNA, 22 bp, Artificial Sequence
  chemically synthesized
tgccgctttctgtctgcagctt

SEQ ID NO: 2847 - DNA, 22 bp, Artificial Sequence
  chemically synthesized
tctgtctgcagcttgtggcctg

SEQ ID NO: 2848 - DNA, 22 bp, Artificial Sequence
  chemically synthesized
ctgtctgcagcttgtggcctgg

SEQ ID NO: 2849 - DNA, 22 bp, Artificial Sequence
  chemically synthesized
tgtctgcagcttgtggcctggg

SEQ ID NO: 2850 - DNA, 22 bp, Artificial Sequence
  chemically synthesized
tctgcagcttgtggcctgggtc

SEQ ID NO: 2851 - DNA, 22 bp, Artificial Sequence
  chemically synthesized
cagcttgtggcctgggtcacct

SEQ ID NO: 2852 - DNA, 22 bp, Artificial Sequence
  chemically synthesized
gtggcctgggtcacctctacgg

SEQ ID NO: 2853 - DNA, 22 bp, Artificial Sequence
  chemically synthesized
tggcctgggtcacctctacggc

SEQ ID NO: 2854 - DNA, 22 bp, Artificial Sequence
  chemically synthesized
ggtcacctctacggctggccca

SEQ ID NO: 2855 - DNA, 22 bp, Artificial Sequence
  chemically synthesized
tacggctggcccagatccttcc

SEQ ID NO: 2856 - DNA, 22 bp, Artificial Sequence
  chemically synthesized
cggctggcccagatccttccct

SEQ ID NO: 2857 - DNA, 22 bp, Artificial Sequence
  chemically synthesized
gcccagatccttccctgccgcc

SEQ ID NO: 2858 - DNA, 22 bp, Artificial Sequence
  chemically synthesized
ccctgccgcctccttcaggttc

SEQ ID NO: 2859 - DNA, 22 bp, Artificial Sequence
  chemically synthesized
cctgccgcctccttcaggttcc

SEQ ID NO: 2860 - DNA, 22 bp, Artificial Sequence
  chemically synthesized
ccgcctccttcaggttccgtct

SEQ ID NO: 2861 - DNA, 22 bp, Artificial Sequence
  chemically synthesized
cttcaggttccgtcttcctcca

SEQ ID NO: 2862 - DNA, 22 bp, Artificial Sequence
  chemically synthesized
caggttccgtcttcctccactc

SEQ ID NO: 2863 - DNA, 22 bp, Artificial Sequence
  chemically synthesized
aggttccgtcttcctccactcc

SEQ ID NO: 2864 - DNA, 22 bp, Artificial Sequence
  chemically synthesized
cgtcttcctccactccctcttc

SEQ ID NO: 2865 - DNA, 22 bp, Artificial Sequence
  chemically synthesized
cctccactccctcttccccttg

SEQ ID NO: 2866 - DNA, 22 bp, Artificial Sequence
  chemically synthesized
ctccactccctcttccccttgc

SEQ ID NO: 2867 - DNA, 22 bp, Artificial Sequence
  chemically synthesized
cactccctcttccccttgctct

SEQ ID NO: 2868 - DNA, 22 bp, Artificial Sequence
  chemically synthesized
cctcttccccttgctctctgct

SEQ ID NO: 2869 - DNA, 22 bp, Artificial Sequence
  chemically synthesized
ttccccttgctctctgctgtgt

SEQ ID NO: 2870 - DNA, 22 bp, Artificial Sequence
  chemically synthesized
ccccttgctctctgctgtgttg

SEQ ID NO: 2871 - DNA, 22 bp, Artificial Sequence
  chemically synthesized
cccttgctctctgctgtgttgc

SEQ ID NO: 2872 - DNA, 22 bp, Artificial Sequence
  chemically synthesized
gctctctgctgtgttgctgccc

SEQ ID NO: 2873 - DNA, 22 bp, Artificial Sequence
  chemically synthesized
ctctctgctgtgttgctgccca

SEQ ID NO: 2874 - DNA, 22 bp, Artificial Sequence
  chemically synthesized
tctgctgtgttgctgcccaagg

SEQ ID NO: 2875 - DNA, 22 bp, Artificial Sequence
  chemically synthesized
tgctgtgttgctgcccaaggat

SEQ ID NO: 2876 - DNA, 22 bp, Artificial Sequence
  chemically synthesized
ctgtgttgctgcccaaggatgc

SEQ ID NO: 2877 - DNA, 22 bp, Artificial Sequence
  chemically synthesized
tgttgctgcccaaggatgctct

SEQ ID NO: 2878 - DNA, 22 bp, Artificial Sequence
  chemically synthesized
ctgcccaaggatgctctttccg

SEQ ID NO: 2879 - DNA, 22 bp, Artificial Sequence
  chemically synthesized
cccaaggatgctctttccggag

SEQ ID NO: 2880 - DNA, 22 bp, Artificial Sequence
  chemically synthesized
tttccggagcacttccttctcg

SEQ ID NO: 2881 - DNA, 22 bp, Artificial Sequence
  chemically synthesized
tccggagcacttccttctcggc

SEQ ID NO: 2882 - DNA, 22 bp, Artificial Sequence
  chemically synthesized
ccggagcacttccttctcggcg

SEQ ID NO: 2883 - DNA, 22 bp, Artificial Sequence
  chemically synthesized
cggagcacttccttctcggcgc

SEQ ID NO: 2884 - DNA, 22 bp, Artificial Sequence
  chemically synthesized
ccttctcggcgctgcaccacgt

SEQ ID NO: 2885 - DNA, 22 bp, Artificial Sequence
  chemically synthesized
cttctcggcgctgcaccacgtg

SEQ ID NO: 2886 - DNA, 22 bp, Artificial Sequence
  chemically synthesized
ctcggcgctgcaccacgtgatg

SEQ ID NO: 2887 - DNA, 22 bp, Artificial Sequence
  chemically synthesized
tcggcgctgcaccacgtgatgt

SEQ ID NO: 2888 - DNA, 22 bp, Artificial Sequence
  chemically synthesized
ggcgctgcaccacgtgatgtcc

SEQ ID NO: 2889 - DNA, 22 bp, Artificial Sequence
  chemically synthesized
caccacgtgatgtcctctgagc

SEQ ID NO: 2890 - DNA, 22 bp, Artificial Sequence
  chemically synthesized
tgagcggatcctccccgtgtct

SEQ ID NO: 2891 - DNA, 22 bp, Artificial Sequence
  chemically synthesized
agcggatcctccccgtgtctgg

SEQ ID NO: 2892 - DNA, 22 bp, Artificial Sequence
  chemically synthesized
cccgtgtctgggtcctctccgg

SEQ ID NO: 2893 - DNA, 22 bp, Artificial Sequence
  chemically synthesized
ggtcctctccgggcatctctcc

SEQ ID NO: 2894 - DNA, 22 bp, Artificial Sequence
  chemically synthesized
tccgggcatctctcctccctca

SEQ ID NO: 2895 - DNA, 22 bp, Artificial Sequence
  chemically synthesized
cgggcatctctcctccctcacc

SEQ ID NO: 2896 - DNA, 22 bp, Artificial Sequence
  chemically synthesized
tcctccctcacccaaccccatg

SEQ ID NO: 2897 - DNA, 22 bp, Artificial Sequence
  chemically synthesized
ctccctcacccaaccccatgcc

SEQ ID NO: 2898 - DNA, 22 bp, Artificial Sequence
  chemically synthesized
cctcacccaaccccatgccgtc

SEQ ID NO: 2899 - DNA, 22 bp, Artificial Sequence
  chemically synthesized
acccaaccccatgccgtcttca

SEQ ID NO: 2900 - DNA, 22 bp, Artificial Sequence
  chemically synthesized
cactcgctgggttcccttttcc

SEQ ID NO: 2901 - DNA, 22 bp, Artificial Sequence
  chemically synthesized
actcgctgggttcccttttcct

SEQ ID NO: 2902 - DNA, 22 bp, Artificial Sequence
  chemically synthesized
gctgggttcccttttccttctc

SEQ ID NO: 2903 - DNA, 22 bp, Artificial Sequence
  chemically synthesized
ggttcccttttccttctccttc

SEQ ID NO: 2904 - DNA, 22 bp, Artificial Sequence
  chemically synthesized
ccttttccttctccttctgggg

SEQ ID NO: 2905 - DNA, 22 bp, Artificial Sequence
  chemically synthesized
ttccttctccttctggggcctg

SEQ ID NO: 2906 - DNA, 22 bp, Artificial Sequence
  chemically synthesized
tccttctccttctggggcctgt

SEQ ID NO: 2907 - DNA, 22 bp, Artificial Sequence
  chemically synthesized
ccttctccttctggggcctgtg

SEQ ID NO: 2908 - DNA, 22 bp, Artificial Sequence
  chemically synthesized
cttctccttctggggcctgtgc

SEQ ID NO: 2909 - DNA, 22 bp, Artificial Sequence
  chemically synthesized
ctccttctggggcctgtgccat

SEQ ID NO: 2910 - DNA, 22 bp, Artificial Sequence
  chemically synthesized
tccttctggggcctgtgccatc

SEQ ID NO: 2911 - DNA, 22 bp, Artificial Sequence
  chemically synthesized
cttctggggcctgtgccatctc

SEQ ID NO: 2912 - DNA, 22 bp, Artificial Sequence
  chemically synthesized
ctggggcctgtgccatctctcg

SEQ ID NO: 2913 - DNA, 22 bp, Artificial Sequence
  chemically synthesized
tggggcctgtgccatctctcgt

SEQ ID NO: 2914 - DNA, 22 bp, Artificial Sequence
  chemically synthesized
gggcctgtgccatctctcgttt

SEQ ID NO: 2915 - DNA, 22 bp, Artificial Sequence
  chemically synthesized
tgccatctctcgtttcttagga

SEQ ID NO: 2916 - DNA, 22 bp, Artificial Sequence
  chemically synthesized
tcgtttcttaggatggccttct

SEQ ID NO: 2917 - DNA, 22 bp, Artificial Sequence
  chemically synthesized
gtttcttaggatggccttctcc

SEQ ID NO: 2918 - DNA, 22 bp, Artificial Sequence
  chemically synthesized
cttaggatggccttctccgacg

SEQ ID NO: 2919 - DNA, 22 bp, Artificial Sequence
  chemically synthesized
ttaggatggccttctccgacgg

SEQ ID NO: 2920 - DNA, 22 bp, Artificial Sequence
  chemically synthesized
aggatggccttctccgacggat

SEQ ID NO: 2921 - DNA, 22 bp, Artificial Sequence
  chemically synthesized
ggatggccttctccgacggatg

SEQ ID NO: 2922 - DNA, 22 bp, Artificial Sequence
  chemically synthesized
ctccgacggatgtctcccttgc

SEQ ID NO: 2923 - DNA, 22 bp, Artificial Sequence
  chemically synthesized
tccgacggatgtctcccttgcg

SEQ ID NO: 2924 - DNA, 22 bp, Artificial Sequence
  chemically synthesized
cgacggatgtctcccttgcgtc

SEQ ID NO: 2925 - DNA, 22 bp, Artificial Sequence
  chemically synthesized
ccttgcgtcccgcctccccttc

SEQ ID NO: 2926 - DNA, 22 bp, Artificial Sequence
  chemically synthesized
gcgtcccgcctccccttcttgt

SEQ ID NO: 2927 - DNA, 22 bp, Artificial Sequence
  chemically synthesized
cgtcccgcctccccttcttgta

SEQ ID NO: 2928 - DNA, 22 bp, Artificial Sequence
  chemically synthesized
cccttcttgtaggcctgcatca

SEQ ID NO: 2929 - DNA, 22 bp, Artificial Sequence
  chemically synthesized
cttgtaggcctgcatcatcacc

SEQ ID NO: 2930 - DNA, 22 bp, Artificial Sequence
  chemically synthesized
ttgtaggcctgcatcatcaccg

SEQ ID NO: 2931 - DNA, 22 bp, Artificial Sequence
  chemically synthesized
gtaggcctgcatcatcaccgtt

SEQ ID NO: 2932 - DNA, 22 bp, Artificial Sequence
  chemically synthesized
taggcctgcatcatcaccgttt

SEQ ID NO: 2933 - DNA, 22 bp, Artificial Sequence
  chemically synthesized
catcatcaccgtttttctggac

SEQ ID NO: 2934 - DNA, 22 bp, Artificial Sequence
  chemically synthesized
ttctggacaaccccaaagtacc

SEQ ID NO: 2935 - DNA, 22 bp, Artificial Sequence
  chemically synthesized
tctggacaaccccaaagtaccc

SEQ ID NO: 2936 - DNA, 22 bp, Artificial Sequence
  chemically synthesized
ctggacaaccccaaagtacccc

SEQ ID NO: 2937 - DNA, 22 bp, Artificial Sequence
  chemically synthesized
tggacaaccccaaagtaccccg

SEQ ID NO: 2938 - DNA, 22 bp, Artificial Sequence
  chemically synthesized
gacaaccccaaagtaccccgtc

SEQ ID NO: 2939 - DNA, 22 bp, Artificial Sequence
  chemically synthesized
cctggctttagccacctctcca

SEQ ID NO: 2940 - DNA, 22 bp, Artificial Sequence
  chemically synthesized
gctttagccacctctccatcct

SEQ ID NO: 2941 - DNA, 22 bp, Artificial Sequence
  chemically synthesized
tagccacctctccatcctcttg

SEQ ID NO: 2942 - DNA, 22 bp, Artificial Sequence
  chemically synthesized
agccacctctccatcctcttgc

SEQ ID NO: 2943 - DNA, 22 bp, Artificial Sequence
  chemically synthesized
gccacctctccatcctcttgct

SEQ ID NO: 2944 - DNA, 22 bp, Artificial Sequence
  chemically synthesized
tccatcctcttgctttctttgc

SEQ ID NO: 2945 - DNA, 22 bp, Artificial Sequence
  chemically synthesized
catcctcttgctttctttgcct

SEQ ID NO: 2946 - DNA, 22 bp, Artificial Sequence
  chemically synthesized
ttgctttctttgcctggacacc

SEQ ID NO: 2947 - DNA, 22 bp, Artificial Sequence
  chemically synthesized
gctttctttgcctggacacccc

SEQ ID NO: 2948 - DNA, 22 bp, Artificial Sequence
  chemically synthesized
ctttctttgcctggacaccccg

SEQ ID NO: 2949 - DNA, 22 bp, Artificial Sequence
  chemically synthesized
tctttgcctggacaccccgttc

SEQ ID NO: 2950 - DNA, 22 bp, Artificial Sequence
  chemically synthesized
ctttgcctggacaccccgttct

SEQ ID NO: 2951 - DNA, 22 bp, Artificial Sequence
  chemically synthesized
tttgcctggacaccccgttctc

SEQ ID NO: 2952 - DNA, 22 bp, Artificial Sequence
  chemically synthesized
tgcctggacaccccgttctcct

SEQ ID NO: 2953 - DNA, 22 bp, Artificial Sequence
  chemically synthesized
gcctggacaccccgttctcctg

SEQ ID NO: 2954 - DNA, 22 bp, Artificial Sequence
  chemically synthesized
cctggacaccccgttctcctgt

SEQ ID NO: 2955 - DNA, 22 bp, Artificial Sequence
  chemically synthesized
gacaccccgttctcctgtggat

SEQ ID NO: 2956 - DNA, 22 bp, Artificial Sequence
  chemically synthesized
tcctgtggattcgggtcacctc

SEQ ID NO: 2957 - DNA, 22 bp, Artificial Sequence
  chemically synthesized
ctgtggattcgggtcacctctc

SEQ ID NO: 2958 - DNA, 22 bp, Artificial Sequence
  chemically synthesized
tggattcgggtcacctctcact

SEQ ID NO: 2959 - DNA, 22 bp, Artificial Sequence
  chemically synthesized
gggtcacctctcactcctttca

SEQ ID NO: 2960 - DNA, 22 bp, Artificial Sequence
  chemically synthesized
tcactcctttcatttgggcagc

SEQ ID NO: 2961 - DNA, 22 bp, Artificial Sequence
  chemically synthesized
actcctttcatttgggcagctc

SEQ ID NO: 2962 - DNA, 22 bp, Artificial Sequence
  chemically synthesized
ctttcatttgggcagctcccct

SEQ ID NO: 2963 - DNA, 22 bp, Artificial Sequence
  chemically synthesized
tcatttgggcagctcccctacc

SEQ ID NO: 2964 - DNA, 22 bp, Artificial Sequence
  chemically synthesized
catttgggcagctcccctaccc

SEQ ID NO: 2965 - DNA, 22 bp, Artificial Sequence
  chemically synthesized
atttgggcagctcccctacccc

SEQ ID NO: 2966 - DNA, 22 bp, Artificial Sequence
  chemically synthesized
gggcagctcccctacccccctt

SEQ ID NO: 2967 - DNA, 22 bp, Artificial Sequence
  chemically synthesized
ggcagctcccctacccccctta

SEQ ID NO: 2968 - DNA, 22 bp, Artificial Sequence
  chemically synthesized
ccctaccccccttacctctcta

SEQ ID NO: 2969 - DNA, 22 bp, Artificial Sequence
  chemically synthesized
ccccccttacctctctagtctg

SEQ ID NO: 2970 - DNA, 22 bp, Artificial Sequence
  chemically synthesized
acctctctagtctgtgctagct

SEQ ID NO: 2971 - DNA, 22 bp, Artificial Sequence
  chemically synthesized
cctctctagtctgtgctagctc

SEQ ID NO: 2972 - DNA, 22 bp, Artificial Sequence
  chemically synthesized
tctagtctgtgctagctcttcc

SEQ ID NO: 2973 - DNA, 22 bp, Artificial Sequence
  chemically synthesized
tagtctgtgctagctcttccag

SEQ ID NO: 2974 - DNA, 22 bp, Artificial Sequence
  chemically synthesized
gtctgtgctagctcttccagcc

SEQ ID NO: 2975 - DNA, 22 bp, Artificial Sequence
  chemically synthesized
tgctagctcttccagccccctg

SEQ ID NO: 2976 - DNA, 22 bp, Artificial Sequence
  chemically synthesized
gctcttccagccccctgtcatg

SEQ ID NO: 2977 - DNA, 22 bp, Artificial Sequence
  chemically synthesized
ttccagccccctgtcatggcat

SEQ ID NO: 2978 - DNA, 22 bp, Artificial Sequence
  chemically synthesized
ccagccccctgtcatggcatct

SEQ ID NO: 2979 - DNA, 22 bp, Artificial Sequence
  chemically synthesized
cagccccctgtcatggcatctt

SEQ ID NO: 2980 - DNA, 22 bp, Artificial Sequence
  chemically synthesized
tcatggcatcttccaggggtcc

SEQ ID NO: 2981 - DNA, 22 bp, Artificial Sequence
  chemically synthesized
ccaggggtccgagagctcagct

SEQ ID NO: 2982 - DNA, 22 bp, Artificial Sequence
  chemically synthesized
caggggtccgagagctcagcta

SEQ ID NO: 2983 - DNA, 22 bp, Artificial Sequence
  chemically synthesized
agctagtcttcttcctccaacc

SEQ ID NO: 2984 - DNA, 22 bp, Artificial Sequence
  chemically synthesized
gtcttcttcctccaacccgggc

SEQ ID NO: 2985 - DNA, 22 bp, Artificial Sequence
  chemically synthesized
cttcctccaacccgggccccta

SEQ ID NO: 2986 - DNA, 22 bp, Artificial Sequence
  chemically synthesized
ttcctccaacccgggcccctat

SEQ ID NO: 2987 - DNA, 22 bp, Artificial Sequence
  chemically synthesized
cctccaacccgggcccctatgt

SEQ ID NO: 2988 - DNA, 22 bp, Artificial Sequence
  chemically synthesized
ctccaacccgggcccctatgtc

SEQ ID NO: 2989 - DNA, 22 bp, Artificial Sequence
  chemically synthesized
caacccgggcccctatgtccac

SEQ ID NO: 2990 - DNA, 22 bp, Artificial Sequence
  chemically synthesized
tgtccacttcaggacagcatgt

SEQ ID NO: 2991 - DNA, 22 bp, Artificial Sequence
  chemically synthesized
caggacagcatgtttgctgcct

SEQ ID NO: 2992 - DNA, 22 bp, Artificial Sequence
  chemically synthesized
aggacagcatgtttgctgcctc

SEQ ID NO: 2993 - DNA, 22 bp, Artificial Sequence
  chemically synthesized
gctgcctccagggatcctgtgt

SEQ ID NO: 2994 - DNA, 22 bp, Artificial Sequence
  chemically synthesized
ctgcctccagggatcctgtgtc

SEQ ID NO: 2995 - DNA, 22 bp, Artificial Sequence
  chemically synthesized
cctccagggatcctgtgtcccc

SEQ ID NO: 2996 - DNA, 22 bp, Artificial Sequence
  chemically synthesized
cagggatcctgtgtccccgagc

SEQ ID NO: 2997 - DNA, 22 bp, Artificial Sequence
  chemically synthesized
tgtccccgagctgggaccacct

SEQ ID NO: 2998 - DNA, 22 bp, Artificial Sequence
  chemically synthesized
ggaccaccttatattcccaggg

SEQ ID NO: 2999 - DNA, 22 bp, Artificial Sequence
  chemically synthesized
atattcccagggccggttaatg

SEQ ID NO: 3000 - DNA, 22 bp, Artificial Sequence
  chemically synthesized
tattcccagggccggttaatgt

SEQ ID NO: 3001 - DNA, 22 bp, Artificial Sequence
  chemically synthesized
ccagggccggttaatgtggctc

SEQ ID NO: 3002 - DNA, 22 bp, Artificial Sequence
  chemically synthesized
atgtggctctggttctgggtac

SEQ ID NO: 3003 - DNA, 22 bp, Artificial Sequence
  chemically synthesized
tggttctgggtacttttatctg

SEQ ID NO: 3004 - DNA, 22 bp, Artificial Sequence
  chemically synthesized
gttctgggtacttttatctgtc

SEQ ID NO: 3005 - DNA, 22 bp, Artificial Sequence
  chemically synthesized
tgggtacttttatctgtcccct

SEQ ID NO: 3006 - DNA, 22 bp, Artificial Sequence
  chemically synthesized
ggtacttttatctgtcccctcc

SEQ ID NO: 3007 - DNA, 22 bp, Artificial Sequence
  chemically synthesized
ttatctgtcccctccaccccac

SEQ ID NO: 3008 - DNA, 22 bp, Artificial Sequence
  chemically synthesized
tatctgtcccctccaccccaca

SEQ ID NO: 3009 - DNA, 22 bp, Artificial Sequence
  chemically synthesized
atctgtcccctccaccccacag

SEQ ID NO: 3010 - DNA, 22 bp, Artificial Sequence
  chemically synthesized
tctgtcccctccaccccacagt

SEQ ID NO: 3011 - DNA, 22 bp, Artificial Sequence
  chemically synthesized
tcccctccaccccacagtgggg

SEQ ID NO: 3012 - DNA, 22 bp, Artificial Sequence
  chemically synthesized
caccccacagtggggccactag

SEQ ID NO: 3013 - DNA, 22 bp, Artificial Sequence
  chemically synthesized
gggacaggattggtgacagaaa

SEQ ID NO: 3014 - DNA, 22 bp, Artificial Sequence
  chemically synthesized
gtgacagaaaagccccatcctt

SEQ ID NO: 3015 - DNA, 22 bp, Artificial Sequence
  chemically synthesized
aggcctcctccttcctagtctc

SEQ ID NO: 3016 - DNA, 22 bp, Artificial Sequence
  chemically synthesized
ggcctcctccttcctagtctcc

SEQ ID NO: 3017 - DNA, 22 bp, Artificial Sequence
  chemically synthesized
ctccttcctagtctcctgatat

SEQ ID NO: 3018 - DNA, 22 bp, Artificial Sequence
  chemically synthesized
cttcctagtctcctgatattgg

SEQ ID NO: 3019 - DNA, 22 bp, Artificial Sequence
  chemically synthesized
cctagtctcctgatattgggtc

SEQ ID NO: 3020 - DNA, 22 bp, Artificial Sequence
  chemically synthesized
ctagtctcctgatattgggtct

SEQ ID NO: 3021 - DNA, 22 bp, Artificial Sequence
  chemically synthesized
gtctcctgatattgggtctaac

SEQ ID NO: 3022 - DNA, 22 bp, Artificial Sequence
  chemically synthesized
ctgatattgggtctaaccccca

SEQ ID NO: 3023 - DNA, 22 bp, Artificial Sequence
  chemically synthesized
atattgggtctaacccccacct

SEQ ID NO: 3024 - DNA, 22 bp, Artificial Sequence
  chemically synthesized
ggtctaacccccacctcctgtt

SEQ ID NO: 3025 - DNA, 22 bp, Artificial Sequence
  chemically synthesized
acccccacctcctgttaggcag

SEQ ID NO: 3026 - DNA, 22 bp, Artificial Sequence
  chemically synthesized
ctgttaggcagattccttatct

SEQ ID NO: 3027 - DNA, 22 bp, Artificial Sequence
  chemically synthesized
ttaggcagattccttatctggt

SEQ ID NO: 3028 - DNA, 22 bp, Artificial Sequence
  chemically synthesized
ggcagattccttatctggtgac

SEQ ID NO: 3029 - DNA, 22 bp, Artificial Sequence
  chemically synthesized
cttatctggtgacacaccccca

SEQ ID NO: 3030 - DNA, 22 bp, Artificial Sequence
  chemically synthesized
atctggtgacacacccccattt

SEQ ID NO: 3031 - DNA, 22 bp, Artificial Sequence
  chemically synthesized
tctggtgacacacccccatttc

SEQ ID NO: 3032 - DNA, 22 bp, Artificial Sequence
  chemically synthesized
gtgacacacccccatttcctgg

SEQ ID NO: 3033 - DNA, 22 bp, Artificial Sequence
  chemically synthesized
cctggagccatctctctccttg

SEQ ID NO: 3034 - DNA, 22 bp, Artificial Sequence
  chemically synthesized
ctggagccatctctctccttgc

SEQ ID NO: 3035 - DNA, 22 bp, Artificial Sequence
  chemically synthesized
gagccatctctctccttgccag

SEQ ID NO: 3036 - DNA, 22 bp, Artificial Sequence
  chemically synthesized
tctccttgccagaacctctaag

SEQ ID NO: 3037 - DNA, 22 bp, Artificial Sequence
  chemically synthesized
tccttgccagaacctctaaggt

SEQ ID NO: 3038 - DNA, 22 bp, Artificial Sequence
  chemically synthesized
cttgccagaacctctaaggttt

SEQ ID NO: 3039 - DNA, 22 bp, Artificial Sequence
  chemically synthesized
gccagaacctctaaggtttgct

SEQ ID NO: 3040 - DNA, 22 bp, Artificial Sequence
  chemically synthesized
ccagaacctctaaggtttgctt

SEQ ID NO: 3041 - DNA, 22 bp, Artificial Sequence
  chemically synthesized
taaggtttgcttacgatggagc

SEQ ID NO: 3042 - DNA, 22 bp, Artificial Sequence
  chemically synthesized
aggtttgcttacgatggagcca

SEQ ID NO: 3043 - DNA, 22 bp, Artificial Sequence
  chemically synthesized
gcttacgatggagccagagagg

SEQ ID NO: 3044 - DNA, 22 bp, Artificial Sequence
  chemically synthesized
cttacgatggagccagagagga

SEQ ID NO: 3045 - DNA, 22 bp, Artificial Sequence
  chemically synthesized
acgatggagccagagaggatcc

SEQ ID NO: 3046 - DNA, 22 bp, Artificial Sequence
  chemically synthesized
cgatggagccagagaggatcct

SEQ ID NO: 3047 - DNA, 22 bp, Artificial Sequence
  chemically synthesized
ggagggagagcttggcaggggg

SEQ ID NO: 3048 - DNA, 22 bp, Artificial Sequence
  chemically synthesized
ggcagggggtgggagggaaggg

SEQ ID NO: 3049 - DNA, 22 bp, Artificial Sequence
  chemically synthesized
gcagggggtgggagggaagggg

SEQ ID NO: 3050 - DNA, 22 bp, Artificial Sequence
  chemically synthesized
cccggttctcagtggccaccct

SEQ ID NO: 3051 - DNA, 22 bp, Artificial Sequence
  chemically synthesized
tcagtggccaccctgcgctacc

SEQ ID NO: 3052 - DNA, 22 bp, Artificial Sequence
  chemically synthesized
agtggccaccctgcgctaccct

SEQ ID NO: 3053 - DNA, 22 bp, Artificial Sequence
  chemically synthesized
cgctaccctctcccagaacctg

SEQ ID NO: 3054 - DNA, 22 bp, Artificial Sequence
  chemically synthesized
ccctctcccagaacctgagctg

SEQ ID NO: 3055 - DNA, 22 bp, Artificial Sequence
  chemically synthesized
tcccagaacctgagctgctctg

SEQ ID NO: 3056 - DNA, 22 bp, Artificial Sequence
  chemically synthesized
ccagaacctgagctgctctgac

SEQ ID NO: 3057 - DNA, 22 bp, Artificial Sequence
  chemically synthesized
agctgctctgacgcggccgtct

SEQ ID NO: 3058 - DNA, 22 bp, Artificial Sequence
  chemically synthesized
ctctgacgcggccgtctggtgc

SEQ ID NO: 3059 - DNA, 22 bp, Artificial Sequence
  chemically synthesized
tgacgcggccgtctggtgcgtt

SEQ ID NO: 3060 - DNA, 22 bp, Artificial Sequence
  chemically synthesized
acgcggccgtctggtgcgtttc

SEQ ID NO: 3061 - DNA, 22 bp, Artificial Sequence
  chemically synthesized
gtgcgtttcactgatcctggtg

SEQ ID NO: 3062 - DNA, 22 bp, Artificial Sequence
  chemically synthesized
cactgatcctggtgctgcagct

SEQ ID NO: 3063 - DNA, 22 bp, Artificial Sequence
  chemically synthesized
actgatcctggtgctgcagctt

SEQ ID NO: 3064 - DNA, 22 bp, Artificial Sequence
  chemically synthesized
atcctggtgctgcagcttcctt

SEQ ID NO: 3065 - DNA, 22 bp, Artificial Sequence
  chemically synthesized
gtgctgcagcttccttacactt

SEQ ID NO: 3066 - DNA, 22 bp, Artificial Sequence
  chemically synthesized
cagcttccttacacttcccaag

SEQ ID NO: 3067 - DNA, 22 bp, Artificial Sequence
  chemically synthesized
ccttacacttcccaagaggaga

SEQ ID NO: 3068 - DNA, 22 bp, Artificial Sequence
  chemically synthesized
cttacacttcccaagaggagaa

SEQ ID NO: 3069 - DNA, 22 bp, Artificial Sequence
  chemically synthesized
acacttcccaagaggagaagca

SEQ ID NO: 3070 - DNA, 22 bp, Artificial Sequence
  chemically synthesized
cacttcccaagaggagaagcag

SEQ ID NO: 3071 - DNA, 22 bp, Artificial Sequence
  chemically synthesized
cccaagaggagaagcagtttgg

SEQ ID NO: 3072 - DNA, 22 bp, Artificial Sequence
  chemically synthesized
ccaagaggagaagcagtttgga

SEQ ID NO: 3073 - DNA, 22 bp, Artificial Sequence
  chemically synthesized
ggaaaaacaaaatcagaataag

SEQ ID NO: 3074 - DNA, 22 bp, Artificial Sequence
  chemically synthesized
gaaaaacaaaatcagaataagt

SEQ ID NO: 3075 - DNA, 22 bp, Artificial Sequence
  chemically synthesized
gtcctgagttctaactttggct

SEQ ID NO: 3076 - DNA, 22 bp, Artificial Sequence
  chemically synthesized
agttctaactttggctcttcac

SEQ ID NO: 3077 - DNA, 22 bp, Artificial Sequence
  chemically synthesized
taactttggctcttcacctttc

SEQ ID NO: 3078 - DNA, 22 bp, Artificial Sequence
  chemically synthesized
actttggctcttcacctttcta

SEQ ID NO: 3079 - DNA, 22 bp, Artificial Sequence
  chemically synthesized
tggctcttcacctttctagtcc

SEQ ID NO: 3080 - DNA, 22 bp, Artificial Sequence
  chemically synthesized
ggctcttcacctttctagtccc

SEQ ID NO: 3081 - DNA, 22 bp, Artificial Sequence
  chemically synthesized
gctcttcacctttctagtcccc

SEQ ID NO: 3082 - DNA, 22 bp, Artificial Sequence
  chemically synthesized
ttcacctttctagtccccaatt

SEQ ID NO: 3083 - DNA, 22 bp, Artificial Sequence
  chemically synthesized
cacctttctagtccccaattta

SEQ ID NO: 3084 - DNA, 22 bp, Artificial Sequence
  chemically synthesized
acctttctagtccccaatttat

SEQ ID NO: 3085 - DNA, 22 bp, Artificial Sequence
  chemically synthesized
tctagtccccaatttatattgt

SEQ ID NO: 3086 - DNA, 22 bp, Artificial Sequence
  chemically synthesized
ctagtccccaatttatattgtt

SEQ ID NO: 3087 - DNA, 22 bp, Artificial Sequence
  chemically synthesized
tagtccccaatttatattgttc

SEQ ID NO: 3088 - DNA, 22 bp, Artificial Sequence
  chemically synthesized
gtccccaatttatattgttcct

SEQ ID NO: 3089 - DNA, 22 bp, Artificial Sequence
  chemically synthesized
atattgttcctccgtgcgtcag

SEQ ID NO: 3090 - DNA, 22 bp, Artificial Sequence
  chemically synthesized
tattgttcctccgtgcgtcagt

SEQ ID NO: 3091 - DNA, 22 bp, Artificial Sequence
  chemically synthesized
ttcctccgtgcgtcagttttac

SEQ ID NO: 3092 - DNA, 22 bp, Artificial Sequence
  chemically synthesized
ctccgtgcgtcagttttacctg

SEQ ID NO: 3093 - DNA, 22 bp, Artificial Sequence
  chemically synthesized
cgtgcgtcagttttacctgtga

SEQ ID NO: 3094 - DNA, 22 bp, Artificial Sequence
  chemically synthesized
tacctgtgagataaggccagta

SEQ ID NO: 3095 - DNA, 22 bp, Artificial Sequence
  chemically synthesized
acctgtgagataaggccagtag

SEQ ID NO: 3096 - DNA, 22 bp, Artificial Sequence
  chemically synthesized
cctgtgagataaggccagtagc

SEQ ID NO: 3097 - DNA, 22 bp, Artificial Sequence
  chemically synthesized
tgagataaggccagtagccagc

SEQ ID NO: 3098 - DNA, 22 bp, Artificial Sequence
  chemically synthesized
gcagggctgtggtgaggagggg

SEQ ID NO: 3099 - DNA, 22 bp, Artificial Sequence
  chemically synthesized
tggtgaggaggggggtgtccgt

SEQ ID NO: 3100 - DNA, 22 bp, Artificial Sequence
  chemically synthesized
cctttgtgagaatggtgcgtcc

SEQ ID NO: 3101 - DNA, 22 bp, Artificial Sequence
  chemically synthesized
tgtgagaatggtgcgtcctagg

SEQ ID NO: 3102 - DNA, 22 bp, Artificial Sequence
  chemically synthesized
gtgagaatggtgcgtcctaggt

SEQ ID NO: 3103 - DNA, 22 bp, Artificial Sequence
  chemically synthesized
tgagaatggtgcgtcctaggtg

SEQ ID NO: 3104 - DNA, 22 bp, Artificial Sequence
  chemically synthesized
ggtgttcaccaggtcgtggccg

SEQ ID NO: 3105 - DNA, 22 bp, Artificial Sequence
  chemically synthesized
accaggtcgtggccgcctctac

SEQ ID NO: 3106 - DNA, 22 bp, Artificial Sequence
  chemically synthesized
tactccctttctctttctccat

SEQ ID NO: 3107 - DNA, 22 bp, Artificial Sequence
  chemically synthesized
ctccctttctctttctccatcc

SEQ ID NO: 3108 - DNA, 22 bp, Artificial Sequence
  chemically synthesized
cctttctctttctccatccttc

SEQ ID NO: 3109 - DNA, 22 bp, Artificial Sequence
  chemically synthesized
tctctttctccatccttctttc

SEQ ID NO: 3110 - DNA, 22 bp, Artificial Sequence
  chemically synthesized
ctctttctccatccttctttcc

SEQ ID NO: 3111 - DNA, 22 bp, Artificial Sequence
  chemically synthesized
tctttctccatccttctttcct

SEQ ID NO: 3112 - DNA, 22 bp, Artificial Sequence
  chemically synthesized
tttctccatccttctttcctta

SEQ ID NO: 3113 - DNA, 22 bp, Artificial Sequence
  chemically synthesized
tctccatccttctttccttaaa

SEQ ID NO: 3114 - DNA, 22 bp, Artificial Sequence
  chemically synthesized
ctccatccttctttccttaaag

SEQ ID NO: 3115 - DNA, 22 bp, Artificial Sequence
  chemically synthesized
tccatccttctttccttaaaga

SEQ ID NO: 3116 - DNA, 22 bp, Artificial Sequence
  chemically synthesized
catccttctttccttaaagagt

SEQ ID NO: 3117 - DNA, 22 bp, Artificial Sequence
  chemically synthesized
ctttccttaaagagtccccagt

SEQ ID NO: 3118 - DNA, 22 bp, Artificial Sequence
  chemically synthesized
tttccttaaagagtccccagtg

SEQ ID NO: 3119 - DNA, 22 bp, Artificial Sequence
  chemically synthesized
tccttaaagagtccccagtgct

SEQ ID NO: 3120 - DNA, 22 bp, Artificial Sequence
  chemically synthesized
ccttaaagagtccccagtgcta

SEQ ID NO: 3121 - DNA, 22 bp, Artificial Sequence
  chemically synthesized
cttaaagagtccccagtgctat

SEQ ID NO: 3122 - DNA, 22 bp, Artificial Sequence
  chemically synthesized
aaagagtccccagtgctatctg

SEQ ID NO: 3123 - DNA, 22 bp, Artificial Sequence
  chemically synthesized
aagagtccccagtgctatctgg

SEQ ID NO: 3124 - DNA, 22 bp, Artificial Sequence
  chemically synthesized
tctgggacatattcctccgccc

SEQ ID NO: 3125 - DNA, 22 bp, Artificial Sequence
  chemically synthesized
ggacatattcctccgcccagag

SEQ ID NO: 3126 - DNA, 22 bp, Artificial Sequence
  chemically synthesized
ctccgcccagagcagggtcccg

SEQ ID NO: 3127 - DNA, 22 bp, Artificial Sequence
  chemically synthesized
cgcccagagcagggtcccgctt

SEQ ID NO: 3128 - DNA, 22 bp, Artificial Sequence
  chemically synthesized
ccctaaggccctgctctgggct

SEQ ID NO: 3129 - DNA, 22 bp, Artificial Sequence
  chemically synthesized
cctaaggccctgctctgggctt

SEQ ID NO: 3130 - DNA, 22 bp, Artificial Sequence
  chemically synthesized
aggccctgctctgggcttctgg

SEQ ID NO: 3131 - DNA, 22 bp, Artificial Sequence
  chemically synthesized
ctctgggcttctgggtttgagt

SEQ ID NO: 3132 - DNA, 22 bp, Artificial Sequence
  chemically synthesized
tgggcttctgggtttgagtcct

SEQ ID NO: 3133 - DNA, 22 bp, Artificial Sequence
  chemically synthesized
ggcttctgggtttgagtccttg

SEQ ID NO: 3134 - DNA, 22 bp, Artificial Sequence
  chemically synthesized
ctgggtttgagtccttggcaag

SEQ ID NO: 3135 - DNA, 22 bp, Artificial Sequence
  chemically synthesized
tgggtttgagtccttggcaagc

SEQ ID NO: 3136 - DNA, 22 bp, Artificial Sequence
  chemically synthesized
ggtttgagtccttggcaagccc

SEQ ID NO: 3137 - DNA, 22 bp, Artificial Sequence
  chemically synthesized
gagtccttggcaagcccaggag

SEQ ID NO: 3138 - DNA, 22 bp, Artificial Sequence
  chemically synthesized
agtccttggcaagcccaggaga

SEQ ID NO: 3139 - DNA, 22 bp, Artificial Sequence
  chemically synthesized
ggcaagcccaggagaggcgctc

SEQ ID NO: 3140 - DNA, 22 bp, Artificial Sequence
  chemically synthesized
gcaagcccaggagaggcgctca

SEQ ID NO: 3141 - DNA, 22 bp, Artificial Sequence
  chemically synthesized
aggcttccctgtcccccttcct

SEQ ID NO: 3142 - DNA, 22 bp, Artificial Sequence
  chemically synthesized
ccctgtcccccttcctcgtcca

SEQ ID NO: 3143 - DNA, 22 bp, Artificial Sequence
  chemically synthesized
cctgtcccccttcctcgtccac

SEQ ID NO: 3144 - DNA, 22 bp, Artificial Sequence
  chemically synthesized
tcccccttcctcgtccaccatc

SEQ ID NO: 3145 - DNA, 22 bp, Artificial Sequence
  chemically synthesized
cctcgtccaccatctcatgccc

SEQ ID NO: 3146 - DNA, 22 bp, Artificial Sequence
  chemically synthesized
ctcgtccaccatctcatgcccc

SEQ ID NO: 3147 - DNA, 22 bp, Artificial Sequence
  chemically synthesized
gtccaccatctcatgcccctgg

SEQ ID NO: 3148 - DNA, 22 bp, Artificial Sequence
  chemically synthesized
atgcccctggctctcctgcccc

SEQ ID NO: 3149 - DNA, 22 bp, Artificial Sequence
  chemically synthesized
gctctcctgccccttccctaca

SEQ ID NO: 3150 - DNA, 22 bp, Artificial Sequence
  chemically synthesized
tcctgccccttccctacagggg

SEQ ID NO: 3151 - DNA, 22 bp, Artificial Sequence
  chemically synthesized
ctgccccttccctacaggggtt

SEQ ID NO: 3152 - DNA, 22 bp, Artificial Sequence
  chemically synthesized
ccccttccctacaggggttcct

SEQ ID NO: 3153 - DNA, 22 bp, Artificial Sequence
  chemically synthesized
ccctacaggggttcctggctct

SEQ ID NO: 3154 - DNA, 22 bp, Artificial Sequence
  chemically synthesized
cctacaggggttcctggctctg

SEQ ID NO: 3155 - DNA, 22 bp, Artificial Sequence
  chemically synthesized
caggggttcctggctctgctct

SEQ ID NO: 3156 - DNA, 22 bp, Artificial Sequence
  chemically synthesized
ctggctctgctcttcagactga

SEQ ID NO: 3157 - DNA, 22 bp, Artificial Sequence
  chemically synthesized
gctctgctcttcagactgagcc

SEQ ID NO: 3158 - DNA, 22 bp, Artificial Sequence
  chemically synthesized
tgctcttcagactgagccccgt

SEQ ID NO: 3159 - DNA, 22 bp, Artificial Sequence
  chemically synthesized
ctcttcagactgagccccgttc

SEQ ID NO: 3160 - DNA, 22 bp, Artificial Sequence
  chemically synthesized
ttcagactgagccccgttcccc

SEQ ID NO: 3161 - DNA, 22 bp, Artificial Sequence
  chemically synthesized
cagactgagccccgttcccctg

SEQ ID NO: 3162 - DNA, 22 bp, Artificial Sequence
  chemically synthesized
agactgagccccgttcccctgc

SEQ ID NO: 3163 - DNA, 22 bp, Artificial Sequence
  chemically synthesized
agccccgttcccctgcatcccc

SEQ ID NO: 3164 - DNA, 22 bp, Artificial Sequence
  chemically synthesized
ccctgcatccccgttcccctgc

SEQ ID NO: 3165 - DNA, 22 bp, Artificial Sequence
  chemically synthesized
catccccgttcccctgcatccc

SEQ ID NO: 3166 - DNA, 22 bp, Artificial Sequence
  chemically synthesized
ccctgcatcccccttcccctgc

SEQ ID NO: 3167 - DNA, 22 bp, Artificial Sequence
  chemically synthesized
catcccccttcccctgcatccc

SEQ ID NO: 3168 - DNA, 22 bp, Artificial Sequence
  chemically synthesized
cccctgcatcccccagaggccc

SEQ ID NO: 3169 - DNA, 22 bp, Artificial Sequence
  chemically synthesized
ccctgcatcccccagaggcccc

SEQ ID NO: 3170 - DNA, 22 bp, Artificial Sequence
  chemically synthesized
catcccccagaggccccaggcc

SEQ ID NO: 3171 - DNA, 22 bp, Artificial Sequence
  chemically synthesized
cttggcctggaccccacgagag

SEQ ID NO: 3172 - DNA, 22 bp, Artificial Sequence
  chemically synthesized
ggcctggaccccacgagaggcc

SEQ ID NO: 3173 - DNA, 22 bp, Artificial Sequence
  chemically synthesized
gcctggaccccacgagaggcca

SEQ ID NO: 3174 - DNA, 22 bp, Artificial Sequence
  chemically synthesized
gaccccacgagaggccacccca

SEQ ID NO: 3175 - DNA, 22 bp, Artificial Sequence
  chemically synthesized
tctaccaggctgccttttgggt

SEQ ID NO: 3176 - DNA, 22 bp, Artificial Sequence
  chemically synthesized
ccaggctgccttttgggtggat

SEQ ID NO: 3177 - DNA, 22 bp, Artificial Sequence
  chemically synthesized
ccttttgggtggattctcctcc

SEQ ID NO: 3178 - DNA, 22 bp, Artificial Sequence
  chemically synthesized
ttgggtggattctcctccaact

SEQ ID NO: 3179 - DNA, 22 bp, Artificial Sequence
  chemically synthesized
tgggtggattctcctccaactg

SEQ ID NO: 3180 - DNA, 22 bp, Artificial Sequence
  chemically synthesized
gggtggattctcctccaactgt

SEQ ID NO: 3181 - DNA, 22 bp, Artificial Sequence
  chemically synthesized
ggtggattctcctccaactgtg

SEQ ID NO: 3182 - DNA, 22 bp, Artificial Sequence
  chemically synthesized
tcctccaactgtggggtgactg

SEQ ID NO: 3183 - DNA, 22 bp, Artificial Sequence
  chemically synthesized
ctccaactgtggggtgactgct

SEQ ID NO: 3184 - DNA, 22 bp, Artificial Sequence
  chemically synthesized
caactgtggggtgactgcttgg

SEQ ID NO: 3185 - DNA, 22 bp, Artificial Sequence
  chemically synthesized
tggggtgactgcttggcaaact

SEQ ID NO: 3186 - DNA, 22 bp, Artificial Sequence
  chemically synthesized
cttggcaaactcactcttcggg

SEQ ID NO: 3187 - DNA, 22 bp, Artificial Sequence
  chemically synthesized
ggcaaactcactcttcggggta

SEQ ID NO: 3188 - DNA, 22 bp, Artificial Sequence
  chemically synthesized
gcaaactcactcttcggggtat

SEQ ID NO: 3189 - DNA, 22 bp, Artificial Sequence
  chemically synthesized
actcttcggggtatcccaggag

SEQ ID NO: 3190 - DNA, 22 bp, Artificial Sequence
  chemically synthesized
ttcggggtatcccaggaggcct

SEQ ID NO: 3191 - DNA, 22 bp, Artificial Sequence
  chemically synthesized
cggggtatcccaggaggcctgg

SEQ ID NO: 3192 - DNA, 22 bp, Artificial Sequence
  chemically synthesized
ggggtatcccaggaggcctgga

SEQ ID NO: 3193 - DNA, 22 bp, Artificial Sequence
  chemically synthesized
gagcattggggtgggctggggt

SEQ ID NO: 3194 - DNA, 22 bp, Artificial Sequence
  chemically synthesized
gggtgggctggggttcagagag

SEQ ID NO: 3195 - DNA, 22 bp, Artificial Sequence
  chemically synthesized
gggttcagagaggagggattcc

SEQ ID NO: 3196 - DNA, 22 bp, Artificial Sequence
  chemically synthesized
agagaggagggattcccttctc

SEQ ID NO: 3197 - DNA, 22 bp, Artificial Sequence
  chemically synthesized
ccttctcaggttacgtggccaa

SEQ ID NO: 3198 - DNA, 22 bp, Artificial Sequence
  chemically synthesized
ctcaggttacgtggccaagaag

SEQ ID NO: 3199 - DNA, 22 bp, Artificial Sequence
  chemically synthesized
tcaggttacgtggccaagaagc

SEQ ID NO: 3200 - DNA, 22 bp, Artificial Sequence
  chemically synthesized
aggttacgtggccaagaagcag

SEQ ID NO: 3201 - DNA, 22 bp, Artificial Sequence
  chemically synthesized
cgtggccaagaagcaggggagc

SEQ ID NO: 3202 - DNA, 22 bp, Artificial Sequence
  chemically synthesized
ggtttgggtcaggtctgggtgt

SEQ ID NO: 3203 - DNA, 22 bp, Artificial Sequence
  chemically synthesized
gggtcaggtctgggtgtggggt

SEQ ID NO: 3204 - DNA, 22 bp, Artificial Sequence
  chemically synthesized
ggtcaggtctgggtgtggggtg

SEQ ID NO: 3205 - DNA, 22 bp, Artificial Sequence
  chemically synthesized
ggtgtggggtgaccagcttatg

SEQ ID NO: 3206 - DNA, 22 bp, Artificial Sequence
  chemically synthesized
atgctgtttgcccaggacagcc

SEQ ID NO: 3207 - DNA, 22 bp, Artificial Sequence
  chemically synthesized
tgctgtttgcccaggacagcct

SEQ ID NO: 3208 - DNA, 22 bp, Artificial Sequence
  chemically synthesized
tttgcccaggacagcctagttt

SEQ ID NO: 3209 - DNA, 22 bp, Artificial Sequence
  chemically synthesized
gcccaggacagcctagttttag

SEQ ID NO: 3210 - DNA, 22 bp, Artificial Sequence
  chemically synthesized
cccaggacagcctagttttagc

SEQ ID NO: 3211 - DNA, 22 bp, Artificial Sequence
  chemically synthesized
gttttagcactgaaaccctcag

SEQ ID NO: 3212 - DNA, 22 bp, Artificial Sequence
  chemically synthesized
tagcactgaaaccctcagtcct

SEQ ID NO: 3213 - DNA, 22 bp, Artificial Sequence
  chemically synthesized
agcactgaaaccctcagtccta

SEQ ID NO: 3214 - DNA, 22 bp, Artificial Sequence
  chemically synthesized
gcactgaaaccctcagtcctag

SEQ ID NO: 3215 - DNA, 22 bp, Artificial Sequence
  chemically synthesized
aaaccctcagtcctaggaaaac

SEQ ID NO: 3216 - DNA, 22 bp, Artificial Sequence
  chemically synthesized
agtcctaggaaaacagggatgg

SEQ ID NO: 3217 - DNA, 22 bp, Artificial Sequence
  chemically synthesized
ggaaaacagggatggttggtca

SEQ ID NO: 3218 - DNA, 22 bp, Artificial Sequence
  chemically synthesized
gtcactgtctctgggtgactct

SEQ ID NO: 3219 - DNA, 22 bp, Artificial Sequence
  chemically synthesized
tctctgggtgactcttgattcc

SEQ ID NO: 3220 - DNA, 22 bp, Artificial Sequence
  chemically synthesized
tgggtgactcttgattcccggc

SEQ ID NO: 3221 - DNA, 22 bp, Artificial Sequence
  chemically synthesized
ggtgactcttgattcccggcca

SEQ ID NO: 3222 - DNA, 22 bp, Artificial Sequence
  chemically synthesized
ttgattcccggccagtttctcc

SEQ ID NO: 3223 - DNA, 22 bp, Artificial Sequence
  chemically synthesized
gattcccggccagtttctccac

SEQ ID NO: 3224 - DNA, 22 bp, Artificial Sequence
  chemically synthesized
attcccggccagtttctccacc

SEQ ID NO: 3225 - DNA, 22 bp, Artificial Sequence
  chemically synthesized
ccggccagtttctccacctggg

SEQ ID NO: 3226 - DNA, 22 bp, Artificial Sequence
  chemically synthesized
ctccacctggggctgtgtttct

SEQ ID NO: 3227 - DNA, 22 bp, Artificial Sequence
  chemically synthesized
tccacctggggctgtgtttctc

SEQ ID NO: 3228 - DNA, 22 bp, Artificial Sequence
  chemically synthesized
cacctggggctgtgtttctcgt

SEQ ID NO: 3229 - DNA, 22 bp, Artificial Sequence
  chemically synthesized
gggctgtgtttctcgtcctgca

SEQ ID NO: 3230 - DNA, 22 bp, Artificial Sequence
  chemically synthesized
tgtttctcgtcctgcatccttc

SEQ ID NO: 3231 - DNA, 22 bp, Artificial Sequence
  chemically synthesized
ctcgtcctgcatccttctccag

SEQ ID NO: 3232 - DNA, 22 bp, Artificial Sequence
  chemically synthesized
tcgtcctgcatccttctccagg

SEQ ID NO: 3233 - DNA, 22 bp, Artificial Sequence
  chemically synthesized
gtcctgcatccttctccaggca

SEQ ID NO: 3234 - DNA, 22 bp, Artificial Sequence
  chemically synthesized
catccttctccaggcaggtccc

SEQ ID NO: 3235 - DNA, 22 bp, Artificial Sequence
  chemically synthesized
ctccaggcaggtccccaagcat

SEQ ID NO: 3236 - DNA, 22 bp, Artificial Sequence
  chemically synthesized
tccaggcaggtccccaagcatc

SEQ ID NO: 3237 - DNA, 22 bp, Artificial Sequence
  chemically synthesized
caggcaggtccccaagcatcgc

SEQ ID NO: 3238 - DNA, 22 bp, Artificial Sequence
  chemically synthesized
ctgtggctgttcccaagttctt

SEQ ID NO: 3239 - DNA, 22 bp, Artificial Sequence
  chemically synthesized
tggctgttcccaagttcttagg

SEQ ID NO: 3240 - DNA, 22 bp, Artificial Sequence
  chemically synthesized
ttcccaagttcttagggtaccc

SEQ ID NO: 3241 - DNA, 22 bp, Artificial Sequence
  chemically synthesized
ccaagttcttagggtaccccac

SEQ ID NO: 3242 - DNA, 22 bp, Artificial Sequence
  chemically synthesized
ttagggtaccccacgtgggttt

SEQ ID NO: 3243 - DNA, 22 bp, Artificial Sequence
  chemically synthesized
agggtaccccacgtgggtttat

SEQ ID NO: 3244 - DNA, 22 bp, Artificial Sequence
  chemically synthesized
gggtaccccacgtgggtttatc

SEQ ID NO: 3245 - DNA, 22 bp, Artificial Sequence
  chemically synthesized
atcaaccacttggtgaggctgg

SEQ ID NO: 3246 - DNA, 22 bp, Artificial Sequence
  chemically synthesized
tcaaccacttggtgaggctggt

SEQ ID NO: 3247 - DNA, 22 bp, Artificial Sequence
  chemically synthesized
ggtgaggctggtaccctgcccc

SEQ ID NO: 3248 - DNA, 22 bp, Artificial Sequence
  chemically synthesized
gtgaggctggtaccctgccccc

SEQ ID NO: 3249 - DNA, 22 bp, Artificial Sequence
  chemically synthesized
gtaccctgcccccattcctgca

SEQ ID NO: 3250 - DNA, 22 bp, Artificial Sequence
  chemically synthesized
cccccattcctgcaccccaatt

SEQ ID NO: 3251 - DNA, 22 bp, Artificial Sequence
  chemically synthesized
ctgcaccccaattgccttagtg

SEQ ID NO: 3252 - DNA, 22 bp, Artificial Sequence
  chemically synthesized
caccccaattgccttagtggct

SEQ ID NO: 3253 - DNA, 22 bp, Artificial Sequence
  chemically synthesized
ccttagtggctagggggttggg

SEQ ID NO: 3254 - DNA, 22 bp, Artificial Sequence
  chemically synthesized
agtggctagggggttgggggct

SEQ ID NO: 3255 - DNA, 22 bp, Artificial Sequence
  chemically synthesized
gtggctagggggttgggggcta

SEQ ID NO: 3256 - DNA, 22 bp, Artificial Sequence
  chemically synthesized
gggggttgggggctagagtagg

SEQ ID NO: 3257 - DNA, 22 bp, Artificial Sequence
  chemically synthesized
ggggctagagtaggaggggctg

SEQ ID NO: 3258 - DNA, 22 bp, Artificial Sequence
  chemically synthesized
gagtaggaggggctggagccag

SEQ ID NO: 3259 - DNA, 22 bp, Artificial Sequence
  chemically synthesized
gagccaggattcttagggctga

SEQ ID NO: 3260 - DNA, 22 bp, Artificial Sequence
  chemically synthesized
ttagggctgaacagagaagagc

SEQ ID NO: 3261 - DNA, 22 bp, Artificial Sequence
  chemically synthesized
agggctgaacagagaagagctg

SEQ ID NO: 3262 - DNA, 22 bp, Artificial Sequence
  chemically synthesized
gggctgaacagagaagagctgg

SEQ ID NO: 3263 - DNA, 22 bp, Artificial Sequence
  chemically synthesized
aacagagaagagctgggggcct

SEQ ID NO: 3264 - DNA, 22 bp, Artificial Sequence
  chemically synthesized
ggggcctgggctcctgggtttg

SEQ ID NO: 3265 - DNA, 22 bp, Artificial Sequence
  chemically synthesized
ggctcctgggtttgagagagga

SEQ ID NO: 3266 - DNA, 22 bp, Artificial Sequence
  chemically synthesized
ctgggtttgagagaggaggggc

SEQ ID NO: 3267 - DNA, 22 bp, Artificial Sequence
  chemically synthesized
ggtttgagagaggaggggctgg

SEQ ID NO: 3268 - DNA, 22 bp, Artificial Sequence
  chemically synthesized
gagagaggaggggctggggcct

SEQ ID NO: 3269 - DNA, 22 bp, Artificial Sequence
  chemically synthesized
agagaggaggggctggggcctg

SEQ ID NO: 3270 - DNA, 22 bp, Artificial Sequence
  chemically synthesized
gggcctggactcctgggtccga

SEQ ID NO: 3271 - DNA, 22 bp, Artificial Sequence
  chemically synthesized
gactcctgggtccgagggagga

SEQ ID NO: 3272 - DNA, 22 bp, Artificial Sequence
  chemically synthesized
ctgggtccgagggaggaggggc

SEQ ID NO: 3273 - DNA, 22 bp, Artificial Sequence
  chemically synthesized
ggtccgagggaggaggggctgg

SEQ ID NO: 3274 - DNA, 22 bp, Artificial Sequence
  chemically synthesized
gggcctggactcctgggtctga

SEQ ID NO: 3275 - DNA, 22 bp, Artificial Sequence
  chemically synthesized
gactcctgggtctgagggtgga

SEQ ID NO: 3276 - DNA, 22 bp, Artificial Sequence
  chemically synthesized
ctgggtctgagggtggagggac

SEQ ID NO: 3277 - DNA, 22 bp, Artificial Sequence
  chemically synthesized
ggtctgagggtggagggactgg

SEQ ID NO: 3278 - DNA, 22 bp, Artificial Sequence
  chemically synthesized
agggtggagggactgggggcct

SEQ ID NO: 3279 - DNA, 22 bp, Artificial Sequence
  chemically synthesized
ggggcctggactcctgggtccg

SEQ ID NO: 3280 - DNA, 22 bp, Artificial Sequence
  chemically synthesized
gactcctgggtccgagggagga

SEQ ID NO: 3281 - DNA, 22 bp, Artificial Sequence
  chemically synthesized
ctgggtccgagggaggaggggc

SEQ ID NO: 3282 - DNA, 22 bp, Artificial Sequence
  chemically synthesized
ggtccgagggaggaggggctgg

SEQ ID NO: 3283 - DNA, 22 bp, Artificial Sequence
  chemically synthesized
gggcctggactcgtgggtctga

SEQ ID NO: 3284 - DNA, 22 bp, Artificial Sequence
  chemically synthesized
gactcgtgggtctgagggagga

SEQ ID NO: 3285 - DNA, 22 bp, Artificial Sequence
  chemically synthesized
gtgggtctgagggaggaggggc

SEQ ID NO: 3286 - DNA, 22 bp, Artificial Sequence
  chemically synthesized
agggaggaggggctgggggcct

SEQ ID NO: 3287 - DNA, 22 bp, Artificial Sequence
  chemically synthesized
ggggcctggacttctgggtctt

SEQ ID NO: 3288 - DNA, 22 bp, Artificial Sequence
  chemically synthesized
gacttctgggtcttagggaggc

SEQ ID NO: 3289 - DNA, 22 bp, Artificial Sequence
  chemically synthesized
ctgggtcttagggaggcggggc

SEQ ID NO: 3290 - DNA, 22 bp, Artificial Sequence
  chemically synthesized
tgggtcttagggaggcggggct

SEQ ID NO: 3291 - DNA, 22 bp, Artificial Sequence
  chemically synthesized
ggtcttagggaggcggggctgg

SEQ ID NO: 3292 - DNA, 22 bp, Artificial Sequence
  chemically synthesized
agggaggcggggctgggcctgg

SEQ ID NO: 3293 - DNA, 22 bp, Artificial Sequence
  chemically synthesized
gggaggcggggctgggcctgga

SEQ ID NO: 3294 - DNA, 22 bp, Artificial Sequence
  chemically synthesized
ggcctggacccctgggtctgaa

SEQ ID NO: 3295 - DNA, 22 bp, Artificial Sequence
  chemically synthesized
gacccctgggtctgaatgggga

SEQ ID NO: 3296 - DNA, 22 bp, Artificial Sequence
  chemically synthesized
ggtctgaatggggagaggctgg

SEQ ID NO: 3297 - DNA, 22 bp, Artificial Sequence
  chemically synthesized
aatggggagaggctgggggcct

SEQ ID NO: 3298 - DNA, 22 bp, Artificial Sequence
  chemically synthesized
ggggcctggactccttcatctg

SEQ ID NO: 3299 - DNA, 22 bp, Artificial Sequence
  chemically synthesized
gactccttcatctgagggcgga

SEQ ID NO: 3300 - DNA, 22 bp, Artificial Sequence
  chemically synthesized
cttcatctgagggcggaagggc

SEQ ID NO: 3301 - DNA, 22 bp, Artificial Sequence
  chemically synthesized
catctgagggcggaagggctgg

SEQ ID NO: 3302 - DNA, 22 bp, Artificial Sequence
  chemically synthesized
atctgagggcggaagggctggg

SEQ ID NO: 3303 - DNA, 22 bp, Artificial Sequence
  chemically synthesized
agggcggaagggctggggcctg

SEQ ID NO: 3304 - DNA, 22 bp, Artificial Sequence
  chemically synthesized
gggcctggcctcctgggttgaa

SEQ ID NO: 3305 - DNA, 22 bp, Artificial Sequence
  chemically synthesized
gcctcctgggttgaatggggag

SEQ ID NO: 3306 - DNA, 22 bp, Artificial Sequence
  chemically synthesized
ctgggttgaatggggaggggtt

SEQ ID NO: 3307 - DNA, 22 bp, Artificial Sequence
  chemically synthesized
ggttgaatggggaggggttggg

SEQ ID NO: 3308 - DNA, 22 bp, Artificial Sequence
  chemically synthesized
aatggggaggggttgggcctgg

SEQ ID NO: 3309 - DNA, 22 bp, Artificial Sequence
  chemically synthesized
ggcctggactctggagtccctg

SEQ ID NO: 3310 - DNA, 22 bp, Artificial Sequence
  chemically synthesized
gactctggagtccctggtgccc

SEQ ID NO: 3311 - DNA, 22 bp, Artificial Sequence
  chemically synthesized
tggagtccctggtgcccaggcc

SEQ ID NO: 3312 - DNA, 22 bp, Artificial Sequence
  chemically synthesized
gagtccctggtgcccaggcctc

SEQ ID NO: 3313 - DNA, 22 bp, Artificial Sequence
  chemically synthesized
gtgcccaggcctcaggcatctt

SEQ ID NO: 3314 - DNA, 22 bp, Artificial Sequence
  chemically synthesized
aggcatctttcacagggatgcc

SEQ ID NO: 3315 - DNA, 22 bp, Artificial Sequence
  chemically synthesized
tcacagggatgcctgtactggg

SEQ ID NO: 3316 - DNA, 22 bp, Artificial Sequence
  chemically synthesized
cacagggatgcctgtactgggc

SEQ ID NO: 3317 - DNA, 22 bp, Artificial Sequence
  chemically synthesized
acagggatgcctgtactgggca

SEQ ID NO: 3318 - DNA, 22 bp, Artificial Sequence
  chemically synthesized
tactgggcaggtccttgaaagg

SEQ ID NO: 3319 - DNA, 22 bp, Artificial Sequence
  chemically synthesized
ggcaggtccttgaaagggaaag

SEQ ID NO: 3320 - DNA, 22 bp, Artificial Sequence
  chemically synthesized
gaaagggaaaggcccattgctc

SEQ ID NO: 3321 - DNA, 22 bp, Artificial Sequence
  chemically synthesized
aaagggaaaggcccattgctct

SEQ ID NO: 3322 - DNA, 22 bp, Artificial Sequence
  chemically synthesized
ctctccttgcccccctccccta

SEQ ID NO: 3323 - DNA, 22 bp, Artificial Sequence
  chemically synthesized
tccttgcccccctcccctatcg

SEQ ID NO: 3324 - DNA, 22 bp, Artificial Sequence
  chemically synthesized
cttgcccccctcccctatcgcc

SEQ ID NO: 3325 - DNA, 22 bp, Artificial Sequence
  chemically synthesized
gcccccctcccctatcgccatg

SEQ ID NO: 3326 - DNA, 22 bp, Artificial Sequence
  chemically synthesized
cccccctcccctatcgccatga

SEQ ID NO: 3327 - DNA, 22 bp, Artificial Sequence
  chemically synthesized
ccctatcgccatgacaactggg

SEQ ID NO: 3328 - DNA, 22 bp, Artificial Sequence
  chemically synthesized
tcgccatgacaactgggtggaa

SEQ ID NO: 3329 - DNA, 22 bp, Artificial Sequence
  chemically synthesized
ggtggaaataaacgagccgagt

SEQ ID NO: 3330 - DNA, 22 bp, Artificial Sequence
  chemically synthesized
atcccgttcccagggcacgtgc

SEQ ID NO: 3331 - DNA, 22 bp, Artificial Sequence
  chemically synthesized
ccagggcacgtgcggccccttc

SEQ ID NO: 3332 - DNA, 22 bp, Artificial Sequence
  chemically synthesized
cacagcccgagtttccatgacc

SEQ ID NO: 3333 - DNA, 22 bp, Artificial Sequence
  chemically synthesized
acagcccgagtttccatgacct

SEQ ID NO: 3334 - DNA, 22 bp, Artificial Sequence
  chemically synthesized
ccatgacctcatgctcttggcc

SEQ ID NO: 3335 - DNA, 22 bp, Artificial Sequence
  chemically synthesized
catgacctcatgctcttggccc

SEQ ID NO: 3336 - DNA, 22 bp, Artificial Sequence
  chemically synthesized
atgctcttggccctcgtagctc

SEQ ID NO: 3337 - DNA, 22 bp, Artificial Sequence
  chemically synthesized
ttggccctcgtagctccctccc

SEQ ID NO: 3338 - DNA, 22 bp, Artificial Sequence
  chemically synthesized
ggccctcgtagctccctcccgc

SEQ ID NO: 3339 - DNA, 22 bp, Artificial Sequence
  chemically synthesized
gccctcgtagctccctcccgcc

SEQ ID NO: 3340 - DNA, 22 bp, Artificial Sequence
  chemically synthesized
gtagctccctcccgcctcctcc

SEQ ID NO: 3341 - DNA, 22 bp, Artificial Sequence
  chemically synthesized
cctcccgcctcctccagatggg

SEQ ID NO: 3342 - DNA, 22 bp, Artificial Sequence
  chemically synthesized
ccgcctcctccagatgggcagc

SEQ ID NO: 3343 - DNA, 22 bp, Artificial Sequence
  chemically synthesized
ctccagatgggcagctttggag

SEQ ID NO: 3344 - DNA, 22 bp, Artificial Sequence
  chemically synthesized
cagatgggcagctttggagagg

SEQ ID NO: 3345 - DNA, 22 bp, Artificial Sequence
  chemically synthesized
tggagaggtgagggacttgggg

SEQ ID NO: 3346 - DNA, 22 bp, Artificial Sequence
  chemically synthesized
ggagaggtgagggacttggggg

SEQ ID NO: 3347 - DNA, 22 bp, Artificial Sequence
  chemically synthesized
gagaggtgagggacttgggggg

SEQ ID NO: 3348 - DNA, 22 bp, Artificial Sequence
  chemically synthesized
ggggggtaatttatcccgtgga

SEQ ID NO: 3349 - DNA, 22 bp, Artificial Sequence
  chemically synthesized
gggggtaatttatcccgtggat

SEQ ID NO: 3350 - DNA, 22 bp, Artificial Sequence
  chemically synthesized
atcccgtggatctaggagttta

SEQ ID NO: 3351 - DNA, 22 bp, Artificial Sequence
  chemically synthesized
tcccgtggatctaggagtttag

SEQ ID NO: 3352 - DNA, 22 bp, Artificial Sequence
  chemically synthesized
ggagtttagcttcactccttcc

SEQ ID NO: 3353 - DNA, 22 bp, Artificial Sequence
  chemically synthesized
agcttcactccttcctcagctc

SEQ ID NO: 3354 - DNA, 22 bp, Artificial Sequence
  chemically synthesized
gcttcactccttcctcagctcc

SEQ ID NO: 3355 - DNA, 22 bp, Artificial Sequence
  chemically synthesized
cactccttcctcagctccagtt

SEQ ID NO: 3356 - DNA, 22 bp, Artificial Sequence
  chemically synthesized
actccttcctcagctccagttc

SEQ ID NO: 3357 - DNA, 22 bp, Artificial Sequence
  chemically synthesized
cttcctcagctccagttcaggt

SEQ ID NO: 3358 - DNA, 22 bp, Artificial Sequence
  chemically synthesized
cctcagctccagttcaggtccc

SEQ ID NO: 3359 - DNA, 22 bp, Artificial Sequence
  chemically synthesized
ctcagctccagttcaggtcccg

SEQ ID NO: 3360 - DNA, 22 bp, Artificial Sequence
  chemically synthesized
agctccagttcaggtcccggag

SEQ ID NO: 3361 - DNA, 22 bp, Artificial Sequence
  chemically synthesized
cagttcaggtcccggagcccac

SEQ ID NO: 3362 - DNA, 22 bp, Artificial Sequence
  chemically synthesized
aggtcccggagcccacccagtg

SEQ ID NO: 3363 - DNA, 22 bp, Artificial Sequence
  chemically synthesized
gggcaagtccctcctccgaccc

SEQ ID NO: 3364 - DNA, 22 bp, Artificial Sequence
  chemically synthesized
ctccgaccccctggacttcggc

SEQ ID NO: 3365 - DNA, 22 bp, Artificial Sequence
  chemically synthesized
cgaccccctggacttcggcttt

SEQ ID NO: 3366 - DNA, 22 bp, Artificial Sequence
  chemically synthesized
gacttcggcttttgtcccccca

SEQ ID NO: 3367 - DNA, 22 bp, Artificial Sequence
  chemically synthesized
cggcttttgtccccccaagttt

SEQ ID NO: 3368 - DNA, 22 bp, Artificial Sequence
  chemically synthesized
ggcttttgtccccccaagtttt

SEQ ID NO: 3369 - DNA, 22 bp, Artificial Sequence
  chemically synthesized
ttgtccccccaagttttggacc

SEQ ID NO: 3370 - DNA, 22 bp, Artificial Sequence
  chemically synthesized
tgtccccccaagttttggaccc

SEQ ID NO: 3371 - DNA, 22 bp, Artificial Sequence
  chemically synthesized
gtccccccaagttttggacccc

SEQ ID NO: 3372 - DNA, 22 bp, Artificial Sequence
  chemically synthesized
tccccccaagttttggacccct

SEQ ID NO: 3373 - DNA, 22 bp, Artificial Sequence
  chemically synthesized
tggacccctaagggaagaatga

SEQ ID NO: 3374 - DNA, 22 bp, Artificial Sequence
  chemically synthesized
ggacccctaagggaagaatgag

SEQ ID NO: 3375 - DNA, 22 bp, Artificial Sequence
  chemically synthesized
gacccctaagggaagaatgaga

SEQ ID NO: 3376 - DNA, 22 bp, Artificial Sequence
  chemically synthesized
agggaagaatgagaaacggtgg

SEQ ID NO: 3377 - DNA, 22 bp, Artificial Sequence
  chemically synthesized
gctgcagggccccgtgcagagg

SEQ ID NO: 3378 - DNA, 22 bp, Artificial Sequence
  chemically synthesized
cagggccccgtgcagagggggc

SEQ ID NO: 3379 - DNA, 22 bp, Artificial Sequence
  chemically synthesized
agtgaactggagtgtgacagcc

SEQ ID NO: 3380 - DNA, 22 bp, Artificial Sequence
  chemically synthesized
gagtgtgacagcctggggccca

SEQ ID NO: 3381 - DNA, 22 bp, Artificial Sequence
  chemically synthesized
gggcccaggcacacaggtgtgc

SEQ ID NO: 3382 - DNA, 22 bp, Artificial Sequence
  chemically synthesized
tctcacccctctgggagtcccg

SEQ ID NO: 3383 - DNA, 22 bp, Artificial Sequence
  chemically synthesized
acccctctgggagtcccgccca

SEQ ID NO: 3384 - DNA, 22 bp, Artificial Sequence
  chemically synthesized
tgggagtcccgcccaggcccct

SEQ ID NO: 3385 - DNA, 22 bp, Artificial Sequence
  chemically synthesized
ggagtcccgcccaggcccctga

SEQ ID NO: 3386 - DNA, 22 bp, Artificial Sequence
  chemically synthesized
agtctgtcccagcacagggtgg

SEQ ID NO: 3387 - DNA, 22 bp, Artificial Sequence
  chemically synthesized
tcccagcacagggtggccttcc

SEQ ID NO: 3388 - DNA, 22 bp, Artificial Sequence
  chemically synthesized
cctccaccctgcatagccctgg

SEQ ID NO: 3389 - DNA, 22 bp, Artificial Sequence
  chemically synthesized
ctccaccctgcatagccctggg

SEQ ID NO: 3390 - DNA, 22 bp, Artificial Sequence
  chemically synthesized
caccctgcatagccctgggccc

SEQ ID NO: 3391 - DNA, 22 bp, Artificial Sequence
  chemically synthesized
catagccctgggcccacggctt

SEQ ID NO: 3392 - DNA, 22 bp, Artificial Sequence
  chemically synthesized
ggcccacggcttcgttcctgca

SEQ ID NO: 3393 - DNA, 22 bp, Artificial Sequence
  chemically synthesized
cgttcctgcagagtatctgctg

SEQ ID NO: 3394 - DNA, 22 bp, Artificial Sequence
  chemically synthesized
gttcctgcagagtatctgctgg

SEQ ID NO: 3395 - DNA, 22 bp, Artificial Sequence
  chemically synthesized
ctgcagagtatctgctggggtg

SEQ ID NO: 3396 - DNA, 22 bp, Artificial Sequence
  chemically synthesized
cagagtatctgctggggtggtt

SEQ ID NO: 3397 - DNA, 22 bp, Artificial Sequence
  chemically synthesized
ctggggtggtttccgagcttga

SEQ ID NO: 3398 - DNA, 22 bp, Artificial Sequence
  chemically synthesized
gggtggtttccgagcttgaccc

SEQ ID NO: 3399 - DNA, 22 bp, Artificial Sequence
  chemically synthesized
ccgagcttgacccttggaagga

SEQ ID NO: 3400 - DNA, 22 bp, Artificial Sequence
  chemically synthesized
cgagcttgacccttggaaggac

SEQ ID NO: 3401 - DNA, 22 bp, Artificial Sequence
  chemically synthesized
gacccttggaaggacctggctg

SEQ ID NO: 3402 - DNA, 22 bp, Artificial Sequence
  chemically synthesized
acccttggaaggacctggctgg

SEQ ID NO: 3403 - DNA, 22 bp, Artificial Sequence
  chemically synthesized
ggaaggacctggctgggtttaa

SEQ ID NO: 3404 - DNA, 22 bp, Artificial Sequence
  chemically synthesized
gaaggacctggctgggtttaag

SEQ ID NO: 3405 - DNA, 22 bp, Artificial Sequence
  chemically synthesized
gctgggtttaaggcaggagggg

SEQ ID NO: 3406 - DNA, 22 bp, Artificial Sequence
  chemically synthesized
ggtttaaggcaggaggggctgg

SEQ ID NO: 3407 - DNA, 22 bp, Artificial Sequence
  chemically synthesized
aaggcaggaggggctgggggcc

SEQ ID NO: 3408 - DNA, 22 bp, Artificial Sequence
  chemically synthesized
aggcaggaggggctgggggcca

SEQ ID NO: 3409 - DNA, 22 bp, Artificial Sequence
  chemically synthesized
ggggccaggactcctggctctg

SEQ ID NO: 3410 - DNA, 22 bp, Artificial Sequence
  chemically synthesized
ctggctctgaaggaggaggggc

SEQ ID NO: 3411 - DNA, 22 bp, Artificial Sequence
  chemically synthesized
gctctgaaggaggaggggctgg

SEQ ID NO: 3412 - DNA, 22 bp, Artificial Sequence
  chemically synthesized
tgaaggaggaggggctggaacc

SEQ ID NO: 3413 - DNA, 22 bp, Artificial Sequence
  chemically synthesized
aaggaggaggggctggaacctc

SEQ ID NO: 3414 - DNA, 22 bp, Artificial Sequence
  chemically synthesized
gaacctcttccctagtctgagc

SEQ ID NO: 3415 - DNA, 22 bp, Artificial Sequence
  chemically synthesized
ttccctagtctgagcactggaa

SEQ ID NO: 3416 - DNA, 22 bp, Artificial Sequence
  chemically synthesized
ccctagtctgagcactggaagc

SEQ ID NO: 3417 - DNA, 22 bp, Artificial Sequence
  chemically synthesized
cctagtctgagcactggaagcg

SEQ ID NO: 3418 - DNA, 22 bp, Artificial Sequence
  chemically synthesized
gtctgagcactggaagcgccac

SEQ ID NO: 3419 - DNA, 22 bp, Artificial Sequence
  chemically synthesized
agcactggaagcgccacctgtg

SEQ ID NO: 3420 - DNA, 22 bp, Artificial Sequence
  chemically synthesized
gaagcgccacctgtgggtggtg

SEQ ID NO: 3421 - DNA, 22 bp, Artificial Sequence
  chemically synthesized
tgggtggtgacgggggttttgc

SEQ ID NO: 3422 - DNA, 22 bp, Artificial Sequence
  chemically synthesized
tgccgtgtctaacaggtaccat

SEQ ID NO: 3423 - DNA, 22 bp, Artificial Sequence
  chemically synthesized
gccgtgtctaacaggtaccatg

SEQ ID NO: 3424 - DNA, 22 bp, Artificial Sequence
  chemically synthesized
ccgtgtctaacaggtaccatgt

SEQ ID NO: 3425 - DNA, 22 bp, Artificial Sequence
  chemically synthesized
acaggtaccatgtggggttccc

SEQ ID NO: 3426 - DNA, 22 bp, Artificial Sequence
  chemically synthesized
ccgcacccagatgagaagcccc

SEQ ID NO: 3427 - DNA, 22 bp, Artificial Sequence
  chemically synthesized
ccttccccgttcacttcctgtt

SEQ ID NO: 3428 - DNA, 22 bp, Artificial Sequence
  chemically synthesized
ccccgttcacttcctgtttgca

SEQ ID NO: 3429 - DNA, 22 bp, Artificial Sequence
  chemically synthesized
cccgttcacttcctgtttgcag

SEQ ID NO: 3430 - DNA, 22 bp, Artificial Sequence
  chemically synthesized
acttcctgtttgcagatagcca

SEQ ID NO: 3431 - DNA, 22 bp, Artificial Sequence
  chemically synthesized
cctgtttgcagatagccaggag

SEQ ID NO: 3432 - DNA, 22 bp, Artificial Sequence
  chemically synthesized
ctgtttgcagatagccaggagt

SEQ ID NO: 3433 - DNA, 22 bp, Artificial Sequence
  chemically synthesized
tttgcagatagccaggagtcct

SEQ ID NO: 3434 - DNA, 22 bp, Artificial Sequence
  chemically synthesized
gcagatagccaggagtcctttc

SEQ ID NO: 3435 - DNA, 22 bp, Artificial Sequence
  chemically synthesized
cagatagccaggagtcctttcg

SEQ ID NO: 3436 - DNA, 22 bp, Artificial Sequence
  chemically synthesized
tcgtggtttccactgagcactg

SEQ ID NO: 3437 - DNA, 22 bp, Artificial Sequence
  chemically synthesized
cgtggtttccactgagcactga

SEQ ID NO: 3438 - DNA, 22 bp, Artificial Sequence
  chemically synthesized
gtggtttccactgagcactgaa

SEQ ID NO: 3439 - DNA, 22 bp, Artificial Sequence
  chemically synthesized
ccactgagcactgaaggcctgg

SEQ ID NO: 3440 - DNA, 22 bp, Artificial Sequence
  chemically synthesized
cactgagcactgaaggcctggc

SEQ ID NO: 3441 - DNA, 22 bp, Artificial Sequence
  chemically synthesized
agcactgaaggcctggccggcc

SEQ ID NO: 3442 - DNA, 22 bp, Artificial Sequence
  chemically synthesized
aaggcctggccggcctgaccac

SEQ ID NO: 3443 - DNA, 22 bp, Artificial Sequence
  chemically synthesized
gccggcctgaccactgggcaac

SEQ ID NO: 3444 - DNA, 22 bp, Artificial Sequence
  chemically synthesized
accactgggcaaccaggcgtat

SEQ ID NO: 3445 - DNA, 22 bp, Artificial Sequence
  chemically synthesized
ggcaaccaggcgtatcttaaac

SEQ ID NO: 3446 - DNA, 22 bp, Artificial Sequence
  chemically synthesized
aaacagccagtggccagaggct

SEQ ID NO: 3447 - DNA, 22 bp, Artificial Sequence
  chemically synthesized
aacagccagtggccagaggctg

SEQ ID NO: 3448 - DNA, 22 bp, Artificial Sequence
  chemically synthesized
ttgggtcattttccccactgtc

SEQ ID NO: 3449 - DNA, 22 bp, Artificial Sequence
  chemically synthesized
ggtcattttccccactgtccta

SEQ ID NO: 3450 - DNA, 22 bp, Artificial Sequence
  chemically synthesized
tccccactgtcctagcaccgtg

SEQ ID NO: 3451 - DNA, 22 bp, Artificial Sequence
  chemically synthesized
ccccactgtcctagcaccgtgt

SEQ ID NO: 3452 - DNA, 22 bp, Artificial Sequence
  chemically synthesized
cccactgtcctagcaccgtgtc

SEQ ID NO: 3453 - DNA, 22 bp, Artificial Sequence
  chemically synthesized
tcctagcaccgtgtccctggat

SEQ ID NO: 3454 - DNA, 22 bp, Artificial Sequence
  chemically synthesized
gcaccgtgtccctggatctgtt

SEQ ID NO: 3455 - DNA, 22 bp, Artificial Sequence
  chemically synthesized
gatctgttttcgtggctccctc

SEQ ID NO: 3456 - DNA, 22 bp, Artificial Sequence
  chemically synthesized
ttttcgtggctccctctggagt

SEQ ID NO: 3457 - DNA, 22 bp, Artificial Sequence
  chemically synthesized
tcgtggctccctctggagtccc

SEQ ID NO: 3458 - DNA, 22 bp, Artificial Sequence
  chemically synthesized
cgtggctccctctggagtcccg

SEQ ID NO: 3459 - DNA, 22 bp, Artificial Sequence
  chemically synthesized
gtggctccctctggagtcccga

SEQ ID NO: 3460 - DNA, 22 bp, Artificial Sequence
  chemically synthesized
cctctggagtcccgacttgctg

SEQ ID NO: 3461 - DNA, 22 bp, Artificial Sequence
  chemically synthesized
tggagtcccgacttgctgggac

SEQ ID NO: 3462 - DNA, 22 bp, Artificial Sequence
  chemically synthesized
gagtcccgacttgctgggacac

SEQ ID NO: 3463 - DNA, 22 bp, Artificial Sequence
  chemically synthesized
gctgggacaccgtggctggggt

SEQ ID NO: 3464 - DNA, 22 bp, Artificial Sequence
  chemically synthesized
ctgggacaccgtggctggggta

SEQ ID NO: 3465 - DNA, 22 bp, Artificial Sequence
  chemically synthesized
ggacaccgtggctggggtaggt

SEQ ID NO: 3466 - DNA, 22 bp, Artificial Sequence
  chemically synthesized
gggtaggtgcggctgacggctg

SEQ ID NO: 3467 - DNA, 22 bp, Artificial Sequence
  chemically synthesized
acggctgtttcccacccccagg

SEQ ID NO: 3468 - DNA, 22 bp, Artificial Sequence
  chemically synthesized
tttcccacccccaggcctgcat

SEQ ID NO: 3469 - DNA, 22 bp, Artificial Sequence
  chemically synthesized
cccacccccaggcctgcattga

SEQ ID NO: 3470 - DNA, 22 bp, Artificial Sequence
  chemically synthesized
ccacccccaggcctgcattgat

SEQ ID NO: 3471 - DNA, 22 bp, Artificial Sequence
  chemically synthesized
cattgatgagaacctggaggtg

SEQ ID NO: 3472 - DNA, 22 bp, Artificial Sequence
  chemically synthesized
atgagaacctggaggtggtgcg

SEQ ID NO: 3473 - DNA, 22 bp, Artificial Sequence
  chemically synthesized
gaggtggtgcgcttcttggtgg

SEQ ID NO: 3474 - DNA, 22 bp, Artificial Sequence
  chemically synthesized
cttggtggagcagggcgccact

SEQ ID NO: 3475 - DNA, 22 bp, Artificial Sequence
  chemically synthesized
ttggtggagcagggcgccactg

SEQ ID NO: 3476 - DNA, 22 bp, Artificial Sequence
  chemically synthesized
ggtggagcagggcgccactgtg

SEQ ID NO: 3477 - DNA, 22 bp, Artificial Sequence
  chemically synthesized
gtggagcagggcgccactgtga

SEQ ID NO: 3478 - DNA, 22 bp, Artificial Sequence
  chemically synthesized
tgaaccaggcagacaacgaggg

SEQ ID NO: 3479 - DNA, 22 bp, Artificial Sequence
  chemically synthesized
gacgccactgcacgtggccgcc

SEQ ID NO: 3480 - DNA, 22 bp, Artificial Sequence
  chemically synthesized
cacgtggccgcctcctgtggct

SEQ ID NO: 3481 - DNA, 22 bp, Artificial Sequence
  chemically synthesized
ctgtggctacctagatatcgcc

SEQ ID NO: 3482 - DNA, 20 bp, Artificial Sequence
  chemically synthesized
taatttccctccgtttgtcc

SEQ ID NO: 3483 - DNA, 20 bp, Artificial Sequence
  chemically synthesized
ctgtcaaccccacacgcctt

SEQ ID NO: 3484 - DNA, 20 bp, Artificial Sequence
  chemically synthesized
cacacgcctttggcacaatg

SEQ ID NO: 3485 - DNA, 20 bp, Artificial Sequence
  chemically synthesized
acgcctttggcacaatgaag

SEQ ID NO: 3486 - DNA, 20 bp, Artificial Sequence
  chemically synthesized
cgcctttggcacaatgaagt

SEQ ID NO: 3487 - DNA, 20 bp, Artificial Sequence
  chemically synthesized
atttcccttctttttctctt

SEQ ID NO: 3488 - DNA, 20 bp, Artificial Sequence
  chemically synthesized
ccttctttttctctttagct

SEQ ID NO: 3489 - DNA, 20 bp, Artificial Sequence
  chemically synthesized
ctctttagctcggcttattc

SEQ ID NO: 3490 - DNA, 20 bp, Artificial Sequence
  chemically synthesized
tctttagctcggcttattcc

SEQ ID NO: 3491 - DNA, 20 bp, Artificial Sequence
  chemically synthesized
ctttagctcggcttattcca

SEQ ID NO: 3492 - DNA, 20 bp, Artificial Sequence
  chemically synthesized
tttagctcggcttattccag

SEQ ID NO: 3493 - DNA, 20 bp, Artificial Sequence
  chemically synthesized
ttccaggggtgtgtttcgtc

SEQ ID NO: 3494 - DNA, 20 bp, Artificial Sequence
  chemically synthesized
tgtttcgtcgagatgcacgt

SEQ ID NO: 3495 - DNA, 20 bp, Artificial Sequence
  chemically synthesized
caacttttattctattttcc

SEQ ID NO: 3496 - DNA, 20 bp, Artificial Sequence
  chemically synthesized
tctattttcccagtaaaata

SEQ ID NO: 3497 - DNA, 20 bp, Artificial Sequence
  chemically synthesized
ttcccagtaaaataaagttt

SEQ ID NO: 3498 - DNA, 20 bp, Artificial Sequence
  chemically synthesized
tagtaaactctgcatcttta

SEQ ID NO: 3499 - DNA, 20 bp, Artificial Sequence
  chemically synthesized
gcatctttaaagaattattt

SEQ ID NO: 3500 - DNA, 20 bp, Artificial Sequence
  chemically synthesized
tttggcatttatttctaaaa

SEQ ID NO: 3501 - DNA, 20 bp, Artificial Sequence
  chemically synthesized
catttatttctaaaatggca

SEQ ID NO: 3502 - DNA, 20 bp, Artificial Sequence
  chemically synthesized
catagtattttgtatttgtg

SEQ ID NO: 3503 - DNA, 20 bp, Artificial Sequence
  chemically synthesized
ttgtatttgtgaagtcttac

SEQ ID NO: 3504 - DNA, 20 bp, Artificial Sequence
  chemically synthesized
tgtatttgtgaagtcttaca

SEQ ID NO: 3505 - DNA, 20 bp, Artificial Sequence
  chemically synthesized
ttaataaaattcaaacatcc

SEQ ID NO: 3506 - DNA, 20 bp, Artificial Sequence
  chemically synthesized
taataaaattcaaacatcct

SEQ ID NO: 3507 - DNA, 20 bp, Artificial Sequence
  chemically synthesized
atcctaggtaaaaaaaaaaa

SEQ ID NO: 3508 - DNA, 20 bp, Artificial Sequence
  chemically synthesized
tcctaggtaaaaaaaaaaaa

SEQ ID NO: 3509 - DNA, 20 bp, Artificial Sequence
  chemically synthesized
aggtaaaaaaaaaaaaaggt

SEQ ID NO: 3510 - DNA, 20 bp, Artificial Sequence
  chemically synthesized
aaaaaaaggtcagaattgtt

SEQ ID NO: 3511 - DNA, 20 bp, Artificial Sequence
  chemically synthesized
gtaattttcttttgcgcact

SEQ ID NO: 3512 - DNA, 20 bp, Artificial Sequence
  chemically synthesized
taattttcttttgcgcacta

SEQ ID NO: 3513 - DNA, 20 bp, Artificial Sequence
  chemically synthesized
tttcttttgcgcactaagga

SEQ ID NO: 3514 - DNA, 20 bp, Artificial Sequence
  chemically synthesized
tgcgcactaaggaaagtgca

SEQ ID NO: 3515 - DNA, 20 bp, Artificial Sequence
  chemically synthesized
aaggaaagtgcaaagtaact

SEQ ID NO: 3516 - DNA, 20 bp, Artificial Sequence
  chemically synthesized
ggaaagtgcaaagtaactta

SEQ ID NO: 3517 - DNA, 20 bp, Artificial Sequence
  chemically synthesized
ttagagtgactgaaacttca

SEQ ID NO: 3518 - DNA, 20 bp, Artificial Sequence
  chemically synthesized
gtgactgaaacttcacagaa

SEQ ID NO: 3519 - DNA, 20 bp, Artificial Sequence
  chemically synthesized
tgactgaaacttcacagaat

SEQ ID NO: 3520 - DNA, 20 bp, Artificial Sequence
  chemically synthesized
gactgaaacttcacagaata

SEQ ID NO: 3521 - DNA, 20 bp, Artificial Sequence
  chemically synthesized
aacttcacagaatagggttg

SEQ ID NO: 3522 - DNA, 20 bp, Artificial Sequence
  chemically synthesized
ttgaattcataactatccca

SEQ ID NO: 3523 - DNA, 20 bp, Artificial Sequence
  chemically synthesized
tgtgctgttgatctcataaa

SEQ ID NO: 3524 - DNA, 20 bp, Artificial Sequence
  chemically synthesized
atttatatttattttcattt

SEQ ID NO: 3525 - DNA, 20 bp, Artificial Sequence
  chemically synthesized
ttcattttagtctgtcttct

SEQ ID NO: 3526 - DNA, 20 bp, Artificial Sequence
  chemically synthesized
gtcttcttggttgctgttga

SEQ ID NO: 3527 - DNA, 20 bp, Artificial Sequence
  chemically synthesized
ttgctgttgatagacactaa

SEQ ID NO: 3528 - DNA, 20 bp, Artificial Sequence
  chemically synthesized
gctgttgatagacactaaaa

SEQ ID NO: 3529 - DNA, 20 bp, Artificial Sequence
  chemically synthesized
gatagacactaaaagagtat

SEQ ID NO: 3530 - DNA, 20 bp, Artificial Sequence
  chemically synthesized
aagagtattagatattatct

SEQ ID NO: 3531 - DNA, 20 bp, Artificial Sequence
  chemically synthesized
tattatctaagtttgaatat

SEQ ID NO: 3532 - DNA, 20 bp, Artificial Sequence
  chemically synthesized
attatctaagtttgaatata

SEQ ID NO: 3533 - DNA, 20 bp, Artificial Sequence
  chemically synthesized
atatttaataatttttaaaa

SEQ ID NO: 3534 - DNA, 20 bp, Artificial Sequence
  chemically synthesized
aatttttaaaatagtattct

SEQ ID NO: 3535 - DNA, 20 bp, Artificial Sequence
  chemically synthesized
ttgaattattcttctgttta

SEQ ID NO: 3536 - DNA, 20 bp, Artificial Sequence
  chemically synthesized
tgaattattcttctgtttaa

SEQ ID NO: 3537 - DNA, 20 bp, Artificial Sequence
  chemically synthesized
attattcttctgtttaaagg

SEQ ID NO: 3538 - DNA, 20 bp, Artificial Sequence
  chemically synthesized
attcttctgtttaaaggcag

SEQ ID NO: 3539 - DNA, 20 bp, Artificial Sequence
  chemically synthesized
aaataattgaacatcatcct

SEQ ID NO: 3540 - DNA, 20 bp, Artificial Sequence
  chemically synthesized
catcatcctgagtttttctg

SEQ ID NO: 3541 - DNA, 20 bp, Artificial Sequence
  chemically synthesized
atcatcctgagtttttctgt

SEQ ID NO: 3542 - DNA, 20 bp, Artificial Sequence
  chemically synthesized
ctgagtttttctgtaggaat

SEQ ID NO: 3543 - DNA, 20 bp, Artificial Sequence
  chemically synthesized
gagtttttctgtaggaatca

SEQ ID NO: 3544 - DNA, 20 bp, Artificial Sequence
  chemically synthesized
ttgaaacaaatgcataatct

SEQ ID NO: 3545 - DNA, 20 bp, Artificial Sequence
  chemically synthesized
aatgcataatctaagtcaaa

SEQ ID NO: 3546 - DNA, 20 bp, Artificial Sequence
  chemically synthesized
cataatctaagtcaaatgga

SEQ ID NO: 3547 - DNA, 20 bp, Artificial Sequence
  chemically synthesized
caaatggaaagaaatataaa

SEQ ID NO: 3548 - DNA, 20 bp, Artificial Sequence
  chemically synthesized
ttattacttcttgttttctt

SEQ ID NO: 3549 - DNA, 20 bp, Artificial Sequence
  chemically synthesized
cttttttttcttcccttgcc

SEQ ID NO: 3550 - DNA, 20 bp, Artificial Sequence
  chemically synthesized
ttttcttcccttgcccagac

SEQ ID NO: 3551 - DNA, 20 bp, Artificial Sequence
  chemically synthesized
ttcttcccttgcccagacaa

SEQ ID NO: 3552 - DNA, 20 bp, Artificial Sequence
  chemically synthesized
tcccttgcccagacaagagt

SEQ ID NO: 3553 - DNA, 20 bp, Artificial Sequence
  chemically synthesized
cccttgcccagacaagagtg

SEQ ID NO: 3554 - DNA, 20 bp, Artificial Sequence
  chemically synthesized
acaagagtgaggttgctcat

SEQ ID NO: 3555 - DNA, 20 bp, Artificial Sequence
  chemically synthesized
tgaggttgctcatcggttta

SEQ ID NO: 3556 - DNA, 20 bp, Artificial Sequence
  chemically synthesized
tgctcatcggtttaaagatt

SEQ ID NO: 3557 - DNA, 20 bp, Artificial Sequence
  chemically synthesized
gctcatcggtttaaagattt

SEQ ID NO: 3558 - DNA, 20 bp, Artificial Sequence
  chemically synthesized
tcatcggtttaaagatttgg

SEQ ID NO: 3559 - DNA, 20 bp, Artificial Sequence
  chemically synthesized
tcggtttaaagatttgggag

SEQ ID NO: 3560 - DNA, 20 bp, Artificial Sequence
  chemically synthesized
tttgggagaagaaaatttca

SEQ ID NO: 3561 - DNA, 20 bp, Artificial Sequence
  chemically synthesized
tcccaaatctttaaaccgat

SEQ ID NO: 3562 - DNA, 20 bp, Artificial Sequence
  chemically synthesized
tgagcaacctcactcttgtc

SEQ ID NO: 3563 - DNA, 20 bp, Artificial Sequence
  chemically synthesized
gagcaacctcactcttgtct

SEQ ID NO: 3564 - DNA, 20 bp, Artificial Sequence
  chemically synthesized
aacctcactcttgtctgggc

SEQ ID NO: 3565 - DNA, 20 bp, Artificial Sequence
  chemically synthesized
acctcactcttgtctgggca

SEQ ID NO: 3566 - DNA, 20 bp, Artificial Sequence
  chemically synthesized
cctcactcttgtctgggcaa

SEQ ID NO: 3567 - DNA, 20 bp, Artificial Sequence
  chemically synthesized
cactcttgtctgggcaaggg

SEQ ID NO: 3568 - DNA, 20 bp, Artificial Sequence
  chemically synthesized
ctgggcaagggaagaaaaaa

SEQ ID NO: 3569 - DNA, 20 bp, Artificial Sequence
  chemically synthesized
tgggcaagggaagaaaaaaa

SEQ ID NO: 3570 - DNA, 20 bp, Artificial Sequence
  chemically synthesized
aaaaggattgttaaatactg

SEQ ID NO: 3571 - DNA, 20 bp, Artificial Sequence
  chemically synthesized
tgttaaatactgaagaaaac

SEQ ID NO: 3572 - DNA, 20 bp, Artificial Sequence
  chemically synthesized
taaatactgaagaaaacaag

SEQ ID NO: 3573 - DNA, 20 bp, Artificial Sequence
  chemically synthesized
atatttctttccatttgact

SEQ ID NO: 3574 - DNA, 20 bp, Artificial Sequence
  chemically synthesized
atgcatttgtttcaaaatat

SEQ ID NO: 3575 - DNA, 20 bp, Artificial Sequence
  chemically synthesized
tgcatttgtttcaaaatatt

SEQ ID NO: 3576 - DNA, 20 bp, Artificial Sequence
  chemically synthesized
atattgggctctgattccta

SEQ ID NO: 3577 - DNA, 20 bp, Artificial Sequence
  chemically synthesized
ctgattcctacagaaaaact

SEQ ID NO: 3578 - DNA, 20 bp, Artificial Sequence
  chemically synthesized
tgattcctacagaaaaactc

SEQ ID NO: 3579 - DNA, 20 bp, Artificial Sequence
  chemically synthesized
ttatttcttctgcctttaaa

SEQ ID NO: 3580 - DNA, 20 bp, Artificial Sequence
  chemically synthesized
tttcttctgcctttaaacag

SEQ ID NO: 3581 - DNA, 20 bp, Artificial Sequence
  chemically synthesized
agaagaataattcaattacc

SEQ ID NO: 3582 - DNA, 20 bp, Artificial Sequence
  chemically synthesized
taaaaattattaaatattta

SEQ ID NO: 3583 - DNA, 20 bp, Artificial Sequence
  chemically synthesized
tatagccttatattcaaact

SEQ ID NO: 3584 - DNA, 20 bp, Artificial Sequence
  chemically synthesized
gataatatctaatactcttt

SEQ ID NO: 3585 - DNA, 20 bp, Artificial Sequence
  chemically synthesized
actcttttagtgtctatcaa

SEQ ID NO: 3586 - DNA, 20 bp, Artificial Sequence
  chemically synthesized
agtgtctatcaacagcaacc

SEQ ID NO: 3587 - DNA, 20 bp, Artificial Sequence
  chemically synthesized
gtctatcaacagcaaccaag

SEQ ID NO: 3588 - DNA, 20 bp, Artificial Sequence
  chemically synthesized
atcaacagcaaccaagaaga

SEQ ID NO: 3589 - DNA, 20 bp, Artificial Sequence
  chemically synthesized
atgaaaataaatataaatac

SEQ ID NO: 3590 - DNA, 20 bp, Artificial Sequence
  chemically synthesized
taaatacaagttctatttat

SEQ ID NO: 3591 - DNA, 20 bp, Artificial Sequence
  chemically synthesized
agttctatttatgagatcaa

SEQ ID NO: 3592 - DNA, 20 bp, Artificial Sequence
  chemically synthesized
tatttatgagatcaacagca

SEQ ID NO: 3593 - DNA, 20 bp, Artificial Sequence
  chemically synthesized
atttatgagatcaacagcac

SEQ ID NO: 3594 - DNA, 20 bp, Artificial Sequence
  chemically synthesized
gatcaacagcacaggttttg

SEQ ID NO: 3595 - DNA, 20 bp, Artificial Sequence
  chemically synthesized
ggttttgtggtttttaaata

SEQ ID NO: 3596 - DNA, 20 bp, Artificial Sequence
  chemically synthesized
tgtggtttttaaataaagca

SEQ ID NO: 3597 - DNA, 20 bp, Artificial Sequence
  chemically synthesized
ttaaataaagcatagtgcaa

SEQ ID NO: 3598 - DNA, 20 bp, Artificial Sequence
  chemically synthesized
ataaagcatagtgcaatgga

SEQ ID NO: 3599 - DNA, 20 bp, Artificial Sequence
  chemically synthesized
taaagcatagtgcaatggat

SEQ ID NO: 3600 - DNA, 20 bp, Artificial Sequence
  chemically synthesized
tagtgcaatggataggtctt

SEQ ID NO: 3601 - DNA, 20 bp, Artificial Sequence
  chemically synthesized
agtgcaatggataggtcttt

SEQ ID NO: 3602 - DNA, 20 bp, Artificial Sequence
  chemically synthesized
caatggataggtctttggga

SEQ ID NO: 3603 - DNA, 20 bp, Artificial Sequence
  chemically synthesized
atcttcaaccctattctgtg

SEQ ID NO: 3604 - DNA, 20 bp, Artificial Sequence
  chemically synthesized
aaccctattctgtgaagttt

SEQ ID NO: 3605 - DNA, 20 bp, Artificial Sequence
  chemically synthesized
tgtgaagtttcagtcactct

SEQ ID NO: 3606 - DNA, 20 bp, Artificial Sequence
  chemically synthesized
aagttactttgcactttcct

SEQ ID NO: 3607 - DNA, 20 bp, Artificial Sequence
  chemically synthesized
gcactttccttagtgcgcaa

SEQ ID NO: 3608 - DNA, 20 bp, Artificial Sequence
  chemically synthesized
tagtgcgcaaaagaaaatta

SEQ ID NO: 3609 - DNA, 20 bp, Artificial Sequence
  chemically synthesized
gacctttttttttttttacc

SEQ ID NO: 3610 - DNA, 20 bp, Artificial Sequence
  chemically synthesized
acctttttttttttttacct

SEQ ID NO: 3611 - DNA, 20 bp, Artificial Sequence
  chemically synthesized
gatgtttgaattttattaat

SEQ ID NO: 3612 - DNA, 20 bp, Artificial Sequence
  chemically synthesized
tattaataagataaccttgt

SEQ ID NO: 3613 - DNA, 20 bp, Artificial Sequence
  chemically synthesized
tacaaaatactatgccattt

SEQ ID NO: 3614 - DNA, 20 bp, Artificial Sequence
  chemically synthesized
aatgccaaaataattcttta

SEQ ID NO: 3615 - DNA, 20 bp, Artificial Sequence
  chemically synthesized
aaaataattctttaaagatg

SEQ ID NO: 3616 - DNA, 20 bp, Artificial Sequence
  chemically synthesized
aataattctttaaagatgca

SEQ ID NO: 3617 - DNA, 20 bp, Artificial Sequence
  chemically synthesized
ttactaaaactttattttac

SEQ ID NO: 3618 - DNA, 20 bp, Artificial Sequence
  chemically synthesized
tactaaaactttattttact

SEQ ID NO: 3619 - DNA, 20 bp, Artificial Sequence
  chemically synthesized
actttattttactgggaaaa

SEQ ID NO: 3620 - DNA, 20 bp, Artificial Sequence
  chemically synthesized
ttactgggaaaatagaataa

SEQ ID NO: 3621 - DNA, 20 bp, Artificial Sequence
  chemically synthesized
atagaataaaagttgaacaa

SEQ ID NO: 3622 - DNA, 20 bp, Artificial Sequence
  chemically synthesized
aaagttgaacaatagaaaaa

SEQ ID NO: 3623 - DNA, 20 bp, Artificial Sequence
  chemically synthesized
atctcgacgaaacacacccc

SEQ ID NO: 3624 - DNA, 20 bp, Artificial Sequence
  chemically synthesized
acgaaacacacccctggaat

SEQ ID NO: 3625 - DNA, 20 bp, Artificial Sequence
  chemically synthesized
acacacccctggaataagcc

SEQ ID NO: 3626 - DNA, 20 bp, Artificial Sequence
  chemically synthesized
ccctggaataagccgagcta

SEQ ID NO: 3627 - DNA, 20 bp, Artificial Sequence
  chemically synthesized
ctggaataagccgagctaaa

SEQ ID NO: 3628 - DNA, 20 bp, Artificial Sequence
  chemically synthesized
taagccgagctaaagagaaa

SEQ ID NO: 3629 - DNA, 20 bp, Artificial Sequence
  chemically synthesized
gccgagctaaagagaaaaag

SEQ ID NO: 3630 - DNA, 20 bp, Artificial Sequence
  chemically synthesized
ccgagctaaagagaaaaaga

SEQ ID NO: 3631 - DNA, 20 bp, Artificial Sequence
  chemically synthesized
cgagctaaagagaaaaagaa

SEQ ID NO: 3632 - DNA, 20 bp, Artificial Sequence
  chemically synthesized
agagaaaaagaagggaaata

SEQ ID NO: 3633 - DNA, 20 bp, Artificial Sequence
  chemically synthesized
gagaaaaagaagggaaataa

SEQ ID NO: 3634 - DNA, 20 bp, Artificial Sequence
  chemically synthesized
ttacccacttcattgtgcca

SEQ ID NO: 3635 - DNA, 20 bp, Artificial Sequence
  chemically synthesized
tacccacttcattgtgccaa

SEQ ID NO: 3636 - DNA, 20 bp, Artificial Sequence
  chemically synthesized
ttcattgtgccaaaggcgtg

SEQ ID NO: 3637 - DNA, 20 bp, Artificial Sequence
  chemically synthesized
tcattgtgccaaaggcgtgt

SEQ ID NO: 3638 - DNA, 20 bp, Artificial Sequence
  chemically synthesized
cattgtgccaaaggcgtgtg

SEQ ID NO: 3639 - DNA, 20 bp, Artificial Sequence
  chemically synthesized
ccaaaggcgtgtggggttga

SEQ ID NO: 3640 - DNA, 20 bp, Artificial Sequence
  chemically synthesized
aaggcgtgtggggttgacag

SEQ ID NO: 3641 - DNA, 20 bp, Artificial Sequence
  chemically synthesized
ggcgtgtggggttgacagaa

SEQ ID NO: 3642 - DNA, 20 bp, Artificial Sequence
  chemically synthesized
gtggggttgacagaagagaa

SEQ ID NO: 3643 - DNA, 20 bp, Artificial Sequence
  chemically synthesized
ggttgacagaagagaaaagc

SEQ ID NO: 3644 - DNA, 20 bp, Artificial Sequence
  chemically synthesized
gttgacagaagagaaaagct

SEQ ID NO: 3645 - DNA, 20 bp, Artificial Sequence
  chemically synthesized
aagagaaaagctaggacaaa

SEQ ID NO: 3646 - DNA, 20 bp, Artificial Sequence
  chemically synthesized
gagaaaagctaggacaaacg

SEQ ID NO: 3647 - DNA, 20 bp, Artificial Sequence
  chemically synthesized
agaaaagctaggacaaacgg

SEQ ID NO: 3648 - DNA, 20 bp, Artificial Sequence
  chemically synthesized
gaaaagctaggacaaacgga

SEQ ID NO: 3649 - DNA, 20 bp, Artificial Sequence
  chemically synthesized
taggacaaacggagggaaat

SEQ ID NO: 3650 - DNA, 20 bp, Artificial Sequence
  chemically synthesized
cacgcctttggcacaatgaa

SEQ ID NO: 3651 - DNA, 20 bp, Artificial Sequence
  chemically synthesized
tctttagctcggcttattcc

SEQ ID NO: 3652 - DNA, 20 bp, Artificial Sequence
  chemically synthesized
tagtaaactctgcatcttta

SEQ ID NO: 3653 - DNA, 20 bp, Artificial Sequence
  chemically synthesized
aggtaaaaaaaaaaaaaggt

SEQ ID NO: 3654 - DNA, 20 bp, Artificial Sequence
  chemically synthesized
aaggaaagtgcaaagtaact

SEQ ID NO: 3655 - DNA, 20 bp, Artificial Sequence
  chemically synthesized
ttagagtgactgaaacttca

SEQ ID NO: 3656 - DNA, 20 bp, Artificial Sequence
  chemically synthesized
gtgactgaaacttcacagaa

SEQ ID NO: 3657 - DNA, 20 bp, Artificial Sequence
  chemically synthesized
tcacagaatagggttgaaga

SEQ ID NO: 3658 - DNA, 20 bp, Artificial Sequence
  chemically synthesized
ttgctgttgatagacactaa

SEQ ID NO: 3659 - DNA, 20 bp, Artificial Sequence
  chemically synthesized
gtattagatattatctaagt

SEQ ID NO: 3660 - DNA, 20 bp, Artificial Sequence
  chemically synthesized
taaaatagtattcttggtaa

SEQ ID NO: 3661 - DNA, 20 bp, Artificial Sequence
  chemically synthesized
agaaataattgaacatcatc

SEQ ID NO: 3662 - DNA, 20 bp, Artificial Sequence
  chemically synthesized
atcatcctgagtttttctgt

SEQ ID NO: 3663 - DNA, 20 bp, Artificial Sequence
  chemically synthesized
ttttcttcccttgcccagac

SEQ ID NO: 3664 - DNA, 20 bp, Artificial Sequence
  chemically synthesized
ctgggcaagggaagaaaaaa

SEQ ID NO: 3665 - DNA, 20 bp, Artificial Sequence
  chemically synthesized
ctgattcctacagaaaaact

SEQ ID NO: 3666 - DNA, 20 bp, Artificial Sequence
  chemically synthesized
tttcttctgcctttaaacag

SEQ ID NO: 3667 - DNA, 20 bp, Artificial Sequence
  chemically synthesized
agaagaataattcaattacc

SEQ ID NO: 3668 - DNA, 20 bp, Artificial Sequence
  chemically synthesized
tttaaataaagcatagtgca

SEQ ID NO: 3669 - DNA, 20 bp, Artificial Sequence
  chemically synthesized
tagtgcaatggataggtctt

SEQ ID NO: 3670 - DNA, 20 bp, Artificial Sequence
  chemically synthesized
gataggtctttgggatagtt

SEQ ID NO: 3671 - DNA, 20 bp, Artificial Sequence
  chemically synthesized
gacctttttttttttttacc

SEQ ID NO: 3672 - DNA, 20 bp, Artificial Sequence
  chemically synthesized
tttttttttacctaggatgt

SEQ ID NO: 3673 - DNA, 20 bp, Artificial Sequence
  chemically synthesized
aaaataattctttaaagatg

SEQ ID NO: 3674 - DNA, 20 bp, Artificial Sequence
  chemically synthesized
actttattttactgggaaaa

SEQ ID NO: 3675 - DNA, 20 bp, Artificial Sequence
  chemically synthesized
aaaagttgaacaatagaaaa

SEQ ID NO: 3676 - DNA, 20 bp, Artificial Sequence
  chemically synthesized
atctcgacgaaacacacccc

SEQ ID NO: 3677 - DNA, 20 bp, Artificial Sequence
  chemically synthesized
ttcattgtgccaaaggcgtg

SEQ ID NO: 3678 - DNA, 20 bp, Artificial Sequence
  chemically synthesized
gtgtttcgtcgagatgcacg

SEQ ID NO: 3679 - DNA, 20 bp, Artificial Sequence
  chemically synthesized
ttagtaaactctgcatcttt

SEQ ID NO: 3680 - DNA, 20 bp, Artificial Sequence
  chemically synthesized
taggtaaaaaaaaaaaaagg

SEQ ID NO: 3681 - DNA, 20 bp, Artificial Sequence
  chemically synthesized
cttagagtgactgaaacttc

SEQ ID NO: 3682 - DNA, 20 bp, Artificial Sequence
  chemically synthesized
tattcttctgtttaaaggca

SEQ ID NO: 3683 - DNA, 20 bp, Artificial Sequence
  chemically synthesized
gcataatctaagtcaaatgg

SEQ ID NO: 3684 - DNA, 20 bp, Artificial Sequence
  chemically synthesized
atcggtttaaagatttggga

SEQ ID NO: 3685 - DNA, 20 bp, Artificial Sequence
  chemically synthesized
tcactcttgtctgggcaagg

SEQ ID NO: 3686 - DNA, 20 bp, Artificial Sequence
  chemically synthesized
aaaaaggattgttaaatact

SEQ ID NO: 3687 - DNA, 20 bp, Artificial Sequence
  chemically synthesized
aatattgggctctgattcct

SEQ ID NO: 3688 - DNA, 20 bp, Artificial Sequence
  chemically synthesized
atttcttctgcctttaaaca

SEQ ID NO: 3689 - DNA, 20 bp, Artificial Sequence
  chemically synthesized
cagaagaataattcaattac

SEQ ID NO: 3690 - DNA, 20 bp, Artificial Sequence
  chemically synthesized
tgcactttccttagtgcgca

SEQ ID NO: 3691 - DNA, 20 bp, Artificial Sequence
  chemically synthesized
atacaaaatactatgccatt

SEQ ID NO: 3692 - DNA, 20 bp, Artificial Sequence
  chemically synthesized
aactttattttactgggaaa

SEQ ID NO: 3693 - DNA, 20 bp, Artificial Sequence
  chemically synthesized
aatagaataaaagttgaaca

SEQ ID NO: 3694 - DNA, 20 bp, Artificial Sequence
  chemically synthesized
cctggaataagccgagctaa

SEQ ID NO: 3695 - DNA, 20 bp, Artificial Sequence
  chemically synthesized
aggcgtgtggggttgacaga

SEQ ID NO: 3696 - DNA, 20 bp, Artificial Sequence
  chemically synthesized
cattgcactatgctttattt

SEQ ID NO: 3697 - DNA, 20 bp, Artificial Sequence
  chemically synthesized
tatgctttatttaaaaacca

SEQ ID NO: 3698 - DNA, 20 bp, Artificial Sequence
  chemically synthesized
aaggattgttaaatactgaa

SEQ ID NO: 3699 - DNA, 20 bp, Artificial Sequence
  chemically synthesized
ttgggctctgattcctacag

SEQ ID NO: 3700 - DNA, 20 bp, Artificial Sequence
  chemically synthesized
tttaaagatgcagagtttac

SEQ ID NO: 3701 - DNA, 20 bp, Artificial Sequence
  chemically synthesized
gtatattagtgctaatttcc

SEQ ID NO: 3702 - DNA, 20 bp, Artificial Sequence
  chemically synthesized
gctaatttccctccgtttgt

SEQ ID NO: 3703 - DNA, 20 bp, Artificial Sequence
  chemically synthesized
tcccttctttttctctttag

SEQ ID NO: 3704 - DNA, 20 bp, Artificial Sequence
  chemically synthesized
tagctcggcttattccaggg

SEQ ID NO: 3705 - DNA, 20 bp, Artificial Sequence
  chemically synthesized
attctattttcccagtaaaa

SEQ ID NO: 3706 - DNA, 20 bp, Artificial Sequence
  chemically synthesized
taaaaaaaaaaaaaggtcag

SEQ ID NO: 3707 - DNA, 20 bp, Artificial Sequence
  chemically synthesized
gaaacttcacagaatagggt

SEQ ID NO: 3708 - DNA, 20 bp, Artificial Sequence
  chemically synthesized
ccaaagacctatccattgca

SEQ ID NO: 3709 - DNA, 20 bp, Artificial Sequence
  chemically synthesized
aaaagagtattagatattat

SEQ ID NO: 3710 - DNA, 20 bp, Artificial Sequence
  chemically synthesized
tcttggtaattgaattattc

SEQ ID NO: 3711 - DNA, 20 bp, Artificial Sequence
  chemically synthesized
agaaataattgaacatcatc

SEQ ID NO: 3712 - DNA, 20 bp, Artificial Sequence
  chemically synthesized
taaaaagtaacattattact

SEQ ID NO: 3713 - DNA, 20 bp, Artificial Sequence
  chemically synthesized
agacaagagtgaggttgctc

SEQ ID NO: 3714 - DNA, 20 bp, Artificial Sequence
  chemically synthesized
agtgaggttgctcatcggtt

SEQ ID NO: 3715 - DNA, 20 bp, Artificial Sequence
  chemically synthesized
tctgggcaagggaagaaaaa

SEQ ID NO: 3716 - DNA, 20 bp, Artificial Sequence
  chemically synthesized
ttatatttctttccatttga

SEQ ID NO: 3717 - DNA, 20 bp, Artificial Sequence
  chemically synthesized
ccatttgacttagattatgc

SEQ ID NO: 3718 - DNA, 20 bp, Artificial Sequence
  chemically synthesized
atttgtttcaaaatattggg

SEQ ID NO: 3719 - DNA, 20 bp, Artificial Sequence
  chemically synthesized
ctatttatgagatcaacagc

SEQ ID NO: 3720 - DNA, 20 bp, Artificial Sequence
  chemically synthesized
gagatcaacagcacaggttt

SEQ ID NO: 3721 - DNA, 20 bp, Artificial Sequence
  chemically synthesized
caatcttcaaccctattctg

SEQ ID NO: 3722 - DNA, 20 bp, Artificial Sequence
  chemically synthesized
cctttttttttttttaccta

SEQ ID NO: 3723 - DNA, 20 bp, Artificial Sequence
  chemically synthesized
aaaataattctttaaagatg

SEQ ID NO: 3724 - DNA, 20 bp, Artificial Sequence
  chemically synthesized
taaaagttgaacaatagaaa

SEQ ID NO: 3725 - DNA, 22 bp, Artificial Sequence
  chemically synthesized
gtgctaatttccctccgtttgt

SEQ ID NO: 3726 - DNA, 22 bp, Artificial Sequence
  chemically synthesized
atttccctccgtttgtcctagc

SEQ ID NO: 3727 - DNA, 22 bp, Artificial Sequence
  chemically synthesized
ccctccgtttgtcctagctttt

SEQ ID NO: 3728 - DNA, 22 bp, Artificial Sequence
  chemically synthesized
cctccgtttgtcctagcttttc

SEQ ID NO: 3729 - DNA, 22 bp, Artificial Sequence
  chemically synthesized
cgtttgtcctagcttttctctt

SEQ ID NO: 3730 - DNA, 22 bp, Artificial Sequence
  chemically synthesized
gtcctagcttttctcttctgtc

SEQ ID NO: 3731 - DNA, 22 bp, Artificial Sequence
  chemically synthesized
tcctagcttttctcttctgtca

SEQ ID NO: 3732 - DNA, 22 bp, Artificial Sequence
  chemically synthesized
gcttttctcttctgtcaacccc

SEQ ID NO: 3733 - DNA, 22 bp, Artificial Sequence
  chemically synthesized
ttctcttctgtcaaccccacac

SEQ ID NO: 3734 - DNA, 22 bp, Artificial Sequence
  chemically synthesized
tctcttctgtcaaccccacacg

SEQ ID NO: 3735 - DNA, 22 bp, Artificial Sequence
  chemically synthesized
ctcttctgtcaaccccacacgc

SEQ ID NO: 3736 - DNA, 22 bp, Artificial Sequence
  chemically synthesized
tcttctgtcaaccccacacgcc

SEQ ID NO: 3737 - DNA, 22 bp, Artificial Sequence
  chemically synthesized
ttctgtcaaccccacacgcctt

SEQ ID NO: 3738 - DNA, 22 bp, Artificial Sequence
  chemically synthesized
ctgtcaaccccacacgcctttg

SEQ ID NO: 3739 - DNA, 22 bp, Artificial Sequence
  chemically synthesized
tgtcaaccccacacgcctttgg

SEQ ID NO: 3740 - DNA, 22 bp, Artificial Sequence
  chemically synthesized
tcaaccccacacgcctttggca

SEQ ID NO: 3741 - DNA, 22 bp, Artificial Sequence
  chemically synthesized
tggcacaatgaagtgggtaacc

SEQ ID NO: 3742 - DNA, 22 bp, Artificial Sequence
  chemically synthesized
ggcacaatgaagtgggtaacct

SEQ ID NO: 3743 - DNA, 22 bp, Artificial Sequence
  chemically synthesized
gcacaatgaagtgggtaacctt

SEQ ID NO: 3744 - DNA, 22 bp, Artificial Sequence
  chemically synthesized
tatttcccttctttttctcttt

SEQ ID NO: 3745 - DNA, 22 bp, Artificial Sequence
  chemically synthesized
atttcccttctttttctcttta

SEQ ID NO: 3746 - DNA, 22 bp, Artificial Sequence
  chemically synthesized
tttcccttctttttctctttag

SEQ ID NO: 3747 - DNA, 22 bp, Artificial Sequence
  chemically synthesized
cccttctttttctctttagctc

SEQ ID NO: 3748 - DNA, 22 bp, Artificial Sequence
  chemically synthesized
ccttctttttctctttagctcg

SEQ ID NO: 3749 - DNA, 22 bp, Artificial Sequence
  chemically synthesized
ctttttctctttagctcggctt

SEQ ID NO: 3750 - DNA, 22 bp, Artificial Sequence
  chemically synthesized
tttttctctttagctcggctta

SEQ ID NO: 3751 - DNA, 22 bp, Artificial Sequence
  chemically synthesized
tttctctttagctcggcttatt

SEQ ID NO: 3752 - DNA, 22 bp, Artificial Sequence
  chemically synthesized
ttctctttagctcggcttattc

SEQ ID NO: 3753 - DNA, 22 bp, Artificial Sequence
  chemically synthesized
tctctttagctcggcttattcc

SEQ ID NO: 3754 - DNA, 22 bp, Artificial Sequence
  chemically synthesized
ctctttagctcggcttattcca

SEQ ID NO: 3755 - DNA, 22 bp, Artificial Sequence
  chemically synthesized
tctttagctcggcttattccag

SEQ ID NO: 3756 - DNA, 22 bp, Artificial Sequence
  chemically synthesized
tttagctcggcttattccaggg

SEQ ID NO: 3757 - DNA, 22 bp, Artificial Sequence
  chemically synthesized
tagctcggcttattccaggggt

SEQ ID NO: 3758 - DNA, 22 bp, Artificial Sequence
  chemically synthesized
agctcggcttattccaggggtg

SEQ ID NO: 3759 - DNA, 22 bp, Artificial Sequence
  chemically synthesized
gctcggcttattccaggggtgt

SEQ ID NO: 3760 - DNA, 22 bp, Artificial Sequence
  chemically synthesized
ggcttattccaggggtgtgttt

SEQ ID NO: 3761 - DNA, 22 bp, Artificial Sequence
  chemically synthesized
attccaggggtgtgtttcgtcg

SEQ ID NO: 3762 - DNA, 22 bp, Artificial Sequence
  chemically synthesized
ttccaggggtgtgtttcgtcga

SEQ ID NO: 3763 - DNA, 22 bp, Artificial Sequence
  chemically synthesized
caggggtgtgtttcgtcgagat

SEQ ID NO: 3764 - DNA, 22 bp, Artificial Sequence
  chemically synthesized
cgtcgagatgcacgtaagaaat

SEQ ID NO: 3765 - DNA, 22 bp, Artificial Sequence
  chemically synthesized
gtcgagatgcacgtaagaaatc

SEQ ID NO: 3766 - DNA, 22 bp, Artificial Sequence
  chemically synthesized
ttctattgttcaacttttattc

SEQ ID NO: 3767 - DNA, 22 bp, Artificial Sequence
  chemically synthesized
tctattgttcaacttttattct

SEQ ID NO: 3768 - DNA, 22 bp, Artificial Sequence
  chemically synthesized
ctattgttcaacttttattcta

SEQ ID NO: 3769 - DNA, 22 bp, Artificial Sequence
  chemically synthesized
tattgttcaacttttattctat

SEQ ID NO: 3770 - DNA, 22 bp, Artificial Sequence
  chemically synthesized
ttgttcaacttttattctattt

SEQ ID NO: 3771 - DNA, 22 bp, Artificial Sequence
  chemically synthesized
ttcaacttttattctattttcc

SEQ ID NO: 3772 - DNA, 22 bp, Artificial Sequence
  chemically synthesized
aacttttattctattttcccag

SEQ ID NO: 3773 - DNA, 22 bp, Artificial Sequence
  chemically synthesized
ttattctattttcccagtaaaa

SEQ ID NO: 3774 - DNA, 22 bp, Artificial Sequence
  chemically synthesized
tattctattttcccagtaaaat

SEQ ID NO: 3775 - DNA, 22 bp, Artificial Sequence
  chemically synthesized
attctattttcccagtaaaata

SEQ ID NO: 3776 - DNA, 22 bp, Artificial Sequence
  chemically synthesized
ttctattttcccagtaaaataa

SEQ ID NO: 3777 - DNA, 22 bp, Artificial Sequence
  chemically synthesized
tattttcccagtaaaataaagt

SEQ ID NO: 3778 - DNA, 22 bp, Artificial Sequence
  chemically synthesized
ttttcccagtaaaataaagttt

SEQ ID NO: 3779 - DNA, 22 bp, Artificial Sequence
  chemically synthesized
tcccagtaaaataaagttttag

SEQ ID NO: 3780 - DNA, 22 bp, Artificial Sequence
  chemically synthesized
cccagtaaaataaagttttagt

SEQ ID NO: 3781 - DNA, 22 bp, Artificial Sequence
  chemically synthesized
ccagtaaaataaagttttagta

SEQ ID NO: 3782 - DNA, 22 bp, Artificial Sequence
  chemically synthesized
tagtaaactctgcatctttaaa

SEQ ID NO: 3783 - DNA, 22 bp, Artificial Sequence
  chemically synthesized
agtaaactctgcatctttaaag

SEQ ID NO: 3784 - DNA, 22 bp, Artificial Sequence
  chemically synthesized
gtaaactctgcatctttaaaga

SEQ ID NO: 3785 - DNA, 22 bp, Artificial Sequence
  chemically synthesized
tgcatctttaaagaattatttt

SEQ ID NO: 3786 - DNA, 22 bp, Artificial Sequence
  chemically synthesized
catctttaaagaattattttgg

SEQ ID NO: 3787 - DNA, 22 bp, Artificial Sequence
  chemically synthesized
taaagaattattttggcattta

SEQ ID NO: 3788 - DNA, 22 bp, Artificial Sequence
  chemically synthesized
aaagaattattttggcatttat

SEQ ID NO: 3789 - DNA, 22 bp, Artificial Sequence
  chemically synthesized
aagaattattttggcatttatt

SEQ ID NO: 3790 - DNA, 22 bp, Artificial Sequence
  chemically synthesized
ttttggcatttatttctaaaat

SEQ ID NO: 3791 - DNA, 22 bp, Artificial Sequence
  chemically synthesized
tggcatttatttctaaaatggc

SEQ ID NO: 3792 - DNA, 22 bp, Artificial Sequence
  chemically synthesized
ggcatttatttctaaaatggca

SEQ ID NO: 3793 - DNA, 22 bp, Artificial Sequence
  chemically synthesized
gcatttatttctaaaatggcat

SEQ ID NO: 3794 - DNA, 22 bp, Artificial Sequence
  chemically synthesized
atttctaaaatggcatagtatt

SEQ ID NO: 3795 - DNA, 22 bp, Artificial Sequence
  chemically synthesized
tttctaaaatggcatagtattt

SEQ ID NO: 3796 - DNA, 22 bp, Artificial Sequence
  chemically synthesized
ctaaaatggcatagtattttgt

SEQ ID NO: 3797 - DNA, 22 bp, Artificial Sequence
  chemically synthesized
taaaatggcatagtattttgta

SEQ ID NO: 3798 - DNA, 22 bp, Artificial Sequence
  chemically synthesized
aaatggcatagtattttgtatt

SEQ ID NO: 3799 - DNA, 22 bp, Artificial Sequence
  chemically synthesized
tgtatttgtgaagtcttacaag

SEQ ID NO: 3800 - DNA, 22 bp, Artificial Sequence
  chemically synthesized
gtatttgtgaagtcttacaagg

SEQ ID NO: 3801 - DNA, 22 bp, Artificial Sequence
  chemically synthesized
tatttgtgaagtcttacaaggt

SEQ ID NO: 3802 - DNA, 22 bp, Artificial Sequence
  chemically synthesized
gtgaagtcttacaaggttatct

SEQ ID NO: 3803 - DNA, 22 bp, Artificial Sequence
  chemically synthesized
tgaagtcttacaaggttatctt

SEQ ID NO: 3804 - DNA, 22 bp, Artificial Sequence
  chemically synthesized
acaaggttatcttattaataaa

SEQ ID NO: 3805 - DNA, 22 bp, Artificial Sequence
  chemically synthesized
caaggttatcttattaataaaa

SEQ ID NO: 3806 - DNA, 22 bp, Artificial Sequence
  chemically synthesized
tcttattaataaaattcaaaca

SEQ ID NO: 3807 - DNA, 22 bp, Artificial Sequence
  chemically synthesized
attaataaaattcaaacatcct

SEQ ID NO: 3808 - DNA, 22 bp, Artificial Sequence
  chemically synthesized
ttaataaaattcaaacatccta

SEQ ID NO: 3809 - DNA, 22 bp, Artificial Sequence
  chemically synthesized
ataaaattcaaacatcctaggt

SEQ ID NO: 3810 - DNA, 22 bp, Artificial Sequence
  chemically synthesized
aaacatcctaggtaaaaaaaaa

SEQ ID NO: 3811 - DNA, 22 bp, Artificial Sequence
  chemically synthesized
ggtaaaaaaaaaaaaaggtcag

SEQ ID NO: 3812 - DNA, 22 bp, Artificial Sequence
  chemically synthesized
tttagtgactgtaattttcttt

SEQ ID NO: 3813 - DNA, 22 bp, Artificial Sequence
  chemically synthesized
agtgactgtaattttcttttgc

SEQ ID NO: 3814 - DNA, 22 bp, Artificial Sequence
  chemically synthesized
gtgactgtaattttcttttgcg

SEQ ID NO: 3815 - DNA, 22 bp, Artificial Sequence
  chemically synthesized
taattttcttttgcgcactaag

SEQ ID NO: 3816 - DNA, 22 bp, Artificial Sequence
  chemically synthesized
tcttttgcgcactaaggaaagt

SEQ ID NO: 3817 - DNA, 22 bp, Artificial Sequence
  chemically synthesized
cttttgcgcactaaggaaagtg

SEQ ID NO: 3818 - DNA, 22 bp, Artificial Sequence
  chemically synthesized
ttttgcgcactaaggaaagtgc

SEQ ID NO: 3819 - DNA, 22 bp, Artificial Sequence
  chemically synthesized
ttgcgcactaaggaaagtgcaa

SEQ ID NO: 3820 - DNA, 22 bp, Artificial Sequence
  chemically synthesized
tgcgcactaaggaaagtgcaaa

SEQ ID NO: 3821 - DNA, 22 bp, Artificial Sequence
  chemically synthesized
gcgcactaaggaaagtgcaaag

SEQ ID NO: 3822 - DNA, 22 bp, Artificial Sequence
  chemically synthesized
cgcactaaggaaagtgcaaagt

SEQ ID NO: 3823 - DNA, 22 bp, Artificial Sequence
  chemically synthesized
aggaaagtgcaaagtaacttag

SEQ ID NO: 3824 - DNA, 22 bp, Artificial Sequence
  chemically synthesized
agagtgactgaaacttcacaga

SEQ ID NO: 3825 - DNA, 22 bp, Artificial Sequence
  chemically synthesized
gagtgactgaaacttcacagaa

SEQ ID NO: 3826 - DNA, 22 bp, Artificial Sequence
  chemically synthesized
aaacttcacagaatagggttga

SEQ ID NO: 3827 - DNA, 22 bp, Artificial Sequence
  chemically synthesized
cacagaatagggttgaagattg

SEQ ID NO: 3828 - DNA, 22 bp, Artificial Sequence
  chemically synthesized
acagaatagggttgaagattga

SEQ ID NO: 3829 - DNA, 22 bp, Artificial Sequence
  chemically synthesized
aagattgaattcataactatcc

SEQ ID NO: 3830 - DNA, 22 bp, Artificial Sequence
  chemically synthesized
aattcataactatcccaaagac

SEQ ID NO: 3831 - DNA, 22 bp, Artificial Sequence
  chemically synthesized
ataactatcccaaagacctatc

SEQ ID NO: 3832 - DNA, 22 bp, Artificial Sequence
  chemically synthesized
tcccaaagacctatccattgca

SEQ ID NO: 3833 - DNA, 22 bp, Artificial Sequence
  chemically synthesized
tccattgcactatgctttattt

SEQ ID NO: 3834 - DNA, 22 bp, Artificial Sequence
  chemically synthesized
cactatgctttatttaaaaacc

SEQ ID NO: 3835 - DNA, 22 bp, Artificial Sequence
  chemically synthesized
tgctttatttaaaaaccacaaa

SEQ ID NO: 3836 - DNA, 22 bp, Artificial Sequence
  chemically synthesized
tatttaaaaaccacaaaacctg

SEQ ID NO: 3837 - DNA, 22 bp, Artificial Sequence
  chemically synthesized
atttaaaaaccacaaaacctgt

SEQ ID NO: 3838 - DNA, 22 bp, Artificial Sequence
  chemically synthesized
tttaaaaaccacaaaacctgtg

SEQ ID NO: 3839 - DNA, 22 bp, Artificial Sequence
  chemically synthesized
aaaaaccacaaaacctgtgctg

SEQ ID NO: 3840 - DNA, 22 bp, Artificial Sequence
  chemically synthesized
aaaaccacaaaacctgtgctgt

SEQ ID NO: 3841 - DNA, 22 bp, Artificial Sequence
  chemically synthesized
tgctgttgatctcataaataga

SEQ ID NO: 3842 - DNA, 22 bp, Artificial Sequence
  chemically synthesized
ttgatctcataaatagaacttg

SEQ ID NO: 3843 - DNA, 22 bp, Artificial Sequence
  chemically synthesized
atctcataaatagaacttgtat

SEQ ID NO: 3844 - DNA, 22 bp, Artificial Sequence
  chemically synthesized
ataaatagaacttgtatttata

SEQ ID NO: 3845 - DNA, 22 bp, Artificial Sequence
  chemically synthesized
gtatttatatttattttcattt

SEQ ID NO: 3846 - DNA, 22 bp, Artificial Sequence
  chemically synthesized
tatttatatttattttcatttt

SEQ ID NO: 3847 - DNA, 22 bp, Artificial Sequence
  chemically synthesized
atatttattttcattttagtct

SEQ ID NO: 3848 - DNA, 22 bp, Artificial Sequence
  chemically synthesized
tatttattttcattttagtctg

SEQ ID NO: 3849 - DNA, 22 bp, Artificial Sequence
  chemically synthesized
attttcattttagtctgtcttc

SEQ ID NO: 3850 - DNA, 22 bp, Artificial Sequence
  chemically synthesized
ttttcattttagtctgtcttct

SEQ ID NO: 3851 - DNA, 22 bp, Artificial Sequence
  chemically synthesized
tcattttagtctgtcttcttgg

SEQ ID NO: 3852 - DNA, 22 bp, Artificial Sequence
  chemically synthesized
cattttagtctgtcttcttggt

SEQ ID NO: 3853 - DNA, 22 bp, Artificial Sequence
  chemically synthesized
attttagtctgtcttcttggtt

SEQ ID NO: 3854 - DNA, 22 bp, Artificial Sequence
  chemically synthesized
tagtctgtcttcttggttgctg

SEQ ID NO: 3855 - DNA, 22 bp, Artificial Sequence
  chemically synthesized
agtctgtcttcttggttgctgt

SEQ ID NO: 3856 - DNA, 22 bp, Artificial Sequence
  chemically synthesized
gtctgtcttcttggttgctgtt

SEQ ID NO: 3857 - DNA, 22 bp, Artificial Sequence
  chemically synthesized
tcttcttggttgctgttgatag

SEQ ID NO: 3858 - DNA, 22 bp, Artificial Sequence
  chemically synthesized
cttggttgctgttgatagacac

SEQ ID NO: 3859 - DNA, 22 bp, Artificial Sequence
  chemically synthesized
ttggttgctgttgatagacact

SEQ ID NO: 3860 - DNA, 22 bp, Artificial Sequence
  chemically synthesized
ggttgctgttgatagacactaa

SEQ ID NO: 3861 - DNA, 22 bp, Artificial Sequence
  chemically synthesized
gttgctgttgatagacactaaa

SEQ ID NO: 3862 - DNA, 22 bp, Artificial Sequence
  chemically synthesized
ctgttgatagacactaaaagag

SEQ ID NO: 3863 - DNA, 22 bp, Artificial Sequence
  chemically synthesized
ttgatagacactaaaagagtat

SEQ ID NO: 3864 - DNA, 22 bp, Artificial Sequence
  chemically synthesized
atagacactaaaagagtattag

SEQ ID NO: 3865 - DNA, 22 bp, Artificial Sequence
  chemically synthesized
aaagagtattagatattatcta

SEQ ID NO: 3866 - DNA, 22 bp, Artificial Sequence
  chemically synthesized
gatattatctaagtttgaatat

SEQ ID NO: 3867 - DNA, 22 bp, Artificial Sequence
  chemically synthesized
tctaagtttgaatataaggcta

SEQ ID NO: 3868 - DNA, 22 bp, Artificial Sequence
  chemically synthesized
agtttgaatataaggctataaa

SEQ ID NO: 3869 - DNA, 22 bp, Artificial Sequence
  chemically synthesized
gaatataaggctataaatattt

SEQ ID NO: 3870 - DNA, 22 bp, Artificial Sequence
  chemically synthesized
aatataaggctataaatattta

SEQ ID NO: 3871 - DNA, 22 bp, Artificial Sequence
  chemically synthesized
taaatatttaataatttttaaa

SEQ ID NO: 3872 - DNA, 22 bp, Artificial Sequence
  chemically synthesized
aataatttttaaaatagtattc

SEQ ID NO: 3873 - DNA, 22 bp, Artificial Sequence
  chemically synthesized
ataatttttaaaatagtattct

SEQ ID NO: 3874 - DNA, 22 bp, Artificial Sequence
  chemically synthesized
ttaaaatagtattcttggtaat

SEQ ID NO: 3875 - DNA, 22 bp, Artificial Sequence
  chemically synthesized
taaaatagtattcttggtaatt

SEQ ID NO: 3876 - DNA, 22 bp, Artificial Sequence
  chemically synthesized
aaaatagtattcttggtaattg

SEQ ID NO: 3877 - DNA, 22 bp, Artificial Sequence
  chemically synthesized
aaatagtattcttggtaattga

SEQ ID NO: 3878 - DNA, 22 bp, Artificial Sequence
  chemically synthesized
ttggtaattgaattattcttct

SEQ ID NO: 3879 - DNA, 22 bp, Artificial Sequence
  chemically synthesized
ggtaattgaattattcttctgt

SEQ ID NO: 3880 - DNA, 22 bp, Artificial Sequence
  chemically synthesized
gtaattgaattattcttctgtt

SEQ ID NO: 3881 - DNA, 22 bp, Artificial Sequence
  chemically synthesized
aattattcttctgtttaaaggc

SEQ ID NO: 3882 - DNA, 22 bp, Artificial Sequence
  chemically synthesized
ttcttctgtttaaaggcagaag

SEQ ID NO: 3883 - DNA, 22 bp, Artificial Sequence
  chemically synthesized
ttctgtttaaaggcagaagaaa

SEQ ID NO: 3884 - DNA, 22 bp, Artificial Sequence
  chemically synthesized
ctgtttaaaggcagaagaaata

SEQ ID NO: 3885 - DNA, 22 bp, Artificial Sequence
  chemically synthesized
tgtttaaaggcagaagaaataa

SEQ ID NO: 3886 - DNA, 22 bp, Artificial Sequence
  chemically synthesized
tttaaaggcagaagaaataatt

SEQ ID NO: 3887 - DNA, 22 bp, Artificial Sequence
  chemically synthesized
aaaggcagaagaaataattgaa

SEQ ID NO: 3888 - DNA, 22 bp, Artificial Sequence
  chemically synthesized
aaggcagaagaaataattgaac

SEQ ID NO: 3889 - DNA, 22 bp, Artificial Sequence
  chemically synthesized
aacatcatcctgagtttttctg

SEQ ID NO: 3890 - DNA, 22 bp, Artificial Sequence
  chemically synthesized
agtttttctgtaggaatcagag

SEQ ID NO: 3891 - DNA, 22 bp, Artificial Sequence
  chemically synthesized
ttctgtaggaatcagagcccaa

SEQ ID NO: 3892 - DNA, 22 bp, Artificial Sequence
  chemically synthesized
tctgtaggaatcagagcccaat

SEQ ID NO: 3893 - DNA, 22 bp, Artificial Sequence
  chemically synthesized
ctgtaggaatcagagcccaata

SEQ ID NO: 3894 - DNA, 22 bp, Artificial Sequence
  chemically synthesized
tgtaggaatcagagcccaatat

SEQ ID NO: 3895 - DNA, 22 bp, Artificial Sequence
  chemically synthesized
taggaatcagagcccaatattt

SEQ ID NO: 3896 - DNA, 22 bp, Artificial Sequence
  chemically synthesized
tgaaacaaatgcataatctaag

SEQ ID NO: 3897 - DNA, 22 bp, Artificial Sequence
  chemically synthesized
gaaacaaatgcataatctaagt

SEQ ID NO: 3898 - DNA, 22 bp, Artificial Sequence
  chemically synthesized
aaacaaatgcataatctaagtc

SEQ ID NO: 3899 - DNA, 22 bp, Artificial Sequence
  chemically synthesized
agtcaaatggaaagaaatataa

SEQ ID NO: 3900 - DNA, 22 bp, Artificial Sequence
  chemically synthesized
ttacttcttgttttcttcagta

SEQ ID NO: 3901 - DNA, 22 bp, Artificial Sequence
  chemically synthesized
cttcttgttttcttcagtattt

SEQ ID NO: 3902 - DNA, 22 bp, Artificial Sequence
  chemically synthesized
cttgttttcttcagtatttaac

SEQ ID NO: 3903 - DNA, 22 bp, Artificial Sequence
  chemically synthesized
ttgttttcttcagtatttaaca

SEQ ID NO: 3904 - DNA, 22 bp, Artificial Sequence
  chemically synthesized
gttttcttcagtatttaacaat

SEQ ID NO: 3905 - DNA, 22 bp, Artificial Sequence
  chemically synthesized
ttttcttcagtatttaacaatc

SEQ ID NO: 3906 - DNA, 22 bp, Artificial Sequence
  chemically synthesized
tcttcagtatttaacaatcctt

SEQ ID NO: 3907 - DNA, 22 bp, Artificial Sequence
  chemically synthesized
cttcagtatttaacaatccttt

SEQ ID NO: 3908 - DNA, 22 bp, Artificial Sequence
  chemically synthesized
ttcagtatttaacaatcctttt

SEQ ID NO: 3909 - DNA, 22 bp, Artificial Sequence
  chemically synthesized
cagtatttaacaatcctttttt

SEQ ID NO: 3910 - DNA, 22 bp, Artificial Sequence
  chemically synthesized
agtatttaacaatccttttttt

SEQ ID NO: 3911 - DNA, 22 bp, Artificial Sequence
  chemically synthesized
aacaatccttttttttcttccc

SEQ ID NO: 3912 - DNA, 22 bp, Artificial Sequence
  chemically synthesized
acaatccttttttttcttccct

SEQ ID NO: 3913 - DNA, 22 bp, Artificial Sequence
  chemically synthesized
ttttttcttcccttgcccagac

SEQ ID NO: 3914 - DNA, 22 bp, Artificial Sequence
  chemically synthesized
tttttcttcccttgcccagaca

SEQ ID NO: 3915 - DNA, 22 bp, Artificial Sequence
  chemically synthesized
ttttcttcccttgcccagacaa

SEQ ID NO: 3916 - DNA, 22 bp, Artificial Sequence
  chemically synthesized
tttcttcccttgcccagacaag

SEQ ID NO: 3917 - DNA, 22 bp, Artificial Sequence
  chemically synthesized
ttcttcccttgcccagacaaga

SEQ ID NO: 3918 - DNA, 22 bp, Artificial Sequence
  chemically synthesized
tcttcccttgcccagacaagag

SEQ ID NO: 3919 - DNA, 22 bp, Artificial Sequence
  chemically synthesized
cttcccttgcccagacaagagt

SEQ ID NO: 3920 - DNA, 22 bp, Artificial Sequence
  chemically synthesized
ttcccttgcccagacaagagtg

SEQ ID NO: 3921 - DNA, 22 bp, Artificial Sequence
  chemically synthesized
cccttgcccagacaagagtgag

SEQ ID NO: 3922 - DNA, 22 bp, Artificial Sequence
  chemically synthesized
ccttgcccagacaagagtgagg

SEQ ID NO: 3923 - DNA, 22 bp, Artificial Sequence
  chemically synthesized
gcccagacaagagtgaggttgc

SEQ ID NO: 3924 - DNA, 22 bp, Artificial Sequence
  chemically synthesized
cccagacaagagtgaggttgct

SEQ ID NO: 3925 - DNA, 22 bp, Artificial Sequence
  chemically synthesized
ctcatcggtttaaagatttggg

SEQ ID NO: 3926 - DNA, 22 bp, Artificial Sequence
  chemically synthesized
atcggtttaaagatttgggaga

SEQ ID NO: 3927 - DNA, 22 bp, Artificial Sequence
  chemically synthesized
aaagatttgggagaagaaaatt

SEQ ID NO: 3928 - DNA, 22 bp, Artificial Sequence
  chemically synthesized
aagatttgggagaagaaaattt

SEQ ID NO: 3929 - DNA, 22 bp, Artificial Sequence
  chemically synthesized
gggagaagaaaatttcaaagcc

SEQ ID NO: 3930 - DNA, 22 bp, Artificial Sequence
  chemically synthesized
ggagaagaaaatttcaaagcct

SEQ ID NO: 3931 - DNA, 22 bp, Artificial Sequence
  chemically synthesized
tgaaattttcttctcccaaatc

SEQ ID NO: 3932 - DNA, 22 bp, Artificial Sequence
  chemically synthesized
gaaattttcttctcccaaatct

SEQ ID NO: 3933 - DNA, 22 bp, Artificial Sequence
  chemically synthesized
aaattttcttctcccaaatctt

SEQ ID NO: 3934 - DNA, 22 bp, Artificial Sequence
  chemically synthesized
tcttctcccaaatctttaaacc

SEQ ID NO: 3935 - DNA, 22 bp, Artificial Sequence
  chemically synthesized
cttctcccaaatctttaaaccg

SEQ ID NO: 3936 - DNA, 22 bp, Artificial Sequence
  chemically synthesized
ttctcccaaatctttaaaccga

SEQ ID NO: 3937 - DNA, 22 bp, Artificial Sequence
  chemically synthesized
ctcccaaatctttaaaccgatg

SEQ ID NO: 3938 - DNA, 22 bp, Artificial Sequence
  chemically synthesized
tcccaaatctttaaaccgatga

SEQ ID NO: 3939 - DNA, 22 bp, Artificial Sequence
  chemically synthesized
ccaaatctttaaaccgatgagc

SEQ ID NO: 3940 - DNA, 22 bp, Artificial Sequence
  chemically synthesized
taaaccgatgagcaacctcact

SEQ ID NO: 3941 - DNA, 22 bp, Artificial Sequence
  chemically synthesized
aaaccgatgagcaacctcactc

SEQ ID NO: 3942 - DNA, 22 bp, Artificial Sequence
  chemically synthesized
aaccgatgagcaacctcactct

SEQ ID NO: 3943 - DNA, 22 bp, Artificial Sequence
  chemically synthesized
actcttgtctgggcaagggaag

SEQ ID NO: 3944 - DNA, 22 bp, Artificial Sequence
  chemically synthesized
ttgtctgggcaagggaagaaaa

SEQ ID NO: 3945 - DNA, 22 bp, Artificial Sequence
  chemically synthesized
gtctgggcaagggaagaaaaaa

SEQ ID NO: 3946 - DNA, 22 bp, Artificial Sequence
  chemically synthesized
tctgggcaagggaagaaaaaaa

SEQ ID NO: 3947 - DNA, 22 bp, Artificial Sequence
  chemically synthesized
ggcaagggaagaaaaaaaagga

SEQ ID NO: 3948 - DNA, 22 bp, Artificial Sequence
  chemically synthesized
ttaaatactgaagaaaacaaga

SEQ ID NO: 3949 - DNA, 22 bp, Artificial Sequence
  chemically synthesized
aatactgaagaaaacaagaagt

SEQ ID NO: 3950 - DNA, 22 bp, Artificial Sequence
  chemically synthesized
aagaaaacaagaagtaataatg

SEQ ID NO: 3951 - DNA, 22 bp, Artificial Sequence
  chemically synthesized
ctttttatatttctttccattt

SEQ ID NO: 3952 - DNA, 22 bp, Artificial Sequence
  chemically synthesized
tttatatttctttccatttgac

SEQ ID NO: 3953 - DNA, 22 bp, Artificial Sequence
  chemically synthesized
ttatatttctttccatttgact

SEQ ID NO: 3954 - DNA, 22 bp, Artificial Sequence
  chemically synthesized
tatatttctttccatttgactt

SEQ ID NO: 3955 - DNA, 22 bp, Artificial Sequence
  chemically synthesized
atatttctttccatttgactta

SEQ ID NO: 3956 - DNA, 22 bp, Artificial Sequence
  chemically synthesized
tatttctttccatttgacttag

SEQ ID NO: 3957 - DNA, 22 bp, Artificial Sequence
  chemically synthesized
ctttccatttgacttagattat

SEQ ID NO: 3958 - DNA, 22 bp, Artificial Sequence
  chemically synthesized
tttccatttgacttagattatg

SEQ ID NO: 3959 - DNA, 22 bp, Artificial Sequence
  chemically synthesized
tccatttgacttagattatgca

SEQ ID NO: 3960 - DNA, 22 bp, Artificial Sequence
  chemically synthesized
ccatttgacttagattatgcat

SEQ ID NO: 3961 - DNA, 22 bp, Artificial Sequence
  chemically synthesized
catttgacttagattatgcatt

SEQ ID NO: 3962 - DNA, 22 bp, Artificial Sequence
  chemically synthesized
gacttagattatgcatttgttt

SEQ ID NO: 3963 - DNA, 22 bp, Artificial Sequence
  chemically synthesized
acttagattatgcatttgtttc

SEQ ID NO: 3964 - DNA, 22 bp, Artificial Sequence
  chemically synthesized
agattatgcatttgtttcaaaa

SEQ ID NO: 3965 - DNA, 22 bp, Artificial Sequence
  chemically synthesized
gattatgcatttgtttcaaaat

SEQ ID NO: 3966 - DNA, 22 bp, Artificial Sequence
  chemically synthesized
tgcatttgtttcaaaatattgg

SEQ ID NO: 3967 - DNA, 22 bp, Artificial Sequence
  chemically synthesized
gtttcaaaatattgggctctga

SEQ ID NO: 3968 - DNA, 22 bp, Artificial Sequence
  chemically synthesized
tttcaaaatattgggctctgat

SEQ ID NO: 3969 - DNA, 22 bp, Artificial Sequence
  chemically synthesized
caaaatattgggctctgattcc

SEQ ID NO: 3970 - DNA, 22 bp, Artificial Sequence
  chemically synthesized
aaaatattgggctctgattcct

SEQ ID NO: 3971 - DNA, 22 bp, Artificial Sequence
  chemically synthesized
ggctctgattcctacagaaaaa

SEQ ID NO: 3972 - DNA, 22 bp, Artificial Sequence
  chemically synthesized
tgattcctacagaaaaactcag

SEQ ID NO: 3973 - DNA, 22 bp, Artificial Sequence
  chemically synthesized
attcctacagaaaaactcagga

SEQ ID NO: 3974 - DNA, 22 bp, Artificial Sequence
  chemically synthesized
ctacagaaaaactcaggatgat

SEQ ID NO: 3975 - DNA, 22 bp, Artificial Sequence
  chemically synthesized
cagaaaaactcaggatgatgtt

SEQ ID NO: 3976 - DNA, 22 bp, Artificial Sequence
  chemically synthesized
aggatgatgttcaattatttct

SEQ ID NO: 3977 - DNA, 22 bp, Artificial Sequence
  chemically synthesized
aattatttcttctgcctttaaa

SEQ ID NO: 3978 - DNA, 22 bp, Artificial Sequence
  chemically synthesized
tttcttctgcctttaaacagaa

SEQ ID NO: 3979 - DNA, 22 bp, Artificial Sequence
  chemically synthesized
cttctgcctttaaacagaagaa

SEQ ID NO: 3980 - DNA, 22 bp, Artificial Sequence
  chemically synthesized
ttctgcctttaaacagaagaat

SEQ ID NO: 3981 - DNA, 22 bp, Artificial Sequence
  chemically synthesized
ctgcctttaaacagaagaataa

SEQ ID NO: 3982 - DNA, 22 bp, Artificial Sequence
  chemically synthesized
tgcctttaaacagaagaataat

SEQ ID NO: 3983 - DNA, 22 bp, Artificial Sequence
  chemically synthesized
cctttaaacagaagaataattc

SEQ ID NO: 3984 - DNA, 22 bp, Artificial Sequence
  chemically synthesized
taaacagaagaataattcaatt

SEQ ID NO: 3985 - DNA, 22 bp, Artificial Sequence
  chemically synthesized
aaacagaagaataattcaatta

SEQ ID NO: 3986 - DNA, 22 bp, Artificial Sequence
  chemically synthesized
aacagaagaataattcaattac

SEQ ID NO: 3987 - DNA, 22 bp, Artificial Sequence
  chemically synthesized
aattaccaagaatactatttta

SEQ ID NO: 3988 - DNA, 22 bp, Artificial Sequence
  chemically synthesized
ccaagaatactattttaaaaat

SEQ ID NO: 3989 - DNA, 22 bp, Artificial Sequence
  chemically synthesized
ttttaaaaattattaaatattt

SEQ ID NO: 3990 - DNA, 22 bp, Artificial Sequence
  chemically synthesized
taaaaattattaaatatttata

SEQ ID NO: 3991 - DNA, 22 bp, Artificial Sequence
  chemically synthesized
aaaaattattaaatatttatag

SEQ ID NO: 3992 - DNA, 22 bp, Artificial Sequence
  chemically synthesized
aaaattattaaatatttatagc

SEQ ID NO: 3993 - DNA, 22 bp, Artificial Sequence
  chemically synthesized
ttaaatatttatagccttatat

SEQ ID NO: 3994 - DNA, 22 bp, Artificial Sequence
  chemically synthesized
aatatttatagccttatattca

SEQ ID NO: 3995 - DNA, 22 bp, Artificial Sequence
  chemically synthesized
atagccttatattcaaacttag

SEQ ID NO: 3996 - DNA, 22 bp, Artificial Sequence
  chemically synthesized
tagccttatattcaaacttaga

SEQ ID NO: 3997 - DNA, 22 bp, Artificial Sequence
  chemically synthesized
atattcaaacttagataatatc

SEQ ID NO: 3998 - DNA, 22 bp, Artificial Sequence
  chemically synthesized
tattcaaacttagataatatct

SEQ ID NO: 3999 - DNA, 22 bp, Artificial Sequence
  chemically synthesized
aaacttagataatatctaatac

SEQ ID NO: 4000 - DNA, 22 bp, Artificial Sequence
  chemically synthesized
agataatatctaatactctttt

SEQ ID NO: 4001 - DNA, 22 bp, Artificial Sequence
  chemically synthesized
gataatatctaatactctttta

SEQ ID NO: 4002 - DNA, 22 bp, Artificial Sequence
  chemically synthesized
atactcttttagtgtctatcaa

SEQ ID NO: 4003 - DNA, 22 bp, Artificial Sequence
  chemically synthesized
ttttagtgtctatcaacagcaa

SEQ ID NO: 4004 - DNA, 22 bp, Artificial Sequence
  chemically synthesized
ttagtgtctatcaacagcaacc

SEQ ID NO: 4005 - DNA, 22 bp, Artificial Sequence
  chemically synthesized
tagtgtctatcaacagcaacca

SEQ ID NO: 4006 - DNA, 22 bp, Artificial Sequence
  chemically synthesized
agtgtctatcaacagcaaccaa

SEQ ID NO: 4007 - DNA, 22 bp, Artificial Sequence
  chemically synthesized
gtgtctatcaacagcaaccaag

SEQ ID NO: 4008 - DNA, 22 bp, Artificial Sequence
  chemically synthesized
tcaacagcaaccaagaagacag

SEQ ID NO: 4009 - DNA, 22 bp, Artificial Sequence
  chemically synthesized
aaatgaaaataaatataaatac

SEQ ID NO: 4010 - DNA, 22 bp, Artificial Sequence
  chemically synthesized
tatttatgagatcaacagcaca

SEQ ID NO: 4011 - DNA, 22 bp, Artificial Sequence
  chemically synthesized
tttatgagatcaacagcacagg

SEQ ID NO: 4012 - DNA, 22 bp, Artificial Sequence
  chemically synthesized
atgagatcaacagcacaggttt

SEQ ID NO: 4013 - DNA, 22 bp, Artificial Sequence
  chemically synthesized
tgagatcaacagcacaggtttt

SEQ ID NO: 4014 - DNA, 22 bp, Artificial Sequence
  chemically synthesized
tgtggtttttaaataaagcata

SEQ ID NO: 4015 - DNA, 22 bp, Artificial Sequence
  chemically synthesized
gtggtttttaaataaagcatag

SEQ ID NO: 4016 - DNA, 22 bp, Artificial Sequence
  chemically synthesized
tggtttttaaataaagcatagt

SEQ ID NO: 4017 - DNA, 22 bp, Artificial Sequence
  chemically synthesized
ttaaataaagcatagtgcaatg

SEQ ID NO: 4018 - DNA, 22 bp, Artificial Sequence
  chemically synthesized
taaataaagcatagtgcaatgg

SEQ ID NO: 4019 - DNA, 22 bp, Artificial Sequence
  chemically synthesized
aaataaagcatagtgcaatgga

SEQ ID NO: 4020 - DNA, 22 bp, Artificial Sequence
  chemically synthesized
aataaagcatagtgcaatggat

SEQ ID NO: 4021 - DNA, 22 bp, Artificial Sequence
  chemically synthesized
tgggatagttatgaattcaatc

SEQ ID NO: 4022 - DNA, 22 bp, Artificial Sequence
  chemically synthesized
gggatagttatgaattcaatct

SEQ ID NO: 4023 - DNA, 22 bp, Artificial Sequence
  chemically synthesized
ggatagttatgaattcaatctt

SEQ ID NO: 4024 - DNA, 22 bp, Artificial Sequence
  chemically synthesized
tgaattcaatcttcaaccctat

SEQ ID NO: 4025 - DNA, 22 bp, Artificial Sequence
  chemically synthesized
aatcttcaaccctattctgtga

SEQ ID NO: 4026 - DNA, 22 bp, Artificial Sequence
  chemically synthesized
caaccctattctgtgaagtttc

SEQ ID NO: 4027 - DNA, 22 bp, Artificial Sequence
  chemically synthesized
aaccctattctgtgaagtttca

SEQ ID NO: 4028 - DNA, 22 bp, Artificial Sequence
  chemically synthesized
ttctgtgaagtttcagtcactc

SEQ ID NO: 4029 - DNA, 22 bp, Artificial Sequence
  chemically synthesized
tgtgaagtttcagtcactctaa

SEQ ID NO: 4030 - DNA, 22 bp, Artificial Sequence
  chemically synthesized
tgaagtttcagtcactctaagt

SEQ ID NO: 4031 - DNA, 22 bp, Artificial Sequence
  chemically synthesized
cagtcactctaagttactttgc

SEQ ID NO: 4032 - DNA, 22 bp, Artificial Sequence
  chemically synthesized
agtcactctaagttactttgca

SEQ ID NO: 4033 - DNA, 22 bp, Artificial Sequence
  chemically synthesized
taagttactttgcactttcctt

SEQ ID NO: 4034 - DNA, 22 bp, Artificial Sequence
  chemically synthesized
agttactttgcactttccttag

SEQ ID NO: 4035 - DNA, 22 bp, Artificial Sequence
  chemically synthesized
ctttgcactttccttagtgcgc

SEQ ID NO: 4036 - DNA, 22 bp, Artificial Sequence
  chemically synthesized
tgcactttccttagtgcgcaaa

SEQ ID NO: 4037 - DNA, 22 bp, Artificial Sequence
  chemically synthesized
gcactttccttagtgcgcaaaa

SEQ ID NO: 4038 - DNA, 22 bp, Artificial Sequence
  chemically synthesized
cactttccttagtgcgcaaaag

SEQ ID NO: 4039 - DNA, 22 bp, Artificial Sequence
  chemically synthesized
tccttagtgcgcaaaagaaaat

SEQ ID NO: 4040 - DNA, 22 bp, Artificial Sequence
  chemically synthesized
ccttagtgcgcaaaagaaaatt

SEQ ID NO: 4041 - DNA, 22 bp, Artificial Sequence
  chemically synthesized
cttagtgcgcaaaagaaaatta

SEQ ID NO: 4042 - DNA, 22 bp, Artificial Sequence
  chemically synthesized
agtgcgcaaaagaaaattacag

SEQ ID NO: 4043 - DNA, 22 bp, Artificial Sequence
  chemically synthesized
gtgcgcaaaagaaaattacagt

SEQ ID NO: 4044 - DNA, 22 bp, Artificial Sequence
  chemically synthesized
cagtcactaaacaattctgacc

SEQ ID NO: 4045 - DNA, 22 bp, Artificial Sequence
  chemically synthesized
aacaattctgaccttttttttt

SEQ ID NO: 4046 - DNA, 22 bp, Artificial Sequence
  chemically synthesized
tgacctttttttttttttacct

SEQ ID NO: 4047 - DNA, 22 bp, Artificial Sequence
  chemically synthesized
acctttttttttttttacctag

SEQ ID NO: 4048 - DNA, 22 bp, Artificial Sequence
  chemically synthesized
tttttttttttacctaggatgt

SEQ ID NO: 4049 - DNA, 22 bp, Artificial Sequence
  chemically synthesized
ttttttttttacctaggatgtt

SEQ ID NO: 4050 - DNA, 22 bp, Artificial Sequence
  chemically synthesized
tttttttttacctaggatgttt

SEQ ID NO: 4051 - DNA, 22 bp, Artificial Sequence
  chemically synthesized
ttttttttacctaggatgtttg

SEQ ID NO: 4052 - DNA, 22 bp, Artificial Sequence
  chemically synthesized
tttttttacctaggatgtttga

SEQ ID NO: 4053 - DNA, 22 bp, Artificial Sequence
  chemically synthesized
ttttttacctaggatgtttgaa

SEQ ID NO: 4054 - DNA, 22 bp, Artificial Sequence
  chemically synthesized
tttttacctaggatgtttgaat

SEQ ID NO: 4055 - DNA, 22 bp, Artificial Sequence
  chemically synthesized
ttttacctaggatgtttgaatt

SEQ ID NO: 4056 - DNA, 22 bp, Artificial Sequence
  chemically synthesized
tttacctaggatgtttgaattt

SEQ ID NO: 4057 - DNA, 22 bp, Artificial Sequence
  chemically synthesized
ttacctaggatgtttgaatttt

SEQ ID NO: 4058 - DNA, 22 bp, Artificial Sequence
  chemically synthesized
tacctaggatgtttgaatttta

SEQ ID NO: 4059 - DNA, 22 bp, Artificial Sequence
  chemically synthesized
acctaggatgtttgaattttat

SEQ ID NO: 4060 - DNA, 22 bp, Artificial Sequence
  chemically synthesized
cctaggatgtttgaattttatt

SEQ ID NO: 4061 - DNA, 22 bp, Artificial Sequence
  chemically synthesized
ggatgtttgaattttattaata

SEQ ID NO: 4062 - DNA, 22 bp, Artificial Sequence
  chemically synthesized
gaattttattaataagataacc

SEQ ID NO: 4063 - DNA, 22 bp, Artificial Sequence
  chemically synthesized
aattttattaataagataacct

SEQ ID NO: 4064 - DNA, 22 bp, Artificial Sequence
  chemically synthesized
tattaataagataaccttgtaa

SEQ ID NO: 4065 - DNA, 22 bp, Artificial Sequence
  chemically synthesized
attaataagataaccttgtaag

SEQ ID NO: 4066 - DNA, 22 bp, Artificial Sequence
  chemically synthesized
ttaataagataaccttgtaaga

SEQ ID NO: 4067 - DNA, 22 bp, Artificial Sequence
  chemically synthesized
ataagataaccttgtaagactt

SEQ ID NO: 4068 - DNA, 22 bp, Artificial Sequence
  chemically synthesized
gtaagacttcacaaatacaaaa

SEQ ID NO: 4069 - DNA, 22 bp, Artificial Sequence
  chemically synthesized
taagacttcacaaatacaaaat

SEQ ID NO: 4070 - DNA, 22 bp, Artificial Sequence
  chemically synthesized
cacaaatacaaaatactatgcc

SEQ ID NO: 4071 - DNA, 22 bp, Artificial Sequence
  chemically synthesized
acaaatacaaaatactatgcca

SEQ ID NO: 4072 - DNA, 22 bp, Artificial Sequence
  chemically synthesized
tgccattttagaaataaatgcc

SEQ ID NO: 4073 - DNA, 22 bp, Artificial Sequence
  chemically synthesized
tagaaataaatgccaaaataat

SEQ ID NO: 4074 - DNA, 22 bp, Artificial Sequence
  chemically synthesized
agaaataaatgccaaaataatt

SEQ ID NO: 4075 - DNA, 22 bp, Artificial Sequence
  chemically synthesized
gaaataaatgccaaaataattc

SEQ ID NO: 4076 - DNA, 22 bp, Artificial Sequence
  chemically synthesized
tttaaagatgcagagtttacta

SEQ ID NO: 4077 - DNA, 22 bp, Artificial Sequence
  chemically synthesized
taaagatgcagagtttactaaa

SEQ ID NO: 4078 - DNA, 22 bp, Artificial Sequence
  chemically synthesized
aaagatgcagagtttactaaaa

SEQ ID NO: 4079 - DNA, 22 bp, Artificial Sequence
  chemically synthesized
aagatgcagagtttactaaaac

SEQ ID NO: 4080 - DNA, 22 bp, Artificial Sequence
  chemically synthesized
actaaaactttattttactggg

SEQ ID NO: 4081 - DNA, 22 bp, Artificial Sequence
  chemically synthesized
ctaaaactttattttactggga

SEQ ID NO: 4082 - DNA, 22 bp, Artificial Sequence
  chemically synthesized
aaactttattttactgggaaaa

SEQ ID NO: 4083 - DNA, 22 bp, Artificial Sequence
  chemically synthesized
tattttactgggaaaatagaat

SEQ ID NO: 4084 - DNA, 22 bp, Artificial Sequence
  chemically synthesized
attttactgggaaaatagaata

SEQ ID NO: 4085 - DNA, 22 bp, Artificial Sequence
  chemically synthesized
ttttactgggaaaatagaataa

SEQ ID NO: 4086 - DNA, 22 bp, Artificial Sequence
  chemically synthesized
tactgggaaaatagaataaaag

SEQ ID NO: 4087 - DNA, 22 bp, Artificial Sequence
  chemically synthesized
actgggaaaatagaataaaagt

SEQ ID NO: 4088 - DNA, 22 bp, Artificial Sequence
  chemically synthesized
ctgggaaaatagaataaaagtt

SEQ ID NO: 4089 - DNA, 22 bp, Artificial Sequence
  chemically synthesized
ggaaaatagaataaaagttgaa

SEQ ID NO: 4090 - DNA, 22 bp, Artificial Sequence
  chemically synthesized
aacaatagaaaaatggatttct

SEQ ID NO: 4091 - DNA, 22 bp, Artificial Sequence
  chemically synthesized
cttacgtgcatctcgacgaaac

SEQ ID NO: 4092 - DNA, 22 bp, Artificial Sequence
  chemically synthesized
ttacgtgcatctcgacgaaaca

SEQ ID NO: 4093 - DNA, 22 bp, Artificial Sequence
  chemically synthesized
acgtgcatctcgacgaaacaca

SEQ ID NO: 4094 - DNA, 22 bp, Artificial Sequence
  chemically synthesized
cgtgcatctcgacgaaacacac

SEQ ID NO: 4095 - DNA, 22 bp, Artificial Sequence
  chemically synthesized
gacgaaacacacccctggaata

SEQ ID NO: 4096 - DNA, 22 bp, Artificial Sequence
  chemically synthesized
gaataagccgagctaaagagaa

SEQ ID NO: 4097 - DNA, 22 bp, Artificial Sequence
  chemically synthesized
aagagaaaaagaagggaaataa

SEQ ID NO: 4098 - DNA, 22 bp, Artificial Sequence
  chemically synthesized
cccacttcattgtgccaaaggc

SEQ ID NO: 4099 - DNA, 22 bp, Artificial Sequence
  chemically synthesized
cattgtgccaaaggcgtgtggg

SEQ ID NO: 4100 - DNA, 22 bp, Artificial Sequence
  chemically synthesized
attgtgccaaaggcgtgtgggg

SEQ ID NO: 4101 - DNA, 22 bp, Artificial Sequence
  chemically synthesized
tgccaaaggcgtgtggggttga

SEQ ID NO: 4102 - DNA, 22 bp, Artificial Sequence
  chemically synthesized
acagaagagaaaagctaggaca

SEQ ID NO: 4103 - DNA, 22 bp, Artificial Sequence
  chemically synthesized
ggacaaacggagggaaattagc

SEQ ID NO: 4104 - DNA, 20 bp, Artificial Sequence
  chemically synthesized
aataaatttacccaacaaaa

SEQ ID NO: 4105 - DNA, 20 bp, Artificial Sequence
  chemically synthesized
aatctcttaaaatcataaaa

SEQ ID NO: 4106 - DNA, 20 bp, Artificial Sequence
  chemically synthesized
aaatcataaaaaagtaaaat

SEQ ID NO: 4107 - DNA, 20 bp, Artificial Sequence
  chemically synthesized
gtaaaattagcttttaaaaa

SEQ ID NO: 4108 - DNA, 20 bp, Artificial Sequence
  chemically synthesized
taaaattagcttttaaaaac

SEQ ID NO: 4109 - DNA, 20 bp, Artificial Sequence
  chemically synthesized
aattagcttttaaaaacagg

SEQ ID NO: 4110 - DNA, 20 bp, Artificial Sequence
  chemically synthesized
ttaaaaacaggtagtcacca

SEQ ID NO: 4111 - DNA, 20 bp, Artificial Sequence
  chemically synthesized
tcaccatagcattgaatgtg

SEQ ID NO: 4112 - DNA, 20 bp, Artificial Sequence
  chemically synthesized
tgaatgtgtagtttataata

SEQ ID NO: 4113 - DNA, 20 bp, Artificial Sequence
  chemically synthesized
gtgtagtttataatacagca

SEQ ID NO: 4114 - DNA, 20 bp, Artificial Sequence
  chemically synthesized
acaatttcaaattacctatt

SEQ ID NO: 4115 - DNA, 20 bp, Artificial Sequence
  chemically synthesized
tttcaaattacctattaagt

SEQ ID NO: 4116 - DNA, 20 bp, Artificial Sequence
  chemically synthesized
ctcatttctttgatttcatt

SEQ ID NO: 4117 - DNA, 20 bp, Artificial Sequence
  chemically synthesized
agcattgatctaactcaatg

SEQ ID NO: 4118 - DNA, 20 bp, Artificial Sequence
  chemically synthesized
attgatctaactcaatgtgg

SEQ ID NO: 4119 - DNA, 20 bp, Artificial Sequence
  chemically synthesized
gatctaactcaatgtggaag

SEQ ID NO: 4120 - DNA, 20 bp, Artificial Sequence
  chemically synthesized
atctaactcaatgtggaaga

SEQ ID NO: 4121 - DNA, 20 bp, Artificial Sequence
  chemically synthesized
gaagaaggttacattcgtgc

SEQ ID NO: 4122 - DNA, 20 bp, Artificial Sequence
  chemically synthesized
tacattcgtgcaagttaaca

SEQ ID NO: 4123 - DNA, 20 bp, Artificial Sequence
  chemically synthesized
cctaccaaccttaccttttc

SEQ ID NO: 4124 - DNA, 20 bp, Artificial Sequence
  chemically synthesized
ctaccaaccttaccttttct

SEQ ID NO: 4125 - DNA, 20 bp, Artificial Sequence
  chemically synthesized
taccttttctgggcaaatat

SEQ ID NO: 4126 - DNA, 20 bp, Artificial Sequence
  chemically synthesized
tgggcaaatattggtatata

SEQ ID NO: 4127 - DNA, 20 bp, Artificial Sequence
  chemically synthesized
ggcaaatattggtatatata

SEQ ID NO: 4128 - DNA, 20 bp, Artificial Sequence
  chemically synthesized
atattggtatatatagagtt

SEQ ID NO: 4129 - DNA, 20 bp, Artificial Sequence
  chemically synthesized
ttggtatatatagagttaag

SEQ ID NO: 4130 - DNA, 20 bp, Artificial Sequence
  chemically synthesized
atatatagagttaagaagtc

SEQ ID NO: 4131 - DNA, 20 bp, Artificial Sequence
  chemically synthesized
tatatagagttaagaagtct

SEQ ID NO: 4132 - DNA, 20 bp, Artificial Sequence
  chemically synthesized
aagaagtctaggtctgcttc

SEQ ID NO: 4133 - DNA, 20 bp, Artificial Sequence
  chemically synthesized
aagtctaggtctgcttccag

SEQ ID NO: 4134 - DNA, 20 bp, Artificial Sequence
  chemically synthesized
ggtctgcttccagaagaaaa

SEQ ID NO: 4135 - DNA, 20 bp, Artificial Sequence
  chemically synthesized
gttgcttgaaattgaaaatc

SEQ ID NO: 4136 - DNA, 20 bp, Artificial Sequence
  chemically synthesized
agataaaaatgttcacaatt

SEQ ID NO: 4137 - DNA, 20 bp, Artificial Sequence
  chemically synthesized
ccttctttttattgttcctc

SEQ ID NO: 4138 - DNA, 20 bp, Artificial Sequence
  chemically synthesized
gttcctctagttatttcctc

SEQ ID NO: 4139 - DNA, 20 bp, Artificial Sequence
  chemically synthesized
tatttcctccagaattgatc

SEQ ID NO: 4140 - DNA, 20 bp, Artificial Sequence
  chemically synthesized
atcatttgattctctatctc

SEQ ID NO: 4141 - DNA, 20 bp, Artificial Sequence
  chemically synthesized
catttgattctctatctcca

SEQ ID NO: 4142 - DNA, 20 bp, Artificial Sequence
  chemically synthesized
ctatctccagagccaaaatc

SEQ ID NO: 4143 - DNA, 20 bp, Artificial Sequence
  chemically synthesized
aaaatcaagatttgctatgt

SEQ ID NO: 4144 - DNA, 20 bp, Artificial Sequence
  chemically synthesized
gttagacgatgtaaaaattt

SEQ ID NO: 4145 - DNA, 20 bp, Artificial Sequence
  chemically synthesized
gatgtaaaaattttagccaa

SEQ ID NO: 4146 - DNA, 20 bp, Artificial Sequence
  chemically synthesized
ttttagccaatggcctcctt

SEQ ID NO: 4147 - DNA, 20 bp, Artificial Sequence
  chemically synthesized
agccaatggcctccttcagt

SEQ ID NO: 4148 - DNA, 20 bp, Artificial Sequence
  chemically synthesized
gccaatggcctccttcagtt

SEQ ID NO: 4149 - DNA, 20 bp, Artificial Sequence
  chemically synthesized
ggcctccttcagttgggaca

SEQ ID NO: 4150 - DNA, 20 bp, Artificial Sequence
  chemically synthesized
tcagttgggacatggtctta

SEQ ID NO: 4151 - DNA, 20 bp, Artificial Sequence
  chemically synthesized
gtcttaaagactttgtccat

SEQ ID NO: 4152 - DNA, 20 bp, Artificial Sequence
  chemically synthesized
aagactttgtccataagacg

SEQ ID NO: 4153 - DNA, 20 bp, Artificial Sequence
  chemically synthesized
agactttgtccataagacga

SEQ ID NO: 4154 - DNA, 20 bp, Artificial Sequence
  chemically synthesized
gactttgtccataagacgaa

SEQ ID NO: 4155 - DNA, 20 bp, Artificial Sequence
  chemically synthesized
aaaaactcaacatatttgat

SEQ ID NO: 4156 - DNA, 20 bp, Artificial Sequence
  chemically synthesized
tatgatctatcgctgcaaac

SEQ ID NO: 4157 - DNA, 20 bp, Artificial Sequence
  chemically synthesized
gctgcaaaccagtgaaatca

SEQ ID NO: 4158 - DNA, 20 bp, Artificial Sequence
  chemically synthesized
gcaaaccagtgaaatcaaag

SEQ ID NO: 4159 - DNA, 20 bp, Artificial Sequence
  chemically synthesized
aaccagtgaaatcaaagaag

SEQ ID NO: 4160 - DNA, 20 bp, Artificial Sequence
  chemically synthesized
gtgaaatcaaagaagaagaa

SEQ ID NO: 4161 - DNA, 20 bp, Artificial Sequence
  chemically synthesized
tgaaatcaaagaagaagaaa

SEQ ID NO: 4162 - DNA, 20 bp, Artificial Sequence
  chemically synthesized
aaagaagaagaaaaggaact

SEQ ID NO: 4163 - DNA, 20 bp, Artificial Sequence
  chemically synthesized
gaagaagaaaaggaactgag

SEQ ID NO: 4164 - DNA, 20 bp, Artificial Sequence
  chemically synthesized
aagaactacatataaactac

SEQ ID NO: 4165 - DNA, 20 bp, Artificial Sequence
  chemically synthesized
taaactacaagtcaaaaatg

SEQ ID NO: 4166 - DNA, 20 bp, Artificial Sequence
  chemically synthesized
aactacaagtcaaaaatgaa

SEQ ID NO: 4167 - DNA, 20 bp, Artificial Sequence
  chemically synthesized
actacaagtcaaaaatgaag

SEQ ID NO: 4168 - DNA, 20 bp, Artificial Sequence
  chemically synthesized
aagtcaaaaatgaagaggta

SEQ ID NO: 4169 - DNA, 20 bp, Artificial Sequence
  chemically synthesized
gaactcaactcaaaacttga

SEQ ID NO: 4170 - DNA, 20 bp, Artificial Sequence
  chemically synthesized
ctcaaaacttgaaagcctcc

SEQ ID NO: 4171 - DNA, 20 bp, Artificial Sequence
  chemically synthesized
aaaacttgaaagcctcctag

SEQ ID NO: 4172 - DNA, 20 bp, Artificial Sequence
  chemically synthesized
aaaaattctacttcaacaaa

SEQ ID NO: 4173 - DNA, 20 bp, Artificial Sequence
  chemically synthesized
tcaacaaaaagtgaaatatt

SEQ ID NO: 4174 - DNA, 20 bp, Artificial Sequence
  chemically synthesized
acaaaaagtgaaatatttag

SEQ ID NO: 4175 - DNA, 20 bp, Artificial Sequence
  chemically synthesized
aaaaagtgaaatatttagaa

SEQ ID NO: 4176 - DNA, 20 bp, Artificial Sequence
  chemically synthesized
tcaaaatcaacctgaaactc

SEQ ID NO: 4177 - DNA, 20 bp, Artificial Sequence
  chemically synthesized
acctgaaactccagaacacc

SEQ ID NO: 4178 - DNA, 20 bp, Artificial Sequence
  chemically synthesized
tgaaactccagaacacccag

SEQ ID NO: 4179 - DNA, 20 bp, Artificial Sequence
  chemically synthesized
cccagaagtaacttcactta

SEQ ID NO: 4180 - DNA, 20 bp, Artificial Sequence
  chemically synthesized
gaagtaacttcacttaaagt

SEQ ID NO: 4181 - DNA, 20 bp, Artificial Sequence
  chemically synthesized
gtaacttcacttaaagtaag

SEQ ID NO: 4182 - DNA, 20 bp, Artificial Sequence
  chemically synthesized
cttaaagtaagtagaaaata

SEQ ID NO: 4183 - DNA, 20 bp, Artificial Sequence
  chemically synthesized
taaagtaagtagaaaataaa

SEQ ID NO: 4184 - DNA, 20 bp, Artificial Sequence
  chemically synthesized
aaagtaagtagaaaataaag

SEQ ID NO: 4185 - DNA, 20 bp, Artificial Sequence
  chemically synthesized
aagtaagtagaaaataaaga

SEQ ID NO: 4186 - DNA, 20 bp, Artificial Sequence
  chemically synthesized
tcatgtttatgttttcaatg

SEQ ID NO: 4187 - DNA, 20 bp, Artificial Sequence
  chemically synthesized
cttttaaaaaaaatatttct

SEQ ID NO: 4188 - DNA, 20 bp, Artificial Sequence
  chemically synthesized
ttttaaaaaaaatatttcta

SEQ ID NO: 4189 - DNA, 20 bp, Artificial Sequence
  chemically synthesized
gttgaaatacttttttttcc

SEQ ID NO: 4190 - DNA, 20 bp, Artificial Sequence
  chemically synthesized
tttccaagaaaaataatctc

SEQ ID NO: 4191 - DNA, 20 bp, Artificial Sequence
  chemically synthesized
aaatttcctattataatttc

SEQ ID NO: 4192 - DNA, 20 bp, Artificial Sequence
  chemically synthesized
ttcctattataatttcaagt

SEQ ID NO: 4193 - DNA, 20 bp, Artificial Sequence
  chemically synthesized
tttatatgaaaattacaaat

SEQ ID NO: 4194 - DNA, 20 bp, Artificial Sequence
  chemically synthesized
atcggttaaattatacaatc

SEQ ID NO: 4195 - DNA, 20 bp, Artificial Sequence
  chemically synthesized
tacactattgtaaattactg

SEQ ID NO: 4196 - DNA, 20 bp, Artificial Sequence
  chemically synthesized
acactattgtaaattactga

SEQ ID NO: 4197 - DNA, 20 bp, Artificial Sequence
  chemically synthesized
tattgtaaattactgaaggt

SEQ ID NO: 4198 - DNA, 20 bp, Artificial Sequence
  chemically synthesized
aattactgaaggtaagtaaa

SEQ ID NO: 4199 - DNA, 20 bp, Artificial Sequence
  chemically synthesized
aaaaatttaaaactattctc

SEQ ID NO: 4200 - DNA, 20 bp, Artificial Sequence
  chemically synthesized
ctattctccagtgtttaaaa

SEQ ID NO: 4201 - DNA, 20 bp, Artificial Sequence
  chemically synthesized
ttaaaacagattaaataata

SEQ ID NO: 4202 - DNA, 20 bp, Artificial Sequence
  chemically synthesized
agattaaataatacagtaaa

SEQ ID NO: 4203 - DNA, 20 bp, Artificial Sequence
  chemically synthesized
aaataatacagtaaatggaa

SEQ ID NO: 4204 - DNA, 20 bp, Artificial Sequence
  chemically synthesized
ttattcatatgaaaatatgc

SEQ ID NO: 4205 - DNA, 20 bp, Artificial Sequence
  chemically synthesized
tattcatatgaaaatatgct

SEQ ID NO: 4206 - DNA, 20 bp, Artificial Sequence
  chemically synthesized
tgggctttttcttttaattg

SEQ ID NO: 4207 - DNA, 20 bp, Artificial Sequence
  chemically synthesized
tttttcttttaattgaagtt

SEQ ID NO: 4208 - DNA, 20 bp, Artificial Sequence
  chemically synthesized
aagttcagaaaatcaaattt

SEQ ID NO: 4209 - DNA, 20 bp, Artificial Sequence
  chemically synthesized
gttcagaaaatcaaatttta

SEQ ID NO: 4210 - DNA, 20 bp, Artificial Sequence
  chemically synthesized
agaaaatcaaattttagaga

SEQ ID NO: 4211 - DNA, 20 bp, Artificial Sequence
  chemically synthesized
tacaatttaaataaaatgtt

SEQ ID NO: 4212 - DNA, 20 bp, Artificial Sequence
  chemically synthesized
acaatttaaataaaatgtta

SEQ ID NO: 4213 - DNA, 20 bp, Artificial Sequence
  chemically synthesized
caaaaatatgtgctatttga

SEQ ID NO: 4214 - DNA, 20 bp, Artificial Sequence
  chemically synthesized
aaatatgtgctatttgaaag

SEQ ID NO: 4215 - DNA, 20 bp, Artificial Sequence
  chemically synthesized
gctatttgaaagaagcatac

SEQ ID NO: 4216 - DNA, 20 bp, Artificial Sequence
  chemically synthesized
ctatttgaaagaagcataca

SEQ ID NO: 4217 - DNA, 20 bp, Artificial Sequence
  chemically synthesized
tatttgaaagaagcatacaa

SEQ ID NO: 4218 - DNA, 20 bp, Artificial Sequence
  chemically synthesized
atttgaaagaagcatacaag

SEQ ID NO: 4219 - DNA, 20 bp, Artificial Sequence
  chemically synthesized
tgaaagaagcatacaagggg

SEQ ID NO: 4220 - DNA, 20 bp, Artificial Sequence
  chemically synthesized
gaaagaagcatacaagggga

SEQ ID NO: 4221 - DNA, 20 bp, Artificial Sequence
  chemically synthesized
tcatttttcaaatccattat

SEQ ID NO: 4222 - DNA, 20 bp, Artificial Sequence
  chemically synthesized
ccattattagtttaaaaatt

SEQ ID NO: 4223 - DNA, 20 bp, Artificial Sequence
  chemically synthesized
tttaaaaatttagattatga

SEQ ID NO: 4224 - DNA, 20 bp, Artificial Sequence
  chemically synthesized
tttagattatgatagtgtta

SEQ ID NO: 4225 - DNA, 20 bp, Artificial Sequence
  chemically synthesized
ttagattatgatagtgttac

SEQ ID NO: 4226 - DNA, 20 bp, Artificial Sequence
  chemically synthesized
atagtgttacaggaaattaa

SEQ ID NO: 4227 - DNA, 20 bp, Artificial Sequence
  chemically synthesized
gttacaggaaattaatagaa

SEQ ID NO: 4228 - DNA, 20 bp, Artificial Sequence
  chemically synthesized
caggaaattaatagaaaaga

SEQ ID NO: 4229 - DNA, 20 bp, Artificial Sequence
  chemically synthesized
ggaaattaatagaaaagaaa

SEQ ID NO: 4230 - DNA, 20 bp, Artificial Sequence
  chemically synthesized
gaaattaatagaaaagaaag

SEQ ID NO: 4231 - DNA, 20 bp, Artificial Sequence
  chemically synthesized
ttaatagaaaagaaagagga

SEQ ID NO: 4232 - DNA, 20 bp, Artificial Sequence
  chemically synthesized
accaacctactctctatatc

SEQ ID NO: 4233 - DNA, 20 bp, Artificial Sequence
  chemically synthesized
tctctatatccagacttttg

SEQ ID NO: 4234 - DNA, 20 bp, Artificial Sequence
  chemically synthesized
ccagacttttgtagaaaaac

SEQ ID NO: 4235 - DNA, 20 bp, Artificial Sequence
  chemically synthesized
tttgtagaaaaacaagataa

SEQ ID NO: 4236 - DNA, 20 bp, Artificial Sequence
  chemically synthesized
aaaacaagataatagcatca

SEQ ID NO: 4237 - DNA, 20 bp, Artificial Sequence
  chemically synthesized
atagcatcaaagaccttctc

SEQ ID NO: 4238 - DNA, 20 bp, Artificial Sequence
  chemically synthesized
caaagaccttctccagaccg

SEQ ID NO: 4239 - DNA, 20 bp, Artificial Sequence
  chemically synthesized
agaccttctccagaccgtgg

SEQ ID NO: 4240 - DNA, 20 bp, Artificial Sequence
  chemically synthesized
aatataaacaattaaaccaa

SEQ ID NO: 4241 - DNA, 20 bp, Artificial Sequence
  chemically synthesized
aaacaattaaaccaacagca

SEQ ID NO: 4242 - DNA, 20 bp, Artificial Sequence
  chemically synthesized
ccaacagcatagtcaaataa

SEQ ID NO: 4243 - DNA, 20 bp, Artificial Sequence
  chemically synthesized
gcatagtcaaataaaagaaa

SEQ ID NO: 4244 - DNA, 20 bp, Artificial Sequence
  chemically synthesized
aaataaaagaaatagaaaat

SEQ ID NO: 4245 - DNA, 20 bp, Artificial Sequence
  chemically synthesized
aataaaagaaatagaaaatc

SEQ ID NO: 4246 - DNA, 20 bp, Artificial Sequence
  chemically synthesized
aaagaaatagaaaatcaggt

SEQ ID NO: 4247 - DNA, 20 bp, Artificial Sequence
  chemically synthesized
aaatagaaaatcaggtaagt

SEQ ID NO: 4248 - DNA, 20 bp, Artificial Sequence
  chemically synthesized
caggtaagtcagtattttaa

SEQ ID NO: 4249 - DNA, 20 bp, Artificial Sequence
  chemically synthesized
ggtatgtcccatctttcaca

SEQ ID NO: 4250 - DNA, 20 bp, Artificial Sequence
  chemically synthesized
gtatgtcccatctttcacac

SEQ ID NO: 4251 - DNA, 20 bp, Artificial Sequence
  chemically synthesized
tgaatcctaaaattatttac

SEQ ID NO: 4252 - DNA, 20 bp, Artificial Sequence
  chemically synthesized
aattatttacaagctttaac

SEQ ID NO: 4253 - DNA, 20 bp, Artificial Sequence
  chemically synthesized
acaagctttaactggatcat

SEQ ID NO: 4254 - DNA, 20 bp, Artificial Sequence
  chemically synthesized
catgagtaaaattatcacat

SEQ ID NO: 4255 - DNA, 20 bp, Artificial Sequence
  chemically synthesized
cagcataactgttaaaattg

SEQ ID NO: 4256 - DNA, 20 bp, Artificial Sequence
  chemically synthesized
agcataactgttaaaattgc

SEQ ID NO: 4257 - DNA, 20 bp, Artificial Sequence
  chemically synthesized
tgttaaaattgcaggctctg

SEQ ID NO: 4258 - DNA, 20 bp, Artificial Sequence
  chemically synthesized
aactacctgcatttaaacca

SEQ ID NO: 4259 - DNA, 20 bp, Artificial Sequence
  chemically synthesized
tacttcacccctttatctct

SEQ ID NO: 4260 - DNA, 20 bp, Artificial Sequence
  chemically synthesized
gtttcctcacatatactaca

SEQ ID NO: 4261 - DNA, 20 bp, Artificial Sequence
  chemically synthesized
atatactacaaagataataa

SEQ ID NO: 4262 - DNA, 20 bp, Artificial Sequence
  chemically synthesized
aaagataataacagaactta

SEQ ID NO: 4263 - DNA, 20 bp, Artificial Sequence
  chemically synthesized
aagataataacagaacttat

SEQ ID NO: 4264 - DNA, 20 bp, Artificial Sequence
  chemically synthesized
agaacttataggattattgt

SEQ ID NO: 4265 - DNA, 20 bp, Artificial Sequence
  chemically synthesized
taagaaaaaaaattaattca

SEQ ID NO: 4266 - DNA, 20 bp, Artificial Sequence
  chemically synthesized
gaaaaaaaattaattcatag

SEQ ID NO: 4267 - DNA, 20 bp, Artificial Sequence
  chemically synthesized
catcttactaaaattcaaat

SEQ ID NO: 4268 - DNA, 20 bp, Artificial Sequence
  chemically synthesized
ctttgctcaaaaccacacaa

SEQ ID NO: 4269 - DNA, 20 bp, Artificial Sequence
  chemically synthesized
gctttccatttcactcatat

SEQ ID NO: 4270 - DNA, 20 bp, Artificial Sequence
  chemically synthesized
tttcactcatattggctctt

SEQ ID NO: 4271 - DNA, 20 bp, Artificial Sequence
  chemically synthesized
tcatattggctctttagacc

SEQ ID NO: 4272 - DNA, 20 bp, Artificial Sequence
  chemically synthesized
ttgggtaatcttggtctaaa

SEQ ID NO: 4273 - DNA, 20 bp, Artificial Sequence
  chemically synthesized
ttggtctaaagagccaatat

SEQ ID NO: 4274 - DNA, 20 bp, Artificial Sequence
  chemically synthesized
aagagccaatatgagtgaaa

SEQ ID NO: 4275 - DNA, 20 bp, Artificial Sequence
  chemically synthesized
gccaatatgagtgaaatgga

SEQ ID NO: 4276 - DNA, 20 bp, Artificial Sequence
  chemically synthesized
tgaaatggaaagctattgtg

SEQ ID NO: 4277 - DNA, 20 bp, Artificial Sequence
  chemically synthesized
gaaagctattgtgtggtttt

SEQ ID NO: 4278 - DNA, 20 bp, Artificial Sequence
  chemically synthesized
ctattgtgtggttttgagca

SEQ ID NO: 4279 - DNA, 20 bp, Artificial Sequence
  chemically synthesized
attgtgtggttttgagcaaa

SEQ ID NO: 4280 - DNA, 20 bp, Artificial Sequence
  chemically synthesized
acatgatctaatttgaattt

SEQ ID NO: 4281 - DNA, 20 bp, Artificial Sequence
  chemically synthesized
gatctaatttgaattttagt

SEQ ID NO: 4282 - DNA, 20 bp, Artificial Sequence
  chemically synthesized
gaattttagtaagatgacat

SEQ ID NO: 4283 - DNA, 20 bp, Artificial Sequence
  chemically synthesized
ttttcttacaataatcctat

SEQ ID NO: 4284 - DNA, 20 bp, Artificial Sequence
  chemically synthesized
aagttctgttattatctttg

SEQ ID NO: 4285 - DNA, 20 bp, Artificial Sequence
  chemically synthesized
attatctttgtagtatatgt

SEQ ID NO: 4286 - DNA, 20 bp, Artificial Sequence
  chemically synthesized
ttatctttgtagtatatgtg

SEQ ID NO: 4287 - DNA, 20 bp, Artificial Sequence
  chemically synthesized
gtagtatatgtgaggaaact

SEQ ID NO: 4288 - DNA, 20 bp, Artificial Sequence
  chemically synthesized
agtatatgtgaggaaactga

SEQ ID NO: 4289 - DNA, 20 bp, Artificial Sequence
  chemically synthesized
tgtgaggaaactgagagata

SEQ ID NO: 4290 - DNA, 20 bp, Artificial Sequence
  chemically synthesized
gtgaggaaactgagagataa

SEQ ID NO: 4291 - DNA, 20 bp, Artificial Sequence
  chemically synthesized
tgaggaaactgagagataaa

SEQ ID NO: 4292 - DNA, 20 bp, Artificial Sequence
  chemically synthesized
gaggaaactgagagataaag

SEQ ID NO: 4293 - DNA, 20 bp, Artificial Sequence
  chemically synthesized
aactgagagataaaggggtg

SEQ ID NO: 4294 - DNA, 20 bp, Artificial Sequence
  chemically synthesized
aggggtgaagtaatttattc

SEQ ID NO: 4295 - DNA, 20 bp, Artificial Sequence
  chemically synthesized
ggggtgaagtaatttattca

SEQ ID NO: 4296 - DNA, 20 bp, Artificial Sequence
  chemically synthesized
aatttattcaaggtcacaca

SEQ ID NO: 4297 - DNA, 20 bp, Artificial Sequence
  chemically synthesized
ttcaaggtcacacaaagttt

SEQ ID NO: 4298 - DNA, 20 bp, Artificial Sequence
  chemically synthesized
caaggtcacacaaagtttta

SEQ ID NO: 4299 - DNA, 20 bp, Artificial Sequence
  chemically synthesized
cacacaaagttttagagcca

SEQ ID NO: 4300 - DNA, 20 bp, Artificial Sequence
  chemically synthesized
ttagagccatggtttaaatg

SEQ ID NO: 4301 - DNA, 20 bp, Artificial Sequence
  chemically synthesized
tagagccatggtttaaatgc

SEQ ID NO: 4302 - DNA, 20 bp, Artificial Sequence
  chemically synthesized
agccatggtttaaatgcagg

SEQ ID NO: 4303 - DNA, 20 bp, Artificial Sequence
  chemically synthesized
tttaaatgcaggtagtttat

SEQ ID NO: 4304 - DNA, 20 bp, Artificial Sequence
  chemically synthesized
tgcaggtagtttattagctt

SEQ ID NO: 4305 - DNA, 20 bp, Artificial Sequence
  chemically synthesized
caggtagtttattagcttca

SEQ ID NO: 4306 - DNA, 20 bp, Artificial Sequence
  chemically synthesized
ttcagagcctgcaattttaa

SEQ ID NO: 4307 - DNA, 20 bp, Artificial Sequence
  chemically synthesized
tgataattttactcatgatc

SEQ ID NO: 4308 - DNA, 20 bp, Artificial Sequence
  chemically synthesized
ttttactcatgatccagtta

SEQ ID NO: 4309 - DNA, 20 bp, Artificial Sequence
  chemically synthesized
ttaaagcttgtaaataattt

SEQ ID NO: 4310 - DNA, 20 bp, Artificial Sequence
  chemically synthesized
taaagcttgtaaataatttt

SEQ ID NO: 4311 - DNA, 20 bp, Artificial Sequence
  chemically synthesized
ttgtaaataattttaggatt

SEQ ID NO: 4312 - DNA, 20 bp, Artificial Sequence
  chemically synthesized
tttaggattcagtgttttta

SEQ ID NO: 4313 - DNA, 20 bp, Artificial Sequence
  chemically synthesized
gtttttacagacctgtgtga

SEQ ID NO: 4314 - DNA, 20 bp, Artificial Sequence
  chemically synthesized
ttacagacctgtgtgaaaga

SEQ ID NO: 4315 - DNA, 20 bp, Artificial Sequence
  chemically synthesized
tacagacctgtgtgaaagat

SEQ ID NO: 4316 - DNA, 20 bp, Artificial Sequence
  chemically synthesized
cttttatttgactatgctgt

SEQ ID NO: 4317 - DNA, 20 bp, Artificial Sequence
  chemically synthesized
gttggtttaattgtttatat

SEQ ID NO: 4318 - DNA, 20 bp, Artificial Sequence
  chemically synthesized
ttgtttatattggtcttcca

SEQ ID NO: 4319 - DNA, 20 bp, Artificial Sequence
  chemically synthesized
tatattggtcttccacggtc

SEQ ID NO: 4320 - DNA, 20 bp, Artificial Sequence
  chemically synthesized
tattggtcttccacggtctg

SEQ ID NO: 4321 - DNA, 20 bp, Artificial Sequence
  chemically synthesized
tggtcttccacggtctggag

SEQ ID NO: 4322 - DNA, 20 bp, Artificial Sequence
  chemically synthesized
ggtcttccacggtctggaga

SEQ ID NO: 4323 - DNA, 20 bp, Artificial Sequence
  chemically synthesized
attatcttgtttttctacaa

SEQ ID NO: 4324 - DNA, 20 bp, Artificial Sequence
  chemically synthesized
cttgtttttctacaaaagtc

SEQ ID NO: 4325 - DNA, 20 bp, Artificial Sequence
  chemically synthesized
tttctacaaaagtctggata

SEQ ID NO: 4326 - DNA, 20 bp, Artificial Sequence
  chemically synthesized
tctacaaaagtctggatata

SEQ ID NO: 4327 - DNA, 20 bp, Artificial Sequence
  chemically synthesized
tacaaaagtctggatataga

SEQ ID NO: 4328 - DNA, 20 bp, Artificial Sequence
  chemically synthesized
aaaagtctggatatagagag

SEQ ID NO: 4329 - DNA, 20 bp, Artificial Sequence
  chemically synthesized
aaagtctggatatagagagt

SEQ ID NO: 4330 - DNA, 20 bp, Artificial Sequence
  chemically synthesized
tctggatatagagagtaggt

SEQ ID NO: 4331 - DNA, 20 bp, Artificial Sequence
  chemically synthesized
atagagagtaggttggttat

SEQ ID NO: 4332 - DNA, 20 bp, Artificial Sequence
  chemically synthesized
ctaaatttttaaactaataa

SEQ ID NO: 4333 - DNA, 20 bp, Artificial Sequence
  chemically synthesized
tggatttgaaaaatgaatat

SEQ ID NO: 4334 - DNA, 20 bp, Artificial Sequence
  chemically synthesized
ccttgtatgcttctttcaaa

SEQ ID NO: 4335 - DNA, 20 bp, Artificial Sequence
  chemically synthesized
attttctgaacttcaattaa

SEQ ID NO: 4336 - DNA, 20 bp, Artificial Sequence
  chemically synthesized
tgaacttcaattaaaagaaa

SEQ ID NO: 4337 - DNA, 20 bp, Artificial Sequence
  chemically synthesized
ttcaattaaaagaaaaagcc

SEQ ID NO: 4338 - DNA, 20 bp, Artificial Sequence
  chemically synthesized
atttaatctgttttaaacac

SEQ ID NO: 4339 - DNA, 20 bp, Artificial Sequence
  chemically synthesized
ttaatctgttttaaacactg

SEQ ID NO: 4340 - DNA, 20 bp, Artificial Sequence
  chemically synthesized
ctgttttaaacactggagaa

SEQ ID NO: 4341 - DNA, 20 bp, Artificial Sequence
  chemically synthesized
tttaactttttacttacctt

SEQ ID NO: 4342 - DNA, 20 bp, Artificial Sequence
  chemically synthesized
ttaccttcagtaatttacaa

SEQ ID NO: 4343 - DNA, 20 bp, Artificial Sequence
  chemically synthesized
tttacaatagtgtaatgaca

SEQ ID NO: 4344 - DNA, 20 bp, Artificial Sequence
  chemically synthesized
agtgtaatgacatagtgttc

SEQ ID NO: 4345 - DNA, 20 bp, Artificial Sequence
  chemically synthesized
tcatataaaatgcaaatttt

SEQ ID NO: 4346 - DNA, 20 bp, Artificial Sequence
  chemically synthesized
agtgttttcatatataacat

SEQ ID NO: 4347 - DNA, 20 bp, Artificial Sequence
  chemically synthesized
gtgttttcatatataacatt

SEQ ID NO: 4348 - DNA, 20 bp, Artificial Sequence
  chemically synthesized
tgttttcatatataacatta

SEQ ID NO: 4349 - DNA, 20 bp, Artificial Sequence
  chemically synthesized
aaactaacttgaaattataa

SEQ ID NO: 4350 - DNA, 20 bp, Artificial Sequence
  chemically synthesized
aactaacttgaaattataat

SEQ ID NO: 4351 - DNA, 20 bp, Artificial Sequence
  chemically synthesized
taataggaaattttattttc

SEQ ID NO: 4352 - DNA, 20 bp, Artificial Sequence
  chemically synthesized
ataggaaattttattttctg

SEQ ID NO: 4353 - DNA, 20 bp, Artificial Sequence
  chemically synthesized
tttctggagattatttttct

SEQ ID NO: 4354 - DNA, 20 bp, Artificial Sequence
  chemically synthesized
attatttttcttggaaaaaa

SEQ ID NO: 4355 - DNA, 20 bp, Artificial Sequence
  chemically synthesized
agtatttcaacaatgcaaca

SEQ ID NO: 4356 - DNA, 20 bp, Artificial Sequence
  chemically synthesized
atgcaacaaagtatttcaaa

SEQ ID NO: 4357 - DNA, 20 bp, Artificial Sequence
  chemically synthesized
gtatttcaaatggcatgcct

SEQ ID NO: 4358 - DNA, 20 bp, Artificial Sequence
  chemically synthesized
cttagaaatattttttttaa

SEQ ID NO: 4359 - DNA, 20 bp, Artificial Sequence
  chemically synthesized
ctttattttctacttacttt

SEQ ID NO: 4360 - DNA, 20 bp, Artificial Sequence
  chemically synthesized
ttttctacttactttaagtg

SEQ ID NO: 4361 - DNA, 20 bp, Artificial Sequence
  chemically synthesized
actttaagtgaagttacttc

SEQ ID NO: 4362 - DNA, 20 bp, Artificial Sequence
  chemically synthesized
ctttaagtgaagttacttct

SEQ ID NO: 4363 - DNA, 20 bp, Artificial Sequence
  chemically synthesized
gaagttacttctgggtgttc

SEQ ID NO: 4364 - DNA, 20 bp, Artificial Sequence
  chemically synthesized
agttacttctgggtgttctg

SEQ ID NO: 4365 - DNA, 20 bp, Artificial Sequence
  chemically synthesized
ttctgggtgttctggagttt

SEQ ID NO: 4366 - DNA, 20 bp, Artificial Sequence
  chemically synthesized
tctgggtgttctggagtttc

SEQ ID NO: 4367 - DNA, 20 bp, Artificial Sequence
  chemically synthesized
tttcaggttgattttgaatt

SEQ ID NO: 4368 - DNA, 20 bp, Artificial Sequence
  chemically synthesized
aggttgattttgaattaagt

SEQ ID NO: 4369 - DNA, 20 bp, Artificial Sequence
  chemically synthesized
tgattttgaattaagttagt

SEQ ID NO: 4370 - DNA, 20 bp, Artificial Sequence
  chemically synthesized
aaatatttcactttttgttg

SEQ ID NO: 4371 - DNA, 20 bp, Artificial Sequence
  chemically synthesized
tatttcactttttgttgaag

SEQ ID NO: 4372 - DNA, 20 bp, Artificial Sequence
  chemically synthesized
tgaagtagaattttttcttc

SEQ ID NO: 4373 - DNA, 20 bp, Artificial Sequence
  chemically synthesized
gaagtagaattttttcttct

SEQ ID NO: 4374 - DNA, 20 bp, Artificial Sequence
  chemically synthesized
agtagaattttttcttctag

SEQ ID NO: 4375 - DNA, 20 bp, Artificial Sequence
  chemically synthesized
gtagaattttttcttctagg

SEQ ID NO: 4376 - DNA, 20 bp, Artificial Sequence
  chemically synthesized
ttttcttctaggaggctttc

SEQ ID NO: 4377 - DNA, 20 bp, Artificial Sequence
  chemically synthesized
ctaggaggctttcaagtttt

SEQ ID NO: 4378 - DNA, 20 bp, Artificial Sequence
  chemically synthesized
aggctttcaagttttgagtt

SEQ ID NO: 4379 - DNA, 20 bp, Artificial Sequence
  chemically synthesized
tcaagttttgagttgagttc

SEQ ID NO: 4380 - DNA, 20 bp, Artificial Sequence
  chemically synthesized
acctcttcatttttgacttg

SEQ ID NO: 4381 - DNA, 20 bp, Artificial Sequence
  chemically synthesized
tttgacttgtagtttatatg

SEQ ID NO: 4382 - DNA, 20 bp, Artificial Sequence
  chemically synthesized
agtttatatgtagttcttct

SEQ ID NO: 4383 - DNA, 20 bp, Artificial Sequence
  chemically synthesized
ttcttcttctttgatttcac

SEQ ID NO: 4384 - DNA, 20 bp, Artificial Sequence
  chemically synthesized
tctttgatttcactggtttg

SEQ ID NO: 4385 - DNA, 20 bp, Artificial Sequence
  chemically synthesized
atttcactggtttgcagcga

SEQ ID NO: 4386 - DNA, 20 bp, Artificial Sequence
  chemically synthesized
ttgcagcgatagatcataaa

SEQ ID NO: 4387 - DNA, 20 bp, Artificial Sequence
  chemically synthesized
aaagactgatcaaatatgtt

SEQ ID NO: 4388 - DNA, 20 bp, Artificial Sequence
  chemically synthesized
tttgaaatatgtcattaatt

SEQ ID NO: 4389 - DNA, 20 bp, Artificial Sequence
  chemically synthesized
taatttggcccttcgtctta

SEQ ID NO: 4390 - DNA, 20 bp, Artificial Sequence
  chemically synthesized
ggcccttcgtcttatggaca

SEQ ID NO: 4391 - DNA, 20 bp, Artificial Sequence
  chemically synthesized
gtcttatggacaaagtcttt

SEQ ID NO: 4392 - DNA, 20 bp, Artificial Sequence
  chemically synthesized
ttaagaccatgtcccaactg

SEQ ID NO: 4393 - DNA, 20 bp, Artificial Sequence
  chemically synthesized
taagaccatgtcccaactga

SEQ ID NO: 4394 - DNA, 20 bp, Artificial Sequence
  chemically synthesized
agaccatgtcccaactgaag

SEQ ID NO: 4395 - DNA, 20 bp, Artificial Sequence
  chemically synthesized
gaccatgtcccaactgaagg

SEQ ID NO: 4396 - DNA, 20 bp, Artificial Sequence
  chemically synthesized
tcccaactgaaggaggccat

SEQ ID NO: 4397 - DNA, 20 bp, Artificial Sequence
  chemically synthesized
aatttttacatcgtctaaca

SEQ ID NO: 4398 - DNA, 20 bp, Artificial Sequence
  chemically synthesized
aacatagcaaatcttgattt

SEQ ID NO: 4399 - DNA, 20 bp, Artificial Sequence
  chemically synthesized
gcaaatcttgattttggctc

SEQ ID NO: 4400 - DNA, 20 bp, Artificial Sequence
  chemically synthesized
aaatcttgattttggctctg

SEQ ID NO: 4401 - DNA, 20 bp, Artificial Sequence
  chemically synthesized
cttgattttggctctggaga

SEQ ID NO: 4402 - DNA, 20 bp, Artificial Sequence
  chemically synthesized
tgattttggctctggagata

SEQ ID NO: 4403 - DNA, 20 bp, Artificial Sequence
  chemically synthesized
tgaattgtcttgatcaattc

SEQ ID NO: 4404 - DNA, 20 bp, Artificial Sequence
  chemically synthesized
aattgtcttgatcaattctg

SEQ ID NO: 4405 - DNA, 20 bp, Artificial Sequence
  chemically synthesized
attgtcttgatcaattctgg

SEQ ID NO: 4406 - DNA, 20 bp, Artificial Sequence
  chemically synthesized
tcaattctggaggaaataac

SEQ ID NO: 4407 - DNA, 20 bp, Artificial Sequence
  chemically synthesized
aattctggaggaaataacta

SEQ ID NO: 4408 - DNA, 20 bp, Artificial Sequence
  chemically synthesized
attctggaggaaataactag

SEQ ID NO: 4409 - DNA, 20 bp, Artificial Sequence
  chemically synthesized
ataactagaggaacaataaa

SEQ ID NO: 4410 - DNA, 20 bp, Artificial Sequence
  chemically synthesized
actagaggaacaataaaaag

SEQ ID NO: 4411 - DNA, 20 bp, Artificial Sequence
  chemically synthesized
ctagaggaacaataaaaaga

SEQ ID NO: 4412 - DNA, 20 bp, Artificial Sequence
  chemically synthesized
agaggaacaataaaaagaag

SEQ ID NO: 4413 - DNA, 20 bp, Artificial Sequence
  chemically synthesized
ttatcttgattttcaatttc

SEQ ID NO: 4414 - DNA, 20 bp, Artificial Sequence
  chemically synthesized
attttcaatttcaagcaacg

SEQ ID NO: 4415 - DNA, 20 bp, Artificial Sequence
  chemically synthesized
aacgtggaactgttttcttc

SEQ ID NO: 4416 - DNA, 20 bp, Artificial Sequence
  chemically synthesized
gtggaactgttttcttctgg

SEQ ID NO: 4417 - DNA, 20 bp, Artificial Sequence
  chemically synthesized
gaactgttttcttctggaag

SEQ ID NO: 4418 - DNA, 20 bp, Artificial Sequence
  chemically synthesized
ttttcttctggaagcagacc

SEQ ID NO: 4419 - DNA, 20 bp, Artificial Sequence
  chemically synthesized
tatatataccaatatttgcc

SEQ ID NO: 4420 - DNA, 20 bp, Artificial Sequence
  chemically synthesized
ataccaatatttgcccagaa

SEQ ID NO: 4421 - DNA, 20 bp, Artificial Sequence
  chemically synthesized
taccaatatttgcccagaaa

SEQ ID NO: 4422 - DNA, 20 bp, Artificial Sequence
  chemically synthesized
aatatttgcccagaaaaggt

SEQ ID NO: 4423 - DNA, 20 bp, Artificial Sequence
  chemically synthesized
atatttgcccagaaaaggta

SEQ ID NO: 4424 - DNA, 20 bp, Artificial Sequence
  chemically synthesized
ttgcccagaaaaggtaaggt

SEQ ID NO: 4425 - DNA, 20 bp, Artificial Sequence
  chemically synthesized
cccagaaaaggtaaggttgg

SEQ ID NO: 4426 - DNA, 20 bp, Artificial Sequence
  chemically synthesized
ccagaaaaggtaaggttggt

SEQ ID NO: 4427 - DNA, 20 bp, Artificial Sequence
  chemically synthesized
gtaaggttggtaggtgaaca

SEQ ID NO: 4428 - DNA, 20 bp, Artificial Sequence
  chemically synthesized
ggtgaacatagttaatcatt

SEQ ID NO: 4429 - DNA, 20 bp, Artificial Sequence
  chemically synthesized
atgtaaccttcttccacatt

SEQ ID NO: 4430 - DNA, 20 bp, Artificial Sequence
  chemically synthesized
aaccttcttccacattgagt

SEQ ID NO: 4431 - DNA, 20 bp, Artificial Sequence
  chemically synthesized
atcaatgctaaatgaaatca

SEQ ID NO: 4432 - DNA, 20 bp, Artificial Sequence
  chemically synthesized
ctaaatgaaatcaaagaaat

SEQ ID NO: 4433 - DNA, 20 bp, Artificial Sequence
  chemically synthesized
gaaatgagcaactaacttaa

SEQ ID NO: 4434 - DNA, 20 bp, Artificial Sequence
  chemically synthesized
aaatgagcaactaacttaat

SEQ ID NO: 4435 - DNA, 20 bp, Artificial Sequence
  chemically synthesized
aaactacacattcaatgcta

SEQ ID NO: 4436 - DNA, 20 bp, Artificial Sequence
  chemically synthesized
tggtgactacctgtttttaa

SEQ ID NO: 4437 - DNA, 20 bp, Artificial Sequence
  chemically synthesized
ttttacttttttatgatttt

SEQ ID NO: 4438 - DNA, 20 bp, Artificial Sequence
  chemically synthesized
ttacttttttatgattttaa

SEQ ID NO: 4439 - DNA, 20 bp, Artificial Sequence
  chemically synthesized
tatgattttaagagatttac

SEQ ID NO: 4440 - DNA, 20 bp, Artificial Sequence
  chemically synthesized
tcaaaaataaacttttttgt

SEQ ID NO: 4441 - DNA, 20 bp, Artificial Sequence
  chemically synthesized
caaaaataaacttttttgtt

SEQ ID NO: 4442 - DNA, 20 bp, Artificial Sequence
  chemically synthesized
gttgggtaaatttattatta

SEQ ID NO: 4443 - DNA, 20 bp, Artificial Sequence
  chemically synthesized
gtaaatttattattaaagtt

SEQ ID NO: 4444 - DNA, 20 bp, Artificial Sequence
  chemically synthesized
taaatttattattaaagttg

SEQ ID NO: 4445 - DNA, 20 bp, Artificial Sequence
  chemically synthesized
aaatttattattaaagttga

SEQ ID NO: 4446 - DNA, 20 bp, Artificial Sequence
  chemically synthesized
aatttattattaaagttgag

SEQ ID NO: 4447 - DNA, 20 bp, Artificial Sequence
  chemically synthesized
tattaaagttgaggggaaaa

SEQ ID NO: 4448 - DNA, 20 bp, Artificial Sequence
  chemically synthesized
ggggaaaaaagtaatgaatt

SEQ ID NO: 4449 - DNA, 20 bp, Artificial Sequence
  chemically synthesized
aacaggtagtcaccatagca

SEQ ID NO: 4450 - DNA, 20 bp, Artificial Sequence
  chemically synthesized
tgggcaaatattggtatata

SEQ ID NO: 4451 - DNA, 20 bp, Artificial Sequence
  chemically synthesized
gttcctctagttatttcctc

SEQ ID NO: 4452 - DNA, 20 bp, Artificial Sequence
  chemically synthesized
aagtcaaaaatgaagaggta

SEQ ID NO: 4453 - DNA, 20 bp, Artificial Sequence
  chemically synthesized
taaagtaagtagaaaataaa

SEQ ID NO: 4454 - DNA, 20 bp, Artificial Sequence
  chemically synthesized
ttcatgtttatgttttcaat

SEQ ID NO: 4455 - DNA, 20 bp, Artificial Sequence
  chemically synthesized
gaaagaagcatacaagggga

SEQ ID NO: 4456 - DNA, 20 bp, Artificial Sequence
  chemically synthesized
cacacaggtctgtaaaaaca

SEQ ID NO: 4457 - DNA, 20 bp, Artificial Sequence
  chemically synthesized
aaattatttacaagctttaa

SEQ ID NO: 4458 - DNA, 20 bp, Artificial Sequence
  chemically synthesized
ttacaagctttaactggatc

SEQ ID NO: 4459 - DNA, 20 bp, Artificial Sequence
  chemically synthesized
ctctaaaactttgtgtgacc

SEQ ID NO: 4460 - DNA, 20 bp, Artificial Sequence
  chemically synthesized
aaagataataacagaactta

SEQ ID NO: 4461 - DNA, 20 bp, Artificial Sequence
  chemically synthesized
tcttggtctaaagagccaat

SEQ ID NO: 4462 - DNA, 20 bp, Artificial Sequence
  chemically synthesized
aaagagaaacatgatctaat

SEQ ID NO: 4463 - DNA, 20 bp, Artificial Sequence
  chemically synthesized
gtaagatgacattggctgct

SEQ ID NO: 4464 - DNA, 20 bp, Artificial Sequence
  chemically synthesized
gtgaggaaactgagagataa

SEQ ID NO: 4465 - DNA, 20 bp, Artificial Sequence
  chemically synthesized
ttaaagcttgtaaataattt

SEQ ID NO: 4466 - DNA, 20 bp, Artificial Sequence
  chemically synthesized
tcttgtttttctacaaaagt

SEQ ID NO: 4467 - DNA, 20 bp, Artificial Sequence
  chemically synthesized
tctacaaaagtctggatata

SEQ ID NO: 4468 - DNA, 20 bp, Artificial Sequence
  chemically synthesized
tctaaatttttaaactaata

SEQ ID NO: 4469 - DNA, 20 bp, Artificial Sequence
  chemically synthesized
actaataatggatttgaaaa

SEQ ID NO: 4470 - DNA, 20 bp, Artificial Sequence
  chemically synthesized
aaagcccagcatattttcat

SEQ ID NO: 4471 - DNA, 20 bp, Artificial Sequence
  chemically synthesized
ttaatctgttttaaacactg

SEQ ID NO: 4472 - DNA, 20 bp, Artificial Sequence
  chemically synthesized
tactttaagtgaagttactt

SEQ ID NO: 4473 - DNA, 20 bp, Artificial Sequence
  chemically synthesized
gaagttacttctgggtgttc

SEQ ID NO: 4474 - DNA, 20 bp, Artificial Sequence
  chemically synthesized
tctggagtttcaggttgatt

SEQ ID NO: 4475 - DNA, 20 bp, Artificial Sequence
  chemically synthesized
tatttcactttttgttgaag

SEQ ID NO: 4476 - DNA, 20 bp, Artificial Sequence
  chemically synthesized
ttctaggaggctttcaagtt

SEQ ID NO: 4477 - DNA, 20 bp, Artificial Sequence
  chemically synthesized
ggaggctttcaagttttgag

SEQ ID NO: 4478 - DNA, 20 bp, Artificial Sequence
  chemically synthesized
aaaaagactgatcaaatatg

SEQ ID NO: 4479 - DNA, 20 bp, Artificial Sequence
  chemically synthesized
tgattttggctctggagata

SEQ ID NO: 4480 - DNA, 20 bp, Artificial Sequence
  chemically synthesized
tggagatagagaatcaaatg

SEQ ID NO: 4481 - DNA, 20 bp, Artificial Sequence
  chemically synthesized
attaagccgtgttaacttgc

SEQ ID NO: 4482 - DNA, 20 bp, Artificial Sequence
  chemically synthesized
gaatgtaaccttcttccaca

SEQ ID NO: 4483 - DNA, 20 bp, Artificial Sequence
  chemically synthesized
gtcaaaaataaacttttttg

SEQ ID NO: 4484 - DNA, 20 bp, Artificial Sequence
  chemically synthesized
aagttgaggggaaaaaagta

SEQ ID NO: 4485 - DNA, 20 bp, Artificial Sequence
  chemically synthesized
gaagtctaggtctgcttcca

SEQ ID NO: 4486 - DNA, 20 bp, Artificial Sequence
  chemically synthesized
tgttcctctagttatttcct

SEQ ID NO: 4487 - DNA, 20 bp, Artificial Sequence
  chemically synthesized
aaaccagtgaaatcaaagaa

SEQ ID NO: 4488 - DNA, 20 bp, Artificial Sequence
  chemically synthesized
caagtcaaaaatgaagaggt

SEQ ID NO: 4489 - DNA, 20 bp, Artificial Sequence
  chemically synthesized
caaaacttgaaagcctccta

SEQ ID NO: 4490 - DNA, 20 bp, Artificial Sequence
  chemically synthesized
agtaacttcacttaaagtaa

SEQ ID NO: 4491 - DNA, 20 bp, Artificial Sequence
  chemically synthesized
tgttgaaatacttttttttc

SEQ ID NO: 4492 - DNA, 20 bp, Artificial Sequence
  chemically synthesized
ttttccaagaaaaataatct

SEQ ID NO: 4493 - DNA, 20 bp, Artificial Sequence
  chemically synthesized
ctttttcttttaattgaagt

SEQ ID NO: 4494 - DNA, 20 bp, Artificial Sequence
  chemically synthesized
gatagtgttacaggaaatta

SEQ ID NO: 4495 - DNA, 20 bp, Artificial Sequence
  chemically synthesized
tgttacaggaaattaataga

SEQ ID NO: 4496 - DNA, 20 bp, Artificial Sequence
  chemically synthesized
ctctctatatccagactttt

SEQ ID NO: 4497 - DNA, 20 bp, Artificial Sequence
  chemically synthesized
accaacagcatagtcaaata

SEQ ID NO: 4498 - DNA, 20 bp, Artificial Sequence
  chemically synthesized
agcatagtcaaataaaagaa

SEQ ID NO: 4499 - DNA, 20 bp, Artificial Sequence
  chemically synthesized
cagaacttataggattattg

SEQ ID NO: 4500 - DNA, 20 bp, Artificial Sequence
  chemically synthesized
tattgtgtggttttgagcaa

SEQ ID NO: 4501 - DNA, 20 bp, Artificial Sequence
  chemically synthesized
gattttctgaacttcaatta

SEQ ID NO: 4502 - DNA, 20 bp, Artificial Sequence
  chemically synthesized
tttaatctgttttaaacact

SEQ ID NO: 4503 - DNA, 20 bp, Artificial Sequence
  chemically synthesized
agtatttcaaatggcatgcc

SEQ ID NO: 4504 - DNA, 20 bp, Artificial Sequence
  chemically synthesized
atatttcactttttgttgaa

SEQ ID NO: 4505 - DNA, 20 bp, Artificial Sequence
  chemically synthesized
ttgattttggctctggagat

SEQ ID NO: 4506 - DNA, 20 bp, Artificial Sequence
  chemically synthesized
ctatatataccaatatttgc

SEQ ID NO: 4507 - DNA, 20 bp, Artificial Sequence
  chemically synthesized
gatcaatgctaaatgaaatc

SEQ ID NO: 4508 - DNA, 20 bp, Artificial Sequence
  chemically synthesized
aaaaagtaaaattagctttt

SEQ ID NO: 4509 - DNA, 20 bp, Artificial Sequence
  chemically synthesized
gtctaggtctgcttccagaa

SEQ ID NO: 4510 - DNA, 20 bp, Artificial Sequence
  chemically synthesized
ccaaattaatgacatatttc

SEQ ID NO: 4511 - DNA, 20 bp, Artificial Sequence
  chemically synthesized
tatgtcacttgaactcaact

SEQ ID NO: 4512 - DNA, 20 bp, Artificial Sequence
  chemically synthesized
gtttccctaatgttatatat

SEQ ID NO: 4513 - DNA, 20 bp, Artificial Sequence
  chemically synthesized
gtaaaaagttaaaaaaaatt

SEQ ID NO: 4514 - DNA, 20 bp, Artificial Sequence
  chemically synthesized
taaaactattctccagtgtt

SEQ ID NO: 4515 - DNA, 20 bp, Artificial Sequence
  chemically synthesized
ctatatccagacttttgtag

SEQ ID NO: 4516 - DNA, 20 bp, Artificial Sequence
  chemically synthesized
catctttcacacaggtctgt

SEQ ID NO: 4517 - DNA, 20 bp, Artificial Sequence
  chemically synthesized
ctgcatttaaaccatggctc

SEQ ID NO: 4518 - DNA, 20 bp, Artificial Sequence
  chemically synthesized
agatcatgtttctctttgct

SEQ ID NO: 4519 - DNA, 20 bp, Artificial Sequence
  chemically synthesized
tatataacattagggaaaca

SEQ ID NO: 4520 - DNA, 20 bp, Artificial Sequence
  chemically synthesized
ttttttaaaagatccacatt

SEQ ID NO: 4521 - DNA, 20 bp, Artificial Sequence
  chemically synthesized
ataataaatttacccaacaa

SEQ ID NO: 4522 - DNA, 20 bp, Artificial Sequence
  chemically synthesized
taaaatcataaaaaagtaaa

SEQ ID NO: 4523 - DNA, 20 bp, Artificial Sequence
  chemically synthesized
agtcaccatagcattgaatg

SEQ ID NO: 4524 - DNA, 20 bp, Artificial Sequence
  chemically synthesized
attaagttagttgctcattt

SEQ ID NO: 4525 - DNA, 20 bp, Artificial Sequence
  chemically synthesized
gttacattcgtgcaagttaa

SEQ ID NO: 4526 - DNA, 20 bp, Artificial Sequence
  chemically synthesized
tcgtgcaagttaacacggct

SEQ ID NO: 4527 - DNA, 20 bp, Artificial Sequence
  chemically synthesized
tatagagttaagaagtctag

SEQ ID NO: 4528 - DNA, 20 bp, Artificial Sequence
  chemically synthesized
tccagaagaaaacagttcca

SEQ ID NO: 4529 - DNA, 20 bp, Artificial Sequence
  chemically synthesized
attgatcaagacaattcatc

SEQ ID NO: 4530 - DNA, 20 bp, Artificial Sequence
  chemically synthesized
ctctatctccagagccaaaa

SEQ ID NO: 4531 - DNA, 20 bp, Artificial Sequence
  chemically synthesized
aagtagaaaataaagagggt

SEQ ID NO: 4532 - DNA, 20 bp, Artificial Sequence
  chemically synthesized
aaaataaagagggttcatgt

SEQ ID NO: 4533 - DNA, 20 bp, Artificial Sequence
  chemically synthesized
atttcctattataatttcaa

SEQ ID NO: 4534 - DNA, 20 bp, Artificial Sequence
  chemically synthesized
attataatttcaagttagtt

SEQ ID NO: 4535 - DNA, 20 bp, Artificial Sequence
  chemically synthesized
aaaaatttaaaactattctc

SEQ ID NO: 4536 - DNA, 20 bp, Artificial Sequence
  chemically synthesized
aactattctccagtgtttaa

SEQ ID NO: 4537 - DNA, 20 bp, Artificial Sequence
  chemically synthesized
ttaaataatacagtaaatgg

SEQ ID NO: 4538 - DNA, 20 bp, Artificial Sequence
  chemically synthesized
tttattcatatgaaaatatg

SEQ ID NO: 4539 - DNA, 20 bp, Artificial Sequence
  chemically synthesized
attcatttttcaaatccatt

SEQ ID NO: 4540 - DNA, 20 bp, Artificial Sequence
  chemically synthesized
atccattattagtttaaaaa

SEQ ID NO: 4541 - DNA, 20 bp, Artificial Sequence
  chemically synthesized
actgaatcctaaaattattt

SEQ ID NO: 4542 - DNA, 20 bp, Artificial Sequence
  chemically synthesized
attacttcacccctttatct

SEQ ID NO: 4543 - DNA, 20 bp, Artificial Sequence
  chemically synthesized
caaagataataacagaactt

SEQ ID NO: 4544 - DNA, 20 bp, Artificial Sequence
  chemically synthesized
ttactaaaattcaaattaga

SEQ ID NO: 4545 - DNA, 20 bp, Artificial Sequence
  chemically synthesized
ctctttgctcaaaaccacac

SEQ ID NO: 4546 - DNA, 20 bp, Artificial Sequence
  chemically synthesized
actcatattggctctttaga

SEQ ID NO: 4547 - DNA, 20 bp, Artificial Sequence
  chemically synthesized
agtgaaatggaaagctattg

SEQ ID NO: 4548 - DNA, 20 bp, Artificial Sequence
  chemically synthesized
gtaatttattcaaggtcaca

SEQ ID NO: 4549 - DNA, 20 bp, Artificial Sequence
  chemically synthesized
gtcacacaaagttttagagc

SEQ ID NO: 4550 - DNA, 20 bp, Artificial Sequence
  chemically synthesized
agagccatggtttaaatgca

SEQ ID NO: 4551 - DNA, 20 bp, Artificial Sequence
  chemically synthesized
ggtttaaatgcaggtagttt

SEQ ID NO: 4552 - DNA, 20 bp, Artificial Sequence
  chemically synthesized
aattttactcatgatccagt

SEQ ID NO: 4553 - DNA, 20 bp, Artificial Sequence
  chemically synthesized
gttaaagcttgtaaataatt

SEQ ID NO: 4554 - DNA, 20 bp, Artificial Sequence
  chemically synthesized
ttgtaaataattttaggatt

SEQ ID NO: 4555 - DNA, 20 bp, Artificial Sequence
  chemically synthesized
taccattaaaatactgactt

SEQ ID NO: 4556 - DNA, 20 bp, Artificial Sequence
  chemically synthesized
ttcttttatttgactatgct

SEQ ID NO: 4557 - DNA, 20 bp, Artificial Sequence
  chemically synthesized
tttgactatgctgttggttt

SEQ ID NO: 4558 - DNA, 20 bp, Artificial Sequence
  chemically synthesized
gaaggtctttgatgctatta

SEQ ID NO: 4559 - DNA, 20 bp, Artificial Sequence
  chemically synthesized
tagagagtaggttggttata

SEQ ID NO: 4560 - DNA, 20 bp, Artificial Sequence
  chemically synthesized
atctaaatttttaaactaat

SEQ ID NO: 4561 - DNA, 20 bp, Artificial Sequence
  chemically synthesized
attggcaattccttcccctt

SEQ ID NO: 4562 - DNA, 20 bp, Artificial Sequence
  chemically synthesized
taaattgtactatctctaaa

SEQ ID NO: 4563 - DNA, 20 bp, Artificial Sequence
  chemically synthesized
tccatttactgtattattta

SEQ ID NO: 4564 - DNA, 20 bp, Artificial Sequence
  chemically synthesized
atctgttttaaacactggag

SEQ ID NO: 4565 - DNA, 20 bp, Artificial Sequence
  chemically synthesized
atagtgtaatgacatagtgt

SEQ ID NO: 4566 - DNA, 20 bp, Artificial Sequence
  chemically synthesized
tgttctagattgtataattt

SEQ ID NO: 4567 - DNA, 20 bp, Artificial Sequence
  chemically synthesized
tcatataaaatgcaaatttt

SEQ ID NO: 4568 - DNA, 20 bp, Artificial Sequence
  chemically synthesized
taataggaaattttattttc

SEQ ID NO: 4569 - DNA, 20 bp, Artificial Sequence
  chemically synthesized
gaagttacttctgggtgttc

SEQ ID NO: 4570 - DNA, 20 bp, Artificial Sequence
  chemically synthesized
ctgggtgttctggagtttca

SEQ ID NO: 4571 - DNA, 20 bp, Artificial Sequence
  chemically synthesized
aagtagaattttttcttcta

SEQ ID NO: 4572 - DNA, 20 bp, Artificial Sequence
  chemically synthesized
ttttttcttctaggaggctt

SEQ ID NO: 4573 - DNA, 20 bp, Artificial Sequence
  chemically synthesized
ttacctcttcatttttgact

SEQ ID NO: 4574 - DNA, 20 bp, Artificial Sequence
  chemically synthesized
tctcagttccttttcttctt

SEQ ID NO: 4575 - DNA, 20 bp, Artificial Sequence
  chemically synthesized
ttttcttcttctttgatttc

SEQ ID NO: 4576 - DNA, 20 bp, Artificial Sequence
  chemically synthesized
aaaaagactgatcaaatatg

SEQ ID NO: 4577 - DNA, 20 bp, Artificial Sequence
  chemically synthesized
acatcgtctaacatagcaaa

SEQ ID NO: 4578 - DNA, 20 bp, Artificial Sequence
  chemically synthesized
ctagaggaacaataaaaaga

SEQ ID NO: 4579 - DNA, 20 bp, Artificial Sequence
  chemically synthesized
cttaattgtgaacattttta

SEQ ID NO: 4580 - DNA, 20 bp, Artificial Sequence
  chemically synthesized
ttcaatttcaagcaacgtgg

SEQ ID NO: 4581 - DNA, 20 bp, Artificial Sequence
  chemically synthesized
cattcaatgctatggtgact

SEQ ID NO: 4582 - DNA, 20 bp, Artificial Sequence
  chemically synthesized
taaaagctaattttactttt

SEQ ID NO: 4583 - DNA, 20 bp, Artificial Sequence
  chemically synthesized
ttttacttttttatgatttt

SEQ ID NO: 4584 - DNA, 22 bp, Artificial Sequence
  chemically synthesized
aattcattacttttttcccctc

SEQ ID NO: 4585 - DNA, 22 bp, Artificial Sequence
  chemically synthesized
attcattacttttttcccctca

SEQ ID NO: 4586 - DNA, 22 bp, Artificial Sequence
  chemically synthesized
attacttttttcccctcaactt

SEQ ID NO: 4587 - DNA, 22 bp, Artificial Sequence
  chemically synthesized
cttttttcccctcaactttaat

SEQ ID NO: 4588 - DNA, 22 bp, Artificial Sequence
  chemically synthesized
ttttcccctcaactttaataat

SEQ ID NO: 4589 - DNA, 22 bp, Artificial Sequence
  chemically synthesized
tttcccctcaactttaataata

SEQ ID NO: 4590 - DNA, 22 bp, Artificial Sequence
  chemically synthesized
ttcccctcaactttaataataa

SEQ ID NO: 4591 - DNA, 22 bp, Artificial Sequence
  chemically synthesized
tcccctcaactttaataataaa

SEQ ID NO: 4592 - DNA, 22 bp, Artificial Sequence
  chemically synthesized
cccctcaactttaataataaat

SEQ ID NO: 4593 - DNA, 22 bp, Artificial Sequence
  chemically synthesized
ccctcaactttaataataaatt

SEQ ID NO: 4594 - DNA, 22 bp, Artificial Sequence
  chemically synthesized
aactttaataataaatttaccc

SEQ ID NO: 4595 - DNA, 22 bp, Artificial Sequence
  chemically synthesized
taataataaatttacccaacaa

SEQ ID NO: 4596 - DNA, 22 bp, Artificial Sequence
  chemically synthesized
aataataaatttacccaacaaa

SEQ ID NO: 4597 - DNA, 22 bp, Artificial Sequence
  chemically synthesized
ataataaatttacccaacaaaa

SEQ ID NO: 4598 - DNA, 22 bp, Artificial Sequence
  chemically synthesized
acccaacaaaaaagtttatttt

SEQ ID NO: 4599 - DNA, 22 bp, Artificial Sequence
  chemically synthesized
cccaacaaaaaagtttattttt

SEQ ID NO: 4600 - DNA, 22 bp, Artificial Sequence
  chemically synthesized
atttttgacttgtaaatctctt

SEQ ID NO: 4601 - DNA, 22 bp, Artificial Sequence
  chemically synthesized
tttttgacttgtaaatctctta

SEQ ID NO: 4602 - DNA, 22 bp, Artificial Sequence
  chemically synthesized
ttgacttgtaaatctcttaaaa

SEQ ID NO: 4603 - DNA, 22 bp, Artificial Sequence
  chemically synthesized
tgacttgtaaatctcttaaaat

SEQ ID NO: 4604 - DNA, 22 bp, Artificial Sequence
  chemically synthesized
gacttgtaaatctcttaaaatc

SEQ ID NO: 4605 - DNA, 22 bp, Artificial Sequence
  chemically synthesized
acttgtaaatctcttaaaatca

SEQ ID NO: 4606 - DNA, 22 bp, Artificial Sequence
  chemically synthesized
gtaaatctcttaaaatcataaa

SEQ ID NO: 4607 - DNA, 22 bp, Artificial Sequence
  chemically synthesized
taaatctcttaaaatcataaaa

SEQ ID NO: 4608 - DNA, 22 bp, Artificial Sequence
  chemically synthesized
ttaaaatcataaaaaagtaaaa

SEQ ID NO: 4609 - DNA, 22 bp, Artificial Sequence
  chemically synthesized
aaaatcataaaaaagtaaaatt

SEQ ID NO: 4610 - DNA, 22 bp, Artificial Sequence
  chemically synthesized
aaatcataaaaaagtaaaatta

SEQ ID NO: 4611 - DNA, 22 bp, Artificial Sequence
  chemically synthesized
gcttttaaaaacaggtagtcac

SEQ ID NO: 4612 - DNA, 22 bp, Artificial Sequence
  chemically synthesized
ttaaaaacaggtagtcaccata

SEQ ID NO: 4613 - DNA, 22 bp, Artificial Sequence
  chemically synthesized
taaaaacaggtagtcaccatag

SEQ ID NO: 4614 - DNA, 22 bp, Artificial Sequence
  chemically synthesized
aaaaacaggtagtcaccatagc

SEQ ID NO: 4615 - DNA, 22 bp, Artificial Sequence
  chemically synthesized
aaaacaggtagtcaccatagca

SEQ ID NO: 4616 - DNA, 22 bp, Artificial Sequence
  chemically synthesized
aatgtgtagtttataatacagc

SEQ ID NO: 4617 - DNA, 22 bp, Artificial Sequence
  chemically synthesized
ataatacagcaaagttaaatac

SEQ ID NO: 4618 - DNA, 22 bp, Artificial Sequence
  chemically synthesized
taatacagcaaagttaaataca

SEQ ID NO: 4619 - DNA, 22 bp, Artificial Sequence
  chemically synthesized
aatacaatttcaaattacctat

SEQ ID NO: 4620 - DNA, 22 bp, Artificial Sequence
  chemically synthesized
caaattacctattaagttagtt

SEQ ID NO: 4621 - DNA, 22 bp, Artificial Sequence
  chemically synthesized
aaattacctattaagttagttg

SEQ ID NO: 4622 - DNA, 22 bp, Artificial Sequence
  chemically synthesized
cctattaagttagttgctcatt

SEQ ID NO: 4623 - DNA, 22 bp, Artificial Sequence
  chemically synthesized
ttaagttagttgctcatttctt

SEQ ID NO: 4624 - DNA, 22 bp, Artificial Sequence
  chemically synthesized
agttagttgctcatttctttga

SEQ ID NO: 4625 - DNA, 22 bp, Artificial Sequence
  chemically synthesized
gttgctcatttctttgatttca

SEQ ID NO: 4626 - DNA, 22 bp, Artificial Sequence
  chemically synthesized
ctcatttctttgatttcattta

SEQ ID NO: 4627 - DNA, 22 bp, Artificial Sequence
  chemically synthesized
atttctttgatttcatttagca

SEQ ID NO: 4628 - DNA, 22 bp, Artificial Sequence
  chemically synthesized
ctttgatttcatttagcattga

SEQ ID NO: 4629 - DNA, 22 bp, Artificial Sequence
  chemically synthesized
tttgatttcatttagcattgat

SEQ ID NO: 4630 - DNA, 22 bp, Artificial Sequence
  chemically synthesized
tgatttcatttagcattgatct

SEQ ID NO: 4631 - DNA, 22 bp, Artificial Sequence
  chemically synthesized
gatttcatttagcattgatcta

SEQ ID NO: 4632 - DNA, 22 bp, Artificial Sequence
  chemically synthesized
atttcatttagcattgatctaa

SEQ ID NO: 4633 - DNA, 22 bp, Artificial Sequence
  chemically synthesized
catttagcattgatctaactca

SEQ ID NO: 4634 - DNA, 22 bp, Artificial Sequence
  chemically synthesized
atttagcattgatctaactcaa

SEQ ID NO: 4635 - DNA, 22 bp, Artificial Sequence
  chemically synthesized
agcattgatctaactcaatgtg

SEQ ID NO: 4636 - DNA, 22 bp, Artificial Sequence
  chemically synthesized
gcattgatctaactcaatgtgg

SEQ ID NO: 4637 - DNA, 22 bp, Artificial Sequence
  chemically synthesized
atctaactcaatgtggaagaag

SEQ ID NO: 4638 - DNA, 22 bp, Artificial Sequence
  chemically synthesized
actcaatgtggaagaaggttac

SEQ ID NO: 4639 - DNA, 22 bp, Artificial Sequence
  chemically synthesized
aatgtggaagaaggttacattc

SEQ ID NO: 4640 - DNA, 22 bp, Artificial Sequence
  chemically synthesized
cattcgtgcaagttaacacggc

SEQ ID NO: 4641 - DNA, 22 bp, Artificial Sequence
  chemically synthesized
gtgcaagttaacacggcttaat

SEQ ID NO: 4642 - DNA, 22 bp, Artificial Sequence
  chemically synthesized
acacggcttaatgattaactat

SEQ ID NO: 4643 - DNA, 22 bp, Artificial Sequence
  chemically synthesized
aatgattaactatgttcaccta

SEQ ID NO: 4644 - DNA, 22 bp, Artificial Sequence
  chemically synthesized
atgattaactatgttcacctac

SEQ ID NO: 4645 - DNA, 22 bp, Artificial Sequence
  chemically synthesized
actatgttcacctaccaacctt

SEQ ID NO: 4646 - DNA, 22 bp, Artificial Sequence
  chemically synthesized
tgttcacctaccaaccttacct

SEQ ID NO: 4647 - DNA, 22 bp, Artificial Sequence
  chemically synthesized
acctaccaaccttaccttttct

SEQ ID NO: 4648 - DNA, 22 bp, Artificial Sequence
  chemically synthesized
ccaaccttaccttttctgggca

SEQ ID NO: 4649 - DNA, 22 bp, Artificial Sequence
  chemically synthesized
accttttctgggcaaatattgg

SEQ ID NO: 4650 - DNA, 22 bp, Artificial Sequence
  chemically synthesized
ccttttctgggcaaatattggt

SEQ ID NO: 4651 - DNA, 22 bp, Artificial Sequence
  chemically synthesized
ttctgggcaaatattggtatat

SEQ ID NO: 4652 - DNA, 22 bp, Artificial Sequence
  chemically synthesized
tctgggcaaatattggtatata

SEQ ID NO: 4653 - DNA, 22 bp, Artificial Sequence
  chemically synthesized
ctgggcaaatattggtatatat

SEQ ID NO: 4654 - DNA, 22 bp, Artificial Sequence
  chemically synthesized
tgggcaaatattggtatatata

SEQ ID NO: 4655 - DNA, 22 bp, Artificial Sequence
  chemically synthesized
ggcaaatattggtatatataga

SEQ ID NO: 4656 - DNA, 22 bp, Artificial Sequence
  chemically synthesized
gtatatatagagttaagaagtc

SEQ ID NO: 4657 - DNA, 22 bp, Artificial Sequence
  chemically synthesized
agaagtctaggtctgcttccag

SEQ ID NO: 4658 - DNA, 22 bp, Artificial Sequence
  chemically synthesized
ggtctgcttccagaagaaaaca

SEQ ID NO: 4659 - DNA, 22 bp, Artificial Sequence
  chemically synthesized
cttccagaagaaaacagttcca

SEQ ID NO: 4660 - DNA, 22 bp, Artificial Sequence
  chemically synthesized
ccagaagaaaacagttccacgt

SEQ ID NO: 4661 - DNA, 22 bp, Artificial Sequence
  chemically synthesized
cagaagaaaacagttccacgtt

SEQ ID NO: 4662 - DNA, 22 bp, Artificial Sequence
  chemically synthesized
cacgttgcttgaaattgaaaat

SEQ ID NO: 4663 - DNA, 22 bp, Artificial Sequence
  chemically synthesized
cttgaaattgaaaatcaagata

SEQ ID NO: 4664 - DNA, 22 bp, Artificial Sequence
  chemically synthesized
gaaattgaaaatcaagataaaa

SEQ ID NO: 4665 - DNA, 22 bp, Artificial Sequence
  chemically synthesized
aaattgaaaatcaagataaaaa

SEQ ID NO: 4666 - DNA, 22 bp, Artificial Sequence
  chemically synthesized
aaaatcaagataaaaatgttca

SEQ ID NO: 4667 - DNA, 22 bp, Artificial Sequence
  chemically synthesized
acaattaagctccttcttttta

SEQ ID NO: 4668 - DNA, 22 bp, Artificial Sequence
  chemically synthesized
agctccttctttttattgttcc

SEQ ID NO: 4669 - DNA, 22 bp, Artificial Sequence
  chemically synthesized
cttctttttattgttcctctag

SEQ ID NO: 4670 - DNA, 22 bp, Artificial Sequence
  chemically synthesized
ctttttattgttcctctagtta

SEQ ID NO: 4671 - DNA, 22 bp, Artificial Sequence
  chemically synthesized
tttttattgttcctctagttat

SEQ ID NO: 4672 - DNA, 22 bp, Artificial Sequence
  chemically synthesized
tttattgttcctctagttattt

SEQ ID NO: 4673 - DNA, 22 bp, Artificial Sequence
  chemically synthesized
ttattgttcctctagttatttc

SEQ ID NO: 4674 - DNA, 22 bp, Artificial Sequence
  chemically synthesized
tattgttcctctagttatttcc

SEQ ID NO: 4675 - DNA, 22 bp, Artificial Sequence
  chemically synthesized
attgttcctctagttatttcct

SEQ ID NO: 4676 - DNA, 22 bp, Artificial Sequence
  chemically synthesized
ttgttcctctagttatttcctc

SEQ ID NO: 4677 - DNA, 22 bp, Artificial Sequence
  chemically synthesized
ttcctctagttatttcctccag

SEQ ID NO: 4678 - DNA, 22 bp, Artificial Sequence
  chemically synthesized
ctctagttatttcctccagaat

SEQ ID NO: 4679 - DNA, 22 bp, Artificial Sequence
  chemically synthesized
tagttatttcctccagaattga

SEQ ID NO: 4680 - DNA, 22 bp, Artificial Sequence
  chemically synthesized
gttatttcctccagaattgatc

SEQ ID NO: 4681 - DNA, 22 bp, Artificial Sequence
  chemically synthesized
tttcctccagaattgatcaaga

SEQ ID NO: 4682 - DNA, 22 bp, Artificial Sequence
  chemically synthesized
cctccagaattgatcaagacaa

SEQ ID NO: 4683 - DNA, 22 bp, Artificial Sequence
  chemically synthesized
ctccagaattgatcaagacaat

SEQ ID NO: 4684 - DNA, 22 bp, Artificial Sequence
  chemically synthesized
cagaattgatcaagacaattca

SEQ ID NO: 4685 - DNA, 22 bp, Artificial Sequence
  chemically synthesized
atcaagacaattcatcatttga

SEQ ID NO: 4686 - DNA, 22 bp, Artificial Sequence
  chemically synthesized
atcatttgattctctatctcca

SEQ ID NO: 4687 - DNA, 22 bp, Artificial Sequence
  chemically synthesized
gattctctatctccagagccaa

SEQ ID NO: 4688 - DNA, 22 bp, Artificial Sequence
  chemically synthesized
attctctatctccagagccaaa

SEQ ID NO: 4689 - DNA, 22 bp, Artificial Sequence
  chemically synthesized
tctatctccagagccaaaatca

SEQ ID NO: 4690 - DNA, 22 bp, Artificial Sequence
  chemically synthesized
tatctccagagccaaaatcaag

SEQ ID NO: 4691 - DNA, 22 bp, Artificial Sequence
  chemically synthesized
tctccagagccaaaatcaagat

SEQ ID NO: 4692 - DNA, 22 bp, Artificial Sequence
  chemically synthesized
cagagccaaaatcaagatttgc

SEQ ID NO: 4693 - DNA, 22 bp, Artificial Sequence
  chemically synthesized
gctatgttagacgatgtaaaaa

SEQ ID NO: 4694 - DNA, 22 bp, Artificial Sequence
  chemically synthesized
ctatgttagacgatgtaaaaat

SEQ ID NO: 4695 - DNA, 22 bp, Artificial Sequence
  chemically synthesized
tgttagacgatgtaaaaatttt

SEQ ID NO: 4696 - DNA, 22 bp, Artificial Sequence
  chemically synthesized
gacgatgtaaaaattttagcca

SEQ ID NO: 4697 - DNA, 22 bp, Artificial Sequence
  chemically synthesized
tagccaatggcctccttcagtt

SEQ ID NO: 4698 - DNA, 22 bp, Artificial Sequence
  chemically synthesized
agccaatggcctccttcagttg

SEQ ID NO: 4699 - DNA, 22 bp, Artificial Sequence
  chemically synthesized
gccaatggcctccttcagttgg

SEQ ID NO: 4700 - DNA, 22 bp, Artificial Sequence
  chemically synthesized
cttcagttgggacatggtctta

SEQ ID NO: 4701 - DNA, 22 bp, Artificial Sequence
  chemically synthesized
cagttgggacatggtcttaaag

SEQ ID NO: 4702 - DNA, 22 bp, Artificial Sequence
  chemically synthesized
agttgggacatggtcttaaaga

SEQ ID NO: 4703 - DNA, 22 bp, Artificial Sequence
  chemically synthesized
ggacatggtcttaaagactttg

SEQ ID NO: 4704 - DNA, 22 bp, Artificial Sequence
  chemically synthesized
aaagactttgtccataagacga

SEQ ID NO: 4705 - DNA, 22 bp, Artificial Sequence
  chemically synthesized
aagactttgtccataagacgaa

SEQ ID NO: 4706 - DNA, 22 bp, Artificial Sequence
  chemically synthesized
tgtccataagacgaagggccaa

SEQ ID NO: 4707 - DNA, 22 bp, Artificial Sequence
  chemically synthesized
gtccataagacgaagggccaaa

SEQ ID NO: 4708 - DNA, 22 bp, Artificial Sequence
  chemically synthesized
tccataagacgaagggccaaat

SEQ ID NO: 4709 - DNA, 22 bp, Artificial Sequence
  chemically synthesized
atgacatatttcaaaaactcaa

SEQ ID NO: 4710 - DNA, 22 bp, Artificial Sequence
  chemically synthesized
caaaaactcaacatatttgatc

SEQ ID NO: 4711 - DNA, 22 bp, Artificial Sequence
  chemically synthesized
aaaaactcaacatatttgatca

SEQ ID NO: 4712 - DNA, 22 bp, Artificial Sequence
  chemically synthesized
aacatatttgatcagtcttttt

SEQ ID NO: 4713 - DNA, 22 bp, Artificial Sequence
  chemically synthesized
gatcagtctttttatgatctat

SEQ ID NO: 4714 - DNA, 22 bp, Artificial Sequence
  chemically synthesized
atcagtctttttatgatctatc

SEQ ID NO: 4715 - DNA, 22 bp, Artificial Sequence
  chemically synthesized
tttatgatctatcgctgcaaac

SEQ ID NO: 4716 - DNA, 22 bp, Artificial Sequence
  chemically synthesized
ttatgatctatcgctgcaaacc

SEQ ID NO: 4717 - DNA, 22 bp, Artificial Sequence
  chemically synthesized
tatgatctatcgctgcaaacca

SEQ ID NO: 4718 - DNA, 22 bp, Artificial Sequence
  chemically synthesized
atgatctatcgctgcaaaccag

SEQ ID NO: 4719 - DNA, 22 bp, Artificial Sequence
  chemically synthesized
tgatctatcgctgcaaaccagt

SEQ ID NO: 4720 - DNA, 22 bp, Artificial Sequence
  chemically synthesized
tcgctgcaaaccagtgaaatca

SEQ ID NO: 4721 - DNA, 22 bp, Artificial Sequence
  chemically synthesized
caaaccagtgaaatcaaagaag

SEQ ID NO: 4722 - DNA, 22 bp, Artificial Sequence
  chemically synthesized
agaagaactacatataaactac

SEQ ID NO: 4723 - DNA, 22 bp, Artificial Sequence
  chemically synthesized
catataaactacaagtcaaaaa

SEQ ID NO: 4724 - DNA, 22 bp, Artificial Sequence
  chemically synthesized
caagtcaaaaatgaagaggtaa

SEQ ID NO: 4725 - DNA, 22 bp, Artificial Sequence
  chemically synthesized
gaactcaactcaaaacttgaaa

SEQ ID NO: 4726 - DNA, 22 bp, Artificial Sequence
  chemically synthesized
aactcaactcaaaacttgaaag

SEQ ID NO: 4727 - DNA, 22 bp, Artificial Sequence
  chemically synthesized
aactcaaaacttgaaagcctcc

SEQ ID NO: 4728 - DNA, 22 bp, Artificial Sequence
  chemically synthesized
aaaacttgaaagcctcctagaa

SEQ ID NO: 4729 - DNA, 22 bp, Artificial Sequence
  chemically synthesized
gaaagcctcctagaagaaaaaa

SEQ ID NO: 4730 - DNA, 22 bp, Artificial Sequence
  chemically synthesized
aaagcctcctagaagaaaaaat

SEQ ID NO: 4731 - DNA, 22 bp, Artificial Sequence
  chemically synthesized
ctagaagaaaaaattctacttc

SEQ ID NO: 4732 - DNA, 22 bp, Artificial Sequence
  chemically synthesized
gaagaaaaaattctacttcaac

SEQ ID NO: 4733 - DNA, 22 bp, Artificial Sequence
  chemically synthesized
tacttcaacaaaaagtgaaata

SEQ ID NO: 4734 - DNA, 22 bp, Artificial Sequence
  chemically synthesized
cttcaacaaaaagtgaaatatt

SEQ ID NO: 4735 - DNA, 22 bp, Artificial Sequence
  chemically synthesized
caacaaaaagtgaaatatttag

SEQ ID NO: 4736 - DNA, 22 bp, Artificial Sequence
  chemically synthesized
aacaaaaagtgaaatatttaga

SEQ ID NO: 4737 - DNA, 22 bp, Artificial Sequence
  chemically synthesized
agaagagcaactaactaactta

SEQ ID NO: 4738 - DNA, 22 bp, Artificial Sequence
  chemically synthesized
gaagagcaactaactaacttaa

SEQ ID NO: 4739 - DNA, 22 bp, Artificial Sequence
  chemically synthesized
actaacttaattcaaaatcaac

SEQ ID NO: 4740 - DNA, 22 bp, Artificial Sequence
  chemically synthesized
acttaattcaaaatcaacctga

SEQ ID NO: 4741 - DNA, 22 bp, Artificial Sequence
  chemically synthesized
aattcaaaatcaacctgaaact

SEQ ID NO: 4742 - DNA, 22 bp, Artificial Sequence
  chemically synthesized
attcaaaatcaacctgaaactc

SEQ ID NO: 4743 - DNA, 22 bp, Artificial Sequence
  chemically synthesized
aaaatcaacctgaaactccaga

SEQ ID NO: 4744 - DNA, 22 bp, Artificial Sequence
  chemically synthesized
aaactccagaacacccagaagt

SEQ ID NO: 4745 - DNA, 22 bp, Artificial Sequence
  chemically synthesized
cagaacacccagaagtaacttc

SEQ ID NO: 4746 - DNA, 22 bp, Artificial Sequence
  chemically synthesized
cacttaaagtaagtagaaaata

SEQ ID NO: 4747 - DNA, 22 bp, Artificial Sequence
  chemically synthesized
acttaaagtaagtagaaaataa

SEQ ID NO: 4748 - DNA, 22 bp, Artificial Sequence
  chemically synthesized
aaagtaagtagaaaataaagag

SEQ ID NO: 4749 - DNA, 22 bp, Artificial Sequence
  chemically synthesized
aagtaagtagaaaataaagagg

SEQ ID NO: 4750 - DNA, 22 bp, Artificial Sequence
  chemically synthesized
atgtttatgttttcaatgtgga

SEQ ID NO: 4751 - DNA, 22 bp, Artificial Sequence
  chemically synthesized
atgttttcaatgtggatctttt

SEQ ID NO: 4752 - DNA, 22 bp, Artificial Sequence
  chemically synthesized
tgttttcaatgtggatctttta

SEQ ID NO: 4753 - DNA, 22 bp, Artificial Sequence
  chemically synthesized
tcaatgtggatcttttaaaaaa

SEQ ID NO: 4754 - DNA, 22 bp, Artificial Sequence
  chemically synthesized
caatgtggatcttttaaaaaaa

SEQ ID NO: 4755 - DNA, 22 bp, Artificial Sequence
  chemically synthesized
aatgtggatcttttaaaaaaaa

SEQ ID NO: 4756 - DNA, 22 bp, Artificial Sequence
  chemically synthesized
ttaaaaaaaatatttctaaggc

SEQ ID NO: 4757 - DNA, 22 bp, Artificial Sequence
  chemically synthesized
taaaaaaaatatttctaaggca

SEQ ID NO: 4758 - DNA, 22 bp, Artificial Sequence
  chemically synthesized
aaaaaaaatatttctaaggcat

SEQ ID NO: 4759 - DNA, 22 bp, Artificial Sequence
  chemically synthesized
aaaaaaatatttctaaggcatg

SEQ ID NO: 4760 - DNA, 22 bp, Artificial Sequence
  chemically synthesized
ctaaggcatgccatttgaaata

SEQ ID NO: 4761 - DNA, 22 bp, Artificial Sequence
  chemically synthesized
taaggcatgccatttgaaatac

SEQ ID NO: 4762 - DNA, 22 bp, Artificial Sequence
  chemically synthesized
aggcatgccatttgaaatactt

SEQ ID NO: 4763 - DNA, 22 bp, Artificial Sequence
  chemically synthesized
gaaatactttgttgcattgttg

SEQ ID NO: 4764 - DNA, 22 bp, Artificial Sequence
  chemically synthesized
aaatactttgttgcattgttga

SEQ ID NO: 4765 - DNA, 22 bp, Artificial Sequence
  chemically synthesized
tgttgcattgttgaaatacttt

SEQ ID NO: 4766 - DNA, 22 bp, Artificial Sequence
  chemically synthesized
gttgcattgttgaaatactttt

SEQ ID NO: 4767 - DNA, 22 bp, Artificial Sequence
  chemically synthesized
ttgcattgttgaaatacttttt

SEQ ID NO: 4768 - DNA, 22 bp, Artificial Sequence
  chemically synthesized
cattgttgaaatactttttttt

SEQ ID NO: 4769 - DNA, 22 bp, Artificial Sequence
  chemically synthesized
ttgaaatacttttttttccaag

SEQ ID NO: 4770 - DNA, 22 bp, Artificial Sequence
  chemically synthesized
aaatacttttttttccaagaaa

SEQ ID NO: 4771 - DNA, 22 bp, Artificial Sequence
  chemically synthesized
ttttttccaagaaaaataatct

SEQ ID NO: 4772 - DNA, 22 bp, Artificial Sequence
  chemically synthesized
tttttccaagaaaaataatctc

SEQ ID NO: 4773 - DNA, 22 bp, Artificial Sequence
  chemically synthesized
ttttccaagaaaaataatctcc

SEQ ID NO: 4774 - DNA, 22 bp, Artificial Sequence
  chemically synthesized
tttccaagaaaaataatctcca

SEQ ID NO: 4775 - DNA, 22 bp, Artificial Sequence
  chemically synthesized
ttccaagaaaaataatctccag

SEQ ID NO: 4776 - DNA, 22 bp, Artificial Sequence
  chemically synthesized
tccaagaaaaataatctccaga

SEQ ID NO: 4777 - DNA, 22 bp, Artificial Sequence
  chemically synthesized
ccaagaaaaataatctccagaa

SEQ ID NO: 4778 - DNA, 22 bp, Artificial Sequence
  chemically synthesized
caagaaaaataatctccagaaa

SEQ ID NO: 4779 - DNA, 22 bp, Artificial Sequence
  chemically synthesized
cagaaaataaaatttcctatta

SEQ ID NO: 4780 - DNA, 22 bp, Artificial Sequence
  chemically synthesized
cctattataatttcaagttagt

SEQ ID NO: 4781 - DNA, 22 bp, Artificial Sequence
  chemically synthesized
ctattataatttcaagttagtt

SEQ ID NO: 4782 - DNA, 22 bp, Artificial Sequence
  chemically synthesized
ttataatttcaagttagttttt

SEQ ID NO: 4783 - DNA, 22 bp, Artificial Sequence
  chemically synthesized
taatttcaagttagttttttgt

SEQ ID NO: 4784 - DNA, 22 bp, Artificial Sequence
  chemically synthesized
caagttagttttttgtttccct

SEQ ID NO: 4785 - DNA, 22 bp, Artificial Sequence
  chemically synthesized
aagttagttttttgtttcccta

SEQ ID NO: 4786 - DNA, 22 bp, Artificial Sequence
  chemically synthesized
gttttttgtttccctaatgtta

SEQ ID NO: 4787 - DNA, 22 bp, Artificial Sequence
  chemically synthesized
tttgtttccctaatgttatata

SEQ ID NO: 4788 - DNA, 22 bp, Artificial Sequence
  chemically synthesized
ttgtttccctaatgttatatat

SEQ ID NO: 4789 - DNA, 22 bp, Artificial Sequence
  chemically synthesized
tgtttccctaatgttatatatg

SEQ ID NO: 4790 - DNA, 22 bp, Artificial Sequence
  chemically synthesized
gtttccctaatgttatatatga

SEQ ID NO: 4791 - DNA, 22 bp, Artificial Sequence
  chemically synthesized
tttccctaatgttatatatgaa

SEQ ID NO: 4792 - DNA, 22 bp, Artificial Sequence
  chemically synthesized
ccctaatgttatatatgaaaac

SEQ ID NO: 4793 - DNA, 22 bp, Artificial Sequence
  chemically synthesized
cctaatgttatatatgaaaaca

SEQ ID NO: 4794 - DNA, 22 bp, Artificial Sequence
  chemically synthesized
atgttatatatgaaaacactga

SEQ ID NO: 4795 - DNA, 22 bp, Artificial Sequence
  chemically synthesized
tatatgaaaacactgaaaattt

SEQ ID NO: 4796 - DNA, 22 bp, Artificial Sequence
  chemically synthesized
aaaatttgcattttatatgaaa

SEQ ID NO: 4797 - DNA, 22 bp, Artificial Sequence
  chemically synthesized
gcattttatatgaaaattacaa

SEQ ID NO: 4798 - DNA, 22 bp, Artificial Sequence
  chemically synthesized
cattttatatgaaaattacaaa

SEQ ID NO: 4799 - DNA, 22 bp, Artificial Sequence
  chemically synthesized
tatatgaaaattacaaatcggt

SEQ ID NO: 4800 - DNA, 22 bp, Artificial Sequence
  chemically synthesized
atatgaaaattacaaatcggtt

SEQ ID NO: 4801 - DNA, 22 bp, Artificial Sequence
  chemically synthesized
tatgaaaattacaaatcggtta

SEQ ID NO: 4802 - DNA, 22 bp, Artificial Sequence
  chemically synthesized
caaatcggttaaattatacaat

SEQ ID NO: 4803 - DNA, 22 bp, Artificial Sequence
  chemically synthesized
aattatacaatctagaacacta

SEQ ID NO: 4804 - DNA, 22 bp, Artificial Sequence
  chemically synthesized
tacaatctagaacactatgtca

SEQ ID NO: 4805 - DNA, 22 bp, Artificial Sequence
  chemically synthesized
gaacactatgtcattacactat

SEQ ID NO: 4806 - DNA, 22 bp, Artificial Sequence
  chemically synthesized
tgtcattacactattgtaaatt

SEQ ID NO: 4807 - DNA, 22 bp, Artificial Sequence
  chemically synthesized
cactattgtaaattactgaagg

SEQ ID NO: 4808 - DNA, 22 bp, Artificial Sequence
  chemically synthesized
ttgtaaattactgaaggtaagt

SEQ ID NO: 4809 - DNA, 22 bp, Artificial Sequence
  chemically synthesized
taaattactgaaggtaagtaaa

SEQ ID NO: 4810 - DNA, 22 bp, Artificial Sequence
  chemically synthesized
ctgaaggtaagtaaaaagttaa

SEQ ID NO: 4811 - DNA, 22 bp, Artificial Sequence
  chemically synthesized
aaggtaagtaaaaagttaaaaa

SEQ ID NO: 4812 - DNA, 22 bp, Artificial Sequence
  chemically synthesized
aaaaaaatttaaaactattctc

SEQ ID NO: 4813 - DNA, 22 bp, Artificial Sequence
  chemically synthesized
aaaactattctccagtgtttaa

SEQ ID NO: 4814 - DNA, 22 bp, Artificial Sequence
  chemically synthesized
aaactattctccagtgtttaaa

SEQ ID NO: 4815 - DNA, 22 bp, Artificial Sequence
  chemically synthesized
ttctccagtgtttaaaacagat

SEQ ID NO: 4816 - DNA, 22 bp, Artificial Sequence
  chemically synthesized
tccagtgtttaaaacagattaa

SEQ ID NO: 4817 - DNA, 22 bp, Artificial Sequence
  chemically synthesized
cagtgtttaaaacagattaaat

SEQ ID NO: 4818 - DNA, 22 bp, Artificial Sequence
  chemically synthesized
aaaacagattaaataatacagt

SEQ ID NO: 4819 - DNA, 22 bp, Artificial Sequence
  chemically synthesized
aaacagattaaataatacagta

SEQ ID NO: 4820 - DNA, 22 bp, Artificial Sequence
  chemically synthesized
aataatacagtaaatggaaaag

SEQ ID NO: 4821 - DNA, 22 bp, Artificial Sequence
  chemically synthesized
attcatatgaaaatatgctggg

SEQ ID NO: 4822 - DNA, 22 bp, Artificial Sequence
  chemically synthesized
ttcatatgaaaatatgctgggc

SEQ ID NO: 4823 - DNA, 22 bp, Artificial Sequence
  chemically synthesized
atatgaaaatatgctgggcttt

SEQ ID NO: 4824 - DNA, 22 bp, Artificial Sequence
  chemically synthesized
ggctttttcttttaattgaagt

SEQ ID NO: 4825 - DNA, 22 bp, Artificial Sequence
  chemically synthesized
tttcttttaattgaagttcaga

SEQ ID NO: 4826 - DNA, 22 bp, Artificial Sequence
  chemically synthesized
ttcttttaattgaagttcagaa

SEQ ID NO: 4827 - DNA, 22 bp, Artificial Sequence
  chemically synthesized
tcttttaattgaagttcagaaa

SEQ ID NO: 4828 - DNA, 22 bp, Artificial Sequence
  chemically synthesized
cttttaattgaagttcagaaaa

SEQ ID NO: 4829 - DNA, 22 bp, Artificial Sequence
  chemically synthesized
ttttaattgaagttcagaaaat

SEQ ID NO: 4830 - DNA, 22 bp, Artificial Sequence
  chemically synthesized
ttaattgaagttcagaaaatca

SEQ ID NO: 4831 - DNA, 22 bp, Artificial Sequence
  chemically synthesized
taattgaagttcagaaaatcaa

SEQ ID NO: 4832 - DNA, 22 bp, Artificial Sequence
  chemically synthesized
aattgaagttcagaaaatcaaa

SEQ ID NO: 4833 - DNA, 22 bp, Artificial Sequence
  chemically synthesized
attgaagttcagaaaatcaaat

SEQ ID NO: 4834 - DNA, 22 bp, Artificial Sequence
  chemically synthesized
aagttcagaaaatcaaatttta

SEQ ID NO: 4835 - DNA, 22 bp, Artificial Sequence
  chemically synthesized
agaaaatcaaattttagagata

SEQ ID NO: 4836 - DNA, 22 bp, Artificial Sequence
  chemically synthesized
tagagatagtacaatttaaata

SEQ ID NO: 4837 - DNA, 22 bp, Artificial Sequence
  chemically synthesized
agagatagtacaatttaaataa

SEQ ID NO: 4838 - DNA, 22 bp, Artificial Sequence
  chemically synthesized
gagatagtacaatttaaataaa

SEQ ID NO: 4839 - DNA, 22 bp, Artificial Sequence
  chemically synthesized
aaataaaatgttaaggacaaaa

SEQ ID NO: 4840 - DNA, 22 bp, Artificial Sequence
  chemically synthesized
aataaaatgttaaggacaaaaa

SEQ ID NO: 4841 - DNA, 22 bp, Artificial Sequence
  chemically synthesized
aggacaaaaatatgtgctattt

SEQ ID NO: 4842 - DNA, 22 bp, Artificial Sequence
  chemically synthesized
tttgaaagaagcatacaagggg

SEQ ID NO: 4843 - DNA, 22 bp, Artificial Sequence
  chemically synthesized
gaaagaagcatacaaggggaag

SEQ ID NO: 4844 - DNA, 22 bp, Artificial Sequence
  chemically synthesized
aaagaagcatacaaggggaagg

SEQ ID NO: 4845 - DNA, 22 bp, Artificial Sequence
  chemically synthesized
ccaatattcatttttcaaatcc

SEQ ID NO: 4846 - DNA, 22 bp, Artificial Sequence
  chemically synthesized
atttttcaaatccattattagt

SEQ ID NO: 4847 - DNA, 22 bp, Artificial Sequence
  chemically synthesized
ttcaaatccattattagtttaa

SEQ ID NO: 4848 - DNA, 22 bp, Artificial Sequence
  chemically synthesized
tcaaatccattattagtttaaa

SEQ ID NO: 4849 - DNA, 22 bp, Artificial Sequence
  chemically synthesized
caaatccattattagtttaaaa

SEQ ID NO: 4850 - DNA, 22 bp, Artificial Sequence
  chemically synthesized
aaatccattattagtttaaaaa

SEQ ID NO: 4851 - DNA, 22 bp, Artificial Sequence
  chemically synthesized
ttagtttaaaaatttagattat

SEQ ID NO: 4852 - DNA, 22 bp, Artificial Sequence
  chemically synthesized
gtttaaaaatttagattatgat

SEQ ID NO: 4853 - DNA, 22 bp, Artificial Sequence
  chemically synthesized
aaaaatttagattatgatagtg

SEQ ID NO: 4854 - DNA, 22 bp, Artificial Sequence
  chemically synthesized
aaaatttagattatgatagtgt

SEQ ID NO: 4855 - DNA, 22 bp, Artificial Sequence
  chemically synthesized
agattatgatagtgttacagga

SEQ ID NO: 4856 - DNA, 22 bp, Artificial Sequence
  chemically synthesized
gattatgatagtgttacaggaa

SEQ ID NO: 4857 - DNA, 22 bp, Artificial Sequence
  chemically synthesized
tgatagtgttacaggaaattaa

SEQ ID NO: 4858 - DNA, 22 bp, Artificial Sequence
  chemically synthesized
caggaaattaatagaaaagaaa

SEQ ID NO: 4859 - DNA, 22 bp, Artificial Sequence
  chemically synthesized
atagaaaagaaagaggaaagca

SEQ ID NO: 4860 - DNA, 22 bp, Artificial Sequence
  chemically synthesized
ataaccaacctactctctatat

SEQ ID NO: 4861 - DNA, 22 bp, Artificial Sequence
  chemically synthesized
taaccaacctactctctatatc

SEQ ID NO: 4862 - DNA, 22 bp, Artificial Sequence
  chemically synthesized
ctctctatatccagacttttgt

SEQ ID NO: 4863 - DNA, 22 bp, Artificial Sequence
  chemically synthesized
tctatatccagacttttgtaga

SEQ ID NO: 4864 - DNA, 22 bp, Artificial Sequence
  chemically synthesized
tatatccagacttttgtagaaa

SEQ ID NO: 4865 - DNA, 22 bp, Artificial Sequence
  chemically synthesized
tatccagacttttgtagaaaaa

SEQ ID NO: 4866 - DNA, 22 bp, Artificial Sequence
  chemically synthesized
ttgtagaaaaacaagataatag

SEQ ID NO: 4867 - DNA, 22 bp, Artificial Sequence
  chemically synthesized
tgtagaaaaacaagataatagc

SEQ ID NO: 4868 - DNA, 22 bp, Artificial Sequence
  chemically synthesized
gtagaaaaacaagataatagca

SEQ ID NO: 4869 - DNA, 22 bp, Artificial Sequence
  chemically synthesized
tagaaaaacaagataatagcat

SEQ ID NO: 4870 - DNA, 22 bp, Artificial Sequence
  chemically synthesized
ctccagaccgtggaagaccaat

SEQ ID NO: 4871 - DNA, 22 bp, Artificial Sequence
  chemically synthesized
tccagaccgtggaagaccaata

SEQ ID NO: 4872 - DNA, 22 bp, Artificial Sequence
  chemically synthesized
cagaccgtggaagaccaatata

SEQ ID NO: 4873 - DNA, 22 bp, Artificial Sequence
  chemically synthesized
aaccaacagcatagtcaaataa

SEQ ID NO: 4874 - DNA, 22 bp, Artificial Sequence
  chemically synthesized
taatggtatgtcccatctttca

SEQ ID NO: 4875 - DNA, 22 bp, Artificial Sequence
  chemically synthesized
aatggtatgtcccatctttcac

SEQ ID NO: 4876 - DNA, 22 bp, Artificial Sequence
  chemically synthesized
atggtatgtcccatctttcaca

SEQ ID NO: 4877 - DNA, 22 bp, Artificial Sequence
  chemically synthesized
tcacacaggtctgtaaaaacac

SEQ ID NO: 4878 - DNA, 22 bp, Artificial Sequence
  chemically synthesized
cacacaggtctgtaaaaacact

SEQ ID NO: 4879 - DNA, 22 bp, Artificial Sequence
  chemically synthesized
acacaggtctgtaaaaacactg

SEQ ID NO: 4880 - DNA, 22 bp, Artificial Sequence
  chemically synthesized
taaaaacactgaatcctaaaat

SEQ ID NO: 4881 - DNA, 22 bp, Artificial Sequence
  chemically synthesized
aatcctaaaattatttacaagc

SEQ ID NO: 4882 - DNA, 22 bp, Artificial Sequence
  chemically synthesized
aaattatttacaagctttaact

SEQ ID NO: 4883 - DNA, 22 bp, Artificial Sequence
  chemically synthesized
tttacaagctttaactggatca

SEQ ID NO: 4884 - DNA, 22 bp, Artificial Sequence
  chemically synthesized
acaagctttaactggatcatga

SEQ ID NO: 4885 - DNA, 22 bp, Artificial Sequence
  chemically synthesized
caagctttaactggatcatgag

SEQ ID NO: 4886 - DNA, 22 bp, Artificial Sequence
  chemically synthesized
taactggatcatgagtaaaatt

SEQ ID NO: 4887 - DNA, 22 bp, Artificial Sequence
  chemically synthesized
aactggatcatgagtaaaatta

SEQ ID NO: 4888 - DNA, 22 bp, Artificial Sequence
  chemically synthesized
actggatcatgagtaaaattat

SEQ ID NO: 4889 - DNA, 22 bp, Artificial Sequence
  chemically synthesized
gatcatgagtaaaattatcaca

SEQ ID NO: 4890 - DNA, 22 bp, Artificial Sequence
  chemically synthesized
tcacatcagcataactgttaaa

SEQ ID NO: 4891 - DNA, 22 bp, Artificial Sequence
  chemically synthesized
ttaaaattgcaggctctgaagc

SEQ ID NO: 4892 - DNA, 22 bp, Artificial Sequence
  chemically synthesized
aaattgcaggctctgaagctaa

SEQ ID NO: 4893 - DNA, 22 bp, Artificial Sequence
  chemically synthesized
caggctctgaagctaataaact

SEQ ID NO: 4894 - DNA, 22 bp, Artificial Sequence
  chemically synthesized
tgaagctaataaactacctgca

SEQ ID NO: 4895 - DNA, 22 bp, Artificial Sequence
  chemically synthesized
aagctaataaactacctgcatt

SEQ ID NO: 4896 - DNA, 22 bp, Artificial Sequence
  chemically synthesized
ataaactacctgcatttaaacc

SEQ ID NO: 4897 - DNA, 22 bp, Artificial Sequence
  chemically synthesized
cctgcatttaaaccatggctct

SEQ ID NO: 4898 - DNA, 22 bp, Artificial Sequence
  chemically synthesized
catttaaaccatggctctaaaa

SEQ ID NO: 4899 - DNA, 22 bp, Artificial Sequence
  chemically synthesized
aaaccatggctctaaaactttg

SEQ ID NO: 4900 - DNA, 22 bp, Artificial Sequence
  chemically synthesized
aaccatggctctaaaactttgt

SEQ ID NO: 4901 - DNA, 22 bp, Artificial Sequence
  chemically synthesized
taaaactttgtgtgaccttgaa

SEQ ID NO: 4902 - DNA, 22 bp, Artificial Sequence
  chemically synthesized
aaactttgtgtgaccttgaata

SEQ ID NO: 4903 - DNA, 22 bp, Artificial Sequence
  chemically synthesized
tgtgtgaccttgaataaattac

SEQ ID NO: 4904 - DNA, 22 bp, Artificial Sequence
  chemically synthesized
gtgtgaccttgaataaattact

SEQ ID NO: 4905 - DNA, 22 bp, Artificial Sequence
  chemically synthesized
tgtgaccttgaataaattactt

SEQ ID NO: 4906 - DNA, 22 bp, Artificial Sequence
  chemically synthesized
gaataaattacttcaccccttt

SEQ ID NO: 4907 - DNA, 22 bp, Artificial Sequence
  chemically synthesized
aataaattacttcaccccttta

SEQ ID NO: 4908 - DNA, 22 bp, Artificial Sequence
  chemically synthesized
cttcacccctttatctctcagt

SEQ ID NO: 4909 - DNA, 22 bp, Artificial Sequence
  chemically synthesized
cacccctttatctctcagtttc

SEQ ID NO: 4910 - DNA, 22 bp, Artificial Sequence
  chemically synthesized
acccctttatctctcagtttcc

SEQ ID NO: 4911 - DNA, 22 bp, Artificial Sequence
  chemically synthesized
tatctctcagtttcctcacata

SEQ ID NO: 4912 - DNA, 22 bp, Artificial Sequence
  chemically synthesized
atctctcagtttcctcacatat

SEQ ID NO: 4913 - DNA, 22 bp, Artificial Sequence
  chemically synthesized
tctctcagtttcctcacatata

SEQ ID NO: 4914 - DNA, 22 bp, Artificial Sequence
  chemically synthesized
tcagtttcctcacatatactac

SEQ ID NO: 4915 - DNA, 22 bp, Artificial Sequence
  chemically synthesized
agtttcctcacatatactacaa

SEQ ID NO: 4916 - DNA, 22 bp, Artificial Sequence
  chemically synthesized
cctcacatatactacaaagata

SEQ ID NO: 4917 - DNA, 22 bp, Artificial Sequence
  chemically synthesized
ctcacatatactacaaagataa

SEQ ID NO: 4918 - DNA, 22 bp, Artificial Sequence
  chemically synthesized
acatatactacaaagataataa

SEQ ID NO: 4919 - DNA, 22 bp, Artificial Sequence
  chemically synthesized
caaagataataacagaacttat

SEQ ID NO: 4920 - DNA, 22 bp, Artificial Sequence
  chemically synthesized
ataggattattgtaagaaaaaa

SEQ ID NO: 4921 - DNA, 22 bp, Artificial Sequence
  chemically synthesized
taggattattgtaagaaaaaaa

SEQ ID NO: 4922 - DNA, 22 bp, Artificial Sequence
  chemically synthesized
ttgtaagaaaaaaaattaattc

SEQ ID NO: 4923 - DNA, 22 bp, Artificial Sequence
  chemically synthesized
taagaaaaaaaattaattcata

SEQ ID NO: 4924 - DNA, 22 bp, Artificial Sequence
  chemically synthesized
attcatagcagccaatgtcatc

SEQ ID NO: 4925 - DNA, 22 bp, Artificial Sequence
  chemically synthesized
atagcagccaatgtcatcttac

SEQ ID NO: 4926 - DNA, 22 bp, Artificial Sequence
  chemically synthesized
actaaaattcaaattagatcat

SEQ ID NO: 4927 - DNA, 22 bp, Artificial Sequence
  chemically synthesized
ctaaaattcaaattagatcatg

SEQ ID NO: 4928 - DNA, 22 bp, Artificial Sequence
  chemically synthesized
aaattcaaattagatcatgttt

SEQ ID NO: 4929 - DNA, 22 bp, Artificial Sequence
  chemically synthesized
aaattagatcatgtttctcttt

SEQ ID NO: 4930 - DNA, 22 bp, Artificial Sequence
  chemically synthesized
gatcatgtttctctttgctcaa

SEQ ID NO: 4931 - DNA, 22 bp, Artificial Sequence
  chemically synthesized
ctctttgctcaaaaccacacaa

SEQ ID NO: 4932 - DNA, 22 bp, Artificial Sequence
  chemically synthesized
tctttgctcaaaaccacacaat

SEQ ID NO: 4933 - DNA, 22 bp, Artificial Sequence
  chemically synthesized
tttgctcaaaaccacacaatag

SEQ ID NO: 4934 - DNA, 22 bp, Artificial Sequence
  chemically synthesized
tgctcaaaaccacacaatagct

SEQ ID NO: 4935 - DNA, 22 bp, Artificial Sequence
  chemically synthesized
gctcaaaaccacacaatagctt

SEQ ID NO: 4936 - DNA, 22 bp, Artificial Sequence
  chemically synthesized
ctcaaaaccacacaatagcttt

SEQ ID NO: 4937 - DNA, 22 bp, Artificial Sequence
  chemically synthesized
aaaaccacacaatagctttcca

SEQ ID NO: 4938 - DNA, 22 bp, Artificial Sequence
  chemically synthesized
tccatttcactcatattggctc

SEQ ID NO: 4939 - DNA, 22 bp, Artificial Sequence
  chemically synthesized
ccatttcactcatattggctct

SEQ ID NO: 4940 - DNA, 22 bp, Artificial Sequence
  chemically synthesized
catttcactcatattggctctt

SEQ ID NO: 4941 - DNA, 22 bp, Artificial Sequence
  chemically synthesized
cactcatattggctctttagac

SEQ ID NO: 4942 - DNA, 22 bp, Artificial Sequence
  chemically synthesized
actcatattggctctttagacc

SEQ ID NO: 4943 - DNA, 22 bp, Artificial Sequence
  chemically synthesized
atattggctctttagaccaaga

SEQ ID NO: 4944 - DNA, 22 bp, Artificial Sequence
  chemically synthesized
gctctttagaccaagattaccc

SEQ ID NO: 4945 - DNA, 22 bp, Artificial Sequence
  chemically synthesized
ggtaatcttggtctaaagagcc

SEQ ID NO: 4946 - DNA, 22 bp, Artificial Sequence
  chemically synthesized
ggtctaaagagccaatatgagt

SEQ ID NO: 4947 - DNA, 22 bp, Artificial Sequence
  chemically synthesized
gtctaaagagccaatatgagtg

SEQ ID NO: 4948 - DNA, 22 bp, Artificial Sequence
  chemically synthesized
aagagccaatatgagtgaaatg

SEQ ID NO: 4949 - DNA, 22 bp, Artificial Sequence
  chemically synthesized
ttgtgtggttttgagcaaagag

SEQ ID NO: 4950 - DNA, 22 bp, Artificial Sequence
  chemically synthesized
tgtggttttgagcaaagagaaa

SEQ ID NO: 4951 - DNA, 22 bp, Artificial Sequence
  chemically synthesized
tgagcaaagagaaacatgatct

SEQ ID NO: 4952 - DNA, 22 bp, Artificial Sequence
  chemically synthesized
gagcaaagagaaacatgatcta

SEQ ID NO: 4953 - DNA, 22 bp, Artificial Sequence
  chemically synthesized
agcaaagagaaacatgatctaa

SEQ ID NO: 4954 - DNA, 22 bp, Artificial Sequence
  chemically synthesized
atttgaattttagtaagatgac

SEQ ID NO: 4955 - DNA, 22 bp, Artificial Sequence
  chemically synthesized
gaattttagtaagatgacattg

SEQ ID NO: 4956 - DNA, 22 bp, Artificial Sequence
  chemically synthesized
aattttagtaagatgacattgg

SEQ ID NO: 4957 - DNA, 22 bp, Artificial Sequence
  chemically synthesized
tagtaagatgacattggctgct

SEQ ID NO: 4958 - DNA, 22 bp, Artificial Sequence
  chemically synthesized
agtaagatgacattggctgcta

SEQ ID NO: 4959 - DNA, 22 bp, Artificial Sequence
  chemically synthesized
gtaagatgacattggctgctat

SEQ ID NO: 4960 - DNA, 22 bp, Artificial Sequence
  chemically synthesized
gctgctatgaattaattttttt

SEQ ID NO: 4961 - DNA, 22 bp, Artificial Sequence
  chemically synthesized
ctatgaattaattttttttctt

SEQ ID NO: 4962 - DNA, 22 bp, Artificial Sequence
  chemically synthesized
tgaattaattttttttcttaca

SEQ ID NO: 4963 - DNA, 22 bp, Artificial Sequence
  chemically synthesized
attttttttcttacaataatcc

SEQ ID NO: 4964 - DNA, 22 bp, Artificial Sequence
  chemically synthesized
tttttcttacaataatcctata

SEQ ID NO: 4965 - DNA, 22 bp, Artificial Sequence
  chemically synthesized
ttttcttacaataatcctataa

SEQ ID NO: 4966 - DNA, 22 bp, Artificial Sequence
  chemically synthesized
tttcttacaataatcctataag

SEQ ID NO: 4967 - DNA, 22 bp, Artificial Sequence
  chemically synthesized
ttcttacaataatcctataagt

SEQ ID NO: 4968 - DNA, 22 bp, Artificial Sequence
  chemically synthesized
tcttacaataatcctataagtt

SEQ ID NO: 4969 - DNA, 22 bp, Artificial Sequence
  chemically synthesized
cttacaataatcctataagttc

SEQ ID NO: 4970 - DNA, 22 bp, Artificial Sequence
  chemically synthesized
ttacaataatcctataagttct

SEQ ID NO: 4971 - DNA, 22 bp, Artificial Sequence
  chemically synthesized
acaataatcctataagttctgt

SEQ ID NO: 4972 - DNA, 22 bp, Artificial Sequence
  chemically synthesized
caataatcctataagttctgtt

SEQ ID NO: 4973 - DNA, 22 bp, Artificial Sequence
  chemically synthesized
taagttctgttattatctttgt

SEQ ID NO: 4974 - DNA, 22 bp, Artificial Sequence
  chemically synthesized
tgttattatctttgtagtatat

SEQ ID NO: 4975 - DNA, 22 bp, Artificial Sequence
  chemically synthesized
ttattatctttgtagtatatgt

SEQ ID NO: 4976 - DNA, 22 bp, Artificial Sequence
  chemically synthesized
ttatctttgtagtatatgtgag

SEQ ID NO: 4977 - DNA, 22 bp, Artificial Sequence
  chemically synthesized
tctttgtagtatatgtgaggaa

SEQ ID NO: 4978 - DNA, 22 bp, Artificial Sequence
  chemically synthesized
tgtagtatatgtgaggaaactg

SEQ ID NO: 4979 - DNA, 22 bp, Artificial Sequence
  chemically synthesized
gtagtatatgtgaggaaactga

SEQ ID NO: 4980 - DNA, 22 bp, Artificial Sequence
  chemically synthesized
tagtatatgtgaggaaactgag

SEQ ID NO: 4981 - DNA, 22 bp, Artificial Sequence
  chemically synthesized
agagataaaggggtgaagtaat

SEQ ID NO: 4982 - DNA, 22 bp, Artificial Sequence
  chemically synthesized
attcaaggtcacacaaagtttt

SEQ ID NO: 4983 - DNA, 22 bp, Artificial Sequence
  chemically synthesized
ttcaaggtcacacaaagtttta

SEQ ID NO: 4984 - DNA, 22 bp, Artificial Sequence
  chemically synthesized
aaggtcacacaaagttttagag

SEQ ID NO: 4985 - DNA, 22 bp, Artificial Sequence
  chemically synthesized
tagagccatggtttaaatgcag

SEQ ID NO: 4986 - DNA, 22 bp, Artificial Sequence
  chemically synthesized
agagccatggtttaaatgcagg

SEQ ID NO: 4987 - DNA, 22 bp, Artificial Sequence
  chemically synthesized
gagccatggtttaaatgcaggt

SEQ ID NO: 4988 - DNA, 22 bp, Artificial Sequence
  chemically synthesized
aaatgcaggtagtttattagct

SEQ ID NO: 4989 - DNA, 22 bp, Artificial Sequence
  chemically synthesized
aatgcaggtagtttattagctt

SEQ ID NO: 4990 - DNA, 22 bp, Artificial Sequence
  chemically synthesized
attagcttcagagcctgcaatt

SEQ ID NO: 4991 - DNA, 22 bp, Artificial Sequence
  chemically synthesized
ttagcttcagagcctgcaattt

SEQ ID NO: 4992 - DNA, 22 bp, Artificial Sequence
  chemically synthesized
gcttcagagcctgcaattttaa

SEQ ID NO: 4993 - DNA, 22 bp, Artificial Sequence
  chemically synthesized
cagagcctgcaattttaacagt

SEQ ID NO: 4994 - DNA, 22 bp, Artificial Sequence
  chemically synthesized
agagcctgcaattttaacagtt

SEQ ID NO: 4995 - DNA, 22 bp, Artificial Sequence
  chemically synthesized
caattttaacagttatgctgat

SEQ ID NO: 4996 - DNA, 22 bp, Artificial Sequence
  chemically synthesized
taacagttatgctgatgtgata

SEQ ID NO: 4997 - DNA, 22 bp, Artificial Sequence
  chemically synthesized
aacagttatgctgatgtgataa

SEQ ID NO: 4998 - DNA, 22 bp, Artificial Sequence
  chemically synthesized
acagttatgctgatgtgataat

SEQ ID NO: 4999 - DNA, 22 bp, Artificial Sequence
  chemically synthesized
tgctgatgtgataattttactc

SEQ ID NO: 5000 - DNA, 22 bp, Artificial Sequence
  chemically synthesized
atgtgataattttactcatgat

SEQ ID NO: 5001 - DNA, 22 bp, Artificial Sequence
  chemically synthesized
tactcatgatccagttaaagct

SEQ ID NO: 5002 - DNA, 22 bp, Artificial Sequence
  chemically synthesized
actcatgatccagttaaagctt

SEQ ID NO: 5003 - DNA, 22 bp, Artificial Sequence
  chemically synthesized
ctcatgatccagttaaagcttg

SEQ ID NO: 5004 - DNA, 22 bp, Artificial Sequence
  chemically synthesized
atgatccagttaaagcttgtaa

SEQ ID NO: 5005 - DNA, 22 bp, Artificial Sequence
  chemically synthesized
aagcttgtaaataattttagga

SEQ ID NO: 5006 - DNA, 22 bp, Artificial Sequence
  chemically synthesized
gtaaataattttaggattcagt

SEQ ID NO: 5007 - DNA, 22 bp, Artificial Sequence
  chemically synthesized
taaataattttaggattcagtg

SEQ ID NO: 5008 - DNA, 22 bp, Artificial Sequence
  chemically synthesized
taggattcagtgtttttacaga

SEQ ID NO: 5009 - DNA, 22 bp, Artificial Sequence
  chemically synthesized
aggattcagtgtttttacagac

SEQ ID NO: 5010 - DNA, 22 bp, Artificial Sequence
  chemically synthesized
ggattcagtgtttttacagacc

SEQ ID NO: 5011 - DNA, 22 bp, Artificial Sequence
  chemically synthesized
agtgtttttacagacctgtgtg

SEQ ID NO: 5012 - DNA, 22 bp, Artificial Sequence
  chemically synthesized
ttacagacctgtgtgaaagatg

SEQ ID NO: 5013 - DNA, 22 bp, Artificial Sequence
  chemically synthesized
tacagacctgtgtgaaagatgg

SEQ ID NO: 5014 - DNA, 22 bp, Artificial Sequence
  chemically synthesized
acagacctgtgtgaaagatggg

SEQ ID NO: 5015 - DNA, 22 bp, Artificial Sequence
  chemically synthesized
cagacctgtgtgaaagatggga

SEQ ID NO: 5016 - DNA, 22 bp, Artificial Sequence
  chemically synthesized
tgtgaaagatgggacataccat

SEQ ID NO: 5017 - DNA, 22 bp, Artificial Sequence
  chemically synthesized
aaatactgacttacctgatttt

SEQ ID NO: 5018 - DNA, 22 bp, Artificial Sequence
  chemically synthesized
acttacctgattttctatttct

SEQ ID NO: 5019 - DNA, 22 bp, Artificial Sequence
  chemically synthesized
acctgattttctatttctttta

SEQ ID NO: 5020 - DNA, 22 bp, Artificial Sequence
  chemically synthesized
cctgattttctatttcttttat

SEQ ID NO: 5021 - DNA, 22 bp, Artificial Sequence
  chemically synthesized
attttctatttcttttatttga

SEQ ID NO: 5022 - DNA, 22 bp, Artificial Sequence
  chemically synthesized
tctatttcttttatttgactat

SEQ ID NO: 5023 - DNA, 22 bp, Artificial Sequence
  chemically synthesized
ctatttcttttatttgactatg

SEQ ID NO: 5024 - DNA, 22 bp, Artificial Sequence
  chemically synthesized
tatttcttttatttgactatgc

SEQ ID NO: 5025 - DNA, 22 bp, Artificial Sequence
  chemically synthesized
tttcttttatttgactatgctg

SEQ ID NO: 5026 - DNA, 22 bp, Artificial Sequence
  chemically synthesized
cttttatttgactatgctgttg

SEQ ID NO: 5027 - DNA, 22 bp, Artificial Sequence
  chemically synthesized
ttttatttgactatgctgttgg

SEQ ID NO: 5028 - DNA, 22 bp, Artificial Sequence
  chemically synthesized
ttatttgactatgctgttggtt

SEQ ID NO: 5029 - DNA, 22 bp, Artificial Sequence
  chemically synthesized
tatttgactatgctgttggttt

SEQ ID NO: 5030 - DNA, 22 bp, Artificial Sequence
  chemically synthesized
atttgactatgctgttggttta

SEQ ID NO: 5031 - DNA, 22 bp, Artificial Sequence
  chemically synthesized
tttgactatgctgttggtttaa

SEQ ID NO: 5032 - DNA, 22 bp, Artificial Sequence
  chemically synthesized
gactatgctgttggtttaattg

SEQ ID NO: 5033 - DNA, 22 bp, Artificial Sequence
  chemically synthesized
actatgctgttggtttaattgt

SEQ ID NO: 5034 - DNA, 22 bp, Artificial Sequence
  chemically synthesized
tgctgttggtttaattgtttat

SEQ ID NO: 5035 - DNA, 22 bp, Artificial Sequence
  chemically synthesized
ttggtttaattgtttatattgg

SEQ ID NO: 5036 - DNA, 22 bp, Artificial Sequence
  chemically synthesized
gtttaattgtttatattggtct

SEQ ID NO: 5037 - DNA, 22 bp, Artificial Sequence
  chemically synthesized
aattgtttatattggtcttcca

SEQ ID NO: 5038 - DNA, 22 bp, Artificial Sequence
  chemically synthesized
attgtttatattggtcttccac

SEQ ID NO: 5039 - DNA, 22 bp, Artificial Sequence
  chemically synthesized
tttatattggtcttccacggtc

SEQ ID NO: 5040 - DNA, 22 bp, Artificial Sequence
  chemically synthesized
atattggtcttccacggtctgg

SEQ ID NO: 5041 - DNA, 22 bp, Artificial Sequence
  chemically synthesized
tattggtcttccacggtctgga

SEQ ID NO: 5042 - DNA, 22 bp, Artificial Sequence
  chemically synthesized
gtcttccacggtctggagaagg

SEQ ID NO: 5043 - DNA, 22 bp, Artificial Sequence
  chemically synthesized
ccacggtctggagaaggtcttt

SEQ ID NO: 5044 - DNA, 22 bp, Artificial Sequence
  chemically synthesized
cacggtctggagaaggtctttg

SEQ ID NO: 5045 - DNA, 22 bp, Artificial Sequence
  chemically synthesized
gagaaggtctttgatgctatta

SEQ ID NO: 5046 - DNA, 22 bp, Artificial Sequence
  chemically synthesized
tgatgctattatcttgtttttc

SEQ ID NO: 5047 - DNA, 22 bp, Artificial Sequence
  chemically synthesized
gatgctattatcttgtttttct

SEQ ID NO: 5048 - DNA, 22 bp, Artificial Sequence
  chemically synthesized
atgctattatcttgtttttcta

SEQ ID NO: 5049 - DNA, 22 bp, Artificial Sequence
  chemically synthesized
ttatcttgtttttctacaaaag

SEQ ID NO: 5050 - DNA, 22 bp, Artificial Sequence
  chemically synthesized
tcttgtttttctacaaaagtct

SEQ ID NO: 5051 - DNA, 22 bp, Artificial Sequence
  chemically synthesized
gtttttctacaaaagtctggat

SEQ ID NO: 5052 - DNA, 22 bp, Artificial Sequence
  chemically synthesized
tttttctacaaaagtctggata

SEQ ID NO: 5053 - DNA, 22 bp, Artificial Sequence
  chemically synthesized
ttctacaaaagtctggatatag

SEQ ID NO: 5054 - DNA, 22 bp, Artificial Sequence
  chemically synthesized
tctacaaaagtctggatataga

SEQ ID NO: 5055 - DNA, 22 bp, Artificial Sequence
  chemically synthesized
ctacaaaagtctggatatagag

SEQ ID NO: 5056 - DNA, 22 bp, Artificial Sequence
  chemically synthesized
tacaaaagtctggatatagaga

SEQ ID NO: 5057 - DNA, 22 bp, Artificial Sequence
  chemically synthesized
caaaagtctggatatagagagt

SEQ ID NO: 5058 - DNA, 22 bp, Artificial Sequence
  chemically synthesized
gatatagagagtaggttggtta

SEQ ID NO: 5059 - DNA, 22 bp, Artificial Sequence
  chemically synthesized
gttataagttgctttcctcttt

SEQ ID NO: 5060 - DNA, 22 bp, Artificial Sequence
  chemically synthesized
taagttgctttcctctttcttt

SEQ ID NO: 5061 - DNA, 22 bp, Artificial Sequence
  chemically synthesized
ctttcctctttcttttctatta

SEQ ID NO: 5062 - DNA, 22 bp, Artificial Sequence
  chemically synthesized
tcctctttcttttctattaatt

SEQ ID NO: 5063 - DNA, 22 bp, Artificial Sequence
  chemically synthesized
cctctttcttttctattaattt

SEQ ID NO: 5064 - DNA, 22 bp, Artificial Sequence
  chemically synthesized
ctctttcttttctattaatttc

SEQ ID NO: 5065 - DNA, 22 bp, Artificial Sequence
  chemically synthesized
tttcttttctattaatttcctg

SEQ ID NO: 5066 - DNA, 22 bp, Artificial Sequence
  chemically synthesized
tcttttctattaatttcctgta

SEQ ID NO: 5067 - DNA, 22 bp, Artificial Sequence
  chemically synthesized
cttttctattaatttcctgtaa

SEQ ID NO: 5068 - DNA, 22 bp, Artificial Sequence
  chemically synthesized
ttttctattaatttcctgtaac

SEQ ID NO: 5069 - DNA, 22 bp, Artificial Sequence
  chemically synthesized
ttctattaatttcctgtaacac

SEQ ID NO: 5070 - DNA, 22 bp, Artificial Sequence
  chemically synthesized
tctattaatttcctgtaacact

SEQ ID NO: 5071 - DNA, 22 bp, Artificial Sequence
  chemically synthesized
ctattaatttcctgtaacacta

SEQ ID NO: 5072 - DNA, 22 bp, Artificial Sequence
  chemically synthesized
tattaatttcctgtaacactat

SEQ ID NO: 5073 - DNA, 22 bp, Artificial Sequence
  chemically synthesized
ttaatttcctgtaacactatca

SEQ ID NO: 5074 - DNA, 22 bp, Artificial Sequence
  chemically synthesized
atttcctgtaacactatcataa

SEQ ID NO: 5075 - DNA, 22 bp, Artificial Sequence
  chemically synthesized
cctgtaacactatcataatcta

SEQ ID NO: 5076 - DNA, 22 bp, Artificial Sequence
  chemically synthesized
ctgtaacactatcataatctaa

SEQ ID NO: 5077 - DNA, 22 bp, Artificial Sequence
  chemically synthesized
taacactatcataatctaaatt

SEQ ID NO: 5078 - DNA, 22 bp, Artificial Sequence
  chemically synthesized
tcataatctaaatttttaaact

SEQ ID NO: 5079 - DNA, 22 bp, Artificial Sequence
  chemically synthesized
aatttttaaactaataatggat

SEQ ID NO: 5080 - DNA, 22 bp, Artificial Sequence
  chemically synthesized
ttaaactaataatggatttgaa

SEQ ID NO: 5081 - DNA, 22 bp, Artificial Sequence
  chemically synthesized
taaactaataatggatttgaaa

SEQ ID NO: 5082 - DNA, 22 bp, Artificial Sequence
  chemically synthesized
aaactaataatggatttgaaaa

SEQ ID NO: 5083 - DNA, 22 bp, Artificial Sequence
  chemically synthesized
aactaataatggatttgaaaaa

SEQ ID NO: 5084 - DNA, 22 bp, Artificial Sequence
  chemically synthesized
ataatggatttgaaaaatgaat

SEQ ID NO: 5085 - DNA, 22 bp, Artificial Sequence
  chemically synthesized
gaaaaatgaatattggcaattc

SEQ ID NO: 5086 - DNA, 22 bp, Artificial Sequence
  chemically synthesized
aaaaatgaatattggcaattcc

SEQ ID NO: 5087 - DNA, 22 bp, Artificial Sequence
  chemically synthesized
gcaattccttccccttgtatgc

SEQ ID NO: 5088 - DNA, 22 bp, Artificial Sequence
  chemically synthesized
cttccccttgtatgcttctttc

SEQ ID NO: 5089 - DNA, 22 bp, Artificial Sequence
  chemically synthesized
ccccttgtatgcttctttcaaa

SEQ ID NO: 5090 - DNA, 22 bp, Artificial Sequence
  chemically synthesized
cccttgtatgcttctttcaaat

SEQ ID NO: 5091 - DNA, 22 bp, Artificial Sequence
  chemically synthesized
gtatgcttctttcaaatagcac

SEQ ID NO: 5092 - DNA, 22 bp, Artificial Sequence
  chemically synthesized
tatgcttctttcaaatagcaca

SEQ ID NO: 5093 - DNA, 22 bp, Artificial Sequence
  chemically synthesized
ctttcaaatagcacatattttt

SEQ ID NO: 5094 - DNA, 22 bp, Artificial Sequence
  chemically synthesized
tttcaaatagcacatatttttg

SEQ ID NO: 5095 - DNA, 22 bp, Artificial Sequence
  chemically synthesized
tcaaatagcacatatttttgtc

SEQ ID NO: 5096 - DNA, 22 bp, Artificial Sequence
  chemically synthesized
caaatagcacatatttttgtcc

SEQ ID NO: 5097 - DNA, 22 bp, Artificial Sequence
  chemically synthesized
aaatagcacatatttttgtcct

SEQ ID NO: 5098 - DNA, 22 bp, Artificial Sequence
  chemically synthesized
ttgtccttaacattttatttaa

SEQ ID NO: 5099 - DNA, 22 bp, Artificial Sequence
  chemically synthesized
tgtccttaacattttatttaaa

SEQ ID NO: 5100 - DNA, 22 bp, Artificial Sequence
  chemically synthesized
gtccttaacattttatttaaat

SEQ ID NO: 5101 - DNA, 22 bp, Artificial Sequence
  chemically synthesized
tccttaacattttatttaaatt

SEQ ID NO: 5102 - DNA, 22 bp, Artificial Sequence
  chemically synthesized
aacattttatttaaattgtact

SEQ ID NO: 5103 - DNA, 22 bp, Artificial Sequence
  chemically synthesized
acattttatttaaattgtacta

SEQ ID NO: 5104 - DNA, 22 bp, Artificial Sequence
  chemically synthesized
tatttaaattgtactatctcta

SEQ ID NO: 5105 - DNA, 22 bp, Artificial Sequence
  chemically synthesized
atttaaattgtactatctctaa

SEQ ID NO: 5106 - DNA, 22 bp, Artificial Sequence
  chemically synthesized
tttaaattgtactatctctaaa

SEQ ID NO: 5107 - DNA, 22 bp, Artificial Sequence
  chemically synthesized
aaattgtactatctctaaaatt

SEQ ID NO: 5108 - DNA, 22 bp, Artificial Sequence
  chemically synthesized
aattgtactatctctaaaattt

SEQ ID NO: 5109 - DNA, 22 bp, Artificial Sequence
  chemically synthesized
tactatctctaaaatttgattt

SEQ ID NO: 5110 - DNA, 22 bp, Artificial Sequence
  chemically synthesized
tctctaaaatttgattttctga

SEQ ID NO: 5111 - DNA, 22 bp, Artificial Sequence
  chemically synthesized
taaaatttgattttctgaactt

SEQ ID NO: 5112 - DNA, 22 bp, Artificial Sequence
  chemically synthesized
aaatttgattttctgaacttca

SEQ ID NO: 5113 - DNA, 22 bp, Artificial Sequence
  chemically synthesized
gattttctgaacttcaattaaa

SEQ ID NO: 5114 - DNA, 22 bp, Artificial Sequence
  chemically synthesized
attttctgaacttcaattaaaa

SEQ ID NO: 5115 - DNA, 22 bp, Artificial Sequence
  chemically synthesized
tctgaacttcaattaaaagaaa

SEQ ID NO: 5116 - DNA, 22 bp, Artificial Sequence
  chemically synthesized
ctgaacttcaattaaaagaaaa

SEQ ID NO: 5117 - DNA, 22 bp, Artificial Sequence
  chemically synthesized
tgaacttcaattaaaagaaaaa

SEQ ID NO: 5118 - DNA, 22 bp, Artificial Sequence
  chemically synthesized
aacttcaattaaaagaaaaagc

SEQ ID NO: 5119 - DNA, 22 bp, Artificial Sequence
  chemically synthesized
caattaaaagaaaaagcccagc

SEQ ID NO: 5120 - DNA, 22 bp, Artificial Sequence
  chemically synthesized
aattaaaagaaaaagcccagca

SEQ ID NO: 5121 - DNA, 22 bp, Artificial Sequence
  chemically synthesized
aaagaaaaagcccagcatattt

SEQ ID NO: 5122 - DNA, 22 bp, Artificial Sequence
  chemically synthesized
tcatatgaataaatcttttcca

SEQ ID NO: 5123 - DNA, 22 bp, Artificial Sequence
  chemically synthesized
catatgaataaatcttttccat

SEQ ID NO: 5124 - DNA, 22 bp, Artificial Sequence
  chemically synthesized
atatgaataaatcttttccatt

SEQ ID NO: 5125 - DNA, 22 bp, Artificial Sequence
  chemically synthesized
ttccatttactgtattatttaa

SEQ ID NO: 5126 - DNA, 22 bp, Artificial Sequence
  chemically synthesized
tccatttactgtattatttaat

SEQ ID NO: 5127 - DNA, 22 bp, Artificial Sequence
  chemically synthesized
ccatttactgtattatttaatc

SEQ ID NO: 5128 - DNA, 22 bp, Artificial Sequence
  chemically synthesized
catttactgtattatttaatct

SEQ ID NO: 5129 - DNA, 22 bp, Artificial Sequence
  chemically synthesized
actgtattatttaatctgtttt

SEQ ID NO: 5130 - DNA, 22 bp, Artificial Sequence
  chemically synthesized
ctgtattatttaatctgtttta

SEQ ID NO: 5131 - DNA, 22 bp, Artificial Sequence
  chemically synthesized
tattatttaatctgttttaaac

SEQ ID NO: 5132 - DNA, 22 bp, Artificial Sequence
  chemically synthesized
tttaatctgttttaaacactgg

SEQ ID NO: 5133 - DNA, 22 bp, Artificial Sequence
  chemically synthesized
aatctgttttaaacactggaga

SEQ ID NO: 5134 - DNA, 22 bp, Artificial Sequence
  chemically synthesized
atctgttttaaacactggagaa

SEQ ID NO: 5135 - DNA, 22 bp, Artificial Sequence
  chemically synthesized
ttttaaacactggagaatagtt

SEQ ID NO: 5136 - DNA, 22 bp, Artificial Sequence
  chemically synthesized
taaacactggagaatagtttta

SEQ ID NO: 5137 - DNA, 22 bp, Artificial Sequence
  chemically synthesized
aaacactggagaatagttttaa

SEQ ID NO: 5138 - DNA, 22 bp, Artificial Sequence
  chemically synthesized
aacactggagaatagttttaaa

SEQ ID NO: 5139 - DNA, 22 bp, Artificial Sequence
  chemically synthesized
gagaatagttttaaattttttt

SEQ ID NO: 5140 - DNA, 22 bp, Artificial Sequence
  chemically synthesized
taaattttttttaactttttac

SEQ ID NO: 5141 - DNA, 22 bp, Artificial Sequence
  chemically synthesized
aaattttttttaactttttact

SEQ ID NO: 5142 - DNA, 22 bp, Artificial Sequence
  chemically synthesized
aattttttttaactttttactt

SEQ ID NO: 5143 - DNA, 22 bp, Artificial Sequence
  chemically synthesized
tttttaactttttacttacctt

SEQ ID NO: 5144 - DNA, 22 bp, Artificial Sequence
  chemically synthesized
ttttaactttttacttaccttc

SEQ ID NO: 5145 - DNA, 22 bp, Artificial Sequence
  chemically synthesized
tttaactttttacttaccttca

SEQ ID NO: 5146 - DNA, 22 bp, Artificial Sequence
  chemically synthesized
ttaactttttacttaccttcag

SEQ ID NO: 5147 - DNA, 22 bp, Artificial Sequence
  chemically synthesized
taactttttacttaccttcagt

SEQ ID NO: 5148 - DNA, 22 bp, Artificial Sequence
  chemically synthesized
aactttttacttaccttcagta

SEQ ID NO: 5149 - DNA, 22 bp, Artificial Sequence
  chemically synthesized
actttttacttaccttcagtaa

SEQ ID NO: 5150 - DNA, 22 bp, Artificial Sequence
  chemically synthesized
tttacttaccttcagtaattta

SEQ ID NO: 5151 - DNA, 22 bp, Artificial Sequence
  chemically synthesized
ttacttaccttcagtaatttac

SEQ ID NO: 5152 - DNA, 22 bp, Artificial Sequence
  chemically synthesized
tacttaccttcagtaatttaca

SEQ ID NO: 5153 - DNA, 22 bp, Artificial Sequence
  chemically synthesized
acttaccttcagtaatttacaa

SEQ ID NO: 5154 - DNA, 22 bp, Artificial Sequence
  chemically synthesized
cttaccttcagtaatttacaat

SEQ ID NO: 5155 - DNA, 22 bp, Artificial Sequence
  chemically synthesized
accttcagtaatttacaatagt

SEQ ID NO: 5156 - DNA, 22 bp, Artificial Sequence
  chemically synthesized
ccttcagtaatttacaatagtg

SEQ ID NO: 5157 - DNA, 22 bp, Artificial Sequence
  chemically synthesized
cagtaatttacaatagtgtaat

SEQ ID NO: 5158 - DNA, 22 bp, Artificial Sequence
  chemically synthesized
agtaatttacaatagtgtaatg

SEQ ID NO: 5159 - DNA, 22 bp, Artificial Sequence
  chemically synthesized
acaatagtgtaatgacatagtg

SEQ ID NO: 5160 - DNA, 22 bp, Artificial Sequence
  chemically synthesized
caatagtgtaatgacatagtgt

SEQ ID NO: 5161 - DNA, 22 bp, Artificial Sequence
  chemically synthesized
tagattgtataatttaaccgat

SEQ ID NO: 5162 - DNA, 22 bp, Artificial Sequence
  chemically synthesized
gattgtataatttaaccgattt

SEQ ID NO: 5163 - DNA, 22 bp, Artificial Sequence
  chemically synthesized
tataatttaaccgatttgtaat

SEQ ID NO: 5164 - DNA, 22 bp, Artificial Sequence
  chemically synthesized
aaccgatttgtaattttcatat

SEQ ID NO: 5165 - DNA, 22 bp, Artificial Sequence
  chemically synthesized
accgatttgtaattttcatata

SEQ ID NO: 5166 - DNA, 22 bp, Artificial Sequence
  chemically synthesized
gtaattttcatataaaatgcaa

SEQ ID NO: 5167 - DNA, 22 bp, Artificial Sequence
  chemically synthesized
taattttcatataaaatgcaaa

SEQ ID NO: 5168 - DNA, 22 bp, Artificial Sequence
  chemically synthesized
tcatataaaatgcaaattttca

SEQ ID NO: 5169 - DNA, 22 bp, Artificial Sequence
  chemically synthesized
catataaaatgcaaattttcag

SEQ ID NO: 5170 - DNA, 22 bp, Artificial Sequence
  chemically synthesized
atataaaatgcaaattttcagt

SEQ ID NO: 5171 - DNA, 22 bp, Artificial Sequence
  chemically synthesized
tcagtgttttcatatataacat

SEQ ID NO: 5172 - DNA, 22 bp, Artificial Sequence
  chemically synthesized
cagtgttttcatatataacatt

SEQ ID NO: 5173 - DNA, 22 bp, Artificial Sequence
  chemically synthesized
agtgttttcatatataacatta

SEQ ID NO: 5174 - DNA, 22 bp, Artificial Sequence
  chemically synthesized
tcatatataacattagggaaac

SEQ ID NO: 5175 - DNA, 22 bp, Artificial Sequence
  chemically synthesized
catatataacattagggaaaca

SEQ ID NO: 5176 - DNA, 22 bp, Artificial Sequence
  chemically synthesized
atatataacattagggaaacaa

SEQ ID NO: 5177 - DNA, 22 bp, Artificial Sequence
  chemically synthesized
gggaaacaaaaaactaacttga

SEQ ID NO: 5178 - DNA, 22 bp, Artificial Sequence
  chemically synthesized
acttgaaattataataggaaat

SEQ ID NO: 5179 - DNA, 22 bp, Artificial Sequence
  chemically synthesized
gaaattataataggaaatttta

SEQ ID NO: 5180 - DNA, 22 bp, Artificial Sequence
  chemically synthesized
aaattataataggaaattttat

SEQ ID NO: 5181 - DNA, 22 bp, Artificial Sequence
  chemically synthesized
taataggaaattttattttctg

SEQ ID NO: 5182 - DNA, 22 bp, Artificial Sequence
  chemically synthesized
tattttctggagattatttttc

SEQ ID NO: 5183 - DNA, 22 bp, Artificial Sequence
  chemically synthesized
attttctggagattatttttct

SEQ ID NO: 5184 - DNA, 22 bp, Artificial Sequence
  chemically synthesized
ttttctggagattatttttctt

SEQ ID NO: 5185 - DNA, 22 bp, Artificial Sequence
  chemically synthesized
tctggagattatttttcttgga

SEQ ID NO: 5186 - DNA, 22 bp, Artificial Sequence
  chemically synthesized
ctggagattatttttcttggaa

SEQ ID NO: 5187 - DNA, 22 bp, Artificial Sequence
  chemically synthesized
tggagattatttttcttggaaa

SEQ ID NO: 5188 - DNA, 22 bp, Artificial Sequence
  chemically synthesized
gagattatttttcttggaaaaa

SEQ ID NO: 5189 - DNA, 22 bp, Artificial Sequence
  chemically synthesized
tttttcttggaaaaaaaagtat

SEQ ID NO: 5190 - DNA, 22 bp, Artificial Sequence
  chemically synthesized
ttcttggaaaaaaaagtatttc

SEQ ID NO: 5191 - DNA, 22 bp, Artificial Sequence
  chemically synthesized
tcttggaaaaaaaagtatttca

SEQ ID NO: 5192 - DNA, 22 bp, Artificial Sequence
  chemically synthesized
cttggaaaaaaaagtatttcaa

SEQ ID NO: 5193 - DNA, 22 bp, Artificial Sequence
  chemically synthesized
ttggaaaaaaaagtatttcaac

SEQ ID NO: 5194 - DNA, 22 bp, Artificial Sequence
  chemically synthesized
ggaaaaaaaagtatttcaacaa

SEQ ID NO: 5195 - DNA, 22 bp, Artificial Sequence
  chemically synthesized
gaaaaaaaagtatttcaacaat

SEQ ID NO: 5196 - DNA, 22 bp, Artificial Sequence
  chemically synthesized
caacaatgcaacaaagtatttc

SEQ ID NO: 5197 - DNA, 22 bp, Artificial Sequence
  chemically synthesized
aacaatgcaacaaagtatttca

SEQ ID NO: 5198 - DNA, 22 bp, Artificial Sequence
  chemically synthesized
caaatggcatgccttagaaata

SEQ ID NO: 5199 - DNA, 22 bp, Artificial Sequence
  chemically synthesized
aaatggcatgccttagaaatat

SEQ ID NO: 5200 - DNA, 22 bp, Artificial Sequence
  chemically synthesized
agaaatattttttttaaaagat

SEQ ID NO: 5201 - DNA, 22 bp, Artificial Sequence
  chemically synthesized
gaaatattttttttaaaagatc

SEQ ID NO: 5202 - DNA, 22 bp, Artificial Sequence
  chemically synthesized
tttttaaaagatccacattgaa

SEQ ID NO: 5203 - DNA, 22 bp, Artificial Sequence
  chemically synthesized
ttttaaaagatccacattgaaa

SEQ ID NO: 5204 - DNA, 22 bp, Artificial Sequence
  chemically synthesized
tttaaaagatccacattgaaaa

SEQ ID NO: 5205 - DNA, 22 bp, Artificial Sequence
  chemically synthesized
ttaaaagatccacattgaaaac

SEQ ID NO: 5206 - DNA, 22 bp, Artificial Sequence
  chemically synthesized
taaaagatccacattgaaaaca

SEQ ID NO: 5207 - DNA, 22 bp, Artificial Sequence
  chemically synthesized
aaaagatccacattgaaaacat

SEQ ID NO: 5208 - DNA, 22 bp, Artificial Sequence
  chemically synthesized
aaagatccacattgaaaacata

SEQ ID NO: 5209 - DNA, 22 bp, Artificial Sequence
  chemically synthesized
aaaacataaacatgaaccctct

SEQ ID NO: 5210 - DNA, 22 bp, Artificial Sequence
  chemically synthesized
tttattttctacttactttaag

SEQ ID NO: 5211 - DNA, 22 bp, Artificial Sequence
  chemically synthesized
tattttctacttactttaagtg

SEQ ID NO: 5212 - DNA, 22 bp, Artificial Sequence
  chemically synthesized
attttctacttactttaagtga

SEQ ID NO: 5213 - DNA, 22 bp, Artificial Sequence
  chemically synthesized
ttttctacttactttaagtgaa

SEQ ID NO: 5214 - DNA, 22 bp, Artificial Sequence
  chemically synthesized
tctacttactttaagtgaagtt

SEQ ID NO: 5215 - DNA, 22 bp, Artificial Sequence
  chemically synthesized
ctacttactttaagtgaagtta

SEQ ID NO: 5216 - DNA, 22 bp, Artificial Sequence
  chemically synthesized
tacttactttaagtgaagttac

SEQ ID NO: 5217 - DNA, 22 bp, Artificial Sequence
  chemically synthesized
cttactttaagtgaagttactt

SEQ ID NO: 5218 - DNA, 22 bp, Artificial Sequence
  chemically synthesized
actttaagtgaagttacttctg

SEQ ID NO: 5219 - DNA, 22 bp, Artificial Sequence
  chemically synthesized
ctttaagtgaagttacttctgg

SEQ ID NO: 5220 - DNA, 22 bp, Artificial Sequence
  chemically synthesized
taagtgaagttacttctgggtg

SEQ ID NO: 5221 - DNA, 22 bp, Artificial Sequence
  chemically synthesized
aagtgaagttacttctgggtgt

SEQ ID NO: 5222 - DNA, 22 bp, Artificial Sequence
  chemically synthesized
agtgaagttacttctgggtgtt

SEQ ID NO: 5223 - DNA, 22 bp, Artificial Sequence
  chemically synthesized
cttctgggtgttctggagtttc

SEQ ID NO: 5224 - DNA, 22 bp, Artificial Sequence
  chemically synthesized
ctgggtgttctggagtttcagg

SEQ ID NO: 5225 - DNA, 22 bp, Artificial Sequence
  chemically synthesized
tgggtgttctggagtttcaggt

SEQ ID NO: 5226 - DNA, 22 bp, Artificial Sequence
  chemically synthesized
ggtgttctggagtttcaggttg

SEQ ID NO: 5227 - DNA, 22 bp, Artificial Sequence
  chemically synthesized
tggagtttcaggttgattttga

SEQ ID NO: 5228 - DNA, 22 bp, Artificial Sequence
  chemically synthesized
gagtttcaggttgattttgaat

SEQ ID NO: 5229 - DNA, 22 bp, Artificial Sequence
  chemically synthesized
caggttgattttgaattaagtt

SEQ ID NO: 5230 - DNA, 22 bp, Artificial Sequence
  chemically synthesized
aggttgattttgaattaagtta

SEQ ID NO: 5231 - DNA, 22 bp, Artificial Sequence
  chemically synthesized
attttgaattaagttagttagt

SEQ ID NO: 5232 - DNA, 22 bp, Artificial Sequence
  chemically synthesized
tgaattaagttagttagttgct

SEQ ID NO: 5233 - DNA, 22 bp, Artificial Sequence
  chemically synthesized
gaattaagttagttagttgctc

SEQ ID NO: 5234 - DNA, 22 bp, Artificial Sequence
  chemically synthesized
aattaagttagttagttgctct

SEQ ID NO: 5235 - DNA, 22 bp, Artificial Sequence
  chemically synthesized
agttagttagttgctcttctaa

SEQ ID NO: 5236 - DNA, 22 bp, Artificial Sequence
  chemically synthesized
gttagttgctcttctaaatatt

SEQ ID NO: 5237 - DNA, 22 bp, Artificial Sequence
  chemically synthesized
gttgctcttctaaatatttcac

SEQ ID NO: 5238 - DNA, 22 bp, Artificial Sequence
  chemically synthesized
ctcttctaaatatttcactttt

SEQ ID NO: 5239 - DNA, 22 bp, Artificial Sequence
  chemically synthesized
ttctaaatatttcactttttgt

SEQ ID NO: 5240 - DNA, 22 bp, Artificial Sequence
  chemically synthesized
ctaaatatttcactttttgttg

SEQ ID NO: 5241 - DNA, 22 bp, Artificial Sequence
  chemically synthesized
taaatatttcactttttgttga

SEQ ID NO: 5242 - DNA, 22 bp, Artificial Sequence
  chemically synthesized
aatatttcactttttgttgaag

SEQ ID NO: 5243 - DNA, 22 bp, Artificial Sequence
  chemically synthesized
cactttttgttgaagtagaatt

SEQ ID NO: 5244 - DNA, 22 bp, Artificial Sequence
  chemically synthesized
actttttgttgaagtagaattt

SEQ ID NO: 5245 - DNA, 22 bp, Artificial Sequence
  chemically synthesized
tttgttgaagtagaattttttc

SEQ ID NO: 5246 - DNA, 22 bp, Artificial Sequence
  chemically synthesized
ttgttgaagtagaattttttct

SEQ ID NO: 5247 - DNA, 22 bp, Artificial Sequence
  chemically synthesized
tgttgaagtagaattttttctt

SEQ ID NO: 5248 - DNA, 22 bp, Artificial Sequence
  chemically synthesized
gttgaagtagaattttttcttc

SEQ ID NO: 5249 - DNA, 22 bp, Artificial Sequence
  chemically synthesized
ttgaagtagaattttttcttct

SEQ ID NO: 5250 - DNA, 22 bp, Artificial Sequence
  chemically synthesized
aagtagaattttttcttctagg

SEQ ID NO: 5251 - DNA, 22 bp, Artificial Sequence
  chemically synthesized
tttcttctaggaggctttcaag

SEQ ID NO: 5252 - DNA, 22 bp, Artificial Sequence
  chemically synthesized
ttcttctaggaggctttcaagt

SEQ ID NO: 5253 - DNA, 22 bp, Artificial Sequence
  chemically synthesized
tcttctaggaggctttcaagtt

SEQ ID NO: 5254 - DNA, 22 bp, Artificial Sequence
  chemically synthesized
cttctaggaggctttcaagttt

SEQ ID NO: 5255 - DNA, 22 bp, Artificial Sequence
  chemically synthesized
ttctaggaggctttcaagtttt

SEQ ID NO: 5256 - DNA, 22 bp, Artificial Sequence
  chemically synthesized
ctaggaggctttcaagttttga

SEQ ID NO: 5257 - DNA, 22 bp, Artificial Sequence
  chemically synthesized
taggaggctttcaagttttgag

SEQ ID NO: 5258 - DNA, 22 bp, Artificial Sequence
  chemically synthesized
ggaggctttcaagttttgagtt

SEQ ID NO: 5259 - DNA, 22 bp, Artificial Sequence
  chemically synthesized
tcaagttttgagttgagttcaa

SEQ ID NO: 5260 - DNA, 22 bp, Artificial Sequence
  chemically synthesized
caagttttgagttgagttcaag

SEQ ID NO: 5261 - DNA, 22 bp, Artificial Sequence
  chemically synthesized
aagttttgagttgagttcaagt

SEQ ID NO: 5262 - DNA, 22 bp, Artificial Sequence
  chemically synthesized
tgagttgagttcaagtgacata

SEQ ID NO: 5263 - DNA, 22 bp, Artificial Sequence
  chemically synthesized
gagttgagttcaagtgacatat

SEQ ID NO: 5264 - DNA, 22 bp, Artificial Sequence
  chemically synthesized
agttgagttcaagtgacatatt

SEQ ID NO: 5265 - DNA, 22 bp, Artificial Sequence
  chemically synthesized
agttcaagtgacatattcttta

SEQ ID NO: 5266 - DNA, 22 bp, Artificial Sequence
  chemically synthesized
aagtgacatattctttacctct

SEQ ID NO: 5267 - DNA, 22 bp, Artificial Sequence
  chemically synthesized
tttacctcttcatttttgactt

SEQ ID NO: 5268 - DNA, 22 bp, Artificial Sequence
  chemically synthesized
tacctcttcatttttgacttgt

SEQ ID NO: 5269 - DNA, 22 bp, Artificial Sequence
  chemically synthesized
acctcttcatttttgacttgta

SEQ ID NO: 5270 - DNA, 22 bp, Artificial Sequence
  chemically synthesized
cctcttcatttttgacttgtag

SEQ ID NO: 5271 - DNA, 22 bp, Artificial Sequence
  chemically synthesized
ttcatttttgacttgtagttta

SEQ ID NO: 5272 - DNA, 22 bp, Artificial Sequence
  chemically synthesized
catttttgacttgtagtttata

SEQ ID NO: 5273 - DNA, 22 bp, Artificial Sequence
  chemically synthesized
atttttgacttgtagtttatat

SEQ ID NO: 5274 - DNA, 22 bp, Artificial Sequence
  chemically synthesized
ttgacttgtagtttatatgtag

SEQ ID NO: 5275 - DNA, 22 bp, Artificial Sequence
  chemically synthesized
tgacttgtagtttatatgtagt

SEQ ID NO: 5276 - DNA, 22 bp, Artificial Sequence
  chemically synthesized
gacttgtagtttatatgtagtt

SEQ ID NO: 5277 - DNA, 22 bp, Artificial Sequence
  chemically synthesized
acttgtagtttatatgtagttc

SEQ ID NO: 5278 - DNA, 22 bp, Artificial Sequence
  chemically synthesized
gtagtttatatgtagttcttct

SEQ ID NO: 5279 - DNA, 22 bp, Artificial Sequence
  chemically synthesized
tagtttatatgtagttcttctc

SEQ ID NO: 5280 - DNA, 22 bp, Artificial Sequence
  chemically synthesized
atatgtagttcttctcagttcc

SEQ ID NO: 5281 - DNA, 22 bp, Artificial Sequence
  chemically synthesized
tatgtagttcttctcagttcct

SEQ ID NO: 5282 - DNA, 22 bp, Artificial Sequence
  chemically synthesized
ttctcagttccttttcttcttc

SEQ ID NO: 5283 - DNA, 22 bp, Artificial Sequence
  chemically synthesized
ctcagttccttttcttcttctt

SEQ ID NO: 5284 - DNA, 22 bp, Artificial Sequence
  chemically synthesized
tcagttccttttcttcttcttt

SEQ ID NO: 5285 - DNA, 22 bp, Artificial Sequence
  chemically synthesized
agttccttttcttcttctttga

SEQ ID NO: 5286 - DNA, 22 bp, Artificial Sequence
  chemically synthesized
cttttcttcttctttgatttca

SEQ ID NO: 5287 - DNA, 22 bp, Artificial Sequence
  chemically synthesized
ttcttcttctttgatttcactg

SEQ ID NO: 5288 - DNA, 22 bp, Artificial Sequence
  chemically synthesized
tcttcttctttgatttcactgg

SEQ ID NO: 5289 - DNA, 22 bp, Artificial Sequence
  chemically synthesized
cttcttctttgatttcactggt

SEQ ID NO: 5290 - DNA, 22 bp, Artificial Sequence
  chemically synthesized
ttcttctttgatttcactggtt

SEQ ID NO: 5291 - DNA, 22 bp, Artificial Sequence
  chemically synthesized
cttctttgatttcactggtttg

SEQ ID NO: 5292 - DNA, 22 bp, Artificial Sequence
  chemically synthesized
ttctttgatttcactggtttgc

SEQ ID NO: 5293 - DNA, 22 bp, Artificial Sequence
  chemically synthesized
ctttgatttcactggtttgcag

SEQ ID NO: 5294 - DNA, 22 bp, Artificial Sequence
  chemically synthesized
tttgatttcactggtttgcagc

SEQ ID NO: 5295 - DNA, 22 bp, Artificial Sequence
  chemically synthesized
tgatttcactggtttgcagcga

SEQ ID NO: 5296 - DNA, 22 bp, Artificial Sequence
  chemically synthesized
gatttcactggtttgcagcgat

SEQ ID NO: 5297 - DNA, 22 bp, Artificial Sequence
  chemically synthesized
atttcactggtttgcagcgata

SEQ ID NO: 5298 - DNA, 22 bp, Artificial Sequence
  chemically synthesized
cactggtttgcagcgatagatc

SEQ ID NO: 5299 - DNA, 22 bp, Artificial Sequence
  chemically synthesized
actggtttgcagcgatagatca

SEQ ID NO: 5300 - DNA, 22 bp, Artificial Sequence
  chemically synthesized
gtttgcagcgatagatcataaa

SEQ ID NO: 5301 - DNA, 22 bp, Artificial Sequence
  chemically synthesized
gcagcgatagatcataaaaaga

SEQ ID NO: 5302 - DNA, 22 bp, Artificial Sequence
  chemically synthesized
cagcgatagatcataaaaagac

SEQ ID NO: 5303 - DNA, 22 bp, Artificial Sequence
  chemically synthesized
atcaaatatgttgagtttttga

SEQ ID NO: 5304 - DNA, 22 bp, Artificial Sequence
  chemically synthesized
agtttttgaaatatgtcattaa

SEQ ID NO: 5305 - DNA, 22 bp, Artificial Sequence
  chemically synthesized
ttgaaatatgtcattaatttgg

SEQ ID NO: 5306 - DNA, 22 bp, Artificial Sequence
  chemically synthesized
tgaaatatgtcattaatttggc

SEQ ID NO: 5307 - DNA, 22 bp, Artificial Sequence
  chemically synthesized
gaaatatgtcattaatttggcc

SEQ ID NO: 5308 - DNA, 22 bp, Artificial Sequence
  chemically synthesized
aaatatgtcattaatttggccc

SEQ ID NO: 5309 - DNA, 22 bp, Artificial Sequence
  chemically synthesized
atttggcccttcgtcttatgga

SEQ ID NO: 5310 - DNA, 22 bp, Artificial Sequence
  chemically synthesized
ggcccttcgtcttatggacaaa

SEQ ID NO: 5311 - DNA, 22 bp, Artificial Sequence
  chemically synthesized
gcccttcgtcttatggacaaag

SEQ ID NO: 5312 - DNA, 22 bp, Artificial Sequence
  chemically synthesized
cgtcttatggacaaagtcttta

SEQ ID NO: 5313 - DNA, 22 bp, Artificial Sequence
  chemically synthesized
gtcttatggacaaagtctttaa

SEQ ID NO: 5314 - DNA, 22 bp, Artificial Sequence
  chemically synthesized
atggacaaagtctttaagacca

SEQ ID NO: 5315 - DNA, 22 bp, Artificial Sequence
  chemically synthesized
tggacaaagtctttaagaccat

SEQ ID NO: 5316 - DNA, 22 bp, Artificial Sequence
  chemically synthesized
taagaccatgtcccaactgaag

SEQ ID NO: 5317 - DNA, 22 bp, Artificial Sequence
  chemically synthesized
aagaccatgtcccaactgaagg

SEQ ID NO: 5318 - DNA, 22 bp, Artificial Sequence
  chemically synthesized
agaccatgtcccaactgaagga

SEQ ID NO: 5319 - DNA, 22 bp, Artificial Sequence
  chemically synthesized
aaggaggccattggctaaaatt

SEQ ID NO: 5320 - DNA, 22 bp, Artificial Sequence
  chemically synthesized
gctaaaatttttacatcgtcta

SEQ ID NO: 5321 - DNA, 22 bp, Artificial Sequence
  chemically synthesized
aaatttttacatcgtctaacat

SEQ ID NO: 5322 - DNA, 22 bp, Artificial Sequence
  chemically synthesized
ttacatcgtctaacatagcaaa

SEQ ID NO: 5323 - DNA, 22 bp, Artificial Sequence
  chemically synthesized
tacatcgtctaacatagcaaat

SEQ ID NO: 5324 - DNA, 22 bp, Artificial Sequence
  chemically synthesized
acatcgtctaacatagcaaatc

SEQ ID NO: 5325 - DNA, 22 bp, Artificial Sequence
  chemically synthesized
catcgtctaacatagcaaatct

SEQ ID NO: 5326 - DNA, 22 bp, Artificial Sequence
  chemically synthesized
acatagcaaatcttgattttgg

SEQ ID NO: 5327 - DNA, 22 bp, Artificial Sequence
  chemically synthesized
gattttggctctggagatagag

SEQ ID NO: 5328 - DNA, 22 bp, Artificial Sequence
  chemically synthesized
attttggctctggagatagaga

SEQ ID NO: 5329 - DNA, 22 bp, Artificial Sequence
  chemically synthesized
tggctctggagatagagaatca

SEQ ID NO: 5330 - DNA, 22 bp, Artificial Sequence
  chemically synthesized
ggctctggagatagagaatcaa

SEQ ID NO: 5331 - DNA, 22 bp, Artificial Sequence
  chemically synthesized
gctctggagatagagaatcaaa

SEQ ID NO: 5332 - DNA, 22 bp, Artificial Sequence
  chemically synthesized
tggagatagagaatcaaatgat

SEQ ID NO: 5333 - DNA, 22 bp, Artificial Sequence
  chemically synthesized
gagatagagaatcaaatgatga

SEQ ID NO: 5334 - DNA, 22 bp, Artificial Sequence
  chemically synthesized
tcttgatcaattctggaggaaa

SEQ ID NO: 5335 - DNA, 22 bp, Artificial Sequence
  chemically synthesized
gatcaattctggaggaaataac

SEQ ID NO: 5336 - DNA, 22 bp, Artificial Sequence
  chemically synthesized
atcaattctggaggaaataact

SEQ ID NO: 5337 - DNA, 22 bp, Artificial Sequence
  chemically synthesized
tggaggaaataactagaggaac

SEQ ID NO: 5338 - DNA, 22 bp, Artificial Sequence
  chemically synthesized
gaggaaataactagaggaacaa

SEQ ID NO: 5339 - DNA, 22 bp, Artificial Sequence
  chemically synthesized
gaggaacaataaaaagaaggag

SEQ ID NO: 5340 - DNA, 22 bp, Artificial Sequence
  chemically synthesized
aattgtgaacatttttatcttg

SEQ ID NO: 5341 - DNA, 22 bp, Artificial Sequence
  chemically synthesized
attgtgaacatttttatcttga

SEQ ID NO: 5342 - DNA, 22 bp, Artificial Sequence
  chemically synthesized
tgaacatttttatcttgatttt

SEQ ID NO: 5343 - DNA, 22 bp, Artificial Sequence
  chemically synthesized
ttatcttgattttcaatttcaa

SEQ ID NO: 5344 - DNA, 22 bp, Artificial Sequence
  chemically synthesized
tatcttgattttcaatttcaag

SEQ ID NO: 5345 - DNA, 22 bp, Artificial Sequence
  chemically synthesized
atcttgattttcaatttcaagc

SEQ ID NO: 5346 - DNA, 22 bp, Artificial Sequence
  chemically synthesized
tcttgattttcaatttcaagca

SEQ ID NO: 5347 - DNA, 22 bp, Artificial Sequence
  chemically synthesized
gattttcaatttcaagcaacgt

SEQ ID NO: 5348 - DNA, 22 bp, Artificial Sequence
  chemically synthesized
attttcaatttcaagcaacgtg

SEQ ID NO: 5349 - DNA, 22 bp, Artificial Sequence
  chemically synthesized
tcaatttcaagcaacgtggaac

SEQ ID NO: 5350 - DNA, 22 bp, Artificial Sequence
  chemically synthesized
caatttcaagcaacgtggaact

SEQ ID NO: 5351 - DNA, 22 bp, Artificial Sequence
  chemically synthesized
aatttcaagcaacgtggaactg

SEQ ID NO: 5352 - DNA, 22 bp, Artificial Sequence
  chemically synthesized
caagcaacgtggaactgttttc

SEQ ID NO: 5353 - DNA, 22 bp, Artificial Sequence
  chemically synthesized
aagcaacgtggaactgttttct

SEQ ID NO: 5354 - DNA, 22 bp, Artificial Sequence
  chemically synthesized
ttttcttctggaagcagaccta

SEQ ID NO: 5355 - DNA, 22 bp, Artificial Sequence
  chemically synthesized
tcttctggaagcagacctagac

SEQ ID NO: 5356 - DNA, 22 bp, Artificial Sequence
  chemically synthesized
cttctggaagcagacctagact

SEQ ID NO: 5357 - DNA, 22 bp, Artificial Sequence
  chemically synthesized
ttctggaagcagacctagactt

SEQ ID NO: 5358 - DNA, 22 bp, Artificial Sequence
  chemically synthesized
ctggaagcagacctagacttct

SEQ ID NO: 5359 - DNA, 22 bp, Artificial Sequence
  chemically synthesized
tggaagcagacctagacttctt

SEQ ID NO: 5360 - DNA, 22 bp, Artificial Sequence
  chemically synthesized
gaagcagacctagacttcttaa

SEQ ID NO: 5361 - DNA, 22 bp, Artificial Sequence
  chemically synthesized
gacttcttaactctatatatac

SEQ ID NO: 5362 - DNA, 22 bp, Artificial Sequence
  chemically synthesized
cttaactctatatataccaata

SEQ ID NO: 5363 - DNA, 22 bp, Artificial Sequence
  chemically synthesized
ttaactctatatataccaatat

SEQ ID NO: 5364 - DNA, 22 bp, Artificial Sequence
  chemically synthesized
aactctatatataccaatattt

SEQ ID NO: 5365 - DNA, 22 bp, Artificial Sequence
  chemically synthesized
actctatatataccaatatttg

SEQ ID NO: 5366 - DNA, 22 bp, Artificial Sequence
  chemically synthesized
tatatataccaatatttgccca

SEQ ID NO: 5367 - DNA, 22 bp, Artificial Sequence
  chemically synthesized
tatataccaatatttgcccaga

SEQ ID NO: 5368 - DNA, 22 bp, Artificial Sequence
  chemically synthesized
gcccagaaaaggtaaggttggt

SEQ ID NO: 5369 - DNA, 22 bp, Artificial Sequence
  chemically synthesized
cccagaaaaggtaaggttggta

SEQ ID NO: 5370 - DNA, 22 bp, Artificial Sequence
  chemically synthesized
gtaggtgaacatagttaatcat

SEQ ID NO: 5371 - DNA, 22 bp, Artificial Sequence
  chemically synthesized
atcattaagccgtgttaacttg

SEQ ID NO: 5372 - DNA, 22 bp, Artificial Sequence
  chemically synthesized
agccgtgttaacttgcacgaat

SEQ ID NO: 5373 - DNA, 22 bp, Artificial Sequence
  chemically synthesized
acttgcacgaatgtaaccttct

SEQ ID NO: 5374 - DNA, 22 bp, Artificial Sequence
  chemically synthesized
gcacgaatgtaaccttcttcca

SEQ ID NO: 5375 - DNA, 22 bp, Artificial Sequence
  chemically synthesized
cacgaatgtaaccttcttccac

SEQ ID NO: 5376 - DNA, 22 bp, Artificial Sequence
  chemically synthesized
cttccacattgagttagatcaa

SEQ ID NO: 5377 - DNA, 22 bp, Artificial Sequence
  chemically synthesized
ttccacattgagttagatcaat

SEQ ID NO: 5378 - DNA, 22 bp, Artificial Sequence
  chemically synthesized
ccacattgagttagatcaatgc

SEQ ID NO: 5379 - DNA, 22 bp, Artificial Sequence
  chemically synthesized
cacattgagttagatcaatgct

SEQ ID NO: 5380 - DNA, 22 bp, Artificial Sequence
  chemically synthesized
agttagatcaatgctaaatgaa

SEQ ID NO: 5381 - DNA, 22 bp, Artificial Sequence
  chemically synthesized
gatcaatgctaaatgaaatcaa

SEQ ID NO: 5382 - DNA, 22 bp, Artificial Sequence
  chemically synthesized
aatgaaatcaaagaaatgagca

SEQ ID NO: 5383 - DNA, 22 bp, Artificial Sequence
  chemically synthesized
acttaataggtaatttgaaatt

SEQ ID NO: 5384 - DNA, 22 bp, Artificial Sequence
  chemically synthesized
aataggtaatttgaaattgtat

SEQ ID NO: 5385 - DNA, 22 bp, Artificial Sequence
  chemically synthesized
ataggtaatttgaaattgtatt

SEQ ID NO: 5386 - DNA, 22 bp, Artificial Sequence
  chemically synthesized
gaaattgtatttaactttgctg

SEQ ID NO: 5387 - DNA, 22 bp, Artificial Sequence
  chemically synthesized
aaattgtatttaactttgctgt

SEQ ID NO: 5388 - DNA, 22 bp, Artificial Sequence
  chemically synthesized
tatttaactttgctgtattata

SEQ ID NO: 5389 - DNA, 22 bp, Artificial Sequence
  chemically synthesized
aactttgctgtattataaacta

SEQ ID NO: 5390 - DNA, 22 bp, Artificial Sequence
  chemically synthesized
actttgctgtattataaactac

SEQ ID NO: 5391 - DNA, 22 bp, Artificial Sequence
  chemically synthesized
tgctgtattataaactacacat

SEQ ID NO: 5392 - DNA, 22 bp, Artificial Sequence
  chemically synthesized
gctgtattataaactacacatt

SEQ ID NO: 5393 - DNA, 22 bp, Artificial Sequence
  chemically synthesized
ctgtattataaactacacattc

SEQ ID NO: 5394 - DNA, 22 bp, Artificial Sequence
  chemically synthesized
tattataaactacacattcaat

SEQ ID NO: 5395 - DNA, 22 bp, Artificial Sequence
  chemically synthesized
taaactacacattcaatgctat

SEQ ID NO: 5396 - DNA, 22 bp, Artificial Sequence
  chemically synthesized
cacattcaatgctatggtgact

SEQ ID NO: 5397 - DNA, 22 bp, Artificial Sequence
  chemically synthesized
aatgctatggtgactacctgtt

SEQ ID NO: 5398 - DNA, 22 bp, Artificial Sequence
  chemically synthesized
tggtgactacctgtttttaaaa

SEQ ID NO: 5399 - DNA, 22 bp, Artificial Sequence
  chemically synthesized
cctgtttttaaaagctaatttt

SEQ ID NO: 5400 - DNA, 22 bp, Artificial Sequence
  chemically synthesized
tttttaaaagctaattttactt

SEQ ID NO: 5401 - DNA, 22 bp, Artificial Sequence
  chemically synthesized
ttaaaagctaattttacttttt

SEQ ID NO: 5402 - DNA, 22 bp, Artificial Sequence
  chemically synthesized
taaaagctaattttactttttt

SEQ ID NO: 5403 - DNA, 22 bp, Artificial Sequence
  chemically synthesized
aaaagctaattttactttttta

SEQ ID NO: 5404 - DNA, 22 bp, Artificial Sequence
  chemically synthesized
aaagctaattttacttttttat

SEQ ID NO: 5405 - DNA, 22 bp, Artificial Sequence
  chemically synthesized
attttacttttttatgatttta

SEQ ID NO: 5406 - DNA, 22 bp, Artificial Sequence
  chemically synthesized
tacttttttatgattttaagag

SEQ ID NO: 5407 - DNA, 22 bp, Artificial Sequence
  chemically synthesized
acttttttatgattttaagaga

SEQ ID NO: 5408 - DNA, 22 bp, Artificial Sequence
  chemically synthesized
cttttttatgattttaagagat

SEQ ID NO: 5409 - DNA, 22 bp, Artificial Sequence
  chemically synthesized
ttttatgattttaagagattta

SEQ ID NO: 5410 - DNA, 22 bp, Artificial Sequence
  chemically synthesized
tttatgattttaagagatttac

SEQ ID NO: 5411 - DNA, 22 bp, Artificial Sequence
  chemically synthesized
ttatgattttaagagatttaca

SEQ ID NO: 5412 - DNA, 22 bp, Artificial Sequence
  chemically synthesized
tatgattttaagagatttacaa

SEQ ID NO: 5413 - DNA, 22 bp, Artificial Sequence
  chemically synthesized
atgattttaagagatttacaag

SEQ ID NO: 5414 - DNA, 22 bp, Artificial Sequence
  chemically synthesized
tgattttaagagatttacaagt

SEQ ID NO: 5415 - DNA, 22 bp, Artificial Sequence
  chemically synthesized
taagagatttacaagtcaaaaa

SEQ ID NO: 5416 - DNA, 22 bp, Artificial Sequence
  chemically synthesized
aagagatttacaagtcaaaaat

SEQ ID NO: 5417 - DNA, 22 bp, Artificial Sequence
  chemically synthesized
agagatttacaagtcaaaaata

SEQ ID NO: 5418 - DNA, 22 bp, Artificial Sequence
  chemically synthesized
acaagtcaaaaataaacttttt

SEQ ID NO: 5419 - DNA, 22 bp, Artificial Sequence
  chemically synthesized
caagtcaaaaataaactttttt

SEQ ID NO: 5420 - DNA, 22 bp, Artificial Sequence
  chemically synthesized
ttttgttgggtaaatttattat

SEQ ID NO: 5421 - DNA, 22 bp, Artificial Sequence
  chemically synthesized
tttgttgggtaaatttattatt

SEQ ID NO: 5422 - DNA, 22 bp, Artificial Sequence
  chemically synthesized
ttgttgggtaaatttattatta

SEQ ID NO: 5423 - DNA, 22 bp, Artificial Sequence
  chemically synthesized
tgttgggtaaatttattattaa

SEQ ID NO: 5424 - DNA, 22 bp, Artificial Sequence
  chemically synthesized
gttgggtaaatttattattaaa

SEQ ID NO: 5425 - DNA, 22 bp, Artificial Sequence
  chemically synthesized
ttgggtaaatttattattaaag

SEQ ID NO: 5426 - DNA, 22 bp, Artificial Sequence
  chemically synthesized
ggtaaatttattattaaagttg

SEQ ID NO: 5427 - DNA, 22 bp, Artificial Sequence
  chemically synthesized
attattaaagttgaggggaaaa

SEQ ID NO: 5428 - DNA, 22 bp, Artificial Sequence
  chemically synthesized
ttattaaagttgaggggaaaaa

SEQ ID NO: 5429 - DNA, 22 bp, Artificial Sequence
  chemically synthesized
ttaaagttgaggggaaaaaagt

SEQ ID NO: 5430 - DNA, 22 bp, Artificial Sequence
  chemically synthesized
aagttgaggggaaaaaagtaat

SEQ ID NO: 5431 - DNA, 22 bp, Artificial Sequence
  chemically synthesized
aggggaaaaaagtaatgaatta

SEQ ID NO: 5432 - DNA, 20 bp, Artificial Sequence
  chemically synthesized
tcccgcccgcttgctgcatc

SEQ ID NO: 5433 - DNA, 20 bp, Artificial Sequence
  chemically synthesized
tgcatctggacaccctgcct

SEQ ID NO: 5434 - DNA, 20 bp, Artificial Sequence
  chemically synthesized
gcatctggacaccctgcctc

SEQ ID NO: 5435 - DNA, 20 bp, Artificial Sequence
  chemically synthesized
cctcaggccctcatctccac

SEQ ID NO: 5436 - DNA, 20 bp, Artificial Sequence
  chemically synthesized
aggccctcatctccactggt

SEQ ID NO: 5437 - DNA, 20 bp, Artificial Sequence
  chemically synthesized
ccctcatctccactggtcag

SEQ ID NO: 5438 - DNA, 20 bp, Artificial Sequence
  chemically synthesized
cctcatctccactggtcagc

SEQ ID NO: 5439 - DNA, 20 bp, Artificial Sequence
  chemically synthesized
gtcagcaggtgacctttgcc

SEQ ID NO: 5440 - DNA, 20 bp, Artificial Sequence
  chemically synthesized
gtgacctttgcccagcgccc

SEQ ID NO: 5441 - DNA, 20 bp, Artificial Sequence
  chemically synthesized
tgacctttgcccagcgccct

SEQ ID NO: 5442 - DNA, 20 bp, Artificial Sequence
  chemically synthesized
tgcccagcgccctgggtcct

SEQ ID NO: 5443 - DNA, 20 bp, Artificial Sequence
  chemically synthesized
gtcctcagtgcctgctgccc

SEQ ID NO: 5444 - DNA, 20 bp, Artificial Sequence
  chemically synthesized
cctcagtgcctgctgccctg

SEQ ID NO: 5445 - DNA, 20 bp, Artificial Sequence
  chemically synthesized
gccctggagatgatataaaa

SEQ ID NO: 5446 - DNA, 20 bp, Artificial Sequence
  chemically synthesized
ccctggagatgatataaaac

SEQ ID NO: 5447 - DNA, 20 bp, Artificial Sequence
  chemically synthesized
ggagatgatataaaacaggt

SEQ ID NO: 5448 - DNA, 20 bp, Artificial Sequence
  chemically synthesized
aaccctcctgcctgtctgct

SEQ ID NO: 5449 - DNA, 20 bp, Artificial Sequence
  chemically synthesized
ctgtctgctcagttcatccc

SEQ ID NO: 5450 - DNA, 20 bp, Artificial Sequence
  chemically synthesized
gtctgctcagttcatcccta

SEQ ID NO: 5451 - DNA, 20 bp, Artificial Sequence
  chemically synthesized
tctgctcagttcatccctag

SEQ ID NO: 5452 - DNA, 20 bp, Artificial Sequence
  chemically synthesized
gctcagttcatccctagagg

SEQ ID NO: 5453 - DNA, 20 bp, Artificial Sequence
  chemically synthesized
atccctagaggcagctgctc

SEQ ID NO: 5454 - DNA, 20 bp, Artificial Sequence
  chemically synthesized
tccctagaggcagctgctcc

SEQ ID NO: 5455 - DNA, 20 bp, Artificial Sequence
  chemically synthesized
ctgctccaggtaatgccctc

SEQ ID NO: 5456 - DNA, 20 bp, Artificial Sequence
  chemically synthesized
tgctccaggtaatgccctct

SEQ ID NO: 5457 - DNA, 20 bp, Artificial Sequence
  chemically synthesized
gctccaggtaatgccctctg

SEQ ID NO: 5458 - DNA, 20 bp, Artificial Sequence
  chemically synthesized
tccaggtaatgccctctggg

SEQ ID NO: 5459 - DNA, 20 bp, Artificial Sequence
  chemically synthesized
ccaggtaatgccctctgggg

SEQ ID NO: 5460 - DNA, 20 bp, Artificial Sequence
  chemically synthesized
caggtaatgccctctgggga

SEQ ID NO: 5461 - DNA, 20 bp, Artificial Sequence
  chemically synthesized
aggtaatgccctctggggag

SEQ ID NO: 5462 - DNA, 20 bp, Artificial Sequence
  chemically synthesized
aatgccctctggggagggga

SEQ ID NO: 5463 - DNA, 20 bp, Artificial Sequence
  chemically synthesized
tgccctctggggaggggaaa

SEQ ID NO: 5464 - DNA, 20 bp, Artificial Sequence
  chemically synthesized
gccctctggggaggggaaag

SEQ ID NO: 5465 - DNA, 20 bp, Artificial Sequence
  chemically synthesized
cctctggggaggggaaagag

SEQ ID NO: 5466 - DNA, 20 bp, Artificial Sequence
  chemically synthesized
ctctggggaggggaaagagg

SEQ ID NO: 5467 - DNA, 20 bp, Artificial Sequence
  chemically synthesized
tctggggaggggaaagagga

SEQ ID NO: 5468 - DNA, 20 bp, Artificial Sequence
  chemically synthesized
ctggggaggggaaagaggag

SEQ ID NO: 5469 - DNA, 20 bp, Artificial Sequence
  chemically synthesized
ggggaggggaaagaggaggg

SEQ ID NO: 5470 - DNA, 20 bp, Artificial Sequence
  chemically synthesized
gggaggggaaagaggagggg

SEQ ID NO: 5471 - DNA, 20 bp, Artificial Sequence
  chemically synthesized
gaggggaaagaggaggggag

SEQ ID NO: 5472 - DNA, 20 bp, Artificial Sequence
  chemically synthesized
aggggaaagaggaggggagg

SEQ ID NO: 5473 - DNA, 20 bp, Artificial Sequence
  chemically synthesized
aagaggaggggaggaggatg

SEQ ID NO: 5474 - DNA, 20 bp, Artificial Sequence
  chemically synthesized
gaggaggggaggaggatgaa

SEQ ID NO: 5475 - DNA, 20 bp, Artificial Sequence
  chemically synthesized
aggaggggaggaggatgaag

SEQ ID NO: 5476 - DNA, 20 bp, Artificial Sequence
  chemically synthesized
ggaggggaggaggatgaaga

SEQ ID NO: 5477 - DNA, 20 bp, Artificial Sequence
  chemically synthesized
gaggggaggaggatgaagag

SEQ ID NO: 5478 - DNA, 20 bp, Artificial Sequence
  chemically synthesized
ggaggaggatgaagaggggc

SEQ ID NO: 5479 - DNA, 20 bp, Artificial Sequence
  chemically synthesized
aggaggatgaagaggggcaa

SEQ ID NO: 5480 - DNA, 20 bp, Artificial Sequence
  chemically synthesized
ggaggatgaagaggggcaag

SEQ ID NO: 5481 - DNA, 20 bp, Artificial Sequence
  chemically synthesized
aggatgaagaggggcaagag

SEQ ID NO: 5482 - DNA, 20 bp, Artificial Sequence
  chemically synthesized
ggcaagaggagctccctgcc

SEQ ID NO: 5483 - DNA, 20 bp, Artificial Sequence
  chemically synthesized
gaggagctccctgcccagcc

SEQ ID NO: 5484 - DNA, 20 bp, Artificial Sequence
  chemically synthesized
agctccctgcccagcccagc

SEQ ID NO: 5485 - DNA, 20 bp, Artificial Sequence
  chemically synthesized
ccctgcccagcccagccagc

SEQ ID NO: 5486 - DNA, 20 bp, Artificial Sequence
  chemically synthesized
cccagcccagccagcaagcc

SEQ ID NO: 5487 - DNA, 20 bp, Artificial Sequence
  chemically synthesized
cagcccagccagcaagcctg

SEQ ID NO: 5488 - DNA, 20 bp, Artificial Sequence
  chemically synthesized
cccagccagcaagcctggag

SEQ ID NO: 5489 - DNA, 20 bp, Artificial Sequence
  chemically synthesized
aagcctggagaagcacttgc

SEQ ID NO: 5490 - DNA, 20 bp, Artificial Sequence
  chemically synthesized
gcctggagaagcacttgcta

SEQ ID NO: 5491 - DNA, 20 bp, Artificial Sequence
  chemically synthesized
gagaagcacttgctagagct

SEQ ID NO: 5492 - DNA, 20 bp, Artificial Sequence
  chemically synthesized
agaagcacttgctagagcta

SEQ ID NO: 5493 - DNA, 20 bp, Artificial Sequence
  chemically synthesized
agcacttgctagagctaagg

SEQ ID NO: 5494 - DNA, 20 bp, Artificial Sequence
  chemically synthesized
tgctagagctaaggaagcct

SEQ ID NO: 5495 - DNA, 20 bp, Artificial Sequence
  chemically synthesized
ctagagctaaggaagcctcg

SEQ ID NO: 5496 - DNA, 20 bp, Artificial Sequence
  chemically synthesized
agctaaggaagcctcggagc

SEQ ID NO: 5497 - DNA, 20 bp, Artificial Sequence
  chemically synthesized
aaggaagcctcggagctgga

SEQ ID NO: 5498 - DNA, 20 bp, Artificial Sequence
  chemically synthesized
aggaagcctcggagctggac

SEQ ID NO: 5499 - DNA, 20 bp, Artificial Sequence
  chemically synthesized
ccacccctcatcataacctg

SEQ ID NO: 5500 - DNA, 20 bp, Artificial Sequence
  chemically synthesized
tcatcataacctgaagaaca

SEQ ID NO: 5501 - DNA, 20 bp, Artificial Sequence
  chemically synthesized
atcataacctgaagaacatg

SEQ ID NO: 5502 - DNA, 20 bp, Artificial Sequence
  chemically synthesized
tcataacctgaagaacatgg

SEQ ID NO: 5503 - DNA, 20 bp, Artificial Sequence
  chemically synthesized
acctgaagaacatggaggcc

SEQ ID NO: 5504 - DNA, 20 bp, Artificial Sequence
  chemically synthesized
cctgaagaacatggaggccc

SEQ ID NO: 5505 - DNA, 20 bp, Artificial Sequence
  chemically synthesized
tgaagaacatggaggcccgg

SEQ ID NO: 5506 - DNA, 20 bp, Artificial Sequence
  chemically synthesized
gaagaacatggaggcccggg

SEQ ID NO: 5507 - DNA, 20 bp, Artificial Sequence
  chemically synthesized
aagaacatggaggcccggga

SEQ ID NO: 5508 - DNA, 20 bp, Artificial Sequence
  chemically synthesized
agaacatggaggcccgggag

SEQ ID NO: 5509 - DNA, 20 bp, Artificial Sequence
  chemically synthesized
ggaggggtgtcacttgccca

SEQ ID NO: 5510 - DNA, 20 bp, Artificial Sequence
  chemically synthesized
gtcacttgcccaaagctaca

SEQ ID NO: 5511 - DNA, 20 bp, Artificial Sequence
  chemically synthesized
tcacttgcccaaagctacac

SEQ ID NO: 5512 - DNA, 20 bp, Artificial Sequence
  chemically synthesized
cacttgcccaaagctacaca

SEQ ID NO: 5513 - DNA, 20 bp, Artificial Sequence
  chemically synthesized
acttgcccaaagctacacag

SEQ ID NO: 5514 - DNA, 20 bp, Artificial Sequence
  chemically synthesized
cttgcccaaagctacacagg

SEQ ID NO: 5515 - DNA, 20 bp, Artificial Sequence
  chemically synthesized
gcccaaagctacacaggggg

SEQ ID NO: 5516 - DNA, 20 bp, Artificial Sequence
  chemically synthesized
cccaaagctacacagggggt

SEQ ID NO: 5517 - DNA, 20 bp, Artificial Sequence
  chemically synthesized
ccaaagctacacagggggtg

SEQ ID NO: 5518 - DNA, 20 bp, Artificial Sequence
  chemically synthesized
agctacacagggggtggggc

SEQ ID NO: 5519 - DNA, 20 bp, Artificial Sequence
  chemically synthesized
tacacagggggtggggctgg

SEQ ID NO: 5520 - DNA, 20 bp, Artificial Sequence
  chemically synthesized
acagggggtggggctggaag

SEQ ID NO: 5521 - DNA, 20 bp, Artificial Sequence
  chemically synthesized
gtggggctggaagtggctcc

SEQ ID NO: 5522 - DNA, 20 bp, Artificial Sequence
  chemically synthesized
gctggaagtggctccaagtg

SEQ ID NO: 5523 - DNA, 20 bp, Artificial Sequence
  chemically synthesized
ctggaagtggctccaagtgc

SEQ ID NO: 5524 - DNA, 20 bp, Artificial Sequence
  chemically synthesized
caggttcccccctcattctt

SEQ ID NO: 5525 - DNA, 20 bp, Artificial Sequence
  chemically synthesized
aggttcccccctcattcttc

SEQ ID NO: 5526 - DNA, 20 bp, Artificial Sequence
  chemically synthesized
cccccctcattcttcaggct

SEQ ID NO: 5527 - DNA, 20 bp, Artificial Sequence
  chemically synthesized
ccccctcattcttcaggctt

SEQ ID NO: 5528 - DNA, 20 bp, Artificial Sequence
  chemically synthesized
cccctcattcttcaggctta

SEQ ID NO: 5529 - DNA, 20 bp, Artificial Sequence
  chemically synthesized
tcattcttcaggcttagggc

SEQ ID NO: 5530 - DNA, 20 bp, Artificial Sequence
  chemically synthesized
attcttcaggcttagggctg

SEQ ID NO: 5531 - DNA, 20 bp, Artificial Sequence
  chemically synthesized
ttcttcaggcttagggctgg

SEQ ID NO: 5532 - DNA, 20 bp, Artificial Sequence
  chemically synthesized
ttcaggcttagggctggagg

SEQ ID NO: 5533 - DNA, 20 bp, Artificial Sequence
  chemically synthesized
cttagggctggaggaagcct

SEQ ID NO: 5534 - DNA, 20 bp, Artificial Sequence
  chemically synthesized
gggctggaggaagccttaga

SEQ ID NO: 5535 - DNA, 20 bp, Artificial Sequence
  chemically synthesized
ggaggaagccttagacagcc

SEQ ID NO: 5536 - DNA, 20 bp, Artificial Sequence
  chemically synthesized
tagacagcccagtcctaccc

SEQ ID NO: 5537 - DNA, 20 bp, Artificial Sequence
  chemically synthesized
cagcccagtcctaccccaga

SEQ ID NO: 5538 - DNA, 20 bp, Artificial Sequence
  chemically synthesized
agcccagtcctaccccagac

SEQ ID NO: 5539 - DNA, 20 bp, Artificial Sequence
  chemically synthesized
gcccagtcctaccccagaca

SEQ ID NO: 5540 - DNA, 20 bp, Artificial Sequence
  chemically synthesized
ctaccccagacagggaaact

SEQ ID NO: 5541 - DNA, 20 bp, Artificial Sequence
  chemically synthesized
taccccagacagggaaactg

SEQ ID NO: 5542 - DNA, 20 bp, Artificial Sequence
  chemically synthesized
cagacagggaaactgaggcc

SEQ ID NO: 5543 - DNA, 20 bp, Artificial Sequence
  chemically synthesized
gacagggaaactgaggcctg

SEQ ID NO: 5544 - DNA, 20 bp, Artificial Sequence
  chemically synthesized
cagggaaactgaggcctgga

SEQ ID NO: 5545 - DNA, 20 bp, Artificial Sequence
  chemically synthesized
agggaaactgaggcctggag

SEQ ID NO: 5546 - DNA, 20 bp, Artificial Sequence
  chemically synthesized
gggaaactgaggcctggaga

SEQ ID NO: 5547 - DNA, 20 bp, Artificial Sequence
  chemically synthesized
aactgaggcctggagagggc

SEQ ID NO: 5548 - DNA, 20 bp, Artificial Sequence
  chemically synthesized
agagggccagaaatcaccca

SEQ ID NO: 5549 - DNA, 20 bp, Artificial Sequence
  chemically synthesized
agaaatcacccaaagacaca

SEQ ID NO: 5550 - DNA, 20 bp, Artificial Sequence
  chemically synthesized
cccaaagacacacagcatgt

SEQ ID NO: 5551 - DNA, 20 bp, Artificial Sequence
  chemically synthesized
aagacacacagcatgttggc

SEQ ID NO: 5552 - DNA, 20 bp, Artificial Sequence
  chemically synthesized
acacagcatgttggctggac

SEQ ID NO: 5553 - DNA, 20 bp, Artificial Sequence
  chemically synthesized
agcatgttggctggactgga

SEQ ID NO: 5554 - DNA, 20 bp, Artificial Sequence
  chemically synthesized
catgttggctggactggacg

SEQ ID NO: 5555 - DNA, 20 bp, Artificial Sequence
  chemically synthesized
tggctggactggacggagat

SEQ ID NO: 5556 - DNA, 20 bp, Artificial Sequence
  chemically synthesized
ggactggacggagatcagtc

SEQ ID NO: 5557 - DNA, 20 bp, Artificial Sequence
  chemically synthesized
acggagatcagtccagaccg

SEQ ID NO: 5558 - DNA, 20 bp, Artificial Sequence
  chemically synthesized
cggagatcagtccagaccgc

SEQ ID NO: 5559 - DNA, 20 bp, Artificial Sequence
  chemically synthesized
accgcaggtgccttgatgtt

SEQ ID NO: 5560 - DNA, 20 bp, Artificial Sequence
  chemically synthesized
aggtgccttgatgttcagtc

SEQ ID NO: 5561 - DNA, 20 bp, Artificial Sequence
  chemically synthesized
tgccttgatgttcagtctgg

SEQ ID NO: 5562 - DNA, 20 bp, Artificial Sequence
  chemically synthesized
gccttgatgttcagtctggt

SEQ ID NO: 5563 - DNA, 20 bp, Artificial Sequence
  chemically synthesized
ccatcccacccacctccctt

SEQ ID NO: 5564 - DNA, 20 bp, Artificial Sequence
  chemically synthesized
catcccacccacctcccttt

SEQ ID NO: 5565 - DNA, 20 bp, Artificial Sequence
  chemically synthesized
ctcgatccctcgcccctcac

SEQ ID NO: 5566 - DNA, 20 bp, Artificial Sequence
  chemically synthesized
ccctcaccagtcccccttct

SEQ ID NO: 5567 - DNA, 20 bp, Artificial Sequence
  chemically synthesized
ctcaccagtcccccttctga

SEQ ID NO: 5568 - DNA, 20 bp, Artificial Sequence
  chemically synthesized
ccccttctgagagcccgtat

SEQ ID NO: 5569 - DNA, 20 bp, Artificial Sequence
  chemically synthesized
cttctgagagcccgtattag

SEQ ID NO: 5570 - DNA, 20 bp, Artificial Sequence
  chemically synthesized
ttctgagagcccgtattagc

SEQ ID NO: 5571 - DNA, 20 bp, Artificial Sequence
  chemically synthesized
tctgagagcccgtattagca

SEQ ID NO: 5572 - DNA, 20 bp, Artificial Sequence
  chemically synthesized
tgagagcccgtattagcagg

SEQ ID NO: 5573 - DNA, 20 bp, Artificial Sequence
  chemically synthesized
agcccgtattagcagggagc

SEQ ID NO: 5574 - DNA, 20 bp, Artificial Sequence
  chemically synthesized
gagccggcccctactccttc

SEQ ID NO: 5575 - DNA, 20 bp, Artificial Sequence
  chemically synthesized
ccggcccctactccttctgg

SEQ ID NO: 5576 - DNA, 20 bp, Artificial Sequence
  chemically synthesized
cctactccttctggcagacc

SEQ ID NO: 5577 - DNA, 20 bp, Artificial Sequence
  chemically synthesized
tccttctggcagacccagct

SEQ ID NO: 5578 - DNA, 20 bp, Artificial Sequence
  chemically synthesized
ccttctggcagacccagcta

SEQ ID NO: 5579 - DNA, 20 bp, Artificial Sequence
  chemically synthesized
acccagctaaggttctacct

SEQ ID NO: 5580 - DNA, 20 bp, Artificial Sequence
  chemically synthesized
cccagctaaggttctacctt

SEQ ID NO: 5581 - DNA, 20 bp, Artificial Sequence
  chemically synthesized
ccagctaaggttctacctta

SEQ ID NO: 5582 - DNA, 20 bp, Artificial Sequence
  chemically synthesized
cagctaaggttctaccttag

SEQ ID NO: 5583 - DNA, 20 bp, Artificial Sequence
  chemically synthesized
taggggccacgccacctccc

SEQ ID NO: 5584 - DNA, 20 bp, Artificial Sequence
  chemically synthesized
aggggccacgccacctcccc

SEQ ID NO: 5585 - DNA, 20 bp, Artificial Sequence
  chemically synthesized
ggggccacgccacctcccca

SEQ ID NO: 5586 - DNA, 20 bp, Artificial Sequence
  chemically synthesized
ggccacgccacctccccagg

SEQ ID NO: 5587 - DNA, 20 bp, Artificial Sequence
  chemically synthesized
gccacgccacctccccaggg

SEQ ID NO: 5588 - DNA, 20 bp, Artificial Sequence
  chemically synthesized
ccacgccacctccccaggga

SEQ ID NO: 5589 - DNA, 20 bp, Artificial Sequence
  chemically synthesized
cacgccacctccccagggag

SEQ ID NO: 5590 - DNA, 20 bp, Artificial Sequence
  chemically synthesized
cacctccccagggaggggtc

SEQ ID NO: 5591 - DNA, 20 bp, Artificial Sequence
  chemically synthesized
cctccccagggaggggtcca

SEQ ID NO: 5592 - DNA, 20 bp, Artificial Sequence
  chemically synthesized
ctccccagggaggggtccag

SEQ ID NO: 5593 - DNA, 20 bp, Artificial Sequence
  chemically synthesized
cagggaggggtccagaggca

SEQ ID NO: 5594 - DNA, 20 bp, Artificial Sequence
  chemically synthesized
agggaggggtccagaggcat

SEQ ID NO: 5595 - DNA, 20 bp, Artificial Sequence
  chemically synthesized
gggaggggtccagaggcatg

SEQ ID NO: 5596 - DNA, 20 bp, Artificial Sequence
  chemically synthesized
ggtccagaggcatggggacc

SEQ ID NO: 5597 - DNA, 20 bp, Artificial Sequence
  chemically synthesized
gtccagaggcatggggacct

SEQ ID NO: 5598 - DNA, 20 bp, Artificial Sequence
  chemically synthesized
tccagaggcatggggacctg

SEQ ID NO: 5599 - DNA, 20 bp, Artificial Sequence
  chemically synthesized
gggacctggggtgcccctca

SEQ ID NO: 5600 - DNA, 20 bp, Artificial Sequence
  chemically synthesized
ggacctggggtgcccctcac

SEQ ID NO: 5601 - DNA, 20 bp, Artificial Sequence
  chemically synthesized
cctcacaggacacttccttg

SEQ ID NO: 5602 - DNA, 20 bp, Artificial Sequence
  chemically synthesized
ctcacaggacacttccttgc

SEQ ID NO: 5603 - DNA, 20 bp, Artificial Sequence
  chemically synthesized
aggacacttccttgcaggaa

SEQ ID NO: 5604 - DNA, 20 bp, Artificial Sequence
  chemically synthesized
gacacttccttgcaggaaca

SEQ ID NO: 5605 - DNA, 20 bp, Artificial Sequence
  chemically synthesized
acacttccttgcaggaacag

SEQ ID NO: 5606 - DNA, 20 bp, Artificial Sequence
  chemically synthesized
gcaggaacagaggtgccatg

SEQ ID NO: 5607 - DNA, 20 bp, Artificial Sequence
  chemically synthesized
acagaggtgccatgcagccc

SEQ ID NO: 5608 - DNA, 20 bp, Artificial Sequence
  chemically synthesized
cagaggtgccatgcagcccc

SEQ ID NO: 5609 - DNA, 20 bp, Artificial Sequence
  chemically synthesized
actccttgttgttgccctcc

SEQ ID NO: 5610 - DNA, 20 bp, Artificial Sequence
  chemically synthesized
tgttgccctcctggcgctcc

SEQ ID NO: 5611 - DNA, 20 bp, Artificial Sequence
  chemically synthesized
cgctcctggcctctgcccgt

SEQ ID NO: 5612 - DNA, 20 bp, Artificial Sequence
  chemically synthesized
ggcctctgcccgtaagcact

SEQ ID NO: 5613 - DNA, 20 bp, Artificial Sequence
  chemically synthesized
ctctgcccgtaagcacttgg

SEQ ID NO: 5614 - DNA, 20 bp, Artificial Sequence
  chemically synthesized
tctgcccgtaagcacttggt

SEQ ID NO: 5615 - DNA, 20 bp, Artificial Sequence
  chemically synthesized
ccgtaagcacttggtgggac

SEQ ID NO: 5616 - DNA, 20 bp, Artificial Sequence
  chemically synthesized
cgtaagcacttggtgggact

SEQ ID NO: 5617 - DNA, 20 bp, Artificial Sequence
  chemically synthesized
agcacttggtgggactgggc

SEQ ID NO: 5618 - DNA, 20 bp, Artificial Sequence
  chemically synthesized
gcacttggtgggactgggct

SEQ ID NO: 5619 - DNA, 20 bp, Artificial Sequence
  chemically synthesized
cacttggtgggactgggctg

SEQ ID NO: 5620 - DNA, 20 bp, Artificial Sequence
  chemically synthesized
acttggtgggactgggctgg

SEQ ID NO: 5621 - DNA, 20 bp, Artificial Sequence
  chemically synthesized
tggtgggactgggctggggg

SEQ ID NO: 5622 - DNA, 20 bp, Artificial Sequence
  chemically synthesized
ggtgggactgggctgggggc

SEQ ID NO: 5623 - DNA, 20 bp, Artificial Sequence
  chemically synthesized
gtgggactgggctgggggca

SEQ ID NO: 5624 - DNA, 20 bp, Artificial Sequence
  chemically synthesized
gcccccagcccagtcccacc

SEQ ID NO: 5625 - DNA, 20 bp, Artificial Sequence
  chemically synthesized
ccagtcccaccaagtgctta

SEQ ID NO: 5626 - DNA, 20 bp, Artificial Sequence
  chemically synthesized
cagtcccaccaagtgcttac

SEQ ID NO: 5627 - DNA, 20 bp, Artificial Sequence
  chemically synthesized
tcccaccaagtgcttacggg

SEQ ID NO: 5628 - DNA, 20 bp, Artificial Sequence
  chemically synthesized
ccaccaagtgcttacgggca

SEQ ID NO: 5629 - DNA, 20 bp, Artificial Sequence
  chemically synthesized
caccaagtgcttacgggcag

SEQ ID NO: 5630 - DNA, 20 bp, Artificial Sequence
  chemically synthesized
aagtgcttacgggcagaggc

SEQ ID NO: 5631 - DNA, 20 bp, Artificial Sequence
  chemically synthesized
agtgcttacgggcagaggcc

SEQ ID NO: 5632 - DNA, 20 bp, Artificial Sequence
  chemically synthesized
tgcttacgggcagaggccag

SEQ ID NO: 5633 - DNA, 20 bp, Artificial Sequence
  chemically synthesized
cgggcagaggccaggagcgc

SEQ ID NO: 5634 - DNA, 20 bp, Artificial Sequence
  chemically synthesized
gggcagaggccaggagcgcc

SEQ ID NO: 5635 - DNA, 20 bp, Artificial Sequence
  chemically synthesized
gcagaggccaggagcgccag

SEQ ID NO: 5636 - DNA, 20 bp, Artificial Sequence
  chemically synthesized
cagaggccaggagcgccagg

SEQ ID NO: 5637 - DNA, 20 bp, Artificial Sequence
  chemically synthesized
agaggccaggagcgccagga

SEQ ID NO: 5638 - DNA, 20 bp, Artificial Sequence
  chemically synthesized
agcgccaggagggcaacaac

SEQ ID NO: 5639 - DNA, 20 bp, Artificial Sequence
  chemically synthesized
gcgccaggagggcaacaaca

SEQ ID NO: 5640 - DNA, 20 bp, Artificial Sequence
  chemically synthesized
gccaggagggcaacaacaag

SEQ ID NO: 5641 - DNA, 20 bp, Artificial Sequence
  chemically synthesized
gggcaacaacaaggagtacc

SEQ ID NO: 5642 - DNA, 20 bp, Artificial Sequence
  chemically synthesized
ggcaacaacaaggagtaccc

SEQ ID NO: 5643 - DNA, 20 bp, Artificial Sequence
  chemically synthesized
gcaacaacaaggagtacccg

SEQ ID NO: 5644 - DNA, 20 bp, Artificial Sequence
  chemically synthesized
aaggagtacccggggctgca

SEQ ID NO: 5645 - DNA, 20 bp, Artificial Sequence
  chemically synthesized
catggcacctctgttcctgc

SEQ ID NO: 5646 - DNA, 20 bp, Artificial Sequence
  chemically synthesized
atggcacctctgttcctgca

SEQ ID NO: 5647 - DNA, 20 bp, Artificial Sequence
  chemically synthesized
gcacctctgttcctgcaagg

SEQ ID NO: 5648 - DNA, 20 bp, Artificial Sequence
  chemically synthesized
cctgcaaggaagtgtcctgt

SEQ ID NO: 5649 - DNA, 20 bp, Artificial Sequence
  chemically synthesized
ctgcaaggaagtgtcctgtg

SEQ ID NO: 5650 - DNA, 20 bp, Artificial Sequence
  chemically synthesized
tgcaaggaagtgtcctgtga

SEQ ID NO: 5651 - DNA, 20 bp, Artificial Sequence
  chemically synthesized
gcaaggaagtgtcctgtgag

SEQ ID NO: 5652 - DNA, 20 bp, Artificial Sequence
  chemically synthesized
gtgtcctgtgaggggcaccc

SEQ ID NO: 5653 - DNA, 20 bp, Artificial Sequence
  chemically synthesized
tgtcctgtgaggggcacccc

SEQ ID NO: 5654 - DNA, 20 bp, Artificial Sequence
  chemically synthesized
accccaggtccccatgcctc

SEQ ID NO: 5655 - DNA, 20 bp, Artificial Sequence
  chemically synthesized
catgcctctggacccctccc

SEQ ID NO: 5656 - DNA, 20 bp, Artificial Sequence
  chemically synthesized
atgcctctggacccctccct

SEQ ID NO: 5657 - DNA, 20 bp, Artificial Sequence
  chemically synthesized
tgcctctggacccctccctg

SEQ ID NO: 5658 - DNA, 20 bp, Artificial Sequence
  chemically synthesized
cctctggacccctccctggg

SEQ ID NO: 5659 - DNA, 20 bp, Artificial Sequence
  chemically synthesized
ctctggacccctccctgggg

SEQ ID NO: 5660 - DNA, 20 bp, Artificial Sequence
  chemically synthesized
tggacccctccctggggagg

SEQ ID NO: 5661 - DNA, 20 bp, Artificial Sequence
  chemically synthesized
ccctccctggggaggtggcg

SEQ ID NO: 5662 - DNA, 20 bp, Artificial Sequence
  chemically synthesized
ggggaggtggcgtggcccct

SEQ ID NO: 5663 - DNA, 20 bp, Artificial Sequence
  chemically synthesized
gggaggtggcgtggccccta

SEQ ID NO: 5664 - DNA, 20 bp, Artificial Sequence
  chemically synthesized
aggtggcgtggcccctaagg

SEQ ID NO: 5665 - DNA, 20 bp, Artificial Sequence
  chemically synthesized
tggcccctaaggtagaacct

SEQ ID NO: 5666 - DNA, 20 bp, Artificial Sequence
  chemically synthesized
ccctaaggtagaaccttagc

SEQ ID NO: 5667 - DNA, 20 bp, Artificial Sequence
  chemically synthesized
cctaaggtagaaccttagct

SEQ ID NO: 5668 - DNA, 20 bp, Artificial Sequence
  chemically synthesized
agaaccttagctgggtctgc

SEQ ID NO: 5669 - DNA, 20 bp, Artificial Sequence
  chemically synthesized
accttagctgggtctgccag

SEQ ID NO: 5670 - DNA, 20 bp, Artificial Sequence
  chemically synthesized
ccttagctgggtctgccaga

SEQ ID NO: 5671 - DNA, 20 bp, Artificial Sequence
  chemically synthesized
ttagctgggtctgccagaag

SEQ ID NO: 5672 - DNA, 20 bp, Artificial Sequence
  chemically synthesized
gctgggtctgccagaaggag

SEQ ID NO: 5673 - DNA, 20 bp, Artificial Sequence
  chemically synthesized
ctgggtctgccagaaggagt

SEQ ID NO: 5674 - DNA, 20 bp, Artificial Sequence
  chemically synthesized
tgggtctgccagaaggagta

SEQ ID NO: 5675 - DNA, 20 bp, Artificial Sequence
  chemically synthesized
gggtctgccagaaggagtag

SEQ ID NO: 5676 - DNA, 20 bp, Artificial Sequence
  chemically synthesized
ctgccagaaggagtaggggc

SEQ ID NO: 5677 - DNA, 20 bp, Artificial Sequence
  chemically synthesized
gggccggctccctgctaata

SEQ ID NO: 5678 - DNA, 20 bp, Artificial Sequence
  chemically synthesized
ggccggctccctgctaatac

SEQ ID NO: 5679 - DNA, 20 bp, Artificial Sequence
  chemically synthesized
tccctgctaatacgggctct

SEQ ID NO: 5680 - DNA, 20 bp, Artificial Sequence
  chemically synthesized
ctgctaatacgggctctcag

SEQ ID NO: 5681 - DNA, 20 bp, Artificial Sequence
  chemically synthesized
tgctaatacgggctctcaga

SEQ ID NO: 5682 - DNA, 20 bp, Artificial Sequence
  chemically synthesized
gctaatacgggctctcagaa

SEQ ID NO: 5683 - DNA, 20 bp, Artificial Sequence
  chemically synthesized
ctaatacgggctctcagaag

SEQ ID NO: 5684 - DNA, 20 bp, Artificial Sequence
  chemically synthesized
taatacgggctctcagaagg

SEQ ID NO: 5685 - DNA, 20 bp, Artificial Sequence
  chemically synthesized
cgggctctcagaagggggac

SEQ ID NO: 5686 - DNA, 20 bp, Artificial Sequence
  chemically synthesized
ctctcagaagggggactggt

SEQ ID NO: 5687 - DNA, 20 bp, Artificial Sequence
  chemically synthesized
tctcagaagggggactggtg

SEQ ID NO: 5688 - DNA, 20 bp, Artificial Sequence
  chemically synthesized
ctcagaagggggactggtga

SEQ ID NO: 5689 - DNA, 20 bp, Artificial Sequence
  chemically synthesized
tcagaagggggactggtgag

SEQ ID NO: 5690 - DNA, 20 bp, Artificial Sequence
  chemically synthesized
aagggggactggtgaggggc

SEQ ID NO: 5691 - DNA, 20 bp, Artificial Sequence
  chemically synthesized
agggggactggtgaggggcg

SEQ ID NO: 5692 - DNA, 20 bp, Artificial Sequence
  chemically synthesized
gggggactggtgaggggcga

SEQ ID NO: 5693 - DNA, 20 bp, Artificial Sequence
  chemically synthesized
ctggtgaggggcgagggatc

SEQ ID NO: 5694 - DNA, 20 bp, Artificial Sequence
  chemically synthesized
tggtgaggggcgagggatcg

SEQ ID NO: 5695 - DNA, 20 bp, Artificial Sequence
  chemically synthesized
gggcgagggatcgaggccca

SEQ ID NO: 5696 - DNA, 20 bp, Artificial Sequence
  chemically synthesized
ggcgagggatcgaggcccaa

SEQ ID NO: 5697 - DNA, 20 bp, Artificial Sequence
  chemically synthesized
gcgagggatcgaggcccaaa

SEQ ID NO: 5698 - DNA, 20 bp, Artificial Sequence
  chemically synthesized
gagggatcgaggcccaaagg

SEQ ID NO: 5699 - DNA, 20 bp, Artificial Sequence
  chemically synthesized
agggatcgaggcccaaaggg

SEQ ID NO: 5700 - DNA, 20 bp, Artificial Sequence
  chemically synthesized
gatcgaggcccaaagggagg

SEQ ID NO: 5701 - DNA, 20 bp, Artificial Sequence
  chemically synthesized
atcgaggcccaaagggaggt

SEQ ID NO: 5702 - DNA, 20 bp, Artificial Sequence
  chemically synthesized
gaggcccaaagggaggtggg

SEQ ID NO: 5703 - DNA, 20 bp, Artificial Sequence
  chemically synthesized
aggcccaaagggaggtgggt

SEQ ID NO: 5704 - DNA, 20 bp, Artificial Sequence
  chemically synthesized
ccaaagggaggtgggtggga

SEQ ID NO: 5705 - DNA, 20 bp, Artificial Sequence
  chemically synthesized
aaagggaggtgggtgggatg

SEQ ID NO: 5706 - DNA, 20 bp, Artificial Sequence
  chemically synthesized
gggaggtgggtgggatggag

SEQ ID NO: 5707 - DNA, 20 bp, Artificial Sequence
  chemically synthesized
ggatggagcagaaaacccac

SEQ ID NO: 5708 - DNA, 20 bp, Artificial Sequence
  chemically synthesized
aacccaccagactgaacatc

SEQ ID NO: 5709 - DNA, 20 bp, Artificial Sequence
  chemically synthesized
acccaccagactgaacatca

SEQ ID NO: 5710 - DNA, 20 bp, Artificial Sequence
  chemically synthesized
actgaacatcaaggcacctg

SEQ ID NO: 5711 - DNA, 20 bp, Artificial Sequence
  chemically synthesized
acatcaaggcacctgcggtc

SEQ ID NO: 5712 - DNA, 20 bp, Artificial Sequence
  chemically synthesized
ggtctggactgatctccgtc

SEQ ID NO: 5713 - DNA, 20 bp, Artificial Sequence
  chemically synthesized
ggactgatctccgtccagtc

SEQ ID NO: 5714 - DNA, 20 bp, Artificial Sequence
  chemically synthesized
gccaacatgctgtgtgtctt

SEQ ID NO: 5715 - DNA, 20 bp, Artificial Sequence
  chemically synthesized
ccaacatgctgtgtgtcttt

SEQ ID NO: 5716 - DNA, 20 bp, Artificial Sequence
  chemically synthesized
gtgtgtctttgggtgatttc

SEQ ID NO: 5717 - DNA, 20 bp, Artificial Sequence
  chemically synthesized
gggtgatttctggccctctc

SEQ ID NO: 5718 - DNA, 20 bp, Artificial Sequence
  chemically synthesized
ggtgatttctggccctctcc

SEQ ID NO: 5719 - DNA, 20 bp, Artificial Sequence
  chemically synthesized
ttctggccctctccaggcct

SEQ ID NO: 5720 - DNA, 20 bp, Artificial Sequence
  chemically synthesized
caggcctcagtttccctgtc

SEQ ID NO: 5721 - DNA, 20 bp, Artificial Sequence
  chemically synthesized
aggcctcagtttccctgtct

SEQ ID NO: 5722 - DNA, 20 bp, Artificial Sequence
  chemically synthesized
ggcctcagtttccctgtctg

SEQ ID NO: 5723 - DNA, 20 bp, Artificial Sequence
  chemically synthesized
ctcagtttccctgtctgggg

SEQ ID NO: 5724 - DNA, 20 bp, Artificial Sequence
  chemically synthesized
tcagtttccctgtctggggt

SEQ ID NO: 5725 - DNA, 20 bp, Artificial Sequence
  chemically synthesized
ttccctgtctggggtaggac

SEQ ID NO: 5726 - DNA, 20 bp, Artificial Sequence
  chemically synthesized
tccctgtctggggtaggact

SEQ ID NO: 5727 - DNA, 20 bp, Artificial Sequence
  chemically synthesized
ggggtaggactgggctgtct

SEQ ID NO: 5728 - DNA, 20 bp, Artificial Sequence
  chemically synthesized
gggtaggactgggctgtcta

SEQ ID NO: 5729 - DNA, 20 bp, Artificial Sequence
  chemically synthesized
gggctgtctaaggcttcctc

SEQ ID NO: 5730 - DNA, 20 bp, Artificial Sequence
  chemically synthesized
ctaaggcttcctccagccct

SEQ ID NO: 5731 - DNA, 20 bp, Artificial Sequence
  chemically synthesized
ttcctccagccctaagcctg

SEQ ID NO: 5732 - DNA, 20 bp, Artificial Sequence
  chemically synthesized
cagccctaagcctgaagaat

SEQ ID NO: 5733 - DNA, 20 bp, Artificial Sequence
  chemically synthesized
agccctaagcctgaagaatg

SEQ ID NO: 5734 - DNA, 20 bp, Artificial Sequence
  chemically synthesized
gccctaagcctgaagaatga

SEQ ID NO: 5735 - DNA, 20 bp, Artificial Sequence
  chemically synthesized
ccctaagcctgaagaatgag

SEQ ID NO: 5736 - DNA, 20 bp, Artificial Sequence
  chemically synthesized
cctaagcctgaagaatgagg

SEQ ID NO: 5737 - DNA, 20 bp, Artificial Sequence
  chemically synthesized
ctaagcctgaagaatgaggg

SEQ ID NO: 5738 - DNA, 20 bp, Artificial Sequence
  chemically synthesized
atgaggggggaacctgcact

SEQ ID NO: 5739 - DNA, 20 bp, Artificial Sequence
  chemically synthesized
gaggggggaacctgcacttg

SEQ ID NO: 5740 - DNA, 20 bp, Artificial Sequence
  chemically synthesized
cctgcacttggagccacttc

SEQ ID NO: 5741 - DNA, 20 bp, Artificial Sequence
  chemically synthesized
ttccagccccaccccctgtg

SEQ ID NO: 5742 - DNA, 20 bp, Artificial Sequence
  chemically synthesized
ccccaccccctgtgtagctt

SEQ ID NO: 5743 - DNA, 20 bp, Artificial Sequence
  chemically synthesized
cccaccccctgtgtagcttt

SEQ ID NO: 5744 - DNA, 20 bp, Artificial Sequence
  chemically synthesized
ccccctgtgtagctttgggc

SEQ ID NO: 5745 - DNA, 20 bp, Artificial Sequence
  chemically synthesized
tgggcaagtgacacccctcc

SEQ ID NO: 5746 - DNA, 20 bp, Artificial Sequence
  chemically synthesized
gggcaagtgacacccctccc

SEQ ID NO: 5747 - DNA, 20 bp, Artificial Sequence
  chemically synthesized
tcccgggcctccatgttctt

SEQ ID NO: 5748 - DNA, 20 bp, Artificial Sequence
  chemically synthesized
cccgggcctccatgttcttc

SEQ ID NO: 5749 - DNA, 20 bp, Artificial Sequence
  chemically synthesized
catgttcttcaggttatgat

SEQ ID NO: 5750 - DNA, 20 bp, Artificial Sequence
  chemically synthesized
atgttcttcaggttatgatg

SEQ ID NO: 5751 - DNA, 20 bp, Artificial Sequence
  chemically synthesized
tgttcttcaggttatgatga

SEQ ID NO: 5752 - DNA, 20 bp, Artificial Sequence
  chemically synthesized
gttcttcaggttatgatgag

SEQ ID NO: 5753 - DNA, 20 bp, Artificial Sequence
  chemically synthesized
cttcaggttatgatgagggg

SEQ ID NO: 5754 - DNA, 20 bp, Artificial Sequence
  chemically synthesized
ttcaggttatgatgaggggt

SEQ ID NO: 5755 - DNA, 20 bp, Artificial Sequence
  chemically synthesized
tcaggttatgatgaggggtg

SEQ ID NO: 5756 - DNA, 20 bp, Artificial Sequence
  chemically synthesized
caggttatgatgaggggtgg

SEQ ID NO: 5757 - DNA, 20 bp, Artificial Sequence
  chemically synthesized
aggttatgatgaggggtggg

SEQ ID NO: 5758 - DNA, 20 bp, Artificial Sequence
  chemically synthesized
aggggtggggggcacccgtc

SEQ ID NO: 5759 - DNA, 20 bp, Artificial Sequence
  chemically synthesized
gggggcacccgtccagctcc

SEQ ID NO: 5760 - DNA, 20 bp, Artificial Sequence
  chemically synthesized
ggggcacccgtccagctccg

SEQ ID NO: 5761 - DNA, 20 bp, Artificial Sequence
  chemically synthesized
gtccagctccgaggcttcct

SEQ ID NO: 5762 - DNA, 20 bp, Artificial Sequence
  chemically synthesized
ctccgaggcttccttagctc

SEQ ID NO: 5763 - DNA, 20 bp, Artificial Sequence
  chemically synthesized
gaggcttccttagctctagc

SEQ ID NO: 5764 - DNA, 20 bp, Artificial Sequence
  chemically synthesized
agctctagcaagtgcttctc

SEQ ID NO: 5765 - DNA, 20 bp, Artificial Sequence
  chemically synthesized
gctctagcaagtgcttctcc

SEQ ID NO: 5766 - DNA, 20 bp, Artificial Sequence
  chemically synthesized
aagtgcttctccaggcttgc

SEQ ID NO: 5767 - DNA, 20 bp, Artificial Sequence
  chemically synthesized
gcttctccaggcttgctggc

SEQ ID NO: 5768 - DNA, 20 bp, Artificial Sequence
  chemically synthesized
cttctccaggcttgctggct

SEQ ID NO: 5769 - DNA, 20 bp, Artificial Sequence
  chemically synthesized
tccaggcttgctggctgggc

SEQ ID NO: 5770 - DNA, 20 bp, Artificial Sequence
  chemically synthesized
ccaggcttgctggctgggct

SEQ ID NO: 5771 - DNA, 20 bp, Artificial Sequence
  chemically synthesized
ggcttgctggctgggctggg

SEQ ID NO: 5772 - DNA, 20 bp, Artificial Sequence
  chemically synthesized
gcttgctggctgggctgggc

SEQ ID NO: 5773 - DNA, 20 bp, Artificial Sequence
  chemically synthesized
cttgctggctgggctgggca

SEQ ID NO: 5774 - DNA, 20 bp, Artificial Sequence
  chemically synthesized
tgctggctgggctgggcagg

SEQ ID NO: 5775 - DNA, 20 bp, Artificial Sequence
  chemically synthesized
cccctcctctttcccctccc

SEQ ID NO: 5776 - DNA, 20 bp, Artificial Sequence
  chemically synthesized
cctcctctttcccctcccca

SEQ ID NO: 5777 - DNA, 20 bp, Artificial Sequence
  chemically synthesized
ctcctctttcccctccccag

SEQ ID NO: 5778 - DNA, 20 bp, Artificial Sequence
  chemically synthesized
tcctctttcccctccccaga

SEQ ID NO: 5779 - DNA, 20 bp, Artificial Sequence
  chemically synthesized
cctccccagagggcattacc

SEQ ID NO: 5780 - DNA, 20 bp, Artificial Sequence
  chemically synthesized
tccccagagggcattacctg

SEQ ID NO: 5781 - DNA, 20 bp, Artificial Sequence
  chemically synthesized
ccagagggcattacctggag

SEQ ID NO: 5782 - DNA, 20 bp, Artificial Sequence
  chemically synthesized
ttacctggagcagctgcctc

SEQ ID NO: 5783 - DNA, 20 bp, Artificial Sequence
  chemically synthesized
tacctggagcagctgcctct

SEQ ID NO: 5784 - DNA, 20 bp, Artificial Sequence
  chemically synthesized
acctggagcagctgcctcta

SEQ ID NO: 5785 - DNA, 20 bp, Artificial Sequence
  chemically synthesized
gctgcctctagggatgaact

SEQ ID NO: 5786 - DNA, 20 bp, Artificial Sequence
  chemically synthesized
gcctctagggatgaactgag

SEQ ID NO: 5787 - DNA, 20 bp, Artificial Sequence
  chemically synthesized
ctagggatgaactgagcaga

SEQ ID NO: 5788 - DNA, 20 bp, Artificial Sequence
  chemically synthesized
tagggatgaactgagcagac

SEQ ID NO: 5789 - DNA, 20 bp, Artificial Sequence
  chemically synthesized
ggatgaactgagcagacagg

SEQ ID NO: 5790 - DNA, 20 bp, Artificial Sequence
  chemically synthesized
gatgaactgagcagacaggc

SEQ ID NO: 5791 - DNA, 20 bp, Artificial Sequence
  chemically synthesized
tgaactgagcagacaggcag

SEQ ID NO: 5792 - DNA, 20 bp, Artificial Sequence
  chemically synthesized
gaactgagcagacaggcagg

SEQ ID NO: 5793 - DNA, 20 bp, Artificial Sequence
  chemically synthesized
aactgagcagacaggcagga

SEQ ID NO: 5794 - DNA, 20 bp, Artificial Sequence
  chemically synthesized
gacctgttttatatcatctc

SEQ ID NO: 5795 - DNA, 20 bp, Artificial Sequence
  chemically synthesized
acctgttttatatcatctcc

SEQ ID NO: 5796 - DNA, 20 bp, Artificial Sequence
  chemically synthesized
cctgttttatatcatctcca

SEQ ID NO: 5797 - DNA, 20 bp, Artificial Sequence
  chemically synthesized
gttttatatcatctccaggg

SEQ ID NO: 5798 - DNA, 20 bp, Artificial Sequence
  chemically synthesized
ttatatcatctccagggcag

SEQ ID NO: 5799 - DNA, 20 bp, Artificial Sequence
  chemically synthesized
tatatcatctccagggcagc

SEQ ID NO: 5800 - DNA, 20 bp, Artificial Sequence
  chemically synthesized
tctccagggcagcaggcact

SEQ ID NO: 5801 - DNA, 20 bp, Artificial Sequence
  chemically synthesized
ctccagggcagcaggcactg

SEQ ID NO: 5802 - DNA, 20 bp, Artificial Sequence
  chemically synthesized
ggcagcaggcactgaggacc

SEQ ID NO: 5803 - DNA, 20 bp, Artificial Sequence
  chemically synthesized
gcagcaggcactgaggaccc

SEQ ID NO: 5804 - DNA, 20 bp, Artificial Sequence
  chemically synthesized
cagcaggcactgaggaccca

SEQ ID NO: 5805 - DNA, 20 bp, Artificial Sequence
  chemically synthesized
gcactgaggacccagggcgc

SEQ ID NO: 5806 - DNA, 20 bp, Artificial Sequence
  chemically synthesized
cactgaggacccagggcgct

SEQ ID NO: 5807 - DNA, 20 bp, Artificial Sequence
  chemically synthesized
aggacccagggcgctgggca

SEQ ID NO: 5808 - DNA, 20 bp, Artificial Sequence
  chemically synthesized
ggacccagggcgctgggcaa

SEQ ID NO: 5809 - DNA, 20 bp, Artificial Sequence
  chemically synthesized
ggcaaaggtcacctgctgac

SEQ ID NO: 5810 - DNA, 20 bp, Artificial Sequence
  chemically synthesized
aaaggtcacctgctgaccag

SEQ ID NO: 5811 - DNA, 20 bp, Artificial Sequence
  chemically synthesized
aggtcacctgctgaccagtg

SEQ ID NO: 5812 - DNA, 20 bp, Artificial Sequence
  chemically synthesized
acctgctgaccagtggagat

SEQ ID NO: 5813 - DNA, 20 bp, Artificial Sequence
  chemically synthesized
cctgctgaccagtggagatg

SEQ ID NO: 5814 - DNA, 20 bp, Artificial Sequence
  chemically synthesized
ctgctgaccagtggagatga

SEQ ID NO: 5815 - DNA, 20 bp, Artificial Sequence
  chemically synthesized
accagtggagatgagggcct

SEQ ID NO: 5816 - DNA, 20 bp, Artificial Sequence
  chemically synthesized
ccagtggagatgagggcctg

SEQ ID NO: 5817 - DNA, 20 bp, Artificial Sequence
  chemically synthesized
gtggagatgagggcctgagg

SEQ ID NO: 5818 - DNA, 20 bp, Artificial Sequence
  chemically synthesized
tggagatgagggcctgaggc

SEQ ID NO: 5819 - DNA, 20 bp, Artificial Sequence
  chemically synthesized
ggagatgagggcctgaggca

SEQ ID NO: 5820 - DNA, 20 bp, Artificial Sequence
  chemically synthesized
agggcctgaggcagggtgtc

SEQ ID NO: 5821 - DNA, 20 bp, Artificial Sequence
  chemically synthesized
tgaggcagggtgtccagatg

SEQ ID NO: 5822 - DNA, 20 bp, Artificial Sequence
  chemically synthesized
gcagggtgtccagatgcagc

SEQ ID NO: 5823 - DNA, 20 bp, Artificial Sequence
  chemically synthesized
gggtgtccagatgcagcaag

SEQ ID NO: 5824 - DNA, 20 bp, Artificial Sequence
  chemically synthesized
ggtgtccagatgcagcaagc

SEQ ID NO: 5825 - DNA, 20 bp, Artificial Sequence
  chemically synthesized
gtccagatgcagcaagcggg

SEQ ID NO: 5826 - DNA, 20 bp, Artificial Sequence
  chemically synthesized
tccagatgcagcaagcgggc

SEQ ID NO: 5827 - DNA, 20 bp, Artificial Sequence
  chemically synthesized
cagatgcagcaagcgggcgg

SEQ ID NO: 5828 - DNA, 20 bp, Artificial Sequence
  chemically synthesized
gatgcagcaagcgggcggga

SEQ ID NO: 5829 - DNA, 20 bp, Artificial Sequence
  chemically synthesized
cagcaagcgggcgggagagt

SEQ ID NO: 5830 - DNA, 20 bp, Artificial Sequence
  chemically synthesized
agcaagcgggcgggagagtt

SEQ ID NO: 5831 - DNA, 20 bp, Artificial Sequence
  chemically synthesized
cgggagagttgggaaatccc

SEQ ID NO: 5832 - DNA, 20 bp, Artificial Sequence
  chemically synthesized
gggagagttgggaaatccct

SEQ ID NO: 5833 - DNA, 20 bp, Artificial Sequence
  chemically synthesized
gagagttgggaaatccctag

SEQ ID NO: 5834 - DNA, 20 bp, Artificial Sequence
  chemically synthesized
tgggaaatccctaggagact

SEQ ID NO: 5835 - DNA, 20 bp, Artificial Sequence
  chemically synthesized
ggtgacctttgcccagcgcc

SEQ ID NO: 5836 - DNA, 20 bp, Artificial Sequence
  chemically synthesized
gaggggaaagaggaggggag

SEQ ID NO: 5837 - DNA, 20 bp, Artificial Sequence
  chemically synthesized
taaggaagcctcggagctgg

SEQ ID NO: 5838 - DNA, 20 bp, Artificial Sequence
  chemically synthesized
gaagaacatggaggcccggg

SEQ ID NO: 5839 - DNA, 20 bp, Artificial Sequence
  chemically synthesized
cacttgcccaaagctacaca

SEQ ID NO: 5840 - DNA, 20 bp, Artificial Sequence
  chemically synthesized
gtgccttgatgttcagtctg

SEQ ID NO: 5841 - DNA, 20 bp, Artificial Sequence
  chemically synthesized
gccacgccacctccccaggg

SEQ ID NO: 5842 - DNA, 20 bp, Artificial Sequence
  chemically synthesized
ggtccagaggcatggggacc

SEQ ID NO: 5843 - DNA, 20 bp, Artificial Sequence
  chemically synthesized
aacagaggtgccatgcagcc

SEQ ID NO: 5844 - DNA, 20 bp, Artificial Sequence
  chemically synthesized
tggtgggactgggctggggg

SEQ ID NO: 5845 - DNA, 20 bp, Artificial Sequence
  chemically synthesized
gcgccaggagggcaacaaca

SEQ ID NO: 5846 - DNA, 20 bp, Artificial Sequence
  chemically synthesized
cccctaaggtagaaccttag

SEQ ID NO: 5847 - DNA, 20 bp, Artificial Sequence
  chemically synthesized
ccttagctgggtctgccaga

SEQ ID NO: 5848 - DNA, 20 bp, Artificial Sequence
  chemically synthesized
agggggactggtgaggggcg

SEQ ID NO: 5849 - DNA, 20 bp, Artificial Sequence
  chemically synthesized
ggatcgaggcccaaagggag

SEQ ID NO: 5850 - DNA, 20 bp, Artificial Sequence
  chemically synthesized
gaggcccaaagggaggtggg

SEQ ID NO: 5851 - DNA, 20 bp, Artificial Sequence
  chemically synthesized
agccaacatgctgtgtgtct

SEQ ID NO: 5852 - DNA, 20 bp, Artificial Sequence
  chemically synthesized
caggcctcagtttccctgtc

SEQ ID NO: 5853 - DNA, 20 bp, Artificial Sequence
  chemically synthesized
ttcctccagccctaagcctg

SEQ ID NO: 5854 - DNA, 20 bp, Artificial Sequence
  chemically synthesized
atgttcttcaggttatgatg

SEQ ID NO: 5855 - DNA, 20 bp, Artificial Sequence
  chemically synthesized
tacctggagcagctgcctct

SEQ ID NO: 5856 - DNA, 20 bp, Artificial Sequence
  chemically synthesized
tgaactgagcagacaggcag

SEQ ID NO: 5857 - DNA, 20 bp, Artificial Sequence
  chemically synthesized
gtggagatgagggcctgagg

SEQ ID NO: 5858 - DNA, 20 bp, Artificial Sequence
  chemically synthesized
cagatgcagcaagcgggcgg

SEQ ID NO: 5859 - DNA, 20 bp, Artificial Sequence
  chemically synthesized
gttgggaaatccctaggaga

SEQ ID NO: 5860 - DNA, 20 bp, Artificial Sequence
  chemically synthesized
aaactgaggcctggagaggg

SEQ ID NO: 5861 - DNA, 20 bp, Artificial Sequence
  chemically synthesized
agggaggtgggtgggatgga

SEQ ID NO: 5862 - DNA, 20 bp, Artificial Sequence
  chemically synthesized
cttcctccagccctaagcct

SEQ ID NO: 5863 - DNA, 20 bp, Artificial Sequence
  chemically synthesized
ctgctgccctggagatgata

SEQ ID NO: 5864 - DNA, 20 bp, Artificial Sequence
  chemically synthesized
gaggtgggtgggatggagca

SEQ ID NO: 5865 - DNA, 20 bp, Artificial Sequence
  chemically synthesized
agggatttcccaactctccc

SEQ ID NO: 5866 - DNA, 20 bp, Artificial Sequence
  chemically synthesized
gcaggttcccccctcattct

SEQ ID NO: 5867 - DNA, 20 bp, Artificial Sequence
  chemically synthesized
gtgccttgatgttcagtctg

SEQ ID NO: 5868 - DNA, 20 bp, Artificial Sequence
  chemically synthesized
gcccccagcccagtcccacc

SEQ ID NO: 5869 - DNA, 20 bp, Artificial Sequence
  chemically synthesized
ccaacatgctgtgtgtcttt

SEQ ID NO: 5870 - DNA, 20 bp, Artificial Sequence
  chemically synthesized
atttctggccctctccaggc

SEQ ID NO: 5871 - DNA, 20 bp, Artificial Sequence
  chemically synthesized
tggggtaggactgggctgtc

SEQ ID NO: 5872 - DNA, 20 bp, Artificial Sequence
  chemically synthesized
acttccagccccaccccctg

SEQ ID NO: 5873 - DNA, 20 bp, Artificial Sequence
  chemically synthesized
ggggggcacccgtccagctc

SEQ ID NO: 5874 - DNA, 20 bp, Artificial Sequence
  chemically synthesized
gaggcttccttagctctagc

SEQ ID NO: 5875 - DNA, 20 bp, Artificial Sequence
  chemically synthesized
tagctctagcaagtgcttct

SEQ ID NO: 5876 - DNA, 20 bp, Artificial Sequence
  chemically synthesized
agacaggcaggagggttctg

SEQ ID NO: 5877 - DNA, 22 bp, Artificial Sequence
  chemically synthesized
agtctcctagggatttcccaac

SEQ ID NO: 5878 - DNA, 22 bp, Artificial Sequence
  chemically synthesized
ctagggatttcccaactctccc

SEQ ID NO: 5879 - DNA, 22 bp, Artificial Sequence
  chemically synthesized
gggatttcccaactctcccgcc

SEQ ID NO: 5880 - DNA, 22 bp, Artificial Sequence
  chemically synthesized
cccaactctcccgcccgcttgc

SEQ ID NO: 5881 - DNA, 22 bp, Artificial Sequence
  chemically synthesized
ccaactctcccgcccgcttgct

SEQ ID NO: 5882 - DNA, 22 bp, Artificial Sequence
  chemically synthesized
tcccgcccgcttgctgcatctg

SEQ ID NO: 5883 - DNA, 22 bp, Artificial Sequence
  chemically synthesized
ccgcccgcttgctgcatctgga

SEQ ID NO: 5884 - DNA, 22 bp, Artificial Sequence
  chemically synthesized
gctgcatctggacaccctgcct

SEQ ID NO: 5885 - DNA, 22 bp, Artificial Sequence
  chemically synthesized
ctgcatctggacaccctgcctc

SEQ ID NO: 5886 - DNA, 22 bp, Artificial Sequence
  chemically synthesized
catctggacaccctgcctcagg

SEQ ID NO: 5887 - DNA, 22 bp, Artificial Sequence
  chemically synthesized
gacaccctgcctcaggccctca

SEQ ID NO: 5888 - DNA, 22 bp, Artificial Sequence
  chemically synthesized
cctcaggccctcatctccactg

SEQ ID NO: 5889 - DNA, 22 bp, Artificial Sequence
  chemically synthesized
aggccctcatctccactggtca

SEQ ID NO: 5890 - DNA, 22 bp, Artificial Sequence
  chemically synthesized
atctccactggtcagcaggtga

SEQ ID NO: 5891 - DNA, 22 bp, Artificial Sequence
  chemically synthesized
cactggtcagcaggtgaccttt

SEQ ID NO: 5892 - DNA, 22 bp, Artificial Sequence
  chemically synthesized
gtcagcaggtgacctttgccca

SEQ ID NO: 5893 - DNA, 22 bp, Artificial Sequence
  chemically synthesized
tgcccagcgccctgggtcctca

SEQ ID NO: 5894 - DNA, 22 bp, Artificial Sequence
  chemically synthesized
gcccagcgccctgggtcctcag

SEQ ID NO: 5895 - DNA, 22 bp, Artificial Sequence
  chemically synthesized
cccagcgccctgggtcctcagt

SEQ ID NO: 5896 - DNA, 22 bp, Artificial Sequence
  chemically synthesized
ggtcctcagtgcctgctgccct

SEQ ID NO: 5897 - DNA, 22 bp, Artificial Sequence
  chemically synthesized
agtgcctgctgccctggagatg

SEQ ID NO: 5898 - DNA, 22 bp, Artificial Sequence
  chemically synthesized
ctgccctggagatgatataaaa

SEQ ID NO: 5899 - DNA, 22 bp, Artificial Sequence
  chemically synthesized
ccctggagatgatataaaacag

SEQ ID NO: 5900 - DNA, 22 bp, Artificial Sequence
  chemically synthesized
gagatgatataaaacaggtcag

SEQ ID NO: 5901 - DNA, 22 bp, Artificial Sequence
  chemically synthesized
ctgcctgtctgctcagttcatc

SEQ ID NO: 5902 - DNA, 22 bp, Artificial Sequence
  chemically synthesized
cctgtctgctcagttcatccct

SEQ ID NO: 5903 - DNA, 22 bp, Artificial Sequence
  chemically synthesized
tctgctcagttcatccctagag

SEQ ID NO: 5904 - DNA, 22 bp, Artificial Sequence
  chemically synthesized
ctcagttcatccctagaggcag

SEQ ID NO: 5905 - DNA, 22 bp, Artificial Sequence
  chemically synthesized
agttcatccctagaggcagctg

SEQ ID NO: 5906 - DNA, 22 bp, Artificial Sequence
  chemically synthesized
atccctagaggcagctgctcca

SEQ ID NO: 5907 - DNA, 22 bp, Artificial Sequence
  chemically synthesized
gaggcagctgctccaggtaatg

SEQ ID NO: 5908 - DNA, 22 bp, Artificial Sequence
  chemically synthesized
ctccaggtaatgccctctgggg

SEQ ID NO: 5909 - DNA, 22 bp, Artificial Sequence
  chemically synthesized
caggtaatgccctctggggagg

SEQ ID NO: 5910 - DNA, 22 bp, Artificial Sequence
  chemically synthesized
tggggaggggaaagaggagggg

SEQ ID NO: 5911 - DNA, 22 bp, Artificial Sequence
  chemically synthesized
gggaggggaaagaggaggggag

SEQ ID NO: 5912 - DNA, 22 bp, Artificial Sequence
  chemically synthesized
cctgcccagcccagccagcaag

SEQ ID NO: 5913 - DNA, 22 bp, Artificial Sequence
  chemically synthesized
cccagcccagccagcaagcctg

SEQ ID NO: 5914 - DNA, 22 bp, Artificial Sequence
  chemically synthesized
gagaagcacttgctagagctaa

SEQ ID NO: 5915 - DNA, 22 bp, Artificial Sequence
  chemically synthesized
gctagagctaaggaagcctcgg

SEQ ID NO: 5916 - DNA, 22 bp, Artificial Sequence
  chemically synthesized
ctagagctaaggaagcctcgga

SEQ ID NO: 5917 - DNA, 22 bp, Artificial Sequence
  chemically synthesized
gagctaaggaagcctcggagct

SEQ ID NO: 5918 - DNA, 22 bp, Artificial Sequence
  chemically synthesized
aggaagcctcggagctggacgg

SEQ ID NO: 5919 - DNA, 22 bp, Artificial Sequence
  chemically synthesized
ggagctggacgggtgcccccca

SEQ ID NO: 5920 - DNA, 22 bp, Artificial Sequence
  chemically synthesized
gacgggtgccccccacccctca

SEQ ID NO: 5921 - DNA, 22 bp, Artificial Sequence
  chemically synthesized
atcataacctgaagaacatgga

SEQ ID NO: 5922 - DNA, 22 bp, Artificial Sequence
  chemically synthesized
aagaacatggaggcccgggagg

SEQ ID NO: 5923 - DNA, 22 bp, Artificial Sequence
  chemically synthesized
gcccaaagctacacagggggtg

SEQ ID NO: 5924 - DNA, 22 bp, Artificial Sequence
  chemically synthesized
cccaaagctacacagggggtgg

SEQ ID NO: 5925 - DNA, 22 bp, Artificial Sequence
  chemically synthesized
cacagggggtggggctggaagt

SEQ ID NO: 5926 - DNA, 22 bp, Artificial Sequence
  chemically synthesized
gaagtggctccaagtgcaggtt

SEQ ID NO: 5927 - DNA, 22 bp, Artificial Sequence
  chemically synthesized
caagtgcaggttcccccctcat

SEQ ID NO: 5928 - DNA, 22 bp, Artificial Sequence
  chemically synthesized
ccccctcattcttcaggcttag

SEQ ID NO: 5929 - DNA, 22 bp, Artificial Sequence
  chemically synthesized
attcttcaggcttagggctgga

SEQ ID NO: 5930 - DNA, 22 bp, Artificial Sequence
  chemically synthesized
ttcaggcttagggctggaggaa

SEQ ID NO: 5931 - DNA, 22 bp, Artificial Sequence
  chemically synthesized
caggcttagggctggaggaagc

SEQ ID NO: 5932 - DNA, 22 bp, Artificial Sequence
  chemically synthesized
aggcttagggctggaggaagcc

SEQ ID NO: 5933 - DNA, 22 bp, Artificial Sequence
  chemically synthesized
agggctggaggaagccttagac

SEQ ID NO: 5934 - DNA, 22 bp, Artificial Sequence
  chemically synthesized
gggctggaggaagccttagaca

SEQ ID NO: 5935 - DNA, 22 bp, Artificial Sequence
  chemically synthesized
gaggaagccttagacagcccag

SEQ ID NO: 5936 - DNA, 22 bp, Artificial Sequence
  chemically synthesized
agacagcccagtcctaccccag

SEQ ID NO: 5937 - DNA, 22 bp, Artificial Sequence
  chemically synthesized
gacagcccagtcctaccccaga

SEQ ID NO: 5938 - DNA, 22 bp, Artificial Sequence
  chemically synthesized
ccccagacagggaaactgaggc

SEQ ID NO: 5939 - DNA, 22 bp, Artificial Sequence
  chemically synthesized
aggcctggagagggccagaaat

SEQ ID NO: 5940 - DNA, 22 bp, Artificial Sequence
  chemically synthesized
gagagggccagaaatcacccaa

SEQ ID NO: 5941 - DNA, 22 bp, Artificial Sequence
  chemically synthesized
gctggactggacggagatcagt

SEQ ID NO: 5942 - DNA, 22 bp, Artificial Sequence
  chemically synthesized
gactggacggagatcagtccag

SEQ ID NO: 5943 - DNA, 22 bp, Artificial Sequence
  chemically synthesized
gacggagatcagtccagaccgc

SEQ ID NO: 5944 - DNA, 22 bp, Artificial Sequence
  chemically synthesized
gatgttcagtctggtgggtttt

SEQ ID NO: 5945 - DNA, 22 bp, Artificial Sequence
  chemically synthesized
atgttcagtctggtgggttttc

SEQ ID NO: 5946 - DNA, 22 bp, Artificial Sequence
  chemically synthesized
agtctggtgggttttctgctcc

SEQ ID NO: 5947 - DNA, 22 bp, Artificial Sequence
  chemically synthesized
gtgggttttctgctccatccca

SEQ ID NO: 5948 - DNA, 22 bp, Artificial Sequence
  chemically synthesized
tctgctccatcccacccacctc

SEQ ID NO: 5949 - DNA, 22 bp, Artificial Sequence
  chemically synthesized
ctgctccatcccacccacctcc

SEQ ID NO: 5950 - DNA, 22 bp, Artificial Sequence
  chemically synthesized
tgctccatcccacccacctccc

SEQ ID NO: 5951 - DNA, 22 bp, Artificial Sequence
  chemically synthesized
ctccatcccacccacctccctt

SEQ ID NO: 5952 - DNA, 22 bp, Artificial Sequence
  chemically synthesized
catcccacccacctccctttgg

SEQ ID NO: 5953 - DNA, 22 bp, Artificial Sequence
  chemically synthesized
cctttgggcctcgatccctcgc

SEQ ID NO: 5954 - DNA, 22 bp, Artificial Sequence
  chemically synthesized
tgggcctcgatccctcgcccct

SEQ ID NO: 5955 - DNA, 22 bp, Artificial Sequence
  chemically synthesized
gggcctcgatccctcgcccctc

SEQ ID NO: 5956 - DNA, 22 bp, Artificial Sequence
  chemically synthesized
ggcctcgatccctcgcccctca

SEQ ID NO: 5957 - DNA, 22 bp, Artificial Sequence
  chemically synthesized
gatccctcgcccctcaccagtc

SEQ ID NO: 5958 - DNA, 22 bp, Artificial Sequence
  chemically synthesized
gcccctcaccagtcccccttct

SEQ ID NO: 5959 - DNA, 22 bp, Artificial Sequence
  chemically synthesized
accagtcccccttctgagagcc

SEQ ID NO: 5960 - DNA, 22 bp, Artificial Sequence
  chemically synthesized
ctgagagcccgtattagcaggg

SEQ ID NO: 5961 - DNA, 22 bp, Artificial Sequence
  chemically synthesized
tgagagcccgtattagcaggga

SEQ ID NO: 5962 - DNA, 22 bp, Artificial Sequence
  chemically synthesized
agagcccgtattagcagggagc

SEQ ID NO: 5963 - DNA, 22 bp, Artificial Sequence
  chemically synthesized
gcagggagccggcccctactcc

SEQ ID NO: 5964 - DNA, 22 bp, Artificial Sequence
  chemically synthesized
ctccttctggcagacccagcta

SEQ ID NO: 5965 - DNA, 22 bp, Artificial Sequence
  chemically synthesized
cttctggcagacccagctaagg

SEQ ID NO: 5966 - DNA, 22 bp, Artificial Sequence
  chemically synthesized
ctggcagacccagctaaggttc

SEQ ID NO: 5967 - DNA, 22 bp, Artificial Sequence
  chemically synthesized
tggcagacccagctaaggttct

SEQ ID NO: 5968 - DNA, 22 bp, Artificial Sequence
  chemically synthesized
gcagacccagctaaggttctac

SEQ ID NO: 5969 - DNA, 22 bp, Artificial Sequence
  chemically synthesized
aggttctaccttaggggccacg

SEQ ID NO: 5970 - DNA, 22 bp, Artificial Sequence
  chemically synthesized
taccttaggggccacgccacct

SEQ ID NO: 5971 - DNA, 22 bp, Artificial Sequence
  chemically synthesized
ccttaggggccacgccacctcc

SEQ ID NO: 5972 - DNA, 22 bp, Artificial Sequence
  chemically synthesized
aggggccacgccacctccccag

SEQ ID NO: 5973 - DNA, 22 bp, Artificial Sequence
  chemically synthesized
ggggccacgccacctccccagg

SEQ ID NO: 5974 - DNA, 22 bp, Artificial Sequence
  chemically synthesized
cccagggaggggtccagaggca

SEQ ID NO: 5975 - DNA, 22 bp, Artificial Sequence
  chemically synthesized
gggtgcccctcacaggacactt

SEQ ID NO: 5976 - DNA, 22 bp, Artificial Sequence
  chemically synthesized
acaggacacttccttgcaggaa

SEQ ID NO: 5977 - DNA, 22 bp, Artificial Sequence
  chemically synthesized
ccttgcaggaacagaggtgcca

SEQ ID NO: 5978 - DNA, 22 bp, Artificial Sequence
  chemically synthesized
cttgcaggaacagaggtgccat

SEQ ID NO: 5979 - DNA, 22 bp, Artificial Sequence
  chemically synthesized
gcaggaacagaggtgccatgca

SEQ ID NO: 5980 - DNA, 22 bp, Artificial Sequence
  chemically synthesized
caggaacagaggtgccatgcag

SEQ ID NO: 5981 - DNA, 22 bp, Artificial Sequence
  chemically synthesized
cttgttgttgccctcctggcgc

SEQ ID NO: 5982 - DNA, 22 bp, Artificial Sequence
  chemically synthesized
gttgttgccctcctggcgctcc

SEQ ID NO: 5983 - DNA, 22 bp, Artificial Sequence
  chemically synthesized
ttgttgccctcctggcgctcct

SEQ ID NO: 5984 - DNA, 22 bp, Artificial Sequence
  chemically synthesized
ttgccctcctggcgctcctggc

SEQ ID NO: 5985 - DNA, 22 bp, Artificial Sequence
  chemically synthesized
ccctcctggcgctcctggcctc

SEQ ID NO: 5986 - DNA, 22 bp, Artificial Sequence
  chemically synthesized
ctggcgctcctggcctctgccc

SEQ ID NO: 5987 - DNA, 22 bp, Artificial Sequence
  chemically synthesized
gcgctcctggcctctgcccgta

SEQ ID NO: 5988 - DNA, 22 bp, Artificial Sequence
  chemically synthesized
ctggcctctgcccgtaagcact

SEQ ID NO: 5989 - DNA, 22 bp, Artificial Sequence
  chemically synthesized
gcctctgcccgtaagcacttgg

SEQ ID NO: 5990 - DNA, 22 bp, Artificial Sequence
  chemically synthesized
tgcccgtaagcacttggtggga

SEQ ID NO: 5991 - DNA, 22 bp, Artificial Sequence
  chemically synthesized
cccgtaagcacttggtgggact

SEQ ID NO: 5992 - DNA, 22 bp, Artificial Sequence
  chemically synthesized
ggtgggactgggctgggggcag

SEQ ID NO: 5993 - DNA, 22 bp, Artificial Sequence
  chemically synthesized
gtgggactgggctgggggcagg

SEQ ID NO: 5994 - DNA, 22 bp, Artificial Sequence
  chemically synthesized
cccccagcccagtcccaccaag

SEQ ID NO: 5995 - DNA, 22 bp, Artificial Sequence
  chemically synthesized
acgggcagaggccaggagcgcc

SEQ ID NO: 5996 - DNA, 22 bp, Artificial Sequence
  chemically synthesized
cgggcagaggccaggagcgcca

SEQ ID NO: 5997 - DNA, 22 bp, Artificial Sequence
  chemically synthesized
catggcacctctgttcctgcaa

SEQ ID NO: 5998 - DNA, 22 bp, Artificial Sequence
  chemically synthesized
tgttcctgcaaggaagtgtcct

SEQ ID NO: 5999 - DNA, 22 bp, Artificial Sequence
  chemically synthesized
ttcctgcaaggaagtgtcctgt

SEQ ID NO: 6000 - DNA, 22 bp, Artificial Sequence
  chemically synthesized
ctgcaaggaagtgtcctgtgag

SEQ ID NO: 6001 - DNA, 22 bp, Artificial Sequence
  chemically synthesized
caaggaagtgtcctgtgagggg

SEQ ID NO: 6002 - DNA, 22 bp, Artificial Sequence
  chemically synthesized
tgaggggcaccccaggtcccca

SEQ ID NO: 6003 - DNA, 22 bp, Artificial Sequence
  chemically synthesized
tggacccctccctggggaggtg

SEQ ID NO: 6004 - DNA, 22 bp, Artificial Sequence
  chemically synthesized
gacccctccctggggaggtggc

SEQ ID NO: 6005 - DNA, 22 bp, Artificial Sequence
  chemically synthesized
cctggggaggtggcgtggcccc

SEQ ID NO: 6006 - DNA, 22 bp, Artificial Sequence
  chemically synthesized
gggaggtggcgtggcccctaag

SEQ ID NO: 6007 - DNA, 22 bp, Artificial Sequence
  chemically synthesized
aggtagaaccttagctgggtct

SEQ ID NO: 6008 - DNA, 22 bp, Artificial Sequence
  chemically synthesized
agctgggtctgccagaaggagt

SEQ ID NO: 6009 - DNA, 22 bp, Artificial Sequence
  chemically synthesized
gctgggtctgccagaaggagta

SEQ ID NO: 6010 - DNA, 22 bp, Artificial Sequence
  chemically synthesized
ggtctgccagaaggagtagggg

SEQ ID NO: 6011 - DNA, 22 bp, Artificial Sequence
  chemically synthesized
ccagaaggagtaggggccggct

SEQ ID NO: 6012 - DNA, 22 bp, Artificial Sequence
  chemically synthesized
cctgctaatacgggctctcaga

SEQ ID NO: 6013 - DNA, 22 bp, Artificial Sequence
  chemically synthesized
ctaatacgggctctcagaaggg

SEQ ID NO: 6014 - DNA, 22 bp, Artificial Sequence
  chemically synthesized
atacgggctctcagaaggggga

SEQ ID NO: 6015 - DNA, 22 bp, Artificial Sequence
  chemically synthesized
tcagaagggggactggtgaggg

SEQ ID NO: 6016 - DNA, 22 bp, Artificial Sequence
  chemically synthesized
agaagggggactggtgaggggc

SEQ ID NO: 6017 - DNA, 22 bp, Artificial Sequence
  chemically synthesized
gtgaggggcgagggatcgaggc

SEQ ID NO: 6018 - DNA, 22 bp, Artificial Sequence
  chemically synthesized
aacatcaaggcacctgcggtct

SEQ ID NO: 6019 - DNA, 22 bp, Artificial Sequence
  chemically synthesized
cggtctggactgatctccgtcc

SEQ ID NO: 6020 - DNA, 22 bp, Artificial Sequence
  chemically synthesized
gactgatctccgtccagtccag

SEQ ID NO: 6021 - DNA, 22 bp, Artificial Sequence
  chemically synthesized
atctccgtccagtccagccaac

SEQ ID NO: 6022 - DNA, 22 bp, Artificial Sequence
  chemically synthesized
cgtccagtccagccaacatgct

SEQ ID NO: 6023 - DNA, 22 bp, Artificial Sequence
  chemically synthesized
tgtgtctttgggtgatttctgg

SEQ ID NO: 6024 - DNA, 22 bp, Artificial Sequence
  chemically synthesized
tgggtgatttctggccctctcc

SEQ ID NO: 6025 - DNA, 22 bp, Artificial Sequence
  chemically synthesized
gggtgatttctggccctctcca

SEQ ID NO: 6026 - DNA, 22 bp, Artificial Sequence
  chemically synthesized
ggtgatttctggccctctccag

SEQ ID NO: 6027 - DNA, 22 bp, Artificial Sequence
  chemically synthesized
ctggccctctccaggcctcagt

SEQ ID NO: 6028 - DNA, 22 bp, Artificial Sequence
  chemically synthesized
tggccctctccaggcctcagtt

SEQ ID NO: 6029 - DNA, 22 bp, Artificial Sequence
  chemically synthesized
gccctctccaggcctcagtttc

SEQ ID NO: 6030 - DNA, 22 bp, Artificial Sequence
  chemically synthesized
tccaggcctcagtttccctgtc

SEQ ID NO: 6031 - DNA, 22 bp, Artificial Sequence
  chemically synthesized
caggcctcagtttccctgtctg

SEQ ID NO: 6032 - DNA, 22 bp, Artificial Sequence
  chemically synthesized
agtttccctgtctggggtagga

SEQ ID NO: 6033 - DNA, 22 bp, Artificial Sequence
  chemically synthesized
ccctgtctggggtaggactggg

SEQ ID NO: 6034 - DNA, 22 bp, Artificial Sequence
  chemically synthesized
cctgtctggggtaggactgggc

SEQ ID NO: 6035 - DNA, 22 bp, Artificial Sequence
  chemically synthesized
tctggggtaggactgggctgtc

SEQ ID NO: 6036 - DNA, 22 bp, Artificial Sequence
  chemically synthesized
gggtaggactgggctgtctaag

SEQ ID NO: 6037 - DNA, 22 bp, Artificial Sequence
  chemically synthesized
ggctgtctaaggcttcctccag

SEQ ID NO: 6038 - DNA, 22 bp, Artificial Sequence
  chemically synthesized
tctaaggcttcctccagcccta

SEQ ID NO: 6039 - DNA, 22 bp, Artificial Sequence
  chemically synthesized
aggcttcctccagccctaagcc

SEQ ID NO: 6040 - DNA, 22 bp, Artificial Sequence
  chemically synthesized
cctccagccctaagcctgaaga

SEQ ID NO: 6041 - DNA, 22 bp, Artificial Sequence
  chemically synthesized
ctccagccctaagcctgaagaa

SEQ ID NO: 6042 - DNA, 22 bp, Artificial Sequence
  chemically synthesized
cagccctaagcctgaagaatga

SEQ ID NO: 6043 - DNA, 22 bp, Artificial Sequence
  chemically synthesized
agcctgaagaatgaggggggaa

SEQ ID NO: 6044 - DNA, 22 bp, Artificial Sequence
  chemically synthesized
aagaatgaggggggaacctgca

SEQ ID NO: 6045 - DNA, 22 bp, Artificial Sequence
  chemically synthesized
cacttggagccacttccagccc

SEQ ID NO: 6046 - DNA, 22 bp, Artificial Sequence
  chemically synthesized
ggagccacttccagccccaccc

SEQ ID NO: 6047 - DNA, 22 bp, Artificial Sequence
  chemically synthesized
gagccacttccagccccacccc

SEQ ID NO: 6048 - DNA, 22 bp, Artificial Sequence
  chemically synthesized
ccagccccaccccctgtgtagc

SEQ ID NO: 6049 - DNA, 22 bp, Artificial Sequence
  chemically synthesized
cagccccaccccctgtgtagct

SEQ ID NO: 6050 - DNA, 22 bp, Artificial Sequence
  chemically synthesized
tgtagctttgggcaagtgacac

SEQ ID NO: 6051 - DNA, 22 bp, Artificial Sequence
  chemically synthesized
tgggcaagtgacacccctcccg

SEQ ID NO: 6052 - DNA, 22 bp, Artificial Sequence
  chemically synthesized
gggcaagtgacacccctcccgg

SEQ ID NO: 6053 - DNA, 22 bp, Artificial Sequence
  chemically synthesized
ggcaagtgacacccctcccggg

SEQ ID NO: 6054 - DNA, 22 bp, Artificial Sequence
  chemically synthesized
ccgggcctccatgttcttcagg

SEQ ID NO: 6055 - DNA, 22 bp, Artificial Sequence
  chemically synthesized
catgttcttcaggttatgatga

SEQ ID NO: 6056 - DNA, 22 bp, Artificial Sequence
  chemically synthesized
ttcaggttatgatgaggggtgg

SEQ ID NO: 6057 - DNA, 22 bp, Artificial Sequence
  chemically synthesized
caggttatgatgaggggtgggg

SEQ ID NO: 6058 - DNA, 22 bp, Artificial Sequence
  chemically synthesized
aggttatgatgaggggtggggg

SEQ ID NO: 6059 - DNA, 22 bp, Artificial Sequence
  chemically synthesized
tgatgaggggtggggggcaccc

SEQ ID NO: 6060 - DNA, 22 bp, Artificial Sequence
  chemically synthesized
cgaggcttccttagctctagca

SEQ ID NO: 6061 - DNA, 22 bp, Artificial Sequence
  chemically synthesized
ccttagctctagcaagtgcttc

SEQ ID NO: 6062 - DNA, 22 bp, Artificial Sequence
  chemically synthesized
cttagctctagcaagtgcttct

SEQ ID NO: 6063 - DNA, 22 bp, Artificial Sequence
  chemically synthesized
agctctagcaagtgcttctcca

SEQ ID NO: 6064 - DNA, 22 bp, Artificial Sequence
  chemically synthesized
gctctagcaagtgcttctccag

SEQ ID NO: 6065 - DNA, 22 bp, Artificial Sequence
  chemically synthesized
tagcaagtgcttctccaggctt

SEQ ID NO: 6066 - DNA, 22 bp, Artificial Sequence
  chemically synthesized
gcaagtgcttctccaggcttgc

SEQ ID NO: 6067 - DNA, 22 bp, Artificial Sequence
  chemically synthesized
ctccaggcttgctggctgggct

SEQ ID NO: 6068 - DNA, 22 bp, Artificial Sequence
  chemically synthesized
tccaggcttgctggctgggctg

SEQ ID NO: 6069 - DNA, 22 bp, Artificial Sequence
  chemically synthesized
caggcttgctggctgggctggg

SEQ ID NO: 6070 - DNA, 22 bp, Artificial Sequence
  chemically synthesized
gctggctgggctgggcagggag

SEQ ID NO: 6071 - DNA, 22 bp, Artificial Sequence
  chemically synthesized
ctggctgggctgggcagggagc

SEQ ID NO: 6072 - DNA, 22 bp, Artificial Sequence
  chemically synthesized
gctgggctgggcagggagctcc

SEQ ID NO: 6073 - DNA, 22 bp, Artificial Sequence
  chemically synthesized
ggctgggcagggagctcctctt

SEQ ID NO: 6074 - DNA, 22 bp, Artificial Sequence
  chemically synthesized
ggcagggagctcctcttgcccc

SEQ ID NO: 6075 - DNA, 22 bp, Artificial Sequence
  chemically synthesized
ctcttgcccctcttcatcctcc

SEQ ID NO: 6076 - DNA, 22 bp, Artificial Sequence
  chemically synthesized
ttgcccctcttcatcctcctcc

SEQ ID NO: 6077 - DNA, 22 bp, Artificial Sequence
  chemically synthesized
gcccctcttcatcctcctcccc

SEQ ID NO: 6078 - DNA, 22 bp, Artificial Sequence
  chemically synthesized
cccctcttcatcctcctcccct

SEQ ID NO: 6079 - DNA, 22 bp, Artificial Sequence
  chemically synthesized
ttcatcctcctcccctcctctt

SEQ ID NO: 6080 - DNA, 22 bp, Artificial Sequence
  chemically synthesized
catcctcctcccctcctctttc

SEQ ID NO: 6081 - DNA, 22 bp, Artificial Sequence
  chemically synthesized
atcctcctcccctcctctttcc

SEQ ID NO: 6082 - DNA, 22 bp, Artificial Sequence
  chemically synthesized
ctcccctcctctttcccctccc

SEQ ID NO: 6083 - DNA, 22 bp, Artificial Sequence
  chemically synthesized
ccctcctctttcccctccccag

SEQ ID NO: 6084 - DNA, 22 bp, Artificial Sequence
  chemically synthesized
ctctttcccctccccagagggc

SEQ ID NO: 6085 - DNA, 22 bp, Artificial Sequence
  chemically synthesized
tttcccctccccagagggcatt

SEQ ID NO: 6086 - DNA, 22 bp, Artificial Sequence
  chemically synthesized
tcccctccccagagggcattac

SEQ ID NO: 6087 - DNA, 22 bp, Artificial Sequence
  chemically synthesized
cccctccccagagggcattacc

SEQ ID NO: 6088 - DNA, 22 bp, Artificial Sequence
  chemically synthesized
ccctccccagagggcattacct

SEQ ID NO: 6089 - DNA, 22 bp, Artificial Sequence
  chemically synthesized
cccagagggcattacctggagc

SEQ ID NO: 6090 - DNA, 22 bp, Artificial Sequence
  chemically synthesized
cctggagcagctgcctctaggg

SEQ ID NO: 6091 - DNA, 22 bp, Artificial Sequence
  chemically synthesized
gagcagctgcctctagggatga

SEQ ID NO: 6092 - DNA, 22 bp, Artificial Sequence
  chemically synthesized
cctctagggatgaactgagcag

SEQ ID NO: 6093 - DNA, 22 bp, Artificial Sequence
  chemically synthesized
tagggatgaactgagcagacag

SEQ ID NO: 6094 - DNA, 22 bp, Artificial Sequence
  chemically synthesized
gggatgaactgagcagacaggc

SEQ ID NO: 6095 - DNA, 22 bp, Artificial Sequence
  chemically synthesized
agcagacaggcaggagggttct

SEQ ID NO: 6096 - DNA, 22 bp, Artificial Sequence
  chemically synthesized
tgacctgttttatatcatctcc

SEQ ID NO: 6097 - DNA, 22 bp, Artificial Sequence
  chemically synthesized
acctgttttatatcatctccag

SEQ ID NO: 6098 - DNA, 22 bp, Artificial Sequence
  chemically synthesized
ttttatatcatctccagggcag

SEQ ID NO: 6099 - DNA, 22 bp, Artificial Sequence
  chemically synthesized
tatatcatctccagggcagcag

SEQ ID NO: 6100 - DNA, 22 bp, Artificial Sequence
  chemically synthesized
atatcatctccagggcagcagg

SEQ ID NO: 6101 - DNA, 22 bp, Artificial Sequence
  chemically synthesized
tatcatctccagggcagcaggc

SEQ ID NO: 6102 - DNA, 22 bp, Artificial Sequence
  chemically synthesized
cagggcagcaggcactgaggac

SEQ ID NO: 6103 - DNA, 22 bp, Artificial Sequence
  chemically synthesized
aggacccagggcgctgggcaaa

SEQ ID NO: 6104 - DNA, 22 bp, Artificial Sequence
  chemically synthesized
ggcaaaggtcacctgctgacca

SEQ ID NO: 6105 - DNA, 22 bp, Artificial Sequence
  chemically synthesized
ctgaccagtggagatgagggcc

SEQ ID NO: 6106 - DNA, 22 bp, Artificial Sequence
  chemically synthesized
accagtggagatgagggcctga

SEQ ID NO: 6107 - DNA, 22 bp, Artificial Sequence
  chemically synthesized
aggcagggtgtccagatgcagc

SEQ ID NO: 6108 - DNA, 22 bp, Artificial Sequence
  chemically synthesized
ggaaatccctaggagactgagt

SEQ ID NO: 6109 - DNA, 20 bp, Artificial Sequence
  chemically synthesized
taccccttgcccatccctgc

SEQ ID NO: 6110 - DNA, 20 bp, Artificial Sequence
  chemically synthesized
ggcccccgtgaccctcactt

SEQ ID NO: 6111 - DNA, 20 bp, Artificial Sequence
  chemically synthesized
gcccccgtgaccctcacttt

SEQ ID NO: 6112 - DNA, 20 bp, Artificial Sequence
  chemically synthesized
gtgaccctcactttgggacc

SEQ ID NO: 6113 - DNA, 20 bp, Artificial Sequence
  chemically synthesized
cactttgggacccagtcaca

SEQ ID NO: 6114 - DNA, 20 bp, Artificial Sequence
  chemically synthesized
ccagtcacacagatgaccac

SEQ ID NO: 6115 - DNA, 20 bp, Artificial Sequence
  chemically synthesized
gtcacacagatgaccaccag

SEQ ID NO: 6116 - DNA, 20 bp, Artificial Sequence
  chemically synthesized
acacagatgaccaccagcag

SEQ ID NO: 6117 - DNA, 20 bp, Artificial Sequence
  chemically synthesized
cacagatgaccaccagcagc

SEQ ID NO: 6118 - DNA, 20 bp, Artificial Sequence
  chemically synthesized
ccaccagcagcaggatgttg

SEQ ID NO: 6119 - DNA, 20 bp, Artificial Sequence
  chemically synthesized
agcagcaggatgttgaagct

SEQ ID NO: 6120 - DNA, 20 bp, Artificial Sequence
  chemically synthesized
gcagcaggatgttgaagctc

SEQ ID NO: 6121 - DNA, 20 bp, Artificial Sequence
  chemically synthesized
cagcaggatgttgaagctca

SEQ ID NO: 6122 - DNA, 20 bp, Artificial Sequence
  chemically synthesized
aggatgttgaagctcagggc

SEQ ID NO: 6123 - DNA, 20 bp, Artificial Sequence
  chemically synthesized
atgttgaagctcagggcaag

SEQ ID NO: 6124 - DNA, 20 bp, Artificial Sequence
  chemically synthesized
agctcagggcaagcagactg

SEQ ID NO: 6125 - DNA, 20 bp, Artificial Sequence
  chemically synthesized
tcagggcaagcagactgaag

SEQ ID NO: 6126 - DNA, 20 bp, Artificial Sequence
  chemically synthesized
aagcagactgaagcagacca

SEQ ID NO: 6127 - DNA, 20 bp, Artificial Sequence
  chemically synthesized
gcagactgaagcagaccatg

SEQ ID NO: 6128 - DNA, 20 bp, Artificial Sequence
  chemically synthesized
gactgaagcagaccatggag

SEQ ID NO: 6129 - DNA, 20 bp, Artificial Sequence
  chemically synthesized
ctgaagcagaccatggagca

SEQ ID NO: 6130 - DNA, 20 bp, Artificial Sequence
  chemically synthesized
atggagcagagacgctgtgc

SEQ ID NO: 6131 - DNA, 20 bp, Artificial Sequence
  chemically synthesized
tggagcagagacgctgtgcc

SEQ ID NO: 6132 - DNA, 20 bp, Artificial Sequence
  chemically synthesized
ggagcagagacgctgtgcca

SEQ ID NO: 6133 - DNA, 20 bp, Artificial Sequence
  chemically synthesized
gagcagagacgctgtgccag

SEQ ID NO: 6134 - DNA, 20 bp, Artificial Sequence
  chemically synthesized
agagacgctgtgccaggggc

SEQ ID NO: 6135 - DNA, 20 bp, Artificial Sequence
  chemically synthesized
gagacgctgtgccaggggct

SEQ ID NO: 6136 - DNA, 20 bp, Artificial Sequence
  chemically synthesized
acgctgtgccaggggctggg

SEQ ID NO: 6137 - DNA, 20 bp, Artificial Sequence
  chemically synthesized
cgctgtgccaggggctgggc

SEQ ID NO: 6138 - DNA, 20 bp, Artificial Sequence
  chemically synthesized
ctgtgccaggggctgggcag

SEQ ID NO: 6139 - DNA, 20 bp, Artificial Sequence
  chemically synthesized
tgtgccaggggctgggcagg

SEQ ID NO: 6140 - DNA, 20 bp, Artificial Sequence
  chemically synthesized
gccaggggctgggcaggagg

SEQ ID NO: 6141 - DNA, 20 bp, Artificial Sequence
  chemically synthesized
ctgggcaggaggtggccctg

SEQ ID NO: 6142 - DNA, 20 bp, Artificial Sequence
  chemically synthesized
tgggcaggaggtggccctgt

SEQ ID NO: 6143 - DNA, 20 bp, Artificial Sequence
  chemically synthesized
ggcaggaggtggccctgtgg

SEQ ID NO: 6144 - DNA, 20 bp, Artificial Sequence
  chemically synthesized
caggaggtggccctgtggga

SEQ ID NO: 6145 - DNA, 20 bp, Artificial Sequence
  chemically synthesized
aggaggtggccctgtgggag

SEQ ID NO: 6146 - DNA, 20 bp, Artificial Sequence
  chemically synthesized
ggaggtggccctgtgggaga

SEQ ID NO: 6147 - DNA, 20 bp, Artificial Sequence
  chemically synthesized
gaggtggccctgtgggagag

SEQ ID NO: 6148 - DNA, 20 bp, Artificial Sequence
  chemically synthesized
gccctgtgggagaggggcat

SEQ ID NO: 6149 - DNA, 20 bp, Artificial Sequence
  chemically synthesized
ccctgtgggagaggggcatc

SEQ ID NO: 6150 - DNA, 20 bp, Artificial Sequence
  chemically synthesized
ctgtgggagaggggcatcag

SEQ ID NO: 6151 - DNA, 20 bp, Artificial Sequence
  chemically synthesized
gggagaggggcatcaggagc

SEQ ID NO: 6152 - DNA, 20 bp, Artificial Sequence
  chemically synthesized
agaggggcatcaggagccgg

SEQ ID NO: 6153 - DNA, 20 bp, Artificial Sequence
  chemically synthesized
ggcatcaggagccggcagcc

SEQ ID NO: 6154 - DNA, 20 bp, Artificial Sequence
  chemically synthesized
gcatcaggagccggcagcct

SEQ ID NO: 6155 - DNA, 20 bp, Artificial Sequence
  chemically synthesized
aggagccggcagcctgggtg

SEQ ID NO: 6156 - DNA, 20 bp, Artificial Sequence
  chemically synthesized
ggagccggcagcctgggtgt

SEQ ID NO: 6157 - DNA, 20 bp, Artificial Sequence
  chemically synthesized
gagccggcagcctgggtgtg

SEQ ID NO: 6158 - DNA, 20 bp, Artificial Sequence
  chemically synthesized
gccggcagcctgggtgtggg

SEQ ID NO: 6159 - DNA, 20 bp, Artificial Sequence
  chemically synthesized
gcagcctgggtgtggggagc

SEQ ID NO: 6160 - DNA, 20 bp, Artificial Sequence
  chemically synthesized
agcctgggtgtggggagccg

SEQ ID NO: 6161 - DNA, 20 bp, Artificial Sequence
  chemically synthesized
gcctgggtgtggggagccgg

SEQ ID NO: 6162 - DNA, 20 bp, Artificial Sequence
  chemically synthesized
cctgggtgtggggagccgga

SEQ ID NO: 6163 - DNA, 20 bp, Artificial Sequence
  chemically synthesized
gtgtggggagccggagggta

SEQ ID NO: 6164 - DNA, 20 bp, Artificial Sequence
  chemically synthesized
ggggagccggagggtaaaga

SEQ ID NO: 6165 - DNA, 20 bp, Artificial Sequence
  chemically synthesized
gggagccggagggtaaagac

SEQ ID NO: 6166 - DNA, 20 bp, Artificial Sequence
  chemically synthesized
ggagccggagggtaaagaca

SEQ ID NO: 6167 - DNA, 20 bp, Artificial Sequence
  chemically synthesized
agggtaaagacagggcaccg

SEQ ID NO: 6168 - DNA, 20 bp, Artificial Sequence
  chemically synthesized
aagacagggcaccgaagcct

SEQ ID NO: 6169 - DNA, 20 bp, Artificial Sequence
  chemically synthesized
agacagggcaccgaagcctg

SEQ ID NO: 6170 - DNA, 20 bp, Artificial Sequence
  chemically synthesized
acagggcaccgaagcctgag

SEQ ID NO: 6171 - DNA, 20 bp, Artificial Sequence
  chemically synthesized
cagggcaccgaagcctgagg

SEQ ID NO: 6172 - DNA, 20 bp, Artificial Sequence
  chemically synthesized
aagcctgaggaggcataacc

SEQ ID NO: 6173 - DNA, 20 bp, Artificial Sequence
  chemically synthesized
agcctgaggaggcataacct

SEQ ID NO: 6174 - DNA, 20 bp, Artificial Sequence
  chemically synthesized
ctgaggaggcataacctggg

SEQ ID NO: 6175 - DNA, 20 bp, Artificial Sequence
  chemically synthesized
tgaggaggcataacctgggc

SEQ ID NO: 6176 - DNA, 20 bp, Artificial Sequence
  chemically synthesized
gaggaggcataacctgggcg

SEQ ID NO: 6177 - DNA, 20 bp, Artificial Sequence
  chemically synthesized
aggaggcataacctgggcgg

SEQ ID NO: 6178 - DNA, 20 bp, Artificial Sequence
  chemically synthesized
ggaggcataacctgggcggg

SEQ ID NO: 6179 - DNA, 20 bp, Artificial Sequence
  chemically synthesized
cataacctgggcggggggat

SEQ ID NO: 6180 - DNA, 20 bp, Artificial Sequence
  chemically synthesized
acctgggcggggggattggt

SEQ ID NO: 6181 - DNA, 20 bp, Artificial Sequence
  chemically synthesized
cctgggcggggggattggtt

SEQ ID NO: 6182 - DNA, 20 bp, Artificial Sequence
  chemically synthesized
ctgggcggggggattggttg

SEQ ID NO: 6183 - DNA, 20 bp, Artificial Sequence
  chemically synthesized
ggggggattggttggggcca

SEQ ID NO: 6184 - DNA, 20 bp, Artificial Sequence
  chemically synthesized
gggggattggttggggccat

SEQ ID NO: 6185 - DNA, 20 bp, Artificial Sequence
  chemically synthesized
ggggattggttggggccatg

SEQ ID NO: 6186 - DNA, 20 bp, Artificial Sequence
  chemically synthesized
gggattggttggggccatgg

SEQ ID NO: 6187 - DNA, 20 bp, Artificial Sequence
  chemically synthesized
ggattggttggggccatggg

SEQ ID NO: 6188 - DNA, 20 bp, Artificial Sequence
  chemically synthesized
gattggttggggccatgggg

SEQ ID NO: 6189 - DNA, 20 bp, Artificial Sequence
  chemically synthesized
attggttggggccatggggg

SEQ ID NO: 6190 - DNA, 20 bp, Artificial Sequence
  chemically synthesized
ttggttggggccatgggggg

SEQ ID NO: 6191 - DNA, 20 bp, Artificial Sequence
  chemically synthesized
gccatgggggggggtcatca

SEQ ID NO: 6192 - DNA, 20 bp, Artificial Sequence
  chemically synthesized
ccatgggggggggtcatcat

SEQ ID NO: 6193 - DNA, 20 bp, Artificial Sequence
  chemically synthesized
gtcatcataggctttgaccc

SEQ ID NO: 6194 - DNA, 20 bp, Artificial Sequence
  chemically synthesized
aggctttgaccccagcattt

SEQ ID NO: 6195 - DNA, 20 bp, Artificial Sequence
  chemically synthesized
catgtataaatatacacacg

SEQ ID NO: 6196 - DNA, 20 bp, Artificial Sequence
  chemically synthesized
atatacacacgcagctaatc

SEQ ID NO: 6197 - DNA, 20 bp, Artificial Sequence
  chemically synthesized
acacacccatgcacacgact

SEQ ID NO: 6198 - DNA, 20 bp, Artificial Sequence
  chemically synthesized
cacacccatgcacacgactc

SEQ ID NO: 6199 - DNA, 20 bp, Artificial Sequence
  chemically synthesized
acgactcaggatattcacat

SEQ ID NO: 6200 - DNA, 20 bp, Artificial Sequence
  chemically synthesized
attcacatcagctgtgtgca

SEQ ID NO: 6201 - DNA, 20 bp, Artificial Sequence
  chemically synthesized
catcagctgtgtgcaaagcc

SEQ ID NO: 6202 - DNA, 20 bp, Artificial Sequence
  chemically synthesized
tgtgtgcaaagcccggatcc

SEQ ID NO: 6203 - DNA, 20 bp, Artificial Sequence
  chemically synthesized
tgtgcaaagcccggatcctg

SEQ ID NO: 6204 - DNA, 20 bp, Artificial Sequence
  chemically synthesized
caaagcccggatcctggagc

SEQ ID NO: 6205 - DNA, 20 bp, Artificial Sequence
  chemically synthesized
aaagcccggatcctggagct

SEQ ID NO: 6206 - DNA, 20 bp, Artificial Sequence
  chemically synthesized
aagcccggatcctggagctg

SEQ ID NO: 6207 - DNA, 20 bp, Artificial Sequence
  chemically synthesized
agcccggatcctggagctgg

SEQ ID NO: 6208 - DNA, 20 bp, Artificial Sequence
  chemically synthesized
ggatcctggagctgggggac

SEQ ID NO: 6209 - DNA, 20 bp, Artificial Sequence
  chemically synthesized
gatcctggagctgggggact

SEQ ID NO: 6210 - DNA, 20 bp, Artificial Sequence
  chemically synthesized
tcctggagctgggggactgg

SEQ ID NO: 6211 - DNA, 20 bp, Artificial Sequence
  chemically synthesized
ctgggggactgggagacgca

SEQ ID NO: 6212 - DNA, 20 bp, Artificial Sequence
  chemically synthesized
tgggggactgggagacgcac

SEQ ID NO: 6213 - DNA, 20 bp, Artificial Sequence
  chemically synthesized
gggggactgggagacgcaca

SEQ ID NO: 6214 - DNA, 20 bp, Artificial Sequence
  chemically synthesized
ggggactgggagacgcacag

SEQ ID NO: 6215 - DNA, 20 bp, Artificial Sequence
  chemically synthesized
gggactgggagacgcacagg

SEQ ID NO: 6216 - DNA, 20 bp, Artificial Sequence
  chemically synthesized
actgggagacgcacaggggg

SEQ ID NO: 6217 - DNA, 20 bp, Artificial Sequence
  chemically synthesized
ctgggagacgcacagggggc

SEQ ID NO: 6218 - DNA, 20 bp, Artificial Sequence
  chemically synthesized
tgggagacgcacagggggcg

SEQ ID NO: 6219 - DNA, 20 bp, Artificial Sequence
  chemically synthesized
gggagacgcacagggggcgg

SEQ ID NO: 6220 - DNA, 20 bp, Artificial Sequence
  chemically synthesized
ggagacgcacagggggcggg

SEQ ID NO: 6221 - DNA, 20 bp, Artificial Sequence
  chemically synthesized
gagacgcacagggggcgggg

SEQ ID NO: 6222 - DNA, 20 bp, Artificial Sequence
  chemically synthesized
acgcacagggggcggggggg

SEQ ID NO: 6223 - DNA, 20 bp, Artificial Sequence
  chemically synthesized
agggggcgggggggcagacc

SEQ ID NO: 6224 - DNA, 20 bp, Artificial Sequence
  chemically synthesized
ggggcagacccggccctgcc

SEQ ID NO: 6225 - DNA, 20 bp, Artificial Sequence
  chemically synthesized
gggcagacccggccctgcct

SEQ ID NO: 6226 - DNA, 20 bp, Artificial Sequence
  chemically synthesized
cctgcctaggcacacatcct

SEQ ID NO: 6227 - DNA, 20 bp, Artificial Sequence
  chemically synthesized
gcctaggcacacatcctgag

SEQ ID NO: 6228 - DNA, 20 bp, Artificial Sequence
  chemically synthesized
cctaggcacacatcctgaga

SEQ ID NO: 6229 - DNA, 20 bp, Artificial Sequence
  chemically synthesized
ctaggcacacatcctgagaa

SEQ ID NO: 6230 - DNA, 20 bp, Artificial Sequence
  chemically synthesized
taggcacacatcctgagaag

SEQ ID NO: 6231 - DNA, 20 bp, Artificial Sequence
  chemically synthesized
aggcacacatcctgagaagg

SEQ ID NO: 6232 - DNA, 20 bp, Artificial Sequence
  chemically synthesized
tgagaagggggatctgtgaa

SEQ ID NO: 6233 - DNA, 20 bp, Artificial Sequence
  chemically synthesized
tgaatggttttcctcccatc

SEQ ID NO: 6234 - DNA, 20 bp, Artificial Sequence
  chemically synthesized
tggttttcctcccatccagc

SEQ ID NO: 6235 - DNA, 20 bp, Artificial Sequence
  chemically synthesized
ttttcctcccatccagccag

SEQ ID NO: 6236 - DNA, 20 bp, Artificial Sequence
  chemically synthesized
tcctcccatccagccagtgg

SEQ ID NO: 6237 - DNA, 20 bp, Artificial Sequence
  chemically synthesized
ctcccatccagccagtggca

SEQ ID NO: 6238 - DNA, 20 bp, Artificial Sequence
  chemically synthesized
tcccatccagccagtggcag

SEQ ID NO: 6239 - DNA, 20 bp, Artificial Sequence
  chemically synthesized
cagccagtggcagaggcctc

SEQ ID NO: 6240 - DNA, 20 bp, Artificial Sequence
  chemically synthesized
cagaggcctccagatcacct

SEQ ID NO: 6241 - DNA, 20 bp, Artificial Sequence
  chemically synthesized
agaggcctccagatcacctc

SEQ ID NO: 6242 - DNA, 20 bp, Artificial Sequence
  chemically synthesized
ctccagatcacctcgggcct

SEQ ID NO: 6243 - DNA, 20 bp, Artificial Sequence
  chemically synthesized
atcacctcgggccttagtct

SEQ ID NO: 6244 - DNA, 20 bp, Artificial Sequence
  chemically synthesized
gccttagtctcagctcttct

SEQ ID NO: 6245 - DNA, 20 bp, Artificial Sequence
  chemically synthesized
ccttagtctcagctcttcta

SEQ ID NO: 6246 - DNA, 20 bp, Artificial Sequence
  chemically synthesized
ttctaaggctcctgtcccct

SEQ ID NO: 6247 - DNA, 20 bp, Artificial Sequence
  chemically synthesized
aggctcctgtcccctcagat

SEQ ID NO: 6248 - DNA, 20 bp, Artificial Sequence
  chemically synthesized
gctcctgtcccctcagattg

SEQ ID NO: 6249 - DNA, 20 bp, Artificial Sequence
  chemically synthesized
tcccctcagattggagactc

SEQ ID NO: 6250 - DNA, 20 bp, Artificial Sequence
  chemically synthesized
cctcagattggagactccag

SEQ ID NO: 6251 - DNA, 20 bp, Artificial Sequence
  chemically synthesized
agattggagactccagaagc

SEQ ID NO: 6252 - DNA, 20 bp, Artificial Sequence
  chemically synthesized
gattggagactccagaagct

SEQ ID NO: 6253 - DNA, 20 bp, Artificial Sequence
  chemically synthesized
gttcttcctaaaatccatac

SEQ ID NO: 6254 - DNA, 20 bp, Artificial Sequence
  chemically synthesized
tcctaaaatccatactggaa

SEQ ID NO: 6255 - DNA, 20 bp, Artificial Sequence
  chemically synthesized
tcccctgccaaaattccatt

SEQ ID NO: 6256 - DNA, 20 bp, Artificial Sequence
  chemically synthesized
tccattgagatccttaaatc

SEQ ID NO: 6257 - DNA, 20 bp, Artificial Sequence
  chemically synthesized
ccattgagatccttaaatct

SEQ ID NO: 6258 - DNA, 20 bp, Artificial Sequence
  chemically synthesized
aaatctgggtcattccacca

SEQ ID NO: 6259 - DNA, 20 bp, Artificial Sequence
  chemically synthesized
tccaccatagcccactctcc

SEQ ID NO: 6260 - DNA, 20 bp, Artificial Sequence
  chemically synthesized
actctccaagcacaaccctc

SEQ ID NO: 6261 - DNA, 20 bp, Artificial Sequence
  chemically synthesized
ctctccaagcacaaccctcc

SEQ ID NO: 6262 - DNA, 20 bp, Artificial Sequence
  chemically synthesized
gtcctcatcccccaccacgc

SEQ ID NO: 6263 - DNA, 20 bp, Artificial Sequence
  chemically synthesized
tcctcatcccccaccacgca

SEQ ID NO: 6264 - DNA, 20 bp, Artificial Sequence
  chemically synthesized
accacgcaaggcctcctccc

SEQ ID NO: 6265 - DNA, 20 bp, Artificial Sequence
  chemically synthesized
gccctttgccctcgcttccc

SEQ ID NO: 6266 - DNA, 20 bp, Artificial Sequence
  chemically synthesized
cacactaaatttgctcccct

SEQ ID NO: 6267 - DNA, 20 bp, Artificial Sequence
  chemically synthesized
aaatttgctcccctcagccc

SEQ ID NO: 6268 - DNA, 20 bp, Artificial Sequence
  chemically synthesized
aatttgctcccctcagcccg

SEQ ID NO: 6269 - DNA, 20 bp, Artificial Sequence
  chemically synthesized
ctcagcccgaggtcatctca

SEQ ID NO: 6270 - DNA, 20 bp, Artificial Sequence
  chemically synthesized
tcagcccgaggtcatctcac

SEQ ID NO: 6271 - DNA, 20 bp, Artificial Sequence
  chemically synthesized
ttgatccatctgcaccctga

SEQ ID NO: 6272 - DNA, 20 bp, Artificial Sequence
  chemically synthesized
cacccacgtcttcctgcaca

SEQ ID NO: 6273 - DNA, 20 bp, Artificial Sequence
  chemically synthesized
cccacgtcttcctgcacaca

SEQ ID NO: 6274 - DNA, 20 bp, Artificial Sequence
  chemically synthesized
cgtcttcctgcacacagagc

SEQ ID NO: 6275 - DNA, 20 bp, Artificial Sequence
  chemically synthesized
gtcttcctgcacacagagct

SEQ ID NO: 6276 - DNA, 20 bp, Artificial Sequence
  chemically synthesized
ggctccctctctgctgcctc

SEQ ID NO: 6277 - DNA, 20 bp, Artificial Sequence
  chemically synthesized
ctctctgctgcctccagacc

SEQ ID NO: 6278 - DNA, 20 bp, Artificial Sequence
  chemically synthesized
ctctgctgcctccagaccca

SEQ ID NO: 6279 - DNA, 20 bp, Artificial Sequence
  chemically synthesized
tgctgcctccagacccagag

SEQ ID NO: 6280 - DNA, 20 bp, Artificial Sequence
  chemically synthesized
ctccagacccagagcagctc

SEQ ID NO: 6281 - DNA, 20 bp, Artificial Sequence
  chemically synthesized
cagagcagctccagttgtcc

SEQ ID NO: 6282 - DNA, 20 bp, Artificial Sequence
  chemically synthesized
gctccagttgtcccagccct

SEQ ID NO: 6283 - DNA, 20 bp, Artificial Sequence
  chemically synthesized
gccctgagctcctctctttg

SEQ ID NO: 6284 - DNA, 20 bp, Artificial Sequence
  chemically synthesized
ttgcagcatccacctgcaaa

SEQ ID NO: 6285 - DNA, 20 bp, Artificial Sequence
  chemically synthesized
cctgcaaacagaacaccttc

SEQ ID NO: 6286 - DNA, 20 bp, Artificial Sequence
  chemically synthesized
ctgcaaacagaacaccttct

SEQ ID NO: 6287 - DNA, 20 bp, Artificial Sequence
  chemically synthesized
acagaacaccttctaggcct

SEQ ID NO: 6288 - DNA, 20 bp, Artificial Sequence
  chemically synthesized
ggccttggaccctgactctg

SEQ ID NO: 6289 - DNA, 20 bp, Artificial Sequence
  chemically synthesized
attcctatcaccccccgacc

SEQ ID NO: 6290 - DNA, 20 bp, Artificial Sequence
  chemically synthesized
cctatcaccccccgacccag

SEQ ID NO: 6291 - DNA, 20 bp, Artificial Sequence
  chemically synthesized
ctatcaccccccgacccagc

SEQ ID NO: 6292 - DNA, 20 bp, Artificial Sequence
  chemically synthesized
gacccagcaggaccacatcc

SEQ ID NO: 6293 - DNA, 20 bp, Artificial Sequence
  chemically synthesized
acccagcaggaccacatcct

SEQ ID NO: 6294 - DNA, 20 bp, Artificial Sequence
  chemically synthesized
cccagcaggaccacatcctg

SEQ ID NO: 6295 - DNA, 20 bp, Artificial Sequence
  chemically synthesized
cagcaggaccacatcctggg

SEQ ID NO: 6296 - DNA, 20 bp, Artificial Sequence
  chemically synthesized
agcaggaccacatcctgggg

SEQ ID NO: 6297 - DNA, 20 bp, Artificial Sequence
  chemically synthesized
gaccacatcctggggaggct

SEQ ID NO: 6298 - DNA, 20 bp, Artificial Sequence
  chemically synthesized
acatcctggggaggctcagt

SEQ ID NO: 6299 - DNA, 20 bp, Artificial Sequence
  chemically synthesized
catcctggggaggctcagtc

SEQ ID NO: 6300 - DNA, 20 bp, Artificial Sequence
  chemically synthesized
atcctggggaggctcagtca

SEQ ID NO: 6301 - DNA, 20 bp, Artificial Sequence
  chemically synthesized
tcctggggaggctcagtcag

SEQ ID NO: 6302 - DNA, 20 bp, Artificial Sequence
  chemically synthesized
gggaggctcagtcaggggcc

SEQ ID NO: 6303 - DNA, 20 bp, Artificial Sequence
  chemically synthesized
gggcccagaatcttcctccc

SEQ ID NO: 6304 - DNA, 20 bp, Artificial Sequence
  chemically synthesized
ggcccagaatcttcctcccc

SEQ ID NO: 6305 - DNA, 20 bp, Artificial Sequence
  chemically synthesized
tcacttcctgccactgtcct

SEQ ID NO: 6306 - DNA, 20 bp, Artificial Sequence
  chemically synthesized
ttcctgccactgtcctgagt

SEQ ID NO: 6307 - DNA, 20 bp, Artificial Sequence
  chemically synthesized
gagtcagacactgcccctgt

SEQ ID NO: 6308 - DNA, 20 bp, Artificial Sequence
  chemically synthesized
actcttcatctttttcacac

SEQ ID NO: 6309 - DNA, 20 bp, Artificial Sequence
  chemically synthesized
gacttccaccttccccactg

SEQ ID NO: 6310 - DNA, 20 bp, Artificial Sequence
  chemically synthesized
ttccccactgcagccacact

SEQ ID NO: 6311 - DNA, 20 bp, Artificial Sequence
  chemically synthesized
tccccactgcagccacactc

SEQ ID NO: 6312 - DNA, 20 bp, Artificial Sequence
  chemically synthesized
actcaggaccccatttgacc

SEQ ID NO: 6313 - DNA, 20 bp, Artificial Sequence
  chemically synthesized
ctcaggaccccatttgaccc

SEQ ID NO: 6314 - DNA, 20 bp, Artificial Sequence
  chemically synthesized
tcaggaccccatttgaccca

SEQ ID NO: 6315 - DNA, 20 bp, Artificial Sequence
  chemically synthesized
aggaccccatttgacccagg

SEQ ID NO: 6316 - DNA, 20 bp, Artificial Sequence
  chemically synthesized
ggaccccatttgacccaggg

SEQ ID NO: 6317 - DNA, 20 bp, Artificial Sequence
  chemically synthesized
ccactgcccactcccgctct

SEQ ID NO: 6318 - DNA, 20 bp, Artificial Sequence
  chemically synthesized
gcccactcccgctctgagca

SEQ ID NO: 6319 - DNA, 20 bp, Artificial Sequence
  chemically synthesized
ctgcccccaccccttcctcc

SEQ ID NO: 6320 - DNA, 20 bp, Artificial Sequence
  chemically synthesized
tgcccccaccccttcctcca

SEQ ID NO: 6321 - DNA, 20 bp, Artificial Sequence
  chemically synthesized
cctttgcattcctctccatc

SEQ ID NO: 6322 - DNA, 20 bp, Artificial Sequence
  chemically synthesized
ttgcattcctctccatccag

SEQ ID NO: 6323 - DNA, 20 bp, Artificial Sequence
  chemically synthesized
ccagaagcgctccatgacca

SEQ ID NO: 6324 - DNA, 20 bp, Artificial Sequence
  chemically synthesized
tgaccacggtgttccccacc

SEQ ID NO: 6325 - DNA, 20 bp, Artificial Sequence
  chemically synthesized
cacggtgttccccaccaagc

SEQ ID NO: 6326 - DNA, 20 bp, Artificial Sequence
  chemically synthesized
cccaccaagctggccctcca

SEQ ID NO: 6327 - DNA, 20 bp, Artificial Sequence
  chemically synthesized
caagctggccctccatggct

SEQ ID NO: 6328 - DNA, 20 bp, Artificial Sequence
  chemically synthesized
gagtccctgactgctgtctt

SEQ ID NO: 6329 - DNA, 20 bp, Artificial Sequence
  chemically synthesized
tgtcttcagcaccctccact

SEQ ID NO: 6330 - DNA, 20 bp, Artificial Sequence
  chemically synthesized
tcttcagcaccctccactca

SEQ ID NO: 6331 - DNA, 20 bp, Artificial Sequence
  chemically synthesized
cttcagcaccctccactcag

SEQ ID NO: 6332 - DNA, 20 bp, Artificial Sequence
  chemically synthesized
ttcagcaccctccactcaga

SEQ ID NO: 6333 - DNA, 20 bp, Artificial Sequence
  chemically synthesized
gagggtcctgtcctgcttcc

SEQ ID NO: 6334 - DNA, 20 bp, Artificial Sequence
  chemically synthesized
gacttatcaactcccaatgc

SEQ ID NO: 6335 - DNA, 20 bp, Artificial Sequence
  chemically synthesized
acttatcaactcccaatgct

SEQ ID NO: 6336 - DNA, 20 bp, Artificial Sequence
  chemically synthesized
atcaactcccaatgctgggt

SEQ ID NO: 6337 - DNA, 20 bp, Artificial Sequence
  chemically synthesized
ctcccaatgctgggtcagcc

SEQ ID NO: 6338 - DNA, 20 bp, Artificial Sequence
  chemically synthesized
ctgtatatccaccctgaaac

SEQ ID NO: 6339 - DNA, 20 bp, Artificial Sequence
  chemically synthesized
ccctgaaaccagactgccca

SEQ ID NO: 6340 - DNA, 20 bp, Artificial Sequence
  chemically synthesized
cctgaaaccagactgcccac

SEQ ID NO: 6341 - DNA, 20 bp, Artificial Sequence
  chemically synthesized
ctgaaaccagactgcccaca

SEQ ID NO: 6342 - DNA, 20 bp, Artificial Sequence
  chemically synthesized
aaaccagactgcccacaggg

SEQ ID NO: 6343 - DNA, 20 bp, Artificial Sequence
  chemically synthesized
agactgcccacagggtagcc

SEQ ID NO: 6344 - DNA, 20 bp, Artificial Sequence
  chemically synthesized
gggtagcccagctgtgcctc

SEQ ID NO: 6345 - DNA, 20 bp, Artificial Sequence
  chemically synthesized
ggtagcccagctgtgcctcc

SEQ ID NO: 6346 - DNA, 20 bp, Artificial Sequence
  chemically synthesized
agcccagctgtgcctccagg

SEQ ID NO: 6347 - DNA, 20 bp, Artificial Sequence
  chemically synthesized
ctgtgcctccaggtagctct

SEQ ID NO: 6348 - DNA, 20 bp, Artificial Sequence
  chemically synthesized
gtagctctgagatcatgcac

SEQ ID NO: 6349 - DNA, 20 bp, Artificial Sequence
  chemically synthesized
ccattttctcgtgtgtaaaa

SEQ ID NO: 6350 - DNA, 20 bp, Artificial Sequence
  chemically synthesized
attttctcgtgtgtaaaatg

SEQ ID NO: 6351 - DNA, 20 bp, Artificial Sequence
  chemically synthesized
cgtgtgtaaaatggagatca

SEQ ID NO: 6352 - DNA, 20 bp, Artificial Sequence
  chemically synthesized
taaaatggagatcacagtcg

SEQ ID NO: 6353 - DNA, 20 bp, Artificial Sequence
  chemically synthesized
cacagtcgtagctacccgat

SEQ ID NO: 6354 - DNA, 20 bp, Artificial Sequence
  chemically synthesized
agctacccgattggattgct

SEQ ID NO: 6355 - DNA, 20 bp, Artificial Sequence
  chemically synthesized
gattggattgctcggataat

SEQ ID NO: 6356 - DNA, 20 bp, Artificial Sequence
  chemically synthesized
gattgctcggataattagat

SEQ ID NO: 6357 - DNA, 20 bp, Artificial Sequence
  chemically synthesized
aaaatatgtaatgtgcttct

SEQ ID NO: 6358 - DNA, 20 bp, Artificial Sequence
  chemically synthesized
aaatatgtaatgtgcttctt

SEQ ID NO: 6359 - DNA, 20 bp, Artificial Sequence
  chemically synthesized
gtaatgtgcttcttaggcaa

SEQ ID NO: 6360 - DNA, 20 bp, Artificial Sequence
  chemically synthesized
aggcaaaagtttgaacataa

SEQ ID NO: 6361 - DNA, 20 bp, Artificial Sequence
  chemically synthesized
aaaagtttgaacataaaaga

SEQ ID NO: 6362 - DNA, 20 bp, Artificial Sequence
  chemically synthesized
aaagtttgaacataaaagac

SEQ ID NO: 6363 - DNA, 20 bp, Artificial Sequence
  chemically synthesized
aagtttgaacataaaagaca

SEQ ID NO: 6364 - DNA, 20 bp, Artificial Sequence
  chemically synthesized
ataaaagacagggtctgccc

SEQ ID NO: 6365 - DNA, 20 bp, Artificial Sequence
  chemically synthesized
aagacagggtctgcccaaga

SEQ ID NO: 6366 - DNA, 20 bp, Artificial Sequence
  chemically synthesized
agacagggtctgcccaagat

SEQ ID NO: 6367 - DNA, 20 bp, Artificial Sequence
  chemically synthesized
cagggtctgcccaagatggg

SEQ ID NO: 6368 - DNA, 20 bp, Artificial Sequence
  chemically synthesized
gggtctgcccaagatgggaa

SEQ ID NO: 6369 - DNA, 20 bp, Artificial Sequence
  chemically synthesized
gggaagagttcttctctccc

SEQ ID NO: 6370 - DNA, 20 bp, Artificial Sequence
  chemically synthesized
agaaacaatcaaaacaaaaa

SEQ ID NO: 6371 - DNA, 20 bp, Artificial Sequence
  chemically synthesized
aaaacaaaaacagacaacta

SEQ ID NO: 6372 - DNA, 20 bp, Artificial Sequence
  chemically synthesized
aaacagacaactatagaaca

SEQ ID NO: 6373 - DNA, 20 bp, Artificial Sequence
  chemically synthesized
cagacaactatagaacatgg

SEQ ID NO: 6374 - DNA, 20 bp, Artificial Sequence
  chemically synthesized
tatagaacatggcagctttc

SEQ ID NO: 6375 - DNA, 20 bp, Artificial Sequence
  chemically synthesized
catggcagctttcaagactc

SEQ ID NO: 6376 - DNA, 20 bp, Artificial Sequence
  chemically synthesized
gctttcaagactctggacat

SEQ ID NO: 6377 - DNA, 20 bp, Artificial Sequence
  chemically synthesized
ctttcaagactctggacatc

SEQ ID NO: 6378 - DNA, 20 bp, Artificial Sequence
  chemically synthesized
caagactctggacatcaggc

SEQ ID NO: 6379 - DNA, 20 bp, Artificial Sequence
  chemically synthesized
aagactctggacatcaggca

SEQ ID NO: 6380 - DNA, 20 bp, Artificial Sequence
  chemically synthesized
gactctggacatcaggcaag

SEQ ID NO: 6381 - DNA, 20 bp, Artificial Sequence
  chemically synthesized
actctggacatcaggcaagg

SEQ ID NO: 6382 - DNA, 20 bp, Artificial Sequence
  chemically synthesized
tctggacatcaggcaaggag

SEQ ID NO: 6383 - DNA, 20 bp, Artificial Sequence
  chemically synthesized
acatcaggcaaggaggagta

SEQ ID NO: 6384 - DNA, 20 bp, Artificial Sequence
  chemically synthesized
aaggaggagtaaagatccct

SEQ ID NO: 6385 - DNA, 20 bp, Artificial Sequence
  chemically synthesized
aggaggagtaaagatccctg

SEQ ID NO: 6386 - DNA, 20 bp, Artificial Sequence
  chemically synthesized
ggaggagtaaagatccctga

SEQ ID NO: 6387 - DNA, 20 bp, Artificial Sequence
  chemically synthesized
agtaaagatccctgagggat

SEQ ID NO: 6388 - DNA, 20 bp, Artificial Sequence
  chemically synthesized
aaagatccctgagggataag

SEQ ID NO: 6389 - DNA, 20 bp, Artificial Sequence
  chemically synthesized
gagggataagaagcaaacaa

SEQ ID NO: 6390 - DNA, 20 bp, Artificial Sequence
  chemically synthesized
agggataagaagcaaacaac

SEQ ID NO: 6391 - DNA, 20 bp, Artificial Sequence
  chemically synthesized
caggaaccctccgatcaccc

SEQ ID NO: 6392 - DNA, 20 bp, Artificial Sequence
  chemically synthesized
gatcaccccagcttactgtt

SEQ ID NO: 6393 - DNA, 20 bp, Artificial Sequence
  chemically synthesized
tcaccccagcttactgtttg

SEQ ID NO: 6394 - DNA, 20 bp, Artificial Sequence
  chemically synthesized
accccagcttactgtttgga

SEQ ID NO: 6395 - DNA, 20 bp, Artificial Sequence
  chemically synthesized
cccagcttactgtttggaga

SEQ ID NO: 6396 - DNA, 20 bp, Artificial Sequence
  chemically synthesized
tactgtttggagagagtctg

SEQ ID NO: 6397 - DNA, 20 bp, Artificial Sequence
  chemically synthesized
actgtttggagagagtctgc

SEQ ID NO: 6398 - DNA, 20 bp, Artificial Sequence
  chemically synthesized
tggagagagtctgcaggtta

SEQ ID NO: 6399 - DNA, 20 bp, Artificial Sequence
  chemically synthesized
ggagagagtctgcaggttac

SEQ ID NO: 6400 - DNA, 20 bp, Artificial Sequence
  chemically synthesized
agagtctgcaggttacaggc

SEQ ID NO: 6401 - DNA, 20 bp, Artificial Sequence
  chemically synthesized
gagtctgcaggttacaggcc

SEQ ID NO: 6402 - DNA, 20 bp, Artificial Sequence
  chemically synthesized
ctgcaggttacaggccagga

SEQ ID NO: 6403 - DNA, 20 bp, Artificial Sequence
  chemically synthesized
tgcaggttacaggccaggaa

SEQ ID NO: 6404 - DNA, 20 bp, Artificial Sequence
  chemically synthesized
gcaggttacaggccaggaaa

SEQ ID NO: 6405 - DNA, 20 bp, Artificial Sequence
  chemically synthesized
ggttacaggccaggaaaggg

SEQ ID NO: 6406 - DNA, 20 bp, Artificial Sequence
  chemically synthesized
caggccaggaaagggaagtc

SEQ ID NO: 6407 - DNA, 20 bp, Artificial Sequence
  chemically synthesized
aggccaggaaagggaagtcc

SEQ ID NO: 6408 - DNA, 20 bp, Artificial Sequence
  chemically synthesized
ccaggaaagggaagtccagg

SEQ ID NO: 6409 - DNA, 20 bp, Artificial Sequence
  chemically synthesized
aggaaagggaagtccaggca

SEQ ID NO: 6410 - DNA, 20 bp, Artificial Sequence
  chemically synthesized
gggaagtccaggcagagccc

SEQ ID NO: 6411 - DNA, 20 bp, Artificial Sequence
  chemically synthesized
gaagtccaggcagagcccaa

SEQ ID NO: 6412 - DNA, 20 bp, Artificial Sequence
  chemically synthesized
cccaagagactccccacgtt

SEQ ID NO: 6413 - DNA, 20 bp, Artificial Sequence
  chemically synthesized
ccaagagactccccacgttg

SEQ ID NO: 6414 - DNA, 20 bp, Artificial Sequence
  chemically synthesized
aagagactccccacgttgag

SEQ ID NO: 6415 - DNA, 20 bp, Artificial Sequence
  chemically synthesized
gactccccacgttgaggaga

SEQ ID NO: 6416 - DNA, 20 bp, Artificial Sequence
  chemically synthesized
ctccccacgttgaggagatg

SEQ ID NO: 6417 - DNA, 20 bp, Artificial Sequence
  chemically synthesized
cacgttgaggagatggagct

SEQ ID NO: 6418 - DNA, 20 bp, Artificial Sequence
  chemically synthesized
cgttgaggagatggagctga

SEQ ID NO: 6419 - DNA, 20 bp, Artificial Sequence
  chemically synthesized
ggagatggagctgagagtcc

SEQ ID NO: 6420 - DNA, 20 bp, Artificial Sequence
  chemically synthesized
gagatggagctgagagtccg

SEQ ID NO: 6421 - DNA, 20 bp, Artificial Sequence
  chemically synthesized
gatggagctgagagtccgag

SEQ ID NO: 6422 - DNA, 20 bp, Artificial Sequence
  chemically synthesized
ccgaggagaccaaaacaatt

SEQ ID NO: 6423 - DNA, 20 bp, Artificial Sequence
  chemically synthesized
gaggagaccaaaacaattaa

SEQ ID NO: 6424 - DNA, 20 bp, Artificial Sequence
  chemically synthesized
caaacgatcaaactgactct

SEQ ID NO: 6425 - DNA, 20 bp, Artificial Sequence
  chemically synthesized
taagttgcttaactgcatcc

SEQ ID NO: 6426 - DNA, 20 bp, Artificial Sequence
  chemically synthesized
agttgcttaactgcatcccg

SEQ ID NO: 6427 - DNA, 20 bp, Artificial Sequence
  chemically synthesized
cttaactgcatcccggagca

SEQ ID NO: 6428 - DNA, 20 bp, Artificial Sequence
  chemically synthesized
tgcatcccggagcaaagctc

SEQ ID NO: 6429 - DNA, 20 bp, Artificial Sequence
  chemically synthesized
gagcaaagctcaagaacatt

SEQ ID NO: 6430 - DNA, 20 bp, Artificial Sequence
  chemically synthesized
gcaaagctcaagaacattta

SEQ ID NO: 6431 - DNA, 20 bp, Artificial Sequence
  chemically synthesized
caaagctcaagaacatttag

SEQ ID NO: 6432 - DNA, 20 bp, Artificial Sequence
  chemically synthesized
tagaggaatacaaaaatatc

SEQ ID NO: 6433 - DNA, 20 bp, Artificial Sequence
  chemically synthesized
aaaaatatccagcacccaac

SEQ ID NO: 6434 - DNA, 20 bp, Artificial Sequence
  chemically synthesized
aaaatatccagcacccaaca

SEQ ID NO: 6435 - DNA, 20 bp, Artificial Sequence
  chemically synthesized
aaggtgaaattgacaatgtc

SEQ ID NO: 6436 - DNA, 20 bp, Artificial Sequence
  chemically synthesized
gtgaaattgacaatgtctgg

SEQ ID NO: 6437 - DNA, 20 bp, Artificial Sequence
  chemically synthesized
caatgtctggcagccaatca

SEQ ID NO: 6438 - DNA, 20 bp, Artificial Sequence
  chemically synthesized
ggcagccaatcaaagattac

SEQ ID NO: 6439 - DNA, 20 bp, Artificial Sequence
  chemically synthesized
gcagccaatcaaagattaca

SEQ ID NO: 6440 - DNA, 20 bp, Artificial Sequence
  chemically synthesized
ttacaaggcatgcaatgaaa

SEQ ID NO: 6441 - DNA, 20 bp, Artificial Sequence
  chemically synthesized
tacaaggcatgcaatgaaac

SEQ ID NO: 6442 - DNA, 20 bp, Artificial Sequence
  chemically synthesized
gggaaaacacaatgcataac

SEQ ID NO: 6443 - DNA, 20 bp, Artificial Sequence
  chemically synthesized
ggaaaacacaatgcataacg

SEQ ID NO: 6444 - DNA, 20 bp, Artificial Sequence
  chemically synthesized
aaaacacaatgcataacgag

SEQ ID NO: 6445 - DNA, 20 bp, Artificial Sequence
  chemically synthesized
aaacacaatgcataacgagg

SEQ ID NO: 6446 - DNA, 20 bp, Artificial Sequence
  chemically synthesized
aggaggttcataaatatcaa

SEQ ID NO: 6447 - DNA, 20 bp, Artificial Sequence
  chemically synthesized
gaggttcataaatatcaaaa

SEQ ID NO: 6448 - DNA, 20 bp, Artificial Sequence
  chemically synthesized
cataaatatcaaaagagatc

SEQ ID NO: 6449 - DNA, 20 bp, Artificial Sequence
  chemically synthesized
aaagagatccagaactgaca

SEQ ID NO: 6450 - DNA, 20 bp, Artificial Sequence
  chemically synthesized
tccagaactgacacggatgc

SEQ ID NO: 6451 - DNA, 20 bp, Artificial Sequence
  chemically synthesized
actgacacggatgctagaat

SEQ ID NO: 6452 - DNA, 20 bp, Artificial Sequence
  chemically synthesized
gacacggatgctagaattag

SEQ ID NO: 6453 - DNA, 20 bp, Artificial Sequence
  chemically synthesized
acacggatgctagaattagc

SEQ ID NO: 6454 - DNA, 20 bp, Artificial Sequence
  chemically synthesized
ggatgctagaattagcaggc

SEQ ID NO: 6455 - DNA, 20 bp, Artificial Sequence
  chemically synthesized
gatgctagaattagcaggca

SEQ ID NO: 6456 - DNA, 20 bp, Artificial Sequence
  chemically synthesized
ctagaattagcaggcaagga

SEQ ID NO: 6457 - DNA, 20 bp, Artificial Sequence
  chemically synthesized
agcaggcaaggatggtaaaa

SEQ ID NO: 6458 - DNA, 20 bp, Artificial Sequence
  chemically synthesized
ggatggtaaaacagatatta

SEQ ID NO: 6459 - DNA, 20 bp, Artificial Sequence
  chemically synthesized
cccattatgttcaaaaaatt

SEQ ID NO: 6460 - DNA, 20 bp, Artificial Sequence
  chemically synthesized
attatgttcaaaaaattaag

SEQ ID NO: 6461 - DNA, 20 bp, Artificial Sequence
  chemically synthesized
caaaaaattaagtagaattg

SEQ ID NO: 6462 - DNA, 20 bp, Artificial Sequence
  chemically synthesized
aaaaattaagtagaattgtg

SEQ ID NO: 6463 - DNA, 20 bp, Artificial Sequence
  chemically synthesized
aaaattaagtagaattgtgg

SEQ ID NO: 6464 - DNA, 20 bp, Artificial Sequence
  chemically synthesized
tagaattgtggaggatattt

SEQ ID NO: 6465 - DNA, 20 bp, Artificial Sequence
  chemically synthesized
gaattgtggaggatatttaa

SEQ ID NO: 6466 - DNA, 20 bp, Artificial Sequence
  chemically synthesized
ggaggatatttaagagtccc

SEQ ID NO: 6467 - DNA, 20 bp, Artificial Sequence
  chemically synthesized
gaggatatttaagagtcccc

SEQ ID NO: 6468 - DNA, 20 bp, Artificial Sequence
  chemically synthesized
agagtccccaggtgaacttc

SEQ ID NO: 6469 - DNA, 20 bp, Artificial Sequence
  chemically synthesized
agtccccaggtgaacttcta

SEQ ID NO: 6470 - DNA, 20 bp, Artificial Sequence
  chemically synthesized
tctgaaatgaaaaaacacac

SEQ ID NO: 6471 - DNA, 20 bp, Artificial Sequence
  chemically synthesized
aaatgaaaaaacacactggc

SEQ ID NO: 6472 - DNA, 20 bp, Artificial Sequence
  chemically synthesized
aatgaaaaaacacactggcc

SEQ ID NO: 6473 - DNA, 20 bp, Artificial Sequence
  chemically synthesized
aacacactggccaggcgccg

SEQ ID NO: 6474 - DNA, 20 bp, Artificial Sequence
  chemically synthesized
caggcgccgtggctcacgcc

SEQ ID NO: 6475 - DNA, 20 bp, Artificial Sequence
  chemically synthesized
gtggctcacgcctggaatcc

SEQ ID NO: 6476 - DNA, 20 bp, Artificial Sequence
  chemically synthesized
cgcctggaatcccagcactg

SEQ ID NO: 6477 - DNA, 20 bp, Artificial Sequence
  chemically synthesized
gcctggaatcccagcactgt

SEQ ID NO: 6478 - DNA, 20 bp, Artificial Sequence
  chemically synthesized
ctggaatcccagcactgtgg

SEQ ID NO: 6479 - DNA, 20 bp, Artificial Sequence
  chemically synthesized
tggaatcccagcactgtggg

SEQ ID NO: 6480 - DNA, 20 bp, Artificial Sequence
  chemically synthesized
tcccagcactgtgggaggcc

SEQ ID NO: 6481 - DNA, 20 bp, Artificial Sequence
  chemically synthesized
cccagcactgtgggaggcca

SEQ ID NO: 6482 - DNA, 20 bp, Artificial Sequence
  chemically synthesized
agcactgtgggaggccaagg

SEQ ID NO: 6483 - DNA, 20 bp, Artificial Sequence
  chemically synthesized
gcactgtgggaggccaaggc

SEQ ID NO: 6484 - DNA, 20 bp, Artificial Sequence
  chemically synthesized
ctgtgggaggccaaggcggg

SEQ ID NO: 6485 - DNA, 20 bp, Artificial Sequence
  chemically synthesized
ggccaaggcgggcagatcat

SEQ ID NO: 6486 - DNA, 20 bp, Artificial Sequence
  chemically synthesized
gccaaggcgggcagatcatg

SEQ ID NO: 6487 - DNA, 20 bp, Artificial Sequence
  chemically synthesized
aggcgggcagatcatgaggt

SEQ ID NO: 6488 - DNA, 20 bp, Artificial Sequence
  chemically synthesized
ggcgggcagatcatgaggtc

SEQ ID NO: 6489 - DNA, 20 bp, Artificial Sequence
  chemically synthesized
cgggcagatcatgaggtcag

SEQ ID NO: 6490 - DNA, 20 bp, Artificial Sequence
  chemically synthesized
tcaggagatcgacaccatcc

SEQ ID NO: 6491 - DNA, 20 bp, Artificial Sequence
  chemically synthesized
cgacaccatcctggctaaca

SEQ ID NO: 6492 - DNA, 20 bp, Artificial Sequence
  chemically synthesized
ctactaaaaatacaaaaaat

SEQ ID NO: 6493 - DNA, 20 bp, Artificial Sequence
  chemically synthesized
taaaaatacaaaaaattagc

SEQ ID NO: 6494 - DNA, 20 bp, Artificial Sequence
  chemically synthesized
tacaaaaaattagccagacg

SEQ ID NO: 6495 - DNA, 20 bp, Artificial Sequence
  chemically synthesized
aaaaaattagccagacgtgg

SEQ ID NO: 6496 - DNA, 20 bp, Artificial Sequence
  chemically synthesized
aaattagccagacgtggtgg

SEQ ID NO: 6497 - DNA, 20 bp, Artificial Sequence
  chemically synthesized
aattagccagacgtggtggc

SEQ ID NO: 6498 - DNA, 20 bp, Artificial Sequence
  chemically synthesized
gacgtggtggcaggcgcctg

SEQ ID NO: 6499 - DNA, 20 bp, Artificial Sequence
  chemically synthesized
gtggcaggcgcctgtagtcc

SEQ ID NO: 6500 - DNA, 20 bp, Artificial Sequence
  chemically synthesized
cgcctgtagtcccagctact

SEQ ID NO: 6501 - DNA, 20 bp, Artificial Sequence
  chemically synthesized
gcctgtagtcccagctactc

SEQ ID NO: 6502 - DNA, 20 bp, Artificial Sequence
  chemically synthesized
ctgtagtcccagctactcgg

SEQ ID NO: 6503 - DNA, 20 bp, Artificial Sequence
  chemically synthesized
tgtagtcccagctactcggg

SEQ ID NO: 6504 - DNA, 20 bp, Artificial Sequence
  chemically synthesized
tcccagctactcgggaggct

SEQ ID NO: 6505 - DNA, 20 bp, Artificial Sequence
  chemically synthesized
cccagctactcgggaggctg

SEQ ID NO: 6506 - DNA, 20 bp, Artificial Sequence
  chemically synthesized
agctactcgggaggctgagg

SEQ ID NO: 6507 - DNA, 20 bp, Artificial Sequence
  chemically synthesized
gctactcgggaggctgaggc

SEQ ID NO: 6508 - DNA, 20 bp, Artificial Sequence
  chemically synthesized
tactcgggaggctgaggcag

SEQ ID NO: 6509 - DNA, 20 bp, Artificial Sequence
  chemically synthesized
gggaggctgaggcaggagaa

SEQ ID NO: 6510 - DNA, 20 bp, Artificial Sequence
  chemically synthesized
gcaggagaatggcatgaacc

SEQ ID NO: 6511 - DNA, 20 bp, Artificial Sequence
  chemically synthesized
caggagaatggcatgaaccc

SEQ ID NO: 6512 - DNA, 20 bp, Artificial Sequence
  chemically synthesized
ggagaatggcatgaacccgg

SEQ ID NO: 6513 - DNA, 20 bp, Artificial Sequence
  chemically synthesized
gagaatggcatgaacccggg

SEQ ID NO: 6514 - DNA, 20 bp, Artificial Sequence
  chemically synthesized
aatggcatgaacccgggagg

SEQ ID NO: 6515 - DNA, 20 bp, Artificial Sequence
  chemically synthesized
tggcatgaacccgggaggca

SEQ ID NO: 6516 - DNA, 20 bp, Artificial Sequence
  chemically synthesized
aacccgggaggcagagcttg

SEQ ID NO: 6517 - DNA, 20 bp, Artificial Sequence
  chemically synthesized
cgggaggcagagcttgcagt

SEQ ID NO: 6518 - DNA, 20 bp, Artificial Sequence
  chemically synthesized
ggcagagcttgcagtgagcc

SEQ ID NO: 6519 - DNA, 20 bp, Artificial Sequence
  chemically synthesized
aagatcgcgccactgcactc

SEQ ID NO: 6520 - DNA, 20 bp, Artificial Sequence
  chemically synthesized
cgcgccactgcactccggcc

SEQ ID NO: 6521 - DNA, 20 bp, Artificial Sequence
  chemically synthesized
gcgccactgcactccggcct

SEQ ID NO: 6522 - DNA, 20 bp, Artificial Sequence
  chemically synthesized
ctgcactccggcctgggcaa

SEQ ID NO: 6523 - DNA, 20 bp, Artificial Sequence
  chemically synthesized
gcactccggcctgggcaaca

SEQ ID NO: 6524 - DNA, 20 bp, Artificial Sequence
  chemically synthesized
tccggcctgggcaacagagc

SEQ ID NO: 6525 - DNA, 20 bp, Artificial Sequence
  chemically synthesized
ccgcctccaaaaaaaaaaaa

SEQ ID NO: 6526 - DNA, 20 bp, Artificial Sequence
  chemically synthesized
tccaaaaaaaaaaaaaagaa

SEQ ID NO: 6527 - DNA, 20 bp, Artificial Sequence
  chemically synthesized
aaaaaaaaaaaaagaaaaga

SEQ ID NO: 6528 - DNA, 20 bp, Artificial Sequence
  chemically synthesized
aaaaaaaagaaaagaaagaa

SEQ ID NO: 6529 - DNA, 20 bp, Artificial Sequence
  chemically synthesized
aaagaaaagaaaaaacacac

SEQ ID NO: 6530 - DNA, 20 bp, Artificial Sequence
  chemically synthesized
aaaagaaaaaacacactgga

SEQ ID NO: 6531 - DNA, 20 bp, Artificial Sequence
  chemically synthesized
aacacactggatggaaataa

SEQ ID NO: 6532 - DNA, 20 bp, Artificial Sequence
  chemically synthesized
acactggatggaaataatgg

SEQ ID NO: 6533 - DNA, 20 bp, Artificial Sequence
  chemically synthesized
ggatggaaataatggaagat

SEQ ID NO: 6534 - DNA, 20 bp, Artificial Sequence
  chemically synthesized
atggaagatgagaaatgcgt

SEQ ID NO: 6535 - DNA, 20 bp, Artificial Sequence
  chemically synthesized
agaaatgcgtaagaaaaatt

SEQ ID NO: 6536 - DNA, 20 bp, Artificial Sequence
  chemically synthesized
gaaatgcgtaagaaaaattt

SEQ ID NO: 6537 - DNA, 20 bp, Artificial Sequence
  chemically synthesized
aaatgcgtaagaaaaattta

SEQ ID NO: 6538 - DNA, 20 bp, Artificial Sequence
  chemically synthesized
gcgtaagaaaaatttagggc

SEQ ID NO: 6539 - DNA, 20 bp, Artificial Sequence
  chemically synthesized
cgtaagaaaaatttagggcc

SEQ ID NO: 6540 - DNA, 20 bp, Artificial Sequence
  chemically synthesized
aaatttagggccaggcactg

SEQ ID NO: 6541 - DNA, 20 bp, Artificial Sequence
  chemically synthesized
gtggatcacatctgtaatcc

SEQ ID NO: 6542 - DNA, 20 bp, Artificial Sequence
  chemically synthesized
catctgtaatcccagcactt

SEQ ID NO: 6543 - DNA, 20 bp, Artificial Sequence
  chemically synthesized
atctgtaatcccagcacttt

SEQ ID NO: 6544 - DNA, 20 bp, Artificial Sequence
  chemically synthesized
ctgtaatcccagcactttgg

SEQ ID NO: 6545 - DNA, 20 bp, Artificial Sequence
  chemically synthesized
tgtaatcccagcactttggg

SEQ ID NO: 6546 - DNA, 20 bp, Artificial Sequence
  chemically synthesized
agcactttgggaggtcgaca

SEQ ID NO: 6547 - DNA, 20 bp, Artificial Sequence
  chemically synthesized
gcactttgggaggtcgacac

SEQ ID NO: 6548 - DNA, 20 bp, Artificial Sequence
  chemically synthesized
cactttgggaggtcgacacg

SEQ ID NO: 6549 - DNA, 20 bp, Artificial Sequence
  chemically synthesized
actttgggaggtcgacacgg

SEQ ID NO: 6550 - DNA, 20 bp, Artificial Sequence
  chemically synthesized
ctttgggaggtcgacacggg

SEQ ID NO: 6551 - DNA, 20 bp, Artificial Sequence
  chemically synthesized
cgacacggggggaatcactt

SEQ ID NO: 6552 - DNA, 20 bp, Artificial Sequence
  chemically synthesized
cggggggaatcacttgagcc

SEQ ID NO: 6553 - DNA, 20 bp, Artificial Sequence
  chemically synthesized
ggggggaatcacttgagccc

SEQ ID NO: 6554 - DNA, 20 bp, Artificial Sequence
  chemically synthesized
ggggaatcacttgagcccag

SEQ ID NO: 6555 - DNA, 20 bp, Artificial Sequence
  chemically synthesized
tcacttgagcccaggagctc

SEQ ID NO: 6556 - DNA, 20 bp, Artificial Sequence
  chemically synthesized
tgagcccaggagctcaagac

SEQ ID NO: 6557 - DNA, 20 bp, Artificial Sequence
  chemically synthesized
ccaggagctcaagactagtc

SEQ ID NO: 6558 - DNA, 20 bp, Artificial Sequence
  chemically synthesized
caggagctcaagactagtct

SEQ ID NO: 6559 - DNA, 20 bp, Artificial Sequence
  chemically synthesized
gagctcaagactagtctggg

SEQ ID NO: 6560 - DNA, 20 bp, Artificial Sequence
  chemically synthesized
caagactagtctgggcagca

SEQ ID NO: 6561 - DNA, 20 bp, Artificial Sequence
  chemically synthesized
catggcaaaacccctctaca

SEQ ID NO: 6562 - DNA, 20 bp, Artificial Sequence
  chemically synthesized
tacaaaaaaaaatttttaat

SEQ ID NO: 6563 - DNA, 20 bp, Artificial Sequence
  chemically synthesized
aaaaaaaatttttaattagc

SEQ ID NO: 6564 - DNA, 20 bp, Artificial Sequence
  chemically synthesized
aaaaaaatttttaattagcc

SEQ ID NO: 6565 - DNA, 20 bp, Artificial Sequence
  chemically synthesized
aatttttaattagccaggtg

SEQ ID NO: 6566 - DNA, 20 bp, Artificial Sequence
  chemically synthesized
ggtgtggtgccacatgccta

SEQ ID NO: 6567 - DNA, 20 bp, Artificial Sequence
  chemically synthesized
gtgccacatgcctatagtcc

SEQ ID NO: 6568 - DNA, 20 bp, Artificial Sequence
  chemically synthesized
tgcctatagtcccagctacc

SEQ ID NO: 6569 - DNA, 20 bp, Artificial Sequence
  chemically synthesized
gcctatagtcccagctacct

SEQ ID NO: 6570 - DNA, 20 bp, Artificial Sequence
  chemically synthesized
ctatagtcccagctacctgg

SEQ ID NO: 6571 - DNA, 20 bp, Artificial Sequence
  chemically synthesized
tatagtcccagctacctggg

SEQ ID NO: 6572 - DNA, 20 bp, Artificial Sequence
  chemically synthesized
cccagctacctgggaggctg

SEQ ID NO: 6573 - DNA, 20 bp, Artificial Sequence
  chemically synthesized
agctacctgggaggctgaag

SEQ ID NO: 6574 - DNA, 20 bp, Artificial Sequence
  chemically synthesized
tacctgggaggctgaagtgg

SEQ ID NO: 6575 - DNA, 20 bp, Artificial Sequence
  chemically synthesized
acctgggaggctgaagtgga

SEQ ID NO: 6576 - DNA, 20 bp, Artificial Sequence
  chemically synthesized
ctgaagtggaaggatcgcct

SEQ ID NO: 6577 - DNA, 20 bp, Artificial Sequence
  chemically synthesized
gtggaaggatcgcctgagcc

SEQ ID NO: 6578 - DNA, 20 bp, Artificial Sequence
  chemically synthesized
tggaaggatcgcctgagccc

SEQ ID NO: 6579 - DNA, 20 bp, Artificial Sequence
  chemically synthesized
gaaggatcgcctgagcccag

SEQ ID NO: 6580 - DNA, 20 bp, Artificial Sequence
  chemically synthesized
aaggatcgcctgagcccagg

SEQ ID NO: 6581 - DNA, 20 bp, Artificial Sequence
  chemically synthesized
gatcgcctgagcccaggagg

SEQ ID NO: 6582 - DNA, 20 bp, Artificial Sequence
  chemically synthesized
tcgcctgagcccaggaggtg

SEQ ID NO: 6583 - DNA, 20 bp, Artificial Sequence
  chemically synthesized
cgcctgagcccaggaggtgg

SEQ ID NO: 6584 - DNA, 20 bp, Artificial Sequence
  chemically synthesized
agcccaggaggtggaggcca

SEQ ID NO: 6585 - DNA, 20 bp, Artificial Sequence
  chemically synthesized
caggaggtggaggccacagt

SEQ ID NO: 6586 - DNA, 20 bp, Artificial Sequence
  chemically synthesized
aggccacagtgagttgtgac

SEQ ID NO: 6587 - DNA, 20 bp, Artificial Sequence
  chemically synthesized
tgtgacaagctactgcattc

SEQ ID NO: 6588 - DNA, 20 bp, Artificial Sequence
  chemically synthesized
caagctactgcattccagcc

SEQ ID NO: 6589 - DNA, 20 bp, Artificial Sequence
  chemically synthesized
aagctactgcattccagcct

SEQ ID NO: 6590 - DNA, 20 bp, Artificial Sequence
  chemically synthesized
ctgcattccagcctgggcaa

SEQ ID NO: 6591 - DNA, 20 bp, Artificial Sequence
  chemically synthesized
gcattccagcctgggcaaca

SEQ ID NO: 6592 - DNA, 20 bp, Artificial Sequence
  chemically synthesized
tccagcctgggcaacagagt

SEQ ID NO: 6593 - DNA, 20 bp, Artificial Sequence
  chemically synthesized
cctgggcaacagagtgagat

SEQ ID NO: 6594 - DNA, 20 bp, Artificial Sequence
  chemically synthesized
tgggcaacagagtgagatga

SEQ ID NO: 6595 - DNA, 20 bp, Artificial Sequence
  chemically synthesized
ggcaacagagtgagatgaga

SEQ ID NO: 6596 - DNA, 20 bp, Artificial Sequence
  chemically synthesized
caacagagtgagatgagaga

SEQ ID NO: 6597 - DNA, 20 bp, Artificial Sequence
  chemically synthesized
acagagtgagatgagagaga

SEQ ID NO: 6598 - DNA, 20 bp, Artificial Sequence
  chemically synthesized
agagtgagatgagagagaga

SEQ ID NO: 6599 - DNA, 20 bp, Artificial Sequence
  chemically synthesized
gagtgagatgagagagagag

SEQ ID NO: 6600 - DNA, 20 bp, Artificial Sequence
  chemically synthesized
agtgagatgagagagagaga

SEQ ID NO: 6601 - DNA, 20 bp, Artificial Sequence
  chemically synthesized
gtgagatgagagagagagag

SEQ ID NO: 6602 - DNA, 20 bp, Artificial Sequence
  chemically synthesized
gagatgagagagagagaggg

SEQ ID NO: 6603 - DNA, 20 bp, Artificial Sequence
  chemically synthesized
agatgagagagagagagggg

SEQ ID NO: 6604 - DNA, 20 bp, Artificial Sequence
  chemically synthesized
gatgagagagagagagggga

SEQ ID NO: 6605 - DNA, 20 bp, Artificial Sequence
  chemically synthesized
atgagagagagagaggggag

SEQ ID NO: 6606 - DNA, 20 bp, Artificial Sequence
  chemically synthesized
agagagagagaggggagggg

SEQ ID NO: 6607 - DNA, 20 bp, Artificial Sequence
  chemically synthesized
agagagaggggaggggaagc

SEQ ID NO: 6608 - DNA, 20 bp, Artificial Sequence
  chemically synthesized
gagagaggggaggggaagcg

SEQ ID NO: 6609 - DNA, 20 bp, Artificial Sequence
  chemically synthesized
agagaggggaggggaagcga

SEQ ID NO: 6610 - DNA, 20 bp, Artificial Sequence
  chemically synthesized
gaggggaggggaagcgaggg

SEQ ID NO: 6611 - DNA, 20 bp, Artificial Sequence
  chemically synthesized
aggggaggggaagcgaggga

SEQ ID NO: 6612 - DNA, 20 bp, Artificial Sequence
  chemically synthesized
gaggggaagcgagggaagga

SEQ ID NO: 6613 - DNA, 20 bp, Artificial Sequence
  chemically synthesized
aggggaagcgagggaaggaa

SEQ ID NO: 6614 - DNA, 20 bp, Artificial Sequence
  chemically synthesized
gggaagcgagggaaggaaag

SEQ ID NO: 6615 - DNA, 20 bp, Artificial Sequence
  chemically synthesized
ggaagcgagggaaggaaagg

SEQ ID NO: 6616 - DNA, 20 bp, Artificial Sequence
  chemically synthesized
gaagcgagggaaggaaagga

SEQ ID NO: 6617 - DNA, 20 bp, Artificial Sequence
  chemically synthesized
aagcgagggaaggaaaggag

SEQ ID NO: 6618 - DNA, 20 bp, Artificial Sequence
  chemically synthesized
gcgagggaaggaaaggaggg

SEQ ID NO: 6619 - DNA, 20 bp, Artificial Sequence
  chemically synthesized
cgagggaaggaaaggagggg

SEQ ID NO: 6620 - DNA, 20 bp, Artificial Sequence
  chemically synthesized
gagggaaggaaaggagggga

SEQ ID NO: 6621 - DNA, 20 bp, Artificial Sequence
  chemically synthesized
agggaaggaaaggaggggag

SEQ ID NO: 6622 - DNA, 20 bp, Artificial Sequence
  chemically synthesized
ggaaggaaaggaggggaggg

SEQ ID NO: 6623 - DNA, 20 bp, Artificial Sequence
  chemically synthesized
gaaggaaaggaggggagggg

SEQ ID NO: 6624 - DNA, 20 bp, Artificial Sequence
  chemically synthesized
aaggaaaggaggggagggga

SEQ ID NO: 6625 - DNA, 20 bp, Artificial Sequence
  chemically synthesized
aggaaaggaggggaggggag

SEQ ID NO: 6626 - DNA, 20 bp, Artificial Sequence
  chemically synthesized
ggaaaggaggggaggggagg

SEQ ID NO: 6627 - DNA, 20 bp, Artificial Sequence
  chemically synthesized
aaaggaggggaggggagggg

SEQ ID NO: 6628 - DNA, 20 bp, Artificial Sequence
  chemically synthesized
aaggaggggaggggaggggg

SEQ ID NO: 6629 - DNA, 20 bp, Artificial Sequence
  chemically synthesized
aggaggggaggggaggggga

SEQ ID NO: 6630 - DNA, 20 bp, Artificial Sequence
  chemically synthesized
ggaggggaggggagggggag

SEQ ID NO: 6631 - DNA, 20 bp, Artificial Sequence
  chemically synthesized
ggggaggggagggggagggg

SEQ ID NO: 6632 - DNA, 20 bp, Artificial Sequence
  chemically synthesized
gggaggggagggggagggga

SEQ ID NO: 6633 - DNA, 20 bp, Artificial Sequence
  chemically synthesized
ggaggggagggggaggggaa

SEQ ID NO: 6634 - DNA, 20 bp, Artificial Sequence
  chemically synthesized
gaggggagggggaggggaag

SEQ ID NO: 6635 - DNA, 20 bp, Artificial Sequence
  chemically synthesized
ggaggggaaggggaaaattt

SEQ ID NO: 6636 - DNA, 20 bp, Artificial Sequence
  chemically synthesized
attttagttaacttaatgaa

SEQ ID NO: 6637 - DNA, 20 bp, Artificial Sequence
  chemically synthesized
aactctataaaatgaaacac

SEQ ID NO: 6638 - DNA, 20 bp, Artificial Sequence
  chemically synthesized
actctataaaatgaaacact

SEQ ID NO: 6639 - DNA, 20 bp, Artificial Sequence
  chemically synthesized
tctataaaatgaaacactgg

SEQ ID NO: 6640 - DNA, 20 bp, Artificial Sequence
  chemically synthesized
aatgaaacactgggagaaaa

SEQ ID NO: 6641 - DNA, 20 bp, Artificial Sequence
  chemically synthesized
gagaaaaaagaattaaaaaa

SEQ ID NO: 6642 - DNA, 20 bp, Artificial Sequence
  chemically synthesized
aaaaagaattaaaaaatgga

SEQ ID NO: 6643 - DNA, 20 bp, Artificial Sequence
  chemically synthesized
aaagaattaaaaaatggaaa

SEQ ID NO: 6644 - DNA, 20 bp, Artificial Sequence
  chemically synthesized
ttaaaaaatggaaagagaat

SEQ ID NO: 6645 - DNA, 20 bp, Artificial Sequence
  chemically synthesized
aaaatggaaagagaatgagt

SEQ ID NO: 6646 - DNA, 20 bp, Artificial Sequence
  chemically synthesized
gaaagagaatgagtgagctg

SEQ ID NO: 6647 - DNA, 20 bp, Artificial Sequence
  chemically synthesized
aaagagaatgagtgagctgt

SEQ ID NO: 6648 - DNA, 20 bp, Artificial Sequence
  chemically synthesized
tgcataattgaaatctttaa

SEQ ID NO: 6649 - DNA, 20 bp, Artificial Sequence
  chemically synthesized
attgaaatctttaaaagaaa

SEQ ID NO: 6650 - DNA, 20 bp, Artificial Sequence
  chemically synthesized
ttgaaatctttaaaagaaaa

SEQ ID NO: 6651 - DNA, 20 bp, Artificial Sequence
  chemically synthesized
tgaaatctttaaaagaaaaa

SEQ ID NO: 6652 - DNA, 20 bp, Artificial Sequence
  chemically synthesized
gaaatctttaaaagaaaaag

SEQ ID NO: 6653 - DNA, 20 bp, Artificial Sequence
  chemically synthesized
aaatctttaaaagaaaaagg

SEQ ID NO: 6654 - DNA, 20 bp, Artificial Sequence
  chemically synthesized
tctttaaaagaaaaaggggg

SEQ ID NO: 6655 - DNA, 20 bp, Artificial Sequence
  chemically synthesized
ttaaaagaaaaagggggtag

SEQ ID NO: 6656 - DNA, 20 bp, Artificial Sequence
  chemically synthesized
gggggtagcagaaaaaaatc

SEQ ID NO: 6657 - DNA, 20 bp, Artificial Sequence
  chemically synthesized
gcagaaaaaaatcaagtgct

SEQ ID NO: 6658 - DNA, 20 bp, Artificial Sequence
  chemically synthesized
aaaaaatcaagtgctgagac

SEQ ID NO: 6659 - DNA, 20 bp, Artificial Sequence
  chemically synthesized
aaatcaagtgctgagacaag

SEQ ID NO: 6660 - DNA, 20 bp, Artificial Sequence
  chemically synthesized
tcaagtgctgagacaagtgg

SEQ ID NO: 6661 - DNA, 20 bp, Artificial Sequence
  chemically synthesized
gtgctgagacaagtggaaga

SEQ ID NO: 6662 - DNA, 20 bp, Artificial Sequence
  chemically synthesized
tgctgagacaagtggaagat

SEQ ID NO: 6663 - DNA, 20 bp, Artificial Sequence
  chemically synthesized
gacaagtggaagatgggccc

SEQ ID NO: 6664 - DNA, 20 bp, Artificial Sequence
  chemically synthesized
agtggaagatgggccccggt

SEQ ID NO: 6665 - DNA, 20 bp, Artificial Sequence
  chemically synthesized
ggaagatgggccccggtgag

SEQ ID NO: 6666 - DNA, 20 bp, Artificial Sequence
  chemically synthesized
ggccccggtgagcagctgat

SEQ ID NO: 6667 - DNA, 20 bp, Artificial Sequence
  chemically synthesized
ggtgagcagctgatcagtgt

SEQ ID NO: 6668 - DNA, 20 bp, Artificial Sequence
  chemically synthesized
ctcccatgatgacgttcccc

SEQ ID NO: 6669 - DNA, 20 bp, Artificial Sequence
  chemically synthesized
ttcccccagcccccaccacc

SEQ ID NO: 6670 - DNA, 20 bp, Artificial Sequence
  chemically synthesized
tcccccagcccccaccaccc

SEQ ID NO: 6671 - DNA, 20 bp, Artificial Sequence
  chemically synthesized
gcccccaccacccgggctgc

SEQ ID NO: 6672 - DNA, 20 bp, Artificial Sequence
  chemically synthesized
ccccaccacccgggctgctg

SEQ ID NO: 6673 - DNA, 20 bp, Artificial Sequence
  chemically synthesized
cccaccacccgggctgctgg

SEQ ID NO: 6674 - DNA, 20 bp, Artificial Sequence
  chemically synthesized
ccaccacccgggctgctgga

SEQ ID NO: 6675 - DNA, 20 bp, Artificial Sequence
  chemically synthesized
cgggctgctggagggaaatg

SEQ ID NO: 6676 - DNA, 20 bp, Artificial Sequence
  chemically synthesized
gtgactttgctacatccctt

SEQ ID NO: 6677 - DNA, 20 bp, Artificial Sequence
  chemically synthesized
ctttgctacatcccttcaga

SEQ ID NO: 6678 - DNA, 20 bp, Artificial Sequence
  chemically synthesized
cccttcagacggtccctcac

SEQ ID NO: 6679 - DNA, 20 bp, Artificial Sequence
  chemically synthesized
ggtccctcactggtgtccct

SEQ ID NO: 6680 - DNA, 20 bp, Artificial Sequence
  chemically synthesized
gtccctcagcccattcgcgt

SEQ ID NO: 6681 - DNA, 20 bp, Artificial Sequence
  chemically synthesized
gctcactctcccattaattt

SEQ ID NO: 6682 - DNA, 20 bp, Artificial Sequence
  chemically synthesized
cccattaatttcagaaatcc

SEQ ID NO: 6683 - DNA, 20 bp, Artificial Sequence
  chemically synthesized
agaaatcctggcctctctcc

SEQ ID NO: 6684 - DNA, 20 bp, Artificial Sequence
  chemically synthesized
actctaaattctgtcaccct

SEQ ID NO: 6685 - DNA, 20 bp, Artificial Sequence
  chemically synthesized
ctaaattctgtcaccctcag

SEQ ID NO: 6686 - DNA, 20 bp, Artificial Sequence
  chemically synthesized
tctgtcaccctcagaagatt

SEQ ID NO: 6687 - DNA, 20 bp, Artificial Sequence
  chemically synthesized
gtcaccctcagaagattcag

SEQ ID NO: 6688 - DNA, 20 bp, Artificial Sequence
  chemically synthesized
cagcatcccgtattctctct

SEQ ID NO: 6689 - DNA, 20 bp, Artificial Sequence
  chemically synthesized
tctgagtgttcactatgtac

SEQ ID NO: 6690 - DNA, 20 bp, Artificial Sequence
  chemically synthesized
ctgagtgttcactatgtacc

SEQ ID NO: 6691 - DNA, 20 bp, Artificial Sequence
  chemically synthesized
actatgtaccgggtgccgtg

SEQ ID NO: 6692 - DNA, 20 bp, Artificial Sequence
  chemically synthesized
ctatgtaccgggtgccgtgt

SEQ ID NO: 6693 - DNA, 20 bp, Artificial Sequence
  chemically synthesized
accgggtgccgtgtgggcac

SEQ ID NO: 6694 - DNA, 20 bp, Artificial Sequence
  chemically synthesized
cgggtgccgtgtgggcactg

SEQ ID NO: 6695 - DNA, 20 bp, Artificial Sequence
  chemically synthesized
ccgtgtgggcactggagttg

SEQ ID NO: 6696 - DNA, 20 bp, Artificial Sequence
  chemically synthesized
gtgtgggcactggagttgca

SEQ ID NO: 6697 - DNA, 20 bp, Artificial Sequence
  chemically synthesized
tgtgggcactggagttgcag

SEQ ID NO: 6698 - DNA, 20 bp, Artificial Sequence
  chemically synthesized
tgggcactggagttgcagag

SEQ ID NO: 6699 - DNA, 20 bp, Artificial Sequence
  chemically synthesized
ggcactggagttgcagagga

SEQ ID NO: 6700 - DNA, 20 bp, Artificial Sequence
  chemically synthesized
ctggagttgcagaggagagt

SEQ ID NO: 6701 - DNA, 20 bp, Artificial Sequence
  chemically synthesized
tggagttgcagaggagagtg

SEQ ID NO: 6702 - DNA, 20 bp, Artificial Sequence
  chemically synthesized
agttgcagaggagagtgagg

SEQ ID NO: 6703 - DNA, 20 bp, Artificial Sequence
  chemically synthesized
gcagaggagagtgaggcgga

SEQ ID NO: 6704 - DNA, 20 bp, Artificial Sequence
  chemically synthesized
cagaggagagtgaggcggac

SEQ ID NO: 6705 - DNA, 20 bp, Artificial Sequence
  chemically synthesized
agaggagagtgaggcggaca

SEQ ID NO: 6706 - DNA, 20 bp, Artificial Sequence
  chemically synthesized
gcggacagggcctctgcctg

SEQ ID NO: 6707 - DNA, 20 bp, Artificial Sequence
  chemically synthesized
cggacagggcctctgcctgt

SEQ ID NO: 6708 - DNA, 20 bp, Artificial Sequence
  chemically synthesized
ggacagggcctctgcctgtg

SEQ ID NO: 6709 - DNA, 20 bp, Artificial Sequence
  chemically synthesized
ctgcctgtggggacaccgcc

SEQ ID NO: 6710 - DNA, 20 bp, Artificial Sequence
  chemically synthesized
cctgtggggacaccgcctgg

SEQ ID NO: 6711 - DNA, 20 bp, Artificial Sequence
  chemically synthesized
ctgtggggacaccgcctggt

SEQ ID NO: 6712 - DNA, 20 bp, Artificial Sequence
  chemically synthesized
tggggacaccgcctggtggg

SEQ ID NO: 6713 - DNA, 20 bp, Artificial Sequence
  chemically synthesized
acaccgcctggtgggaagtc

SEQ ID NO: 6714 - DNA, 20 bp, Artificial Sequence
  chemically synthesized
cgcctggtgggaagtccagc

SEQ ID NO: 6715 - DNA, 20 bp, Artificial Sequence
  chemically synthesized
gaagtccagccagcccccta

SEQ ID NO: 6716 - DNA, 20 bp, Artificial Sequence
  chemically synthesized
agtccagccagccccctaca

SEQ ID NO: 6717 - DNA, 20 bp, Artificial Sequence
  chemically synthesized
tccagccagccccctacaga

SEQ ID NO: 6718 - DNA, 20 bp, Artificial Sequence
  chemically synthesized
cagccagccccctacagaga

SEQ ID NO: 6719 - DNA, 20 bp, Artificial Sequence
  chemically synthesized
agccagccccctacagagag

SEQ ID NO: 6720 - DNA, 20 bp, Artificial Sequence
  chemically synthesized
ccagccccctacagagagag

SEQ ID NO: 6721 - DNA, 20 bp, Artificial Sequence
  chemically synthesized
acagagagaggagatgctac

SEQ ID NO: 6722 - DNA, 20 bp, Artificial Sequence
  chemically synthesized
gagatgctactggtgttcct

SEQ ID NO: 6723 - DNA, 20 bp, Artificial Sequence
  chemically synthesized
atgctactggtgttcctgag

SEQ ID NO: 6724 - DNA, 20 bp, Artificial Sequence
  chemically synthesized
tggtgttcctgagtggtcct

SEQ ID NO: 6725 - DNA, 20 bp, Artificial Sequence
  chemically synthesized
ggtgttcctgagtggtcctc

SEQ ID NO: 6726 - DNA, 20 bp, Artificial Sequence
  chemically synthesized
tgttcctgagtggtcctcgg

SEQ ID NO: 6727 - DNA, 20 bp, Artificial Sequence
  chemically synthesized
gttcctgagtggtcctcggg

SEQ ID NO: 6728 - DNA, 20 bp, Artificial Sequence
  chemically synthesized
ttcctgagtggtcctcggga

SEQ ID NO: 6729 - DNA, 20 bp, Artificial Sequence
  chemically synthesized
gtcccctgccctgccctgcc

SEQ ID NO: 6730 - DNA, 20 bp, Artificial Sequence
  chemically synthesized
tgccctgccctgcccagcac

SEQ ID NO: 6731 - DNA, 20 bp, Artificial Sequence
  chemically synthesized
gcccagcaccggccctccct

SEQ ID NO: 6732 - DNA, 20 bp, Artificial Sequence
  chemically synthesized
agcaccggccctccctcggt

SEQ ID NO: 6733 - DNA, 20 bp, Artificial Sequence
  chemically synthesized
ccggccctccctcggttggc

SEQ ID NO: 6734 - DNA, 20 bp, Artificial Sequence
  chemically synthesized
ctccctcggttggccagcct

SEQ ID NO: 6735 - DNA, 20 bp, Artificial Sequence
  chemically synthesized
tccctcggttggccagcctc

SEQ ID NO: 6736 - DNA, 20 bp, Artificial Sequence
  chemically synthesized
ggttggccagcctcaggaat

SEQ ID NO: 6737 - DNA, 20 bp, Artificial Sequence
  chemically synthesized
gttggccagcctcaggaatg

SEQ ID NO: 6738 - DNA, 20 bp, Artificial Sequence
  chemically synthesized
tggccagcctcaggaatgag

SEQ ID NO: 6739 - DNA, 20 bp, Artificial Sequence
  chemically synthesized
gaatgaggagtccctcattc

SEQ ID NO: 6740 - DNA, 20 bp, Artificial Sequence
  chemically synthesized
aggagtccctcattccagcc

SEQ ID NO: 6741 - DNA, 20 bp, Artificial Sequence
  chemically synthesized
agctaaccaatccccttcct

SEQ ID NO: 6742 - DNA, 20 bp, Artificial Sequence
  chemically synthesized
caatccccttcctaagctcc

SEQ ID NO: 6743 - DNA, 20 bp, Artificial Sequence
  chemically synthesized
ccctgctcctcctgcctcca

SEQ ID NO: 6744 - DNA, 20 bp, Artificial Sequence
  chemically synthesized
cctcctgcctccatggaacc

SEQ ID NO: 6745 - DNA, 20 bp, Artificial Sequence
  chemically synthesized
atggaacccggctccaccac

SEQ ID NO: 6746 - DNA, 20 bp, Artificial Sequence
  chemically synthesized
acctgacactcctccattcc

SEQ ID NO: 6747 - DNA, 20 bp, Artificial Sequence
  chemically synthesized
ctggctcttgcccttctgcc

SEQ ID NO: 6748 - DNA, 20 bp, Artificial Sequence
  chemically synthesized
cccttctgcctagcactgct

SEQ ID NO: 6749 - DNA, 20 bp, Artificial Sequence
  chemically synthesized
accttaaaatcttttcccac

SEQ ID NO: 6750 - DNA, 20 bp, Artificial Sequence
  chemically synthesized
aaaatcttttcccaccagcc

SEQ ID NO: 6751 - DNA, 20 bp, Artificial Sequence
  chemically synthesized
aaatcttttcccaccagcct

SEQ ID NO: 6752 - DNA, 20 bp, Artificial Sequence
  chemically synthesized
tcccaccagcctgggcaaca

SEQ ID NO: 6753 - DNA, 20 bp, Artificial Sequence
  chemically synthesized
accagcctgggcaacatagc

SEQ ID NO: 6754 - DNA, 20 bp, Artificial Sequence
  chemically synthesized
aaaaattttttttaatttgc

SEQ ID NO: 6755 - DNA, 20 bp, Artificial Sequence
  chemically synthesized
aaaattttttttaatttgcc

SEQ ID NO: 6756 - DNA, 20 bp, Artificial Sequence
  chemically synthesized
tttttttaatttgccaggca

SEQ ID NO: 6757 - DNA, 20 bp, Artificial Sequence
  chemically synthesized
ttttaatttgccaggcacag

SEQ ID NO: 6758 - DNA, 20 bp, Artificial Sequence
  chemically synthesized
gcacagtggtgcacacctgt

SEQ ID NO: 6759 - DNA, 20 bp, Artificial Sequence
  chemically synthesized
acctgtaagtcctaactact

SEQ ID NO: 6760 - DNA, 20 bp, Artificial Sequence
  chemically synthesized
cctgtaagtcctaactactt

SEQ ID NO: 6761 - DNA, 20 bp, Artificial Sequence
  chemically synthesized
tgtaagtcctaactacttgg

SEQ ID NO: 6762 - DNA, 20 bp, Artificial Sequence
  chemically synthesized
gtaagtcctaactacttggg

SEQ ID NO: 6763 - DNA, 20 bp, Artificial Sequence
  chemically synthesized
tcctaactacttgggaggct

SEQ ID NO: 6764 - DNA, 20 bp, Artificial Sequence
  chemically synthesized
cctaactacttgggaggctg

SEQ ID NO: 6765 - DNA, 20 bp, Artificial Sequence
  chemically synthesized
aactacttgggaggctgagg

SEQ ID NO: 6766 - DNA, 20 bp, Artificial Sequence
  chemically synthesized
actacttgggaggctgaggt

SEQ ID NO: 6767 - DNA, 20 bp, Artificial Sequence
  chemically synthesized
tacttgggaggctgaggtgg

SEQ ID NO: 6768 - DNA, 20 bp, Artificial Sequence
  chemically synthesized
acttgggaggctgaggtggg

SEQ ID NO: 6769 - DNA, 20 bp, Artificial Sequence
  chemically synthesized
gggaggctgaggtgggagga

SEQ ID NO: 6770 - DNA, 20 bp, Artificial Sequence
  chemically synthesized
ctgaggtgggaggatggctt

SEQ ID NO: 6771 - DNA, 20 bp, Artificial Sequence
  chemically synthesized
gtgggaggatggcttgagcc

SEQ ID NO: 6772 - DNA, 20 bp, Artificial Sequence
  chemically synthesized
tgggaggatggcttgagccc

SEQ ID NO: 6773 - DNA, 20 bp, Artificial Sequence
  chemically synthesized
ggaggatggcttgagcccag

SEQ ID NO: 6774 - DNA, 20 bp, Artificial Sequence
  chemically synthesized
tggcttgagcccaggagttc

SEQ ID NO: 6775 - DNA, 20 bp, Artificial Sequence
  chemically synthesized
ggcttgagcccaggagttcg

SEQ ID NO: 6776 - DNA, 20 bp, Artificial Sequence
  chemically synthesized
agcccaggagttcgaggttg

SEQ ID NO: 6777 - DNA, 20 bp, Artificial Sequence
  chemically synthesized
caggagttcgaggttgcagt

SEQ ID NO: 6778 - DNA, 20 bp, Artificial Sequence
  chemically synthesized
tctctaaaaaaaaaatgtcc

SEQ ID NO: 6779 - DNA, 20 bp, Artificial Sequence
  chemically synthesized
aaaaaaatgtccaagatact

SEQ ID NO: 6780 - DNA, 20 bp, Artificial Sequence
  chemically synthesized
aaaaaatgtccaagatactt

SEQ ID NO: 6781 - DNA, 20 bp, Artificial Sequence
  chemically synthesized
tccaagatacttaggtcctt

SEQ ID NO: 6782 - DNA, 20 bp, Artificial Sequence
  chemically synthesized
gatacttaggtccttcagtc

SEQ ID NO: 6783 - DNA, 20 bp, Artificial Sequence
  chemically synthesized
ccttcagtcaagatttatta

SEQ ID NO: 6784 - DNA, 20 bp, Artificial Sequence
  chemically synthesized
tcagtcaagatttattacag

SEQ ID NO: 6785 - DNA, 20 bp, Artificial Sequence
  chemically synthesized
cagtcaagatttattacaga

SEQ ID NO: 6786 - DNA, 20 bp, Artificial Sequence
  chemically synthesized
agatttattacagaaggatc

SEQ ID NO: 6787 - DNA, 20 bp, Artificial Sequence
  chemically synthesized
gatttattacagaaggatcc

SEQ ID NO: 6788 - DNA, 20 bp, Artificial Sequence
  chemically synthesized
atttattacagaaggatcca

SEQ ID NO: 6789 - DNA, 20 bp, Artificial Sequence
  chemically synthesized
tattacagaaggatccaggg

SEQ ID NO: 6790 - DNA, 20 bp, Artificial Sequence
  chemically synthesized
attacagaaggatccaggga

SEQ ID NO: 6791 - DNA, 20 bp, Artificial Sequence
  chemically synthesized
ttacagaaggatccagggaa

SEQ ID NO: 6792 - DNA, 20 bp, Artificial Sequence
  chemically synthesized
aaggatccagggaagggtct

SEQ ID NO: 6793 - DNA, 20 bp, Artificial Sequence
  chemically synthesized
aggatccagggaagggtctt

SEQ ID NO: 6794 - DNA, 20 bp, Artificial Sequence
  chemically synthesized
gatccagggaagggtcttgg

SEQ ID NO: 6795 - DNA, 20 bp, Artificial Sequence
  chemically synthesized
agggaagggtcttgggagat

SEQ ID NO: 6796 - DNA, 20 bp, Artificial Sequence
  chemically synthesized
ggaagggtcttgggagatga

SEQ ID NO: 6797 - DNA, 20 bp, Artificial Sequence
  chemically synthesized
gaagggtcttgggagatgag

SEQ ID NO: 6798 - DNA, 20 bp, Artificial Sequence
  chemically synthesized
agggtcttgggagatgagag

SEQ ID NO: 6799 - DNA, 20 bp, Artificial Sequence
  chemically synthesized
gtcttgggagatgagaggag

SEQ ID NO: 6800 - DNA, 20 bp, Artificial Sequence
  chemically synthesized
tcttgggagatgagaggagc

SEQ ID NO: 6801 - DNA, 20 bp, Artificial Sequence
  chemically synthesized
cttgggagatgagaggagca

SEQ ID NO: 6802 - DNA, 20 bp, Artificial Sequence
  chemically synthesized
tgagaggagcagggatcttc

SEQ ID NO: 6803 - DNA, 20 bp, Artificial Sequence
  chemically synthesized
gagaggagcagggatcttcc

SEQ ID NO: 6804 - DNA, 20 bp, Artificial Sequence
  chemically synthesized
cacaacatacacacatgcac

SEQ ID NO: 6805 - DNA, 20 bp, Artificial Sequence
  chemically synthesized
cacaacatacactcacacac

SEQ ID NO: 6806 - DNA, 20 bp, Artificial Sequence
  chemically synthesized
cattcactcacacacacaca

SEQ ID NO: 6807 - DNA, 20 bp, Artificial Sequence
  chemically synthesized
ttcactcacacacacacaca

SEQ ID NO: 6808 - DNA, 20 bp, Artificial Sequence
  chemically synthesized
cacacacacacacagagtcc

SEQ ID NO: 6809 - DNA, 20 bp, Artificial Sequence
  chemically synthesized
atacgtgcacacgcacatac

SEQ ID NO: 6810 - DNA, 20 bp, Artificial Sequence
  chemically synthesized
tacgtgcacacgcacatacg

SEQ ID NO: 6811 - DNA, 20 bp, Artificial Sequence
  chemically synthesized
atacgaggcacatgtgttct

SEQ ID NO: 6812 - DNA, 20 bp, Artificial Sequence
  chemically synthesized
tacgaggcacatgtgttctt

SEQ ID NO: 6813 - DNA, 20 bp, Artificial Sequence
  chemically synthesized
aggcacatgtgttcttgggt

SEQ ID NO: 6814 - DNA, 20 bp, Artificial Sequence
  chemically synthesized
ggcacatgtgttcttgggtt

SEQ ID NO: 6815 - DNA, 20 bp, Artificial Sequence
  chemically synthesized
cacatgtgttcttgggttgg

SEQ ID NO: 6816 - DNA, 20 bp, Artificial Sequence
  chemically synthesized
acatgtgttcttgggttggg

SEQ ID NO: 6817 - DNA, 20 bp, Artificial Sequence
  chemically synthesized
atgtgttcttgggttgggag

SEQ ID NO: 6818 - DNA, 20 bp, Artificial Sequence
  chemically synthesized
tgttcttgggttgggaggag

SEQ ID NO: 6819 - DNA, 20 bp, Artificial Sequence
  chemically synthesized
gttcttgggttgggaggaga

SEQ ID NO: 6820 - DNA, 20 bp, Artificial Sequence
  chemically synthesized
ttcttgggttgggaggagaa

SEQ ID NO: 6821 - DNA, 20 bp, Artificial Sequence
  chemically synthesized
ttgggttgggaggagaaggg

SEQ ID NO: 6822 - DNA, 20 bp, Artificial Sequence
  chemically synthesized
tgggttgggaggagaagggc

SEQ ID NO: 6823 - DNA, 20 bp, Artificial Sequence
  chemically synthesized
gttgggaggagaagggcagg

SEQ ID NO: 6824 - DNA, 20 bp, Artificial Sequence
  chemically synthesized
aagggcaggcagttatcttc

SEQ ID NO: 6825 - DNA, 20 bp, Artificial Sequence
  chemically synthesized
tccagatctccccacacctc

SEQ ID NO: 6826 - DNA, 20 bp, Artificial Sequence
  chemically synthesized
cctctggcacatgcctttcc

SEQ ID NO: 6827 - DNA, 20 bp, Artificial Sequence
  chemically synthesized
ctctggcacatgcctttcct

SEQ ID NO: 6828 - DNA, 20 bp, Artificial Sequence
  chemically synthesized
tctggcacatgcctttcctg

SEQ ID NO: 6829 - DNA, 20 bp, Artificial Sequence
  chemically synthesized
acatgcctttcctggggtcc

SEQ ID NO: 6830 - DNA, 20 bp, Artificial Sequence
  chemically synthesized
catgcctttcctggggtcct

SEQ ID NO: 6831 - DNA, 20 bp, Artificial Sequence
  chemically synthesized
atgcctttcctggggtcctg

SEQ ID NO: 6832 - DNA, 20 bp, Artificial Sequence
  chemically synthesized
cctttcctggggtcctgggg

SEQ ID NO: 6833 - DNA, 20 bp, Artificial Sequence
  chemically synthesized
tcctggggtcctggggtaga

SEQ ID NO: 6834 - DNA, 20 bp, Artificial Sequence
  chemically synthesized
cctggggtcctggggtagac

SEQ ID NO: 6835 - DNA, 20 bp, Artificial Sequence
  chemically synthesized
ggggtcctggggtagacagg

SEQ ID NO: 6836 - DNA, 20 bp, Artificial Sequence
  chemically synthesized
gggtcctggggtagacagga

SEQ ID NO: 6837 - DNA, 20 bp, Artificial Sequence
  chemically synthesized
cctggggtagacaggaaggt

SEQ ID NO: 6838 - DNA, 20 bp, Artificial Sequence
  chemically synthesized
ctggggtagacaggaaggtg

SEQ ID NO: 6839 - DNA, 20 bp, Artificial Sequence
  chemically synthesized
ggtagacaggaaggtgaggt

SEQ ID NO: 6840 - DNA, 20 bp, Artificial Sequence
  chemically synthesized
gtagacaggaaggtgaggtg

SEQ ID NO: 6841 - DNA, 20 bp, Artificial Sequence
  chemically synthesized
tagacaggaaggtgaggtga

SEQ ID NO: 6842 - DNA, 20 bp, Artificial Sequence
  chemically synthesized
ggaaggtgaggtgagggaac

SEQ ID NO: 6843 - DNA, 20 bp, Artificial Sequence
  chemically synthesized
aggtgaggtgagggaacaag

SEQ ID NO: 6844 - DNA, 20 bp, Artificial Sequence
  chemically synthesized
ggtgaggtgagggaacaagc

SEQ ID NO: 6845 - DNA, 20 bp, Artificial Sequence
  chemically synthesized
gtgaggtgagggaacaagcg

SEQ ID NO: 6846 - DNA, 20 bp, Artificial Sequence
  chemically synthesized
tgaggtgagggaacaagcgg

SEQ ID NO: 6847 - DNA, 20 bp, Artificial Sequence
  chemically synthesized
gagggaacaagcgggggtgt

SEQ ID NO: 6848 - DNA, 20 bp, Artificial Sequence
  chemically synthesized
agggaacaagcgggggtgtc

SEQ ID NO: 6849 - DNA, 20 bp, Artificial Sequence
  chemically synthesized
cgggggtgtcgggccctcct

SEQ ID NO: 6850 - DNA, 20 bp, Artificial Sequence
  chemically synthesized
ccctcctcagtccctgttca

SEQ ID NO: 6851 - DNA, 20 bp, Artificial Sequence
  chemically synthesized
ctcctcagtccctgttcaca

SEQ ID NO: 6852 - DNA, 20 bp, Artificial Sequence
  chemically synthesized
ctcagtccctgttcacagag

SEQ ID NO: 6853 - DNA, 20 bp, Artificial Sequence
  chemically synthesized
tcagtccctgttcacagagt

SEQ ID NO: 6854 - DNA, 20 bp, Artificial Sequence
  chemically synthesized
ccctgttcacagagtgggtg

SEQ ID NO: 6855 - DNA, 20 bp, Artificial Sequence
  chemically synthesized
tgttcacagagtgggtgcgg

SEQ ID NO: 6856 - DNA, 20 bp, Artificial Sequence
  chemically synthesized
ttcacagagtgggtgcggca

SEQ ID NO: 6857 - DNA, 20 bp, Artificial Sequence
  chemically synthesized
tgggtgcggcagagacctca

SEQ ID NO: 6858 - DNA, 20 bp, Artificial Sequence
  chemically synthesized
gggtgcggcagagacctcaa

SEQ ID NO: 6859 - DNA, 20 bp, Artificial Sequence
  chemically synthesized
ggtgcggcagagacctcaaa

SEQ ID NO: 6860 - DNA, 20 bp, Artificial Sequence
  chemically synthesized
cggcagagacctcaaaggga

SEQ ID NO: 6861 - DNA, 20 bp, Artificial Sequence
  chemically synthesized
gcagagacctcaaagggaca

SEQ ID NO: 6862 - DNA, 20 bp, Artificial Sequence
  chemically synthesized
caaagggacagagcaatcat

SEQ ID NO: 6863 - DNA, 20 bp, Artificial Sequence
  chemically synthesized
ggacagagcaatcatgagct

SEQ ID NO: 6864 - DNA, 20 bp, Artificial Sequence
  chemically synthesized
agagcaatcatgagctgaga

SEQ ID NO: 6865 - DNA, 20 bp, Artificial Sequence
  chemically synthesized
agcaatcatgagctgagaca

SEQ ID NO: 6866 - DNA, 20 bp, Artificial Sequence
  chemically synthesized
gcaatcatgagctgagacag

SEQ ID NO: 6867 - DNA, 20 bp, Artificial Sequence
  chemically synthesized
caatcatgagctgagacaga

SEQ ID NO: 6868 - DNA, 20 bp, Artificial Sequence
  chemically synthesized
aatcatgagctgagacagag

SEQ ID NO: 6869 - DNA, 20 bp, Artificial Sequence
  chemically synthesized
atcatgagctgagacagagg

SEQ ID NO: 6870 - DNA, 20 bp, Artificial Sequence
  chemically synthesized
catgagctgagacagagggg

SEQ ID NO: 6871 - DNA, 20 bp, Artificial Sequence
  chemically synthesized
gctgagacagagggggagca

SEQ ID NO: 6872 - DNA, 20 bp, Artificial Sequence
  chemically synthesized
acagagggggagcaaagccg

SEQ ID NO: 6873 - DNA, 20 bp, Artificial Sequence
  chemically synthesized
gcacacttgcctttcaaaaa

SEQ ID NO: 6874 - DNA, 20 bp, Artificial Sequence
  chemically synthesized
caaaaatggatttcctctcc

SEQ ID NO: 6875 - DNA, 20 bp, Artificial Sequence
  chemically synthesized
aaaaatggatttcctctcct

SEQ ID NO: 6876 - DNA, 20 bp, Artificial Sequence
  chemically synthesized
ggatttcctctcctgggatt

SEQ ID NO: 6877 - DNA, 20 bp, Artificial Sequence
  chemically synthesized
tctcctgggattcagcctgc

SEQ ID NO: 6878 - DNA, 20 bp, Artificial Sequence
  chemically synthesized
ggattcagcctgcgagtgcc

SEQ ID NO: 6879 - DNA, 20 bp, Artificial Sequence
  chemically synthesized
tgcctggcccctcaccttga

SEQ ID NO: 6880 - DNA, 20 bp, Artificial Sequence
  chemically synthesized
tggcccctcaccttgatgga

SEQ ID NO: 6881 - DNA, 20 bp, Artificial Sequence
  chemically synthesized
ggcccctcaccttgatggaa

SEQ ID NO: 6882 - DNA, 20 bp, Artificial Sequence
  chemically synthesized
cctcaccttgatggaaagga

SEQ ID NO: 6883 - DNA, 20 bp, Artificial Sequence
  chemically synthesized
aaggatggtcattttcctcc

SEQ ID NO: 6884 - DNA, 20 bp, Artificial Sequence
  chemically synthesized
tggtcattttcctccgagct

SEQ ID NO: 6885 - DNA, 20 bp, Artificial Sequence
  chemically synthesized
tttcctccgagctcagctgc

SEQ ID NO: 6886 - DNA, 20 bp, Artificial Sequence
  chemically synthesized
tcagctgctggatatcttga

SEQ ID NO: 6887 - DNA, 20 bp, Artificial Sequence
  chemically synthesized
ctggatatcttgaaagtcct

SEQ ID NO: 6888 - DNA, 20 bp, Artificial Sequence
  chemically synthesized
ttgaaagtccttggccatga

SEQ ID NO: 6889 - DNA, 20 bp, Artificial Sequence
  chemically synthesized
tgaaagtccttggccatgat

SEQ ID NO: 6890 - DNA, 20 bp, Artificial Sequence
  chemically synthesized
gaaagtccttggccatgatg

SEQ ID NO: 6891 - DNA, 20 bp, Artificial Sequence
  chemically synthesized
tccttggccatgatggggcc

SEQ ID NO: 6892 - DNA, 20 bp, Artificial Sequence
  chemically synthesized
ccttggccatgatggggccc

SEQ ID NO: 6893 - DNA, 20 bp, Artificial Sequence
  chemically synthesized
ggccatgatggggcccgggc

SEQ ID NO: 6894 - DNA, 20 bp, Artificial Sequence
  chemically synthesized
ccatgatggggcccgggctg

SEQ ID NO: 6895 - DNA, 20 bp, Artificial Sequence
  chemically synthesized
gatggggcccgggctggagc

SEQ ID NO: 6896 - DNA, 20 bp, Artificial Sequence
  chemically synthesized
tggggcccgggctggagctg

SEQ ID NO: 6897 - DNA, 20 bp, Artificial Sequence
  chemically synthesized
gcccgggctggagctggagc

SEQ ID NO: 6898 - DNA, 20 bp, Artificial Sequence
  chemically synthesized
ccgggctggagctggagctg

SEQ ID NO: 6899 - DNA, 20 bp, Artificial Sequence
  chemically synthesized
gctggagctggagctggagc

SEQ ID NO: 6900 - DNA, 20 bp, Artificial Sequence
  chemically synthesized
ctggagctggagctggagct

SEQ ID NO: 6901 - DNA, 20 bp, Artificial Sequence
  chemically synthesized
agctggagctggagctgggc

SEQ ID NO: 6902 - DNA, 20 bp, Artificial Sequence
  chemically synthesized
gctggagctggagctgggct

SEQ ID NO: 6903 - DNA, 20 bp, Artificial Sequence
  chemically synthesized
gagctggagctgggctgggc

SEQ ID NO: 6904 - DNA, 20 bp, Artificial Sequence
  chemically synthesized
agctggagctgggctgggct

SEQ ID NO: 6905 - DNA, 20 bp, Artificial Sequence
  chemically synthesized
gagctgggctgggctgggct

SEQ ID NO: 6906 - DNA, 20 bp, Artificial Sequence
  chemically synthesized
agctgggctgggctgggctg

SEQ ID NO: 6907 - DNA, 20 bp, Artificial Sequence
  chemically synthesized
ggctgggctgaggttgctct

SEQ ID NO: 6908 - DNA, 20 bp, Artificial Sequence
  chemically synthesized
gctgggctgaggttgctctg

SEQ ID NO: 6909 - DNA, 20 bp, Artificial Sequence
  chemically synthesized
ctgggctgaggttgctctga

SEQ ID NO: 6910 - DNA, 20 bp, Artificial Sequence
  chemically synthesized
gctgaggttgctctgagggc

SEQ ID NO: 6911 - DNA, 20 bp, Artificial Sequence
  chemically synthesized
ctgaggttgctctgagggct

SEQ ID NO: 6912 - DNA, 20 bp, Artificial Sequence
  chemically synthesized
tgaggttgctctgagggctg

SEQ ID NO: 6913 - DNA, 20 bp, Artificial Sequence
  chemically synthesized
gttgctctgagggctggggc

SEQ ID NO: 6914 - DNA, 20 bp, Artificial Sequence
  chemically synthesized
ttgctctgagggctggggct

SEQ ID NO: 6915 - DNA, 20 bp, Artificial Sequence
  chemically synthesized
tgctctgagggctggggctg

SEQ ID NO: 6916 - DNA, 20 bp, Artificial Sequence
  chemically synthesized
tctgagggctggggctgggg

SEQ ID NO: 6917 - DNA, 20 bp, Artificial Sequence
  chemically synthesized
tgagggctggggctggggca

SEQ ID NO: 6918 - DNA, 20 bp, Artificial Sequence
  chemically synthesized
gagggctggggctggggcag

SEQ ID NO: 6919 - DNA, 20 bp, Artificial Sequence
  chemically synthesized
ctggggctggggcagaggtg

SEQ ID NO: 6920 - DNA, 20 bp, Artificial Sequence
  chemically synthesized
ggcagaggtgcagattcacg

SEQ ID NO: 6921 - DNA, 20 bp, Artificial Sequence
  chemically synthesized
cagaggtgcagattcacgtg

SEQ ID NO: 6922 - DNA, 20 bp, Artificial Sequence
  chemically synthesized
agaggtgcagattcacgtgg

SEQ ID NO: 6923 - DNA, 20 bp, Artificial Sequence
  chemically synthesized
cagattcacgtggaggttga

SEQ ID NO: 6924 - DNA, 20 bp, Artificial Sequence
  chemically synthesized
attcacgtggaggttgatgg

SEQ ID NO: 6925 - DNA, 20 bp, Artificial Sequence
  chemically synthesized
ttcacgtggaggttgatggt

SEQ ID NO: 6926 - DNA, 20 bp, Artificial Sequence
  chemically synthesized
cgtggaggttgatggtggga

SEQ ID NO: 6927 - DNA, 20 bp, Artificial Sequence
  chemically synthesized
gttgatggtgggatggaacg

SEQ ID NO: 6928 - DNA, 20 bp, Artificial Sequence
  chemically synthesized
ttgatggtgggatggaacgc

SEQ ID NO: 6929 - DNA, 20 bp, Artificial Sequence
  chemically synthesized
tgatggtgggatggaacgca

SEQ ID NO: 6930 - DNA, 20 bp, Artificial Sequence
  chemically synthesized
ggtgggatggaacgcagggt

SEQ ID NO: 6931 - DNA, 20 bp, Artificial Sequence
  chemically synthesized
tgggatggaacgcagggtcg

SEQ ID NO: 6932 - DNA, 20 bp, Artificial Sequence
  chemically synthesized
gggatggaacgcagggtcgg

SEQ ID NO: 6933 - DNA, 20 bp, Artificial Sequence
  chemically synthesized
ggatggaacgcagggtcgga

SEQ ID NO: 6934 - DNA, 20 bp, Artificial Sequence
  chemically synthesized
gatggaacgcagggtcggag

SEQ ID NO: 6935 - DNA, 20 bp, Artificial Sequence
  chemically synthesized
aacgcagggtcggaggggtt

SEQ ID NO: 6936 - DNA, 20 bp, Artificial Sequence
  chemically synthesized
acgcagggtcggaggggttc

SEQ ID NO: 6937 - DNA, 20 bp, Artificial Sequence
  chemically synthesized
cgcagggtcggaggggttcg

SEQ ID NO: 6938 - DNA, 20 bp, Artificial Sequence
  chemically synthesized
agggtcggaggggttcgggg

SEQ ID NO: 6939 - DNA, 20 bp, Artificial Sequence
  chemically synthesized
gtcggaggggttcggggtgg

SEQ ID NO: 6940 - DNA, 20 bp, Artificial Sequence
  chemically synthesized
aggggttcggggtggtggcc

SEQ ID NO: 6941 - DNA, 20 bp, Artificial Sequence
  chemically synthesized
ggggttcggggtggtggcct

SEQ ID NO: 6942 - DNA, 20 bp, Artificial Sequence
  chemically synthesized
gttcggggtggtggcctggg

SEQ ID NO: 6943 - DNA, 20 bp, Artificial Sequence
  chemically synthesized
ttcggggtggtggcctgggt

SEQ ID NO: 6944 - DNA, 20 bp, Artificial Sequence
  chemically synthesized
tggtggcctgggtaggatct

SEQ ID NO: 6945 - DNA, 20 bp, Artificial Sequence
  chemically synthesized
ggtggcctgggtaggatctg

SEQ ID NO: 6946 - DNA, 20 bp, Artificial Sequence
  chemically synthesized
gcctgggtaggatctgaggt

SEQ ID NO: 6947 - DNA, 20 bp, Artificial Sequence
  chemically synthesized
tgccaacctcagatcctacc

SEQ ID NO: 6948 - DNA, 20 bp, Artificial Sequence
  chemically synthesized
gccaacctcagatcctaccc

SEQ ID NO: 6949 - DNA, 20 bp, Artificial Sequence
  chemically synthesized
gtgaatctgcacctctgccc

SEQ ID NO: 6950 - DNA, 20 bp, Artificial Sequence
  chemically synthesized
ctgcacctctgccccagccc

SEQ ID NO: 6951 - DNA, 20 bp, Artificial Sequence
  chemically synthesized
tctgccccagccccagccct

SEQ ID NO: 6952 - DNA, 20 bp, Artificial Sequence
  chemically synthesized
tgccccagccccagccctca

SEQ ID NO: 6953 - DNA, 20 bp, Artificial Sequence
  chemically synthesized
cccagccctcagagcaacct

SEQ ID NO: 6954 - DNA, 20 bp, Artificial Sequence
  chemically synthesized
ccctcagagcaacctcagcc

SEQ ID NO: 6955 - DNA, 20 bp, Artificial Sequence
  chemically synthesized
agagcaacctcagcccagcc

SEQ ID NO: 6956 - DNA, 20 bp, Artificial Sequence
  chemically synthesized
aacctcagcccagcccagcc

SEQ ID NO: 6957 - DNA, 20 bp, Artificial Sequence
  chemically synthesized
agcccagcccagcccagctc

SEQ ID NO: 6958 - DNA, 20 bp, Artificial Sequence
  chemically synthesized
gcccagcccagctccagctc

SEQ ID NO: 6959 - DNA, 20 bp, Artificial Sequence
  chemically synthesized
cccagctccagctccagctc

SEQ ID NO: 6960 - DNA, 20 bp, Artificial Sequence
  chemically synthesized
ctccagctccagctccagcc

SEQ ID NO: 6961 - DNA, 20 bp, Artificial Sequence
  chemically synthesized
tccagctccagctccagccc

SEQ ID NO: 6962 - DNA, 20 bp, Artificial Sequence
  chemically synthesized
ctccagcccgggccccatca

SEQ ID NO: 6963 - DNA, 20 bp, Artificial Sequence
  chemically synthesized
gcccgggccccatcatggcc

SEQ ID NO: 6964 - DNA, 20 bp, Artificial Sequence
  chemically synthesized
cccgggccccatcatggcca

SEQ ID NO: 6965 - DNA, 20 bp, Artificial Sequence
  chemically synthesized
catcatggccaaggactttc

SEQ ID NO: 6966 - DNA, 20 bp, Artificial Sequence
  chemically synthesized
ccaaggactttcaagatatc

SEQ ID NO: 6967 - DNA, 20 bp, Artificial Sequence
  chemically synthesized
aggactttcaagatatccag

SEQ ID NO: 6968 - DNA, 20 bp, Artificial Sequence
  chemically synthesized
tttcaagatatccagcagct

SEQ ID NO: 6969 - DNA, 20 bp, Artificial Sequence
  chemically synthesized
agatatccagcagctgagct

SEQ ID NO: 6970 - DNA, 20 bp, Artificial Sequence
  chemically synthesized
atatccagcagctgagctcg

SEQ ID NO: 6971 - DNA, 20 bp, Artificial Sequence
  chemically synthesized
tatccagcagctgagctcgg

SEQ ID NO: 6972 - DNA, 20 bp, Artificial Sequence
  chemically synthesized
aaatgaccatcctttccatc

SEQ ID NO: 6973 - DNA, 20 bp, Artificial Sequence
  chemically synthesized
aatgaccatcctttccatca

SEQ ID NO: 6974 - DNA, 20 bp, Artificial Sequence
  chemically synthesized
accatcctttccatcaaggt

SEQ ID NO: 6975 - DNA, 20 bp, Artificial Sequence
  chemically synthesized
ccatcctttccatcaaggtg

SEQ ID NO: 6976 - DNA, 20 bp, Artificial Sequence
  chemically synthesized
catcctttccatcaaggtga

SEQ ID NO: 6977 - DNA, 20 bp, Artificial Sequence
  chemically synthesized
atcctttccatcaaggtgag

SEQ ID NO: 6978 - DNA, 20 bp, Artificial Sequence
  chemically synthesized
tttccatcaaggtgaggggc

SEQ ID NO: 6979 - DNA, 20 bp, Artificial Sequence
  chemically synthesized
ttccatcaaggtgaggggcc

SEQ ID NO: 6980 - DNA, 20 bp, Artificial Sequence
  chemically synthesized
ggtgaggggccaggcactcg

SEQ ID NO: 6981 - DNA, 20 bp, Artificial Sequence
  chemically synthesized
gtgaggggccaggcactcgc

SEQ ID NO: 6982 - DNA, 20 bp, Artificial Sequence
  chemically synthesized
ggcactcgcaggctgaatcc

SEQ ID NO: 6983 - DNA, 20 bp, Artificial Sequence
  chemically synthesized
gcactcgcaggctgaatccc

SEQ ID NO: 6984 - DNA, 20 bp, Artificial Sequence
  chemically synthesized
actcgcaggctgaatcccag

SEQ ID NO: 6985 - DNA, 20 bp, Artificial Sequence
  chemically synthesized
tcgcaggctgaatcccagga

SEQ ID NO: 6986 - DNA, 20 bp, Artificial Sequence
  chemically synthesized
cgcaggctgaatcccaggag

SEQ ID NO: 6987 - DNA, 20 bp, Artificial Sequence
  chemically synthesized
gagaggaaatccatttttga

SEQ ID NO: 6988 - DNA, 20 bp, Artificial Sequence
  chemically synthesized
agaggaaatccatttttgaa

SEQ ID NO: 6989 - DNA, 20 bp, Artificial Sequence
  chemically synthesized
gaaatccatttttgaaaggc

SEQ ID NO: 6990 - DNA, 20 bp, Artificial Sequence
  chemically synthesized
atttttgaaaggcaagtgtg

SEQ ID NO: 6991 - DNA, 20 bp, Artificial Sequence
  chemically synthesized
aggcaagtgtgcagtttctg

SEQ ID NO: 6992 - DNA, 20 bp, Artificial Sequence
  chemically synthesized
gctttgctccccctctgtct

SEQ ID NO: 6993 - DNA, 20 bp, Artificial Sequence
  chemically synthesized
catgattgctctgtcccttt

SEQ ID NO: 6994 - DNA, 20 bp, Artificial Sequence
  chemically synthesized
atgattgctctgtccctttg

SEQ ID NO: 6995 - DNA, 20 bp, Artificial Sequence
  chemically synthesized
tgccgcacccactctgtgaa

SEQ ID NO: 6996 - DNA, 20 bp, Artificial Sequence
  chemically synthesized
gccgcacccactctgtgaac

SEQ ID NO: 6997 - DNA, 20 bp, Artificial Sequence
  chemically synthesized
ccgcacccactctgtgaaca

SEQ ID NO: 6998 - DNA, 20 bp, Artificial Sequence
  chemically synthesized
ccactctgtgaacagggact

SEQ ID NO: 6999 - DNA, 20 bp, Artificial Sequence
  chemically synthesized
cactctgtgaacagggactg

SEQ ID NO: 7000 - DNA, 20 bp, Artificial Sequence
  chemically synthesized
ctctgtgaacagggactgag

SEQ ID NO: 7001 - DNA, 20 bp, Artificial Sequence
  chemically synthesized
tctgtgaacagggactgagg

SEQ ID NO: 7002 - DNA, 20 bp, Artificial Sequence
  chemically synthesized
ctgtgaacagggactgagga

SEQ ID NO: 7003 - DNA, 20 bp, Artificial Sequence
  chemically synthesized
cctcaccttcctgtctaccc

SEQ ID NO: 7004 - DNA, 20 bp, Artificial Sequence
  chemically synthesized
ctcaccttcctgtctacccc

SEQ ID NO: 7005 - DNA, 20 bp, Artificial Sequence
  chemically synthesized
tcctgtctaccccaggaccc

SEQ ID NO: 7006 - DNA, 20 bp, Artificial Sequence
  chemically synthesized
cctgtctaccccaggacccc

SEQ ID NO: 7007 - DNA, 20 bp, Artificial Sequence
  chemically synthesized
tctaccccaggaccccagga

SEQ ID NO: 7008 - DNA, 20 bp, Artificial Sequence
  chemically synthesized
ctaccccaggaccccaggaa

SEQ ID NO: 7009 - DNA, 20 bp, Artificial Sequence
  chemically synthesized
accccaggaaaggcatgtgc

SEQ ID NO: 7010 - DNA, 20 bp, Artificial Sequence
  chemically synthesized
cccaggaaaggcatgtgcca

SEQ ID NO: 7011 - DNA, 20 bp, Artificial Sequence
  chemically synthesized
ccaggaaaggcatgtgccag

SEQ ID NO: 7012 - DNA, 20 bp, Artificial Sequence
  chemically synthesized
aaaggcatgtgccagaggtg

SEQ ID NO: 7013 - DNA, 20 bp, Artificial Sequence
  chemically synthesized
aaggcatgtgccagaggtgt

SEQ ID NO: 7014 - DNA, 20 bp, Artificial Sequence
  chemically synthesized
aggcatgtgccagaggtgtg

SEQ ID NO: 7015 - DNA, 20 bp, Artificial Sequence
  chemically synthesized
gcatgtgccagaggtgtggg

SEQ ID NO: 7016 - DNA, 20 bp, Artificial Sequence
  chemically synthesized
gccagaggtgtggggagatc

SEQ ID NO: 7017 - DNA, 20 bp, Artificial Sequence
  chemically synthesized
agaggtgtggggagatctgg

SEQ ID NO: 7018 - DNA, 20 bp, Artificial Sequence
  chemically synthesized
tgcccttctcctcccaaccc

SEQ ID NO: 7019 - DNA, 20 bp, Artificial Sequence
  chemically synthesized
gtgtgcacgtatgtgcatat

SEQ ID NO: 7020 - DNA, 20 bp, Artificial Sequence
  chemically synthesized
tgtgcacgtatgtgcatatg

SEQ ID NO: 7021 - DNA, 20 bp, Artificial Sequence
  chemically synthesized
gtatgtgcatatgaggaatg

SEQ ID NO: 7022 - DNA, 20 bp, Artificial Sequence
  chemically synthesized
gcatatgaggaatgcagatt

SEQ ID NO: 7023 - DNA, 20 bp, Artificial Sequence
  chemically synthesized
atgaggaatgcagattcagc

SEQ ID NO: 7024 - DNA, 20 bp, Artificial Sequence
  chemically synthesized
tgaggaatgcagattcagct

SEQ ID NO: 7025 - DNA, 20 bp, Artificial Sequence
  chemically synthesized
gggactctgtgtgtgtgtgt

SEQ ID NO: 7026 - DNA, 20 bp, Artificial Sequence
  chemically synthesized
gtgtgtgtgtatatgtgcgc

SEQ ID NO: 7027 - DNA, 20 bp, Artificial Sequence
  chemically synthesized
gtgtgtgtatatgtgcgcga

SEQ ID NO: 7028 - DNA, 20 bp, Artificial Sequence
  chemically synthesized
tgtgtgtatgtcgtgtatgt

SEQ ID NO: 7029 - DNA, 20 bp, Artificial Sequence
  chemically synthesized
tgtgtatgtcgtgtatgtga

SEQ ID NO: 7030 - DNA, 20 bp, Artificial Sequence
  chemically synthesized
gtgtatgtcgtgtatgtgag

SEQ ID NO: 7031 - DNA, 20 bp, Artificial Sequence
  chemically synthesized
tgtatgtcgtgtatgtgaga

SEQ ID NO: 7032 - DNA, 20 bp, Artificial Sequence
  chemically synthesized
tgagagggtatgttgtgtgt

SEQ ID NO: 7033 - DNA, 20 bp, Artificial Sequence
  chemically synthesized
agagggtatgttgtgtgtga

SEQ ID NO: 7034 - DNA, 20 bp, Artificial Sequence
  chemically synthesized
gttgtgtgtgtatgttgtgt

SEQ ID NO: 7035 - DNA, 20 bp, Artificial Sequence
  chemically synthesized
gttgtgtgtatcttgtgtgt

SEQ ID NO: 7036 - DNA, 20 bp, Artificial Sequence
  chemically synthesized
tgcatgtgtgtatgttgtgc

SEQ ID NO: 7037 - DNA, 20 bp, Artificial Sequence
  chemically synthesized
cgagtgtatgttgtgtatgt

SEQ ID NO: 7038 - DNA, 20 bp, Artificial Sequence
  chemically synthesized
tgtgtatgtatgttgtgtat

SEQ ID NO: 7039 - DNA, 20 bp, Artificial Sequence
  chemically synthesized
gttgtgtgtgtgtattgtgt

SEQ ID NO: 7040 - DNA, 20 bp, Artificial Sequence
  chemically synthesized
tgtatgtttgtgtgttgtgt

SEQ ID NO: 7041 - DNA, 20 bp, Artificial Sequence
  chemically synthesized
tgcgtgtgtgtatgttgtgc

SEQ ID NO: 7042 - DNA, 20 bp, Artificial Sequence
  chemically synthesized
gtgttgtgtgtgtatgttgt

SEQ ID NO: 7043 - DNA, 20 bp, Artificial Sequence
  chemically synthesized
gttatgtatgttgtgtgtgt

SEQ ID NO: 7044 - DNA, 20 bp, Artificial Sequence
  chemically synthesized
tgtgtgtgagtgtgttgcgt

SEQ ID NO: 7045 - DNA, 20 bp, Artificial Sequence
  chemically synthesized
tgttgcgtgagtgtgtgtgt

SEQ ID NO: 7046 - DNA, 20 bp, Artificial Sequence
  chemically synthesized
tgtgtgtgtgtgtgtgtgtg

SEQ ID NO: 7047 - DNA, 20 bp, Artificial Sequence
  chemically synthesized
tgtgtgtgtgtgtgtgtgta

SEQ ID NO: 7048 - DNA, 20 bp, Artificial Sequence
  chemically synthesized
gtgtgtgtgtgtgtgtgtag

SEQ ID NO: 7049 - DNA, 20 bp, Artificial Sequence
  chemically synthesized
tgtgtgtgtgtgtgtagagg

SEQ ID NO: 7050 - DNA, 20 bp, Artificial Sequence
  chemically synthesized
gtgtgtgtgtgtgtagaggt

SEQ ID NO: 7051 - DNA, 20 bp, Artificial Sequence
  chemically synthesized
tgtgtgtgtgtgtagaggtg

SEQ ID NO: 7052 - DNA, 20 bp, Artificial Sequence
  chemically synthesized
tgtgtgtgtagaggtggggt

SEQ ID NO: 7053 - DNA, 20 bp, Artificial Sequence
  chemically synthesized
tgtgtagaggtggggtgagt

SEQ ID NO: 7054 - DNA, 20 bp, Artificial Sequence
  chemically synthesized
gtgtagaggtggggtgagtt

SEQ ID NO: 7055 - DNA, 20 bp, Artificial Sequence
  chemically synthesized
agaggtggggtgagttggga

SEQ ID NO: 7056 - DNA, 20 bp, Artificial Sequence
  chemically synthesized
gaggtggggtgagttgggat

SEQ ID NO: 7057 - DNA, 20 bp, Artificial Sequence
  chemically synthesized
gtggggtgagttgggatggg

SEQ ID NO: 7058 - DNA, 20 bp, Artificial Sequence
  chemically synthesized
tggggtgagttgggatgggt

SEQ ID NO: 7059 - DNA, 20 bp, Artificial Sequence
  chemically synthesized
ggggtgagttgggatgggtg

SEQ ID NO: 7060 - DNA, 20 bp, Artificial Sequence
  chemically synthesized
gggtgagttgggatgggtgg

SEQ ID NO: 7061 - DNA, 20 bp, Artificial Sequence
  chemically synthesized
ttgggatgggtgggggacgt

SEQ ID NO: 7062 - DNA, 20 bp, Artificial Sequence
  chemically synthesized
atgggtgggggacgtgagca

SEQ ID NO: 7063 - DNA, 20 bp, Artificial Sequence
  chemically synthesized
gggtgggggacgtgagcaca

SEQ ID NO: 7064 - DNA, 20 bp, Artificial Sequence
  chemically synthesized
gtgggggacgtgagcacaga

SEQ ID NO: 7065 - DNA, 20 bp, Artificial Sequence
  chemically synthesized
acgtgagcacagagagatcc

SEQ ID NO: 7066 - DNA, 20 bp, Artificial Sequence
  chemically synthesized
tgagcacagagagatcctgg

SEQ ID NO: 7067 - DNA, 20 bp, Artificial Sequence
  chemically synthesized
ccctgctcctctcatctccc

SEQ ID NO: 7068 - DNA, 20 bp, Artificial Sequence
  chemically synthesized
catctcccaagacccttccc

SEQ ID NO: 7069 - DNA, 20 bp, Artificial Sequence
  chemically synthesized
tctgtaataaatcttgactg

SEQ ID NO: 7070 - DNA, 20 bp, Artificial Sequence
  chemically synthesized
ctgtaataaatcttgactga

SEQ ID NO: 7071 - DNA, 20 bp, Artificial Sequence
  chemically synthesized
aaatcttgactgaaggacct

SEQ ID NO: 7072 - DNA, 20 bp, Artificial Sequence
  chemically synthesized
actgaaggacctaagtatct

SEQ ID NO: 7073 - DNA, 20 bp, Artificial Sequence
  chemically synthesized
tatcttggacattttttttt

SEQ ID NO: 7074 - DNA, 20 bp, Artificial Sequence
  chemically synthesized
tcttggacatttttttttta

SEQ ID NO: 7075 - DNA, 20 bp, Artificial Sequence
  chemically synthesized
ggacattttttttttagaga

SEQ ID NO: 7076 - DNA, 20 bp, Artificial Sequence
  chemically synthesized
gacattttttttttagagac

SEQ ID NO: 7077 - DNA, 20 bp, Artificial Sequence
  chemically synthesized
cattttttttttagagacag

SEQ ID NO: 7078 - DNA, 20 bp, Artificial Sequence
  chemically synthesized
tttttttagagacaggagtg

SEQ ID NO: 7079 - DNA, 20 bp, Artificial Sequence
  chemically synthesized
ttttagagacaggagtgtag

SEQ ID NO: 7080 - DNA, 20 bp, Artificial Sequence
  chemically synthesized
tagagacaggagtgtagtgg

SEQ ID NO: 7081 - DNA, 20 bp, Artificial Sequence
  chemically synthesized
agagacaggagtgtagtggc

SEQ ID NO: 7082 - DNA, 20 bp, Artificial Sequence
  chemically synthesized
ggagtgtagtggcaggatca

SEQ ID NO: 7083 - DNA, 20 bp, Artificial Sequence
  chemically synthesized
tcactgcaacctcgaactcc

SEQ ID NO: 7084 - DNA, 20 bp, Artificial Sequence
  chemically synthesized
cactgcaacctcgaactcct

SEQ ID NO: 7085 - DNA, 20 bp, Artificial Sequence
  chemically synthesized
aacctcgaactcctgggctc

SEQ ID NO: 7086 - DNA, 20 bp, Artificial Sequence
  chemically synthesized
ctcaagccatcctcccacct

SEQ ID NO: 7087 - DNA, 20 bp, Artificial Sequence
  chemically synthesized
tcctcccacctcagcctccc

SEQ ID NO: 7088 - DNA, 20 bp, Artificial Sequence
  chemically synthesized
tcccacctcagcctcccaag

SEQ ID NO: 7089 - DNA, 20 bp, Artificial Sequence
  chemically synthesized
acctcagcctcccaagtagt

SEQ ID NO: 7090 - DNA, 20 bp, Artificial Sequence
  chemically synthesized
cctcagcctcccaagtagtt

SEQ ID NO: 7091 - DNA, 20 bp, Artificial Sequence
  chemically synthesized
tcccaagtagttaggactta

SEQ ID NO: 7092 - DNA, 20 bp, Artificial Sequence
  chemically synthesized
cccaagtagttaggacttac

SEQ ID NO: 7093 - DNA, 20 bp, Artificial Sequence
  chemically synthesized
caggtgtgcaccactgtgcc

SEQ ID NO: 7094 - DNA, 20 bp, Artificial Sequence
  chemically synthesized
gcaaattaaaaaaaattttt

SEQ ID NO: 7095 - DNA, 20 bp, Artificial Sequence
  chemically synthesized
aaattaaaaaaaatttttta

SEQ ID NO: 7096 - DNA, 20 bp, Artificial Sequence
  chemically synthesized
aaaaaaattttttagagaaa

SEQ ID NO: 7097 - DNA, 20 bp, Artificial Sequence
  chemically synthesized
aaaaaattttttagagaaat

SEQ ID NO: 7098 - DNA, 20 bp, Artificial Sequence
  chemically synthesized
aaaaattttttagagaaatg

SEQ ID NO: 7099 - DNA, 20 bp, Artificial Sequence
  chemically synthesized
tggggtcttgctatgttgcc

SEQ ID NO: 7100 - DNA, 20 bp, Artificial Sequence
  chemically synthesized
ggggtcttgctatgttgccc

SEQ ID NO: 7101 - DNA, 20 bp, Artificial Sequence
  chemically synthesized
tcttgctatgttgcccaggc

SEQ ID NO: 7102 - DNA, 20 bp, Artificial Sequence
  chemically synthesized
tgctatgttgcccaggctgg

SEQ ID NO: 7103 - DNA, 20 bp, Artificial Sequence
  chemically synthesized
gctatgttgcccaggctggt

SEQ ID NO: 7104 - DNA, 20 bp, Artificial Sequence
  chemically synthesized
gttgcccaggctggtgggaa

SEQ ID NO: 7105 - DNA, 20 bp, Artificial Sequence
  chemically synthesized
ggctggtgggaaaagatttt

SEQ ID NO: 7106 - DNA, 20 bp, Artificial Sequence
  chemically synthesized
gctggtgggaaaagatttta

SEQ ID NO: 7107 - DNA, 20 bp, Artificial Sequence
  chemically synthesized
gtgggaaaagattttaaggt

SEQ ID NO: 7108 - DNA, 20 bp, Artificial Sequence
  chemically synthesized
gggaaaagattttaaggtga

SEQ ID NO: 7109 - DNA, 20 bp, Artificial Sequence
  chemically synthesized
gaaaagattttaaggtgaga

SEQ ID NO: 7110 - DNA, 20 bp, Artificial Sequence
  chemically synthesized
ttttaaggtgagagagatct

SEQ ID NO: 7111 - DNA, 20 bp, Artificial Sequence
  chemically synthesized
taaggtgagagagatctgag

SEQ ID NO: 7112 - DNA, 20 bp, Artificial Sequence
  chemically synthesized
gagagagatctgagcagtgc

SEQ ID NO: 7113 - DNA, 20 bp, Artificial Sequence
  chemically synthesized
agagagatctgagcagtgct

SEQ ID NO: 7114 - DNA, 20 bp, Artificial Sequence
  chemically synthesized
gagatctgagcagtgctagg

SEQ ID NO: 7115 - DNA, 20 bp, Artificial Sequence
  chemically synthesized
atctgagcagtgctaggcag

SEQ ID NO: 7116 - DNA, 20 bp, Artificial Sequence
  chemically synthesized
tctgagcagtgctaggcaga

SEQ ID NO: 7117 - DNA, 20 bp, Artificial Sequence
  chemically synthesized
ctgagcagtgctaggcagaa

SEQ ID NO: 7118 - DNA, 20 bp, Artificial Sequence
  chemically synthesized
gcagtgctaggcagaagggc

SEQ ID NO: 7119 - DNA, 20 bp, Artificial Sequence
  chemically synthesized
agtgctaggcagaagggcaa

SEQ ID NO: 7120 - DNA, 20 bp, Artificial Sequence
  chemically synthesized
ctaggcagaagggcaagagc

SEQ ID NO: 7121 - DNA, 20 bp, Artificial Sequence
  chemically synthesized
taggcagaagggcaagagcc

SEQ ID NO: 7122 - DNA, 20 bp, Artificial Sequence
  chemically synthesized
agaagggcaagagccaggaa

SEQ ID NO: 7123 - DNA, 20 bp, Artificial Sequence
  chemically synthesized
aagggcaagagccaggaatg

SEQ ID NO: 7124 - DNA, 20 bp, Artificial Sequence
  chemically synthesized
agggcaagagccaggaatgg

SEQ ID NO: 7125 - DNA, 20 bp, Artificial Sequence
  chemically synthesized
ggcaagagccaggaatggag

SEQ ID NO: 7126 - DNA, 20 bp, Artificial Sequence
  chemically synthesized
agccaggaatggaggagtgt

SEQ ID NO: 7127 - DNA, 20 bp, Artificial Sequence
  chemically synthesized
gccaggaatggaggagtgtc

SEQ ID NO: 7128 - DNA, 20 bp, Artificial Sequence
  chemically synthesized
atggaggagtgtcaggtgtg

SEQ ID NO: 7129 - DNA, 20 bp, Artificial Sequence
  chemically synthesized
tggaggagtgtcaggtgtgt

SEQ ID NO: 7130 - DNA, 20 bp, Artificial Sequence
  chemically synthesized
agtgtcaggtgtgtgggtgc

SEQ ID NO: 7131 - DNA, 20 bp, Artificial Sequence
  chemically synthesized
gtcaggtgtgtgggtgctgg

SEQ ID NO: 7132 - DNA, 20 bp, Artificial Sequence
  chemically synthesized
aggtgtgtgggtgctggtgg

SEQ ID NO: 7133 - DNA, 20 bp, Artificial Sequence
  chemically synthesized
gtgtgtgggtgctggtggtg

SEQ ID NO: 7134 - DNA, 20 bp, Artificial Sequence
  chemically synthesized
gtgggtgctggtggtggagc

SEQ ID NO: 7135 - DNA, 20 bp, Artificial Sequence
  chemically synthesized
tgggtgctggtggtggagcc

SEQ ID NO: 7136 - DNA, 20 bp, Artificial Sequence
  chemically synthesized
ggtggtggagccgggttcca

SEQ ID NO: 7137 - DNA, 20 bp, Artificial Sequence
  chemically synthesized
tggtggagccgggttccatg

SEQ ID NO: 7138 - DNA, 20 bp, Artificial Sequence
  chemically synthesized
ggtggagccgggttccatgg

SEQ ID NO: 7139 - DNA, 20 bp, Artificial Sequence
  chemically synthesized
ggagccgggttccatggagg

SEQ ID NO: 7140 - DNA, 20 bp, Artificial Sequence
  chemically synthesized
gagccgggttccatggaggc

SEQ ID NO: 7141 - DNA, 20 bp, Artificial Sequence
  chemically synthesized
gccgggttccatggaggcag

SEQ ID NO: 7142 - DNA, 20 bp, Artificial Sequence
  chemically synthesized
ccgggttccatggaggcagg

SEQ ID NO: 7143 - DNA, 20 bp, Artificial Sequence
  chemically synthesized
gggttccatggaggcaggag

SEQ ID NO: 7144 - DNA, 20 bp, Artificial Sequence
  chemically synthesized
ttccatggaggcaggaggag

SEQ ID NO: 7145 - DNA, 20 bp, Artificial Sequence
  chemically synthesized
tccatggaggcaggaggagc

SEQ ID NO: 7146 - DNA, 20 bp, Artificial Sequence
  chemically synthesized
ccatggaggcaggaggagca

SEQ ID NO: 7147 - DNA, 20 bp, Artificial Sequence
  chemically synthesized
catggaggcaggaggagcag

SEQ ID NO: 7148 - DNA, 20 bp, Artificial Sequence
  chemically synthesized
aggcaggaggagcaggggct

SEQ ID NO: 7149 - DNA, 20 bp, Artificial Sequence
  chemically synthesized
gcaggaggagcaggggcttg

SEQ ID NO: 7150 - DNA, 20 bp, Artificial Sequence
  chemically synthesized
aggagcaggggcttggagct

SEQ ID NO: 7151 - DNA, 20 bp, Artificial Sequence
  chemically synthesized
ggagcaggggcttggagctt

SEQ ID NO: 7152 - DNA, 20 bp, Artificial Sequence
  chemically synthesized
gcaggggcttggagcttagg

SEQ ID NO: 7153 - DNA, 20 bp, Artificial Sequence
  chemically synthesized
caggggcttggagcttagga

SEQ ID NO: 7154 - DNA, 20 bp, Artificial Sequence
  chemically synthesized
aggggcttggagcttaggaa

SEQ ID NO: 7155 - DNA, 20 bp, Artificial Sequence
  chemically synthesized
ggggcttggagcttaggaag

SEQ ID NO: 7156 - DNA, 20 bp, Artificial Sequence
  chemically synthesized
ttggagcttaggaaggggat

SEQ ID NO: 7157 - DNA, 20 bp, Artificial Sequence
  chemically synthesized
agcttaggaaggggattggt

SEQ ID NO: 7158 - DNA, 20 bp, Artificial Sequence
  chemically synthesized
taggaaggggattggttagc

SEQ ID NO: 7159 - DNA, 20 bp, Artificial Sequence
  chemically synthesized
aggaaggggattggttagct

SEQ ID NO: 7160 - DNA, 20 bp, Artificial Sequence
  chemically synthesized
aggggattggttagctgggc

SEQ ID NO: 7161 - DNA, 20 bp, Artificial Sequence
  chemically synthesized
ttggttagctgggctggaat

SEQ ID NO: 7162 - DNA, 20 bp, Artificial Sequence
  chemically synthesized
tggttagctgggctggaatg

SEQ ID NO: 7163 - DNA, 20 bp, Artificial Sequence
  chemically synthesized
ggttagctgggctggaatga

SEQ ID NO: 7164 - DNA, 20 bp, Artificial Sequence
  chemically synthesized
atgagggactcctcattcct

SEQ ID NO: 7165 - DNA, 20 bp, Artificial Sequence
  chemically synthesized
tgagggactcctcattcctg

SEQ ID NO: 7166 - DNA, 20 bp, Artificial Sequence
  chemically synthesized
ggactcctcattcctgaggc

SEQ ID NO: 7167 - DNA, 20 bp, Artificial Sequence
  chemically synthesized
attcctgaggctggccaacc

SEQ ID NO: 7168 - DNA, 20 bp, Artificial Sequence
  chemically synthesized
ttcctgaggctggccaaccg

SEQ ID NO: 7169 - DNA, 20 bp, Artificial Sequence
  chemically synthesized
tcctgaggctggccaaccga

SEQ ID NO: 7170 - DNA, 20 bp, Artificial Sequence
  chemically synthesized
ctgaggctggccaaccgagg

SEQ ID NO: 7171 - DNA, 20 bp, Artificial Sequence
  chemically synthesized
tgaggctggccaaccgaggg

SEQ ID NO: 7172 - DNA, 20 bp, Artificial Sequence
  chemically synthesized
gaggctggccaaccgaggga

SEQ ID NO: 7173 - DNA, 20 bp, Artificial Sequence
  chemically synthesized
ctggccaaccgagggagggc

SEQ ID NO: 7174 - DNA, 20 bp, Artificial Sequence
  chemically synthesized
aaccgagggagggccggtgc

SEQ ID NO: 7175 - DNA, 20 bp, Artificial Sequence
  chemically synthesized
accgagggagggccggtgct

SEQ ID NO: 7176 - DNA, 20 bp, Artificial Sequence
  chemically synthesized
gagggagggccggtgctggg

SEQ ID NO: 7177 - DNA, 20 bp, Artificial Sequence
  chemically synthesized
agggagggccggtgctgggc

SEQ ID NO: 7178 - DNA, 20 bp, Artificial Sequence
  chemically synthesized
gggagggccggtgctgggca

SEQ ID NO: 7179 - DNA, 20 bp, Artificial Sequence
  chemically synthesized
agggccggtgctgggcaggg

SEQ ID NO: 7180 - DNA, 20 bp, Artificial Sequence
  chemically synthesized
gggccggtgctgggcagggc

SEQ ID NO: 7181 - DNA, 20 bp, Artificial Sequence
  chemically synthesized
ggccggtgctgggcagggca

SEQ ID NO: 7182 - DNA, 20 bp, Artificial Sequence
  chemically synthesized
cggtgctgggcagggcaggg

SEQ ID NO: 7183 - DNA, 20 bp, Artificial Sequence
  chemically synthesized
ggtgctgggcagggcagggc

SEQ ID NO: 7184 - DNA, 20 bp, Artificial Sequence
  chemically synthesized
gtgctgggcagggcagggca

SEQ ID NO: 7185 - DNA, 20 bp, Artificial Sequence
  chemically synthesized
tgctgggcagggcagggcag

SEQ ID NO: 7186 - DNA, 20 bp, Artificial Sequence
  chemically synthesized
gggcagggcagggcagggga

SEQ ID NO: 7187 - DNA, 20 bp, Artificial Sequence
  chemically synthesized
ggcagggcagggcaggggac

SEQ ID NO: 7188 - DNA, 20 bp, Artificial Sequence
  chemically synthesized
cagggcagggcaggggacag

SEQ ID NO: 7189 - DNA, 20 bp, Artificial Sequence
  chemically synthesized
agggcagggcaggggacagg

SEQ ID NO: 7190 - DNA, 20 bp, Artificial Sequence
  chemically synthesized
gggcagggcaggggacagga

SEQ ID NO: 7191 - DNA, 20 bp, Artificial Sequence
  chemically synthesized
agggcaggggacaggaggga

SEQ ID NO: 7192 - DNA, 20 bp, Artificial Sequence
  chemically synthesized
gggcaggggacaggagggat

SEQ ID NO: 7193 - DNA, 20 bp, Artificial Sequence
  chemically synthesized
gcaggggacaggagggatag

SEQ ID NO: 7194 - DNA, 20 bp, Artificial Sequence
  chemically synthesized
caggggacaggagggatagg

SEQ ID NO: 7195 - DNA, 20 bp, Artificial Sequence
  chemically synthesized
agggataggaggtccctccc

SEQ ID NO: 7196 - DNA, 20 bp, Artificial Sequence
  chemically synthesized
gggataggaggtccctcccg

SEQ ID NO: 7197 - DNA, 20 bp, Artificial Sequence
  chemically synthesized
ggtccctcccgaggaccact

SEQ ID NO: 7198 - DNA, 20 bp, Artificial Sequence
  chemically synthesized
gtccctcccgaggaccactc

SEQ ID NO: 7199 - DNA, 20 bp, Artificial Sequence
  chemically synthesized
cgaggaccactcaggaacac

SEQ ID NO: 7200 - DNA, 20 bp, Artificial Sequence
  chemically synthesized
ggaccactcaggaacaccag

SEQ ID NO: 7201 - DNA, 20 bp, Artificial Sequence
  chemically synthesized
agtagcatctcctctctctg

SEQ ID NO: 7202 - DNA, 20 bp, Artificial Sequence
  chemically synthesized
gtagcatctcctctctctgt

SEQ ID NO: 7203 - DNA, 20 bp, Artificial Sequence
  chemically synthesized
tagcatctcctctctctgta

SEQ ID NO: 7204 - DNA, 20 bp, Artificial Sequence
  chemically synthesized
agcatctcctctctctgtag

SEQ ID NO: 7205 - DNA, 20 bp, Artificial Sequence
  chemically synthesized
gcatctcctctctctgtagg

SEQ ID NO: 7206 - DNA, 20 bp, Artificial Sequence
  chemically synthesized
ctcctctctctgtagggggc

SEQ ID NO: 7207 - DNA, 20 bp, Artificial Sequence
  chemically synthesized
tctctctgtagggggctggc

SEQ ID NO: 7208 - DNA, 20 bp, Artificial Sequence
  chemically synthesized
gggctggctggacttcccac

SEQ ID NO: 7209 - DNA, 20 bp, Artificial Sequence
  chemically synthesized
ggctggctggacttcccacc

SEQ ID NO: 7210 - DNA, 20 bp, Artificial Sequence
  chemically synthesized
tggctggacttcccaccagg

SEQ ID NO: 7211 - DNA, 20 bp, Artificial Sequence
  chemically synthesized
cccaccaggcggtgtcccca

SEQ ID NO: 7212 - DNA, 20 bp, Artificial Sequence
  chemically synthesized
ccaccaggcggtgtccccac

SEQ ID NO: 7213 - DNA, 20 bp, Artificial Sequence
  chemically synthesized
ccaggcggtgtccccacagg

SEQ ID NO: 7214 - DNA, 20 bp, Artificial Sequence
  chemically synthesized
aggcggtgtccccacaggca

SEQ ID NO: 7215 - DNA, 20 bp, Artificial Sequence
  chemically synthesized
ggcggtgtccccacaggcag

SEQ ID NO: 7216 - DNA, 20 bp, Artificial Sequence
  chemically synthesized
ctcactctcctctgcaactc

SEQ ID NO: 7217 - DNA, 20 bp, Artificial Sequence
  chemically synthesized
ctgcaactccagtgcccaca

SEQ ID NO: 7218 - DNA, 20 bp, Artificial Sequence
  chemically synthesized
tccagtgcccacacggcacc

SEQ ID NO: 7219 - DNA, 20 bp, Artificial Sequence
  chemically synthesized
cccacacggcacccggtaca

SEQ ID NO: 7220 - DNA, 20 bp, Artificial Sequence
  chemically synthesized
cccggtacatagtgaacact

SEQ ID NO: 7221 - DNA, 20 bp, Artificial Sequence
  chemically synthesized
cggtacatagtgaacactca

SEQ ID NO: 7222 - DNA, 20 bp, Artificial Sequence
  chemically synthesized
gtacatagtgaacactcaga

SEQ ID NO: 7223 - DNA, 20 bp, Artificial Sequence
  chemically synthesized
gtgaacactcagagagaata

SEQ ID NO: 7224 - DNA, 20 bp, Artificial Sequence
  chemically synthesized
tgaacactcagagagaatac

SEQ ID NO: 7225 - DNA, 20 bp, Artificial Sequence
  chemically synthesized
gggatgctgctgaatcttct

SEQ ID NO: 7226 - DNA, 20 bp, Artificial Sequence
  chemically synthesized
ggatgctgctgaatcttctg

SEQ ID NO: 7227 - DNA, 20 bp, Artificial Sequence
  chemically synthesized
gatgctgctgaatcttctga

SEQ ID NO: 7228 - DNA, 20 bp, Artificial Sequence
  chemically synthesized
gctgaatcttctgagggtga

SEQ ID NO: 7229 - DNA, 20 bp, Artificial Sequence
  chemically synthesized
cttctgagggtgacagaatt

SEQ ID NO: 7230 - DNA, 20 bp, Artificial Sequence
  chemically synthesized
tctgagggtgacagaattta

SEQ ID NO: 7231 - DNA, 20 bp, Artificial Sequence
  chemically synthesized
ggtgacagaatttagagttt

SEQ ID NO: 7232 - DNA, 20 bp, Artificial Sequence
  chemically synthesized
gacagaatttagagtttgag

SEQ ID NO: 7233 - DNA, 20 bp, Artificial Sequence
  chemically synthesized
acagaatttagagtttgagc

SEQ ID NO: 7234 - DNA, 20 bp, Artificial Sequence
  chemically synthesized
agaatttagagtttgagcag

SEQ ID NO: 7235 - DNA, 20 bp, Artificial Sequence
  chemically synthesized
gaatttagagtttgagcagg

SEQ ID NO: 7236 - DNA, 20 bp, Artificial Sequence
  chemically synthesized
tagagtttgagcaggaggct

SEQ ID NO: 7237 - DNA, 20 bp, Artificial Sequence
  chemically synthesized
gagtttgagcaggaggcttg

SEQ ID NO: 7238 - DNA, 20 bp, Artificial Sequence
  chemically synthesized
gtttgagcaggaggcttgga

SEQ ID NO: 7239 - DNA, 20 bp, Artificial Sequence
  chemically synthesized
ttgagcaggaggcttggaga

SEQ ID NO: 7240 - DNA, 20 bp, Artificial Sequence
  chemically synthesized
tgagcaggaggcttggagag

SEQ ID NO: 7241 - DNA, 20 bp, Artificial Sequence
  chemically synthesized
caggaggcttggagagaggc

SEQ ID NO: 7242 - DNA, 20 bp, Artificial Sequence
  chemically synthesized
aggaggcttggagagaggcc

SEQ ID NO: 7243 - DNA, 20 bp, Artificial Sequence
  chemically synthesized
gccaggatttctgaaattaa

SEQ ID NO: 7244 - DNA, 20 bp, Artificial Sequence
  chemically synthesized
ccaggatttctgaaattaat

SEQ ID NO: 7245 - DNA, 20 bp, Artificial Sequence
  chemically synthesized
aggatttctgaaattaatgg

SEQ ID NO: 7246 - DNA, 20 bp, Artificial Sequence
  chemically synthesized
gatttctgaaattaatggga

SEQ ID NO: 7247 - DNA, 20 bp, Artificial Sequence
  chemically synthesized
tctgaaattaatgggagagt

SEQ ID NO: 7248 - DNA, 20 bp, Artificial Sequence
  chemically synthesized
ggagagtgagctcacgcgaa

SEQ ID NO: 7249 - DNA, 20 bp, Artificial Sequence
  chemically synthesized
gagagtgagctcacgcgaat

SEQ ID NO: 7250 - DNA, 20 bp, Artificial Sequence
  chemically synthesized
tgagctcacgcgaatgggct

SEQ ID NO: 7251 - DNA, 20 bp, Artificial Sequence
  chemically synthesized
gagctcacgcgaatgggctg

SEQ ID NO: 7252 - DNA, 20 bp, Artificial Sequence
  chemically synthesized
agctcacgcgaatgggctga

SEQ ID NO: 7253 - DNA, 20 bp, Artificial Sequence
  chemically synthesized
gcgaatgggctgagggacac

SEQ ID NO: 7254 - DNA, 20 bp, Artificial Sequence
  chemically synthesized
atgggctgagggacaccagt

SEQ ID NO: 7255 - DNA, 20 bp, Artificial Sequence
  chemically synthesized
tgggctgagggacaccagtg

SEQ ID NO: 7256 - DNA, 20 bp, Artificial Sequence
  chemically synthesized
gggctgagggacaccagtga

SEQ ID NO: 7257 - DNA, 20 bp, Artificial Sequence
  chemically synthesized
caccagtgagggaccgtctg

SEQ ID NO: 7258 - DNA, 20 bp, Artificial Sequence
  chemically synthesized
accagtgagggaccgtctga

SEQ ID NO: 7259 - DNA, 20 bp, Artificial Sequence
  chemically synthesized
ccagtgagggaccgtctgaa

SEQ ID NO: 7260 - DNA, 20 bp, Artificial Sequence
  chemically synthesized
agggaccgtctgaagggatg

SEQ ID NO: 7261 - DNA, 20 bp, Artificial Sequence
  chemically synthesized
ccgtctgaagggatgtagca

SEQ ID NO: 7262 - DNA, 20 bp, Artificial Sequence
  chemically synthesized
aaagtcaccgcatttccctc

SEQ ID NO: 7263 - DNA, 20 bp, Artificial Sequence
  chemically synthesized
gtcaccgcatttccctccag

SEQ ID NO: 7264 - DNA, 20 bp, Artificial Sequence
  chemically synthesized
cgcatttccctccagcagcc

SEQ ID NO: 7265 - DNA, 20 bp, Artificial Sequence
  chemically synthesized
gcatttccctccagcagccc

SEQ ID NO: 7266 - DNA, 20 bp, Artificial Sequence
  chemically synthesized
tttccctccagcagcccggg

SEQ ID NO: 7267 - DNA, 20 bp, Artificial Sequence
  chemically synthesized
ccctccagcagcccgggtgg

SEQ ID NO: 7268 - DNA, 20 bp, Artificial Sequence
  chemically synthesized
cctccagcagcccgggtggt

SEQ ID NO: 7269 - DNA, 20 bp, Artificial Sequence
  chemically synthesized
ctccagcagcccgggtggtg

SEQ ID NO: 7270 - DNA, 20 bp, Artificial Sequence
  chemically synthesized
tccagcagcccgggtggtgg

SEQ ID NO: 7271 - DNA, 20 bp, Artificial Sequence
  chemically synthesized
gcagcccgggtggtgggggc

SEQ ID NO: 7272 - DNA, 20 bp, Artificial Sequence
  chemically synthesized
cagcccgggtggtgggggct

SEQ ID NO: 7273 - DNA, 20 bp, Artificial Sequence
  chemically synthesized
agcccgggtggtgggggctg

SEQ ID NO: 7274 - DNA, 20 bp, Artificial Sequence
  chemically synthesized
gcccgggtggtgggggctgg

SEQ ID NO: 7275 - DNA, 20 bp, Artificial Sequence
  chemically synthesized
gggctgggggaacgtcatca

SEQ ID NO: 7276 - DNA, 20 bp, Artificial Sequence
  chemically synthesized
ggctgggggaacgtcatcat

SEQ ID NO: 7277 - DNA, 20 bp, Artificial Sequence
  chemically synthesized
ctgggggaacgtcatcatgg

SEQ ID NO: 7278 - DNA, 20 bp, Artificial Sequence
  chemically synthesized
tcatgggagctgacactgat

SEQ ID NO: 7279 - DNA, 20 bp, Artificial Sequence
  chemically synthesized
gacactgatcagctgctcac

SEQ ID NO: 7280 - DNA, 20 bp, Artificial Sequence
  chemically synthesized
acactgatcagctgctcacc

SEQ ID NO: 7281 - DNA, 20 bp, Artificial Sequence
  chemically synthesized
cactgatcagctgctcaccg

SEQ ID NO: 7282 - DNA, 20 bp, Artificial Sequence
  chemically synthesized
ggcccatcttccacttgtct

SEQ ID NO: 7283 - DNA, 20 bp, Artificial Sequence
  chemically synthesized
gctaccccctttttctttta

SEQ ID NO: 7284 - DNA, 20 bp, Artificial Sequence
  chemically synthesized
atttcaattatgcatgtatt

SEQ ID NO: 7285 - DNA, 20 bp, Artificial Sequence
  chemically synthesized
tttcaattatgcatgtatta

SEQ ID NO: 7286 - DNA, 20 bp, Artificial Sequence
  chemically synthesized
ttcaattatgcatgtattaa

SEQ ID NO: 7287 - DNA, 20 bp, Artificial Sequence
  chemically synthesized
tgcatgtattaagggtccca

SEQ ID NO: 7288 - DNA, 20 bp, Artificial Sequence
  chemically synthesized
tttttaattcttttttctcc

SEQ ID NO: 7289 - DNA, 20 bp, Artificial Sequence
  chemically synthesized
tctcccagtgtttcatttta

SEQ ID NO: 7290 - DNA, 20 bp, Artificial Sequence
  chemically synthesized
tcccagtgtttcattttata

SEQ ID NO: 7291 - DNA, 20 bp, Artificial Sequence
  chemically synthesized
tagagttattgctgttcatt

SEQ ID NO: 7292 - DNA, 20 bp, Artificial Sequence
  chemically synthesized
tctcatctcactctgttgcc

SEQ ID NO: 7293 - DNA, 20 bp, Artificial Sequence
  chemically synthesized
ctcatctcactctgttgccc

SEQ ID NO: 7294 - DNA, 20 bp, Artificial Sequence
  chemically synthesized
tctcactctgttgcccaggc

SEQ ID NO: 7295 - DNA, 20 bp, Artificial Sequence
  chemically synthesized
ctgttgcccaggctggaatg

SEQ ID NO: 7296 - DNA, 20 bp, Artificial Sequence
  chemically synthesized
ttgcccaggctggaatgcag

SEQ ID NO: 7297 - DNA, 20 bp, Artificial Sequence
  chemically synthesized
tagcttgtcacaactcactg

SEQ ID NO: 7298 - DNA, 20 bp, Artificial Sequence
  chemically synthesized
tcactgtggcctccacctcc

SEQ ID NO: 7299 - DNA, 20 bp, Artificial Sequence
  chemically synthesized
cactgtggcctccacctcct

SEQ ID NO: 7300 - DNA, 20 bp, Artificial Sequence
  chemically synthesized
tggcctccacctcctgggct

SEQ ID NO: 7301 - DNA, 20 bp, Artificial Sequence
  chemically synthesized
ggcctccacctcctgggctc

SEQ ID NO: 7302 - DNA, 20 bp, Artificial Sequence
  chemically synthesized
ctcaggcgatccttccactt

SEQ ID NO: 7303 - DNA, 20 bp, Artificial Sequence
  chemically synthesized
atccttccacttcagcctcc

SEQ ID NO: 7304 - DNA, 20 bp, Artificial Sequence
  chemically synthesized
tccttccacttcagcctccc

SEQ ID NO: 7305 - DNA, 20 bp, Artificial Sequence
  chemically synthesized
ttccacttcagcctcccagg

SEQ ID NO: 7306 - DNA, 20 bp, Artificial Sequence
  chemically synthesized
acttcagcctcccaggtagc

SEQ ID NO: 7307 - DNA, 20 bp, Artificial Sequence
  chemically synthesized
cttcagcctcccaggtagct

SEQ ID NO: 7308 - DNA, 20 bp, Artificial Sequence
  chemically synthesized
ctcccaggtagctgggacta

SEQ ID NO: 7309 - DNA, 20 bp, Artificial Sequence
  chemically synthesized
tcccaggtagctgggactat

SEQ ID NO: 7310 - DNA, 20 bp, Artificial Sequence
  chemically synthesized
tagctgggactataggcatg

SEQ ID NO: 7311 - DNA, 20 bp, Artificial Sequence
  chemically synthesized
taggcatgtggcaccacacc

SEQ ID NO: 7312 - DNA, 20 bp, Artificial Sequence
  chemically synthesized
taattaaaaatttttttttg

SEQ ID NO: 7313 - DNA, 20 bp, Artificial Sequence
  chemically synthesized
attaaaaatttttttttgta

SEQ ID NO: 7314 - DNA, 20 bp, Artificial Sequence
  chemically synthesized
aaaatttttttttgtagaga

SEQ ID NO: 7315 - DNA, 20 bp, Artificial Sequence
  chemically synthesized
gtagagacggttttgccatg

SEQ ID NO: 7316 - DNA, 20 bp, Artificial Sequence
  chemically synthesized
agagacggttttgccatgta

SEQ ID NO: 7317 - DNA, 20 bp, Artificial Sequence
  chemically synthesized
gagacggttttgccatgtag

SEQ ID NO: 7318 - DNA, 20 bp, Artificial Sequence
  chemically synthesized
agacggttttgccatgtaga

SEQ ID NO: 7319 - DNA, 20 bp, Artificial Sequence
  chemically synthesized
gacggttttgccatgtagag

SEQ ID NO: 7320 - DNA, 20 bp, Artificial Sequence
  chemically synthesized
aggggttttgccatgctgcc

SEQ ID NO: 7321 - DNA, 20 bp, Artificial Sequence
  chemically synthesized
ttttgccatgctgcccagac

SEQ ID NO: 7322 - DNA, 20 bp, Artificial Sequence
  chemically synthesized
atgctgcccagactagtctt

SEQ ID NO: 7323 - DNA, 20 bp, Artificial Sequence
  chemically synthesized
ccagactagtcttgagctcc

SEQ ID NO: 7324 - DNA, 20 bp, Artificial Sequence
  chemically synthesized
cagactagtcttgagctcct

SEQ ID NO: 7325 - DNA, 20 bp, Artificial Sequence
  chemically synthesized
agtcttgagctcctgggctc

SEQ ID NO: 7326 - DNA, 20 bp, Artificial Sequence
  chemically synthesized
ccccccgtgtcgacctccca

SEQ ID NO: 7327 - DNA, 20 bp, Artificial Sequence
  chemically synthesized
gtgtcgacctcccaaagtgc

SEQ ID NO: 7328 - DNA, 20 bp, Artificial Sequence
  chemically synthesized
tgtcgacctcccaaagtgct

SEQ ID NO: 7329 - DNA, 20 bp, Artificial Sequence
  chemically synthesized
ctcccaaagtgctgggatta

SEQ ID NO: 7330 - DNA, 20 bp, Artificial Sequence
  chemically synthesized
gggattacagatgtgatcca

SEQ ID NO: 7331 - DNA, 20 bp, Artificial Sequence
  chemically synthesized
cagatgtgatccacagtgcc

SEQ ID NO: 7332 - DNA, 20 bp, Artificial Sequence
  chemically synthesized
catcttccattatttccatc

SEQ ID NO: 7333 - DNA, 20 bp, Artificial Sequence
  chemically synthesized
tcttttcttttttttttttt

SEQ ID NO: 7334 - DNA, 20 bp, Artificial Sequence
  chemically synthesized
ttttcttttttttttttttg

SEQ ID NO: 7335 - DNA, 20 bp, Artificial Sequence
  chemically synthesized
tttcttttttttttttttgg

SEQ ID NO: 7336 - DNA, 20 bp, Artificial Sequence
  chemically synthesized
cttttttttttttttggagg

SEQ ID NO: 7337 - DNA, 20 bp, Artificial Sequence
  chemically synthesized
tttttttttttttggaggcg

SEQ ID NO: 7338 - DNA, 20 bp, Artificial Sequence
  chemically synthesized
cggagtctcgctctgttgcc

SEQ ID NO: 7339 - DNA, 20 bp, Artificial Sequence
  chemically synthesized
ggagtctcgctctgttgccc

SEQ ID NO: 7340 - DNA, 20 bp, Artificial Sequence
  chemically synthesized
tctcgctctgttgcccaggc

SEQ ID NO: 7341 - DNA, 20 bp, Artificial Sequence
  chemically synthesized
tcgctctgttgcccaggccg

SEQ ID NO: 7342 - DNA, 20 bp, Artificial Sequence
  chemically synthesized
ctgttgcccaggccggagtg

SEQ ID NO: 7343 - DNA, 20 bp, Artificial Sequence
  chemically synthesized
ttgcccaggccggagtgcag

SEQ ID NO: 7344 - DNA, 20 bp, Artificial Sequence
  chemically synthesized
ggagtgcagtggcgcgatct

SEQ ID NO: 7345 - DNA, 20 bp, Artificial Sequence
  chemically synthesized
gcgcgatcttggctcactgc

SEQ ID NO: 7346 - DNA, 20 bp, Artificial Sequence
  chemically synthesized
tcactgcaagctctgcctcc

SEQ ID NO: 7347 - DNA, 20 bp, Artificial Sequence
  chemically synthesized
cactgcaagctctgcctccc

SEQ ID NO: 7348 - DNA, 20 bp, Artificial Sequence
  chemically synthesized
ttcatgccattctcctgcct

SEQ ID NO: 7349 - DNA, 20 bp, Artificial Sequence
  chemically synthesized
ttctcctgcctcagcctccc

SEQ ID NO: 7350 - DNA, 20 bp, Artificial Sequence
  chemically synthesized
tcctgcctcagcctcccgag

SEQ ID NO: 7351 - DNA, 20 bp, Artificial Sequence
  chemically synthesized
gcctcagcctcccgagtagc

SEQ ID NO: 7352 - DNA, 20 bp, Artificial Sequence
  chemically synthesized
cctcagcctcccgagtagct

SEQ ID NO: 7353 - DNA, 20 bp, Artificial Sequence
  chemically synthesized
ctcccgagtagctgggacta

SEQ ID NO: 7354 - DNA, 20 bp, Artificial Sequence
  chemically synthesized
tcccgagtagctgggactac

SEQ ID NO: 7355 - DNA, 20 bp, Artificial Sequence
  chemically synthesized
caggcgcctgccaccacgtc

SEQ ID NO: 7356 - DNA, 20 bp, Artificial Sequence
  chemically synthesized
tggctaattttttgtatttt

SEQ ID NO: 7357 - DNA, 20 bp, Artificial Sequence
  chemically synthesized
ctaattttttgtatttttag

SEQ ID NO: 7358 - DNA, 20 bp, Artificial Sequence
  chemically synthesized
aattttttgtatttttagta

SEQ ID NO: 7359 - DNA, 20 bp, Artificial Sequence
  chemically synthesized
ttttgtatttttagtagaga

SEQ ID NO: 7360 - DNA, 20 bp, Artificial Sequence
  chemically synthesized
tttgtatttttagtagagat

SEQ ID NO: 7361 - DNA, 20 bp, Artificial Sequence
  chemically synthesized
ttgtatttttagtagagatg

SEQ ID NO: 7362 - DNA, 20 bp, Artificial Sequence
  chemically synthesized
gagatggggtttcaccatgt

SEQ ID NO: 7363 - DNA, 20 bp, Artificial Sequence
  chemically synthesized
tggggtttcaccatgttagc

SEQ ID NO: 7364 - DNA, 20 bp, Artificial Sequence
  chemically synthesized
ggggtttcaccatgttagcc

SEQ ID NO: 7365 - DNA, 20 bp, Artificial Sequence
  chemically synthesized
tttcaccatgttagccagga

SEQ ID NO: 7366 - DNA, 20 bp, Artificial Sequence
  chemically synthesized
acctcatgatctgcccgcct

SEQ ID NO: 7367 - DNA, 20 bp, Artificial Sequence
  chemically synthesized
ctgcccgccttggcctccca

SEQ ID NO: 7368 - DNA, 20 bp, Artificial Sequence
  chemically synthesized
gccttggcctcccacagtgc

SEQ ID NO: 7369 - DNA, 20 bp, Artificial Sequence
  chemically synthesized
ccttggcctcccacagtgct

SEQ ID NO: 7370 - DNA, 20 bp, Artificial Sequence
  chemically synthesized
ctcccacagtgctgggattc

SEQ ID NO: 7371 - DNA, 20 bp, Artificial Sequence
  chemically synthesized
tcccacagtgctgggattcc

SEQ ID NO: 7372 - DNA, 20 bp, Artificial Sequence
  chemically synthesized
agtgctgggattccaggcgt

SEQ ID NO: 7373 - DNA, 20 bp, Artificial Sequence
  chemically synthesized
gggattccaggcgtgagcca

SEQ ID NO: 7374 - DNA, 20 bp, Artificial Sequence
  chemically synthesized
caggcgtgagccacggcgcc

SEQ ID NO: 7375 - DNA, 20 bp, Artificial Sequence
  chemically synthesized
cgtgagccacggcgcctggc

SEQ ID NO: 7376 - DNA, 20 bp, Artificial Sequence
  chemically synthesized
gccagtgtgttttttcattt

SEQ ID NO: 7377 - DNA, 20 bp, Artificial Sequence
  chemically synthesized
ttttttcatttcagacattg

SEQ ID NO: 7378 - DNA, 20 bp, Artificial Sequence
  chemically synthesized
gacattgtagtttttatctc

SEQ ID NO: 7379 - DNA, 20 bp, Artificial Sequence
  chemically synthesized
attgtagtttttatctctag

SEQ ID NO: 7380 - DNA, 20 bp, Artificial Sequence
  chemically synthesized
tttatctctagaagttcacc

SEQ ID NO: 7381 - DNA, 20 bp, Artificial Sequence
  chemically synthesized
ttatctctagaagttcacct

SEQ ID NO: 7382 - DNA, 20 bp, Artificial Sequence
  chemically synthesized
tatctctagaagttcacctg

SEQ ID NO: 7383 - DNA, 20 bp, Artificial Sequence
  chemically synthesized
acttaattttttgaacataa

SEQ ID NO: 7384 - DNA, 20 bp, Artificial Sequence
  chemically synthesized
cttaattttttgaacataat

SEQ ID NO: 7385 - DNA, 20 bp, Artificial Sequence
  chemically synthesized
tttttgaacataatgggata

SEQ ID NO: 7386 - DNA, 20 bp, Artificial Sequence
  chemically synthesized
ccatccttgcctgctaattc

SEQ ID NO: 7387 - DNA, 20 bp, Artificial Sequence
  chemically synthesized
gctaattctagcatccgtgt

SEQ ID NO: 7388 - DNA, 20 bp, Artificial Sequence
  chemically synthesized
tctagcatccgtgtcagttc

SEQ ID NO: 7389 - DNA, 20 bp, Artificial Sequence
  chemically synthesized
catgccttgtaatctttgat

SEQ ID NO: 7390 - DNA, 20 bp, Artificial Sequence
  chemically synthesized
tgtaatctttgattggctgc

SEQ ID NO: 7391 - DNA, 20 bp, Artificial Sequence
  chemically synthesized
cattgtcaatttcaccttgt

SEQ ID NO: 7392 - DNA, 20 bp, Artificial Sequence
  chemically synthesized
attgtcaatttcaccttgtt

SEQ ID NO: 7393 - DNA, 20 bp, Artificial Sequence
  chemically synthesized
aatttcaccttgttgggtgc

SEQ ID NO: 7394 - DNA, 20 bp, Artificial Sequence
  chemically synthesized
gtattcctctaaatgttctt

SEQ ID NO: 7395 - DNA, 20 bp, Artificial Sequence
  chemically synthesized
aatgttcttgagctttgctc

SEQ ID NO: 7396 - DNA, 20 bp, Artificial Sequence
  chemically synthesized
atgttcttgagctttgctcc

SEQ ID NO: 7397 - DNA, 20 bp, Artificial Sequence
  chemically synthesized
ttgagctttgctccgggatg

SEQ ID NO: 7398 - DNA, 20 bp, Artificial Sequence
  chemically synthesized
ctttgctccgggatgcagtt

SEQ ID NO: 7399 - DNA, 20 bp, Artificial Sequence
  chemically synthesized
cgggatgcagttaagcaact

SEQ ID NO: 7400 - DNA, 20 bp, Artificial Sequence
  chemically synthesized
ggatgcagttaagcaactta

SEQ ID NO: 7401 - DNA, 20 bp, Artificial Sequence
  chemically synthesized
gcagttaagcaacttagagt

SEQ ID NO: 7402 - DNA, 20 bp, Artificial Sequence
  chemically synthesized
gtttgaactcttaattgttt

SEQ ID NO: 7403 - DNA, 20 bp, Artificial Sequence
  chemically synthesized
cttaattgttttggtctcct

SEQ ID NO: 7404 - DNA, 20 bp, Artificial Sequence
  chemically synthesized
ttttggtctcctcggactct

SEQ ID NO: 7405 - DNA, 20 bp, Artificial Sequence
  chemically synthesized
tcagctccatctcctcaacg

SEQ ID NO: 7406 - DNA, 20 bp, Artificial Sequence
  chemically synthesized
cagctccatctcctcaacgt

SEQ ID NO: 7407 - DNA, 20 bp, Artificial Sequence
  chemically synthesized
agctccatctcctcaacgtg

SEQ ID NO: 7408 - DNA, 20 bp, Artificial Sequence
  chemically synthesized
ctccatctcctcaacgtggg

SEQ ID NO: 7409 - DNA, 20 bp, Artificial Sequence
  chemically synthesized
cctcaacgtggggagtctct

SEQ ID NO: 7410 - DNA, 20 bp, Artificial Sequence
  chemically synthesized
ctcaacgtggggagtctctt

SEQ ID NO: 7411 - DNA, 20 bp, Artificial Sequence
  chemically synthesized
ggagtctcttgggctctgcc

SEQ ID NO: 7412 - DNA, 20 bp, Artificial Sequence
  chemically synthesized
ctgcctggacttccctttcc

SEQ ID NO: 7413 - DNA, 20 bp, Artificial Sequence
  chemically synthesized
ctttcctggcctgtaacctg

SEQ ID NO: 7414 - DNA, 20 bp, Artificial Sequence
  chemically synthesized
acctgcagactctctccaaa

SEQ ID NO: 7415 - DNA, 20 bp, Artificial Sequence
  chemically synthesized
gcagactctctccaaacagt

SEQ ID NO: 7416 - DNA, 20 bp, Artificial Sequence
  chemically synthesized
actctctccaaacagtaagc

SEQ ID NO: 7417 - DNA, 20 bp, Artificial Sequence
  chemically synthesized
ctctctccaaacagtaagct

SEQ ID NO: 7418 - DNA, 20 bp, Artificial Sequence
  chemically synthesized
tctctccaaacagtaagctg

SEQ ID NO: 7419 - DNA, 20 bp, Artificial Sequence
  chemically synthesized
aaacagtaagctggggtgat

SEQ ID NO: 7420 - DNA, 20 bp, Artificial Sequence
  chemically synthesized
acagtaagctggggtgatcg

SEQ ID NO: 7421 - DNA, 20 bp, Artificial Sequence
  chemically synthesized
cagtaagctggggtgatcgg

SEQ ID NO: 7422 - DNA, 20 bp, Artificial Sequence
  chemically synthesized
agtaagctggggtgatcgga

SEQ ID NO: 7423 - DNA, 20 bp, Artificial Sequence
  chemically synthesized
gttgtttgcttcttatccct

SEQ ID NO: 7424 - DNA, 20 bp, Artificial Sequence
  chemically synthesized
ttgtttgcttcttatccctc

SEQ ID NO: 7425 - DNA, 20 bp, Artificial Sequence
  chemically synthesized
tgtttgcttcttatccctca

SEQ ID NO: 7426 - DNA, 20 bp, Artificial Sequence
  chemically synthesized
actcctccttgcctgatgtc

SEQ ID NO: 7427 - DNA, 20 bp, Artificial Sequence
  chemically synthesized
tcctccttgcctgatgtcca

SEQ ID NO: 7428 - DNA, 20 bp, Artificial Sequence
  chemically synthesized
cctgatgtccagagtcttga

SEQ ID NO: 7429 - DNA, 20 bp, Artificial Sequence
  chemically synthesized
ttgaaagctgccatgttcta

SEQ ID NO: 7430 - DNA, 20 bp, Artificial Sequence
  chemically synthesized
gtttttgttttgattgtttc

SEQ ID NO: 7431 - DNA, 20 bp, Artificial Sequence
  chemically synthesized
tttttgttttgattgtttct

SEQ ID NO: 7432 - DNA, 20 bp, Artificial Sequence
  chemically synthesized
ttttgttttgattgtttctg

SEQ ID NO: 7433 - DNA, 20 bp, Artificial Sequence
  chemically synthesized
ttgttttgattgtttctggg

SEQ ID NO: 7434 - DNA, 20 bp, Artificial Sequence
  chemically synthesized
gttttgattgtttctgggga

SEQ ID NO: 7435 - DNA, 20 bp, Artificial Sequence
  chemically synthesized
ttgattgtttctggggagag

SEQ ID NO: 7436 - DNA, 20 bp, Artificial Sequence
  chemically synthesized
gagaagaactcttcccatct

SEQ ID NO: 7437 - DNA, 20 bp, Artificial Sequence
  chemically synthesized
agaagaactcttcccatctt

SEQ ID NO: 7438 - DNA, 20 bp, Artificial Sequence
  chemically synthesized
agaactcttcccatcttggg

SEQ ID NO: 7439 - DNA, 20 bp, Artificial Sequence
  chemically synthesized
ttatgttcaaacttttgcct

SEQ ID NO: 7440 - DNA, 20 bp, Artificial Sequence
  chemically synthesized
tgttcaaacttttgcctaag

SEQ ID NO: 7441 - DNA, 20 bp, Artificial Sequence
  chemically synthesized
tttaactcatctaattatcc

SEQ ID NO: 7442 - DNA, 20 bp, Artificial Sequence
  chemically synthesized
aattatccgagcaatccaat

SEQ ID NO: 7443 - DNA, 20 bp, Artificial Sequence
  chemically synthesized
attatccgagcaatccaatc

SEQ ID NO: 7444 - DNA, 20 bp, Artificial Sequence
  chemically synthesized
atccgagcaatccaatcggg

SEQ ID NO: 7445 - DNA, 20 bp, Artificial Sequence
  chemically synthesized
gtgatctccattttacacac

SEQ ID NO: 7446 - DNA, 20 bp, Artificial Sequence
  chemically synthesized
ccattttacacacgagaaaa

SEQ ID NO: 7447 - DNA, 20 bp, Artificial Sequence
  chemically synthesized
ttttacacacgagaaaatgg

SEQ ID NO: 7448 - DNA, 20 bp, Artificial Sequence
  chemically synthesized
cacacgagaaaatggaagca

SEQ ID NO: 7449 - DNA, 20 bp, Artificial Sequence
  chemically synthesized
cacgagaaaatggaagcatg

SEQ ID NO: 7450 - DNA, 20 bp, Artificial Sequence
  chemically synthesized
agcatggagaaattgaatgc

SEQ ID NO: 7451 - DNA, 20 bp, Artificial Sequence
  chemically synthesized
tgaatgctggtgcatgatct

SEQ ID NO: 7452 - DNA, 20 bp, Artificial Sequence
  chemically synthesized
aatgctggtgcatgatctca

SEQ ID NO: 7453 - DNA, 20 bp, Artificial Sequence
  chemically synthesized
tgcatgatctcagagctacc

SEQ ID NO: 7454 - DNA, 20 bp, Artificial Sequence
  chemically synthesized
catgatctcagagctacctg

SEQ ID NO: 7455 - DNA, 20 bp, Artificial Sequence
  chemically synthesized
atgatctcagagctacctgg

SEQ ID NO: 7456 - DNA, 20 bp, Artificial Sequence
  chemically synthesized
ctcagagctacctggaggca

SEQ ID NO: 7457 - DNA, 20 bp, Artificial Sequence
  chemically synthesized
gagctacctggaggcacagc

SEQ ID NO: 7458 - DNA, 20 bp, Artificial Sequence
  chemically synthesized
agctacctggaggcacagct

SEQ ID NO: 7459 - DNA, 20 bp, Artificial Sequence
  chemically synthesized
ggcacagctgggctaccctg

SEQ ID NO: 7460 - DNA, 20 bp, Artificial Sequence
  chemically synthesized
gcacagctgggctaccctgt

SEQ ID NO: 7461 - DNA, 20 bp, Artificial Sequence
  chemically synthesized
cagctgggctaccctgtggg

SEQ ID NO: 7462 - DNA, 20 bp, Artificial Sequence
  chemically synthesized
gggctaccctgtgggcagtc

SEQ ID NO: 7463 - DNA, 20 bp, Artificial Sequence
  chemically synthesized
ccctgtgggcagtctggttt

SEQ ID NO: 7464 - DNA, 20 bp, Artificial Sequence
  chemically synthesized
cctgtgggcagtctggtttc

SEQ ID NO: 7465 - DNA, 20 bp, Artificial Sequence
  chemically synthesized
ctgtgggcagtctggtttca

SEQ ID NO: 7466 - DNA, 20 bp, Artificial Sequence
  chemically synthesized
tgggcagtctggtttcaggg

SEQ ID NO: 7467 - DNA, 20 bp, Artificial Sequence
  chemically synthesized
ctggtttcagggtggatata

SEQ ID NO: 7468 - DNA, 20 bp, Artificial Sequence
  chemically synthesized
tggatatacagacacgttgc

SEQ ID NO: 7469 - DNA, 20 bp, Artificial Sequence
  chemically synthesized
ggatatacagacacgttgct

SEQ ID NO: 7470 - DNA, 20 bp, Artificial Sequence
  chemically synthesized
gacacgttgctgggctgacc

SEQ ID NO: 7471 - DNA, 20 bp, Artificial Sequence
  chemically synthesized
ttgctgggctgacccagcat

SEQ ID NO: 7472 - DNA, 20 bp, Artificial Sequence
  chemically synthesized
tgctgggctgacccagcatt

SEQ ID NO: 7473 - DNA, 20 bp, Artificial Sequence
  chemically synthesized
ctgggctgacccagcattgg

SEQ ID NO: 7474 - DNA, 20 bp, Artificial Sequence
  chemically synthesized
acccagcattgggagttgat

SEQ ID NO: 7475 - DNA, 20 bp, Artificial Sequence
  chemically synthesized
agcattgggagttgataagt

SEQ ID NO: 7476 - DNA, 20 bp, Artificial Sequence
  chemically synthesized
tgggagttgataagtcggac

SEQ ID NO: 7477 - DNA, 20 bp, Artificial Sequence
  chemically synthesized
gggagttgataagtcggact

SEQ ID NO: 7478 - DNA, 20 bp, Artificial Sequence
  chemically synthesized
agttgataagtcggactggg

SEQ ID NO: 7479 - DNA, 20 bp, Artificial Sequence
  chemically synthesized
tgataagtcggactgggaag

SEQ ID NO: 7480 - DNA, 20 bp, Artificial Sequence
  chemically synthesized
gataagtcggactgggaagc

SEQ ID NO: 7481 - DNA, 20 bp, Artificial Sequence
  chemically synthesized
agtcggactgggaagcagga

SEQ ID NO: 7482 - DNA, 20 bp, Artificial Sequence
  chemically synthesized
gtcggactgggaagcaggac

SEQ ID NO: 7483 - DNA, 20 bp, Artificial Sequence
  chemically synthesized
gaagcaggacaggaccctct

SEQ ID NO: 7484 - DNA, 20 bp, Artificial Sequence
  chemically synthesized
gcaggacaggaccctctgag

SEQ ID NO: 7485 - DNA, 20 bp, Artificial Sequence
  chemically synthesized
aggacaggaccctctgagtg

SEQ ID NO: 7486 - DNA, 20 bp, Artificial Sequence
  chemically synthesized
ggacaggaccctctgagtgg

SEQ ID NO: 7487 - DNA, 20 bp, Artificial Sequence
  chemically synthesized
gacaggaccctctgagtgga

SEQ ID NO: 7488 - DNA, 20 bp, Artificial Sequence
  chemically synthesized
cctctgagtggagggtgctg

SEQ ID NO: 7489 - DNA, 20 bp, Artificial Sequence
  chemically synthesized
tgagtggagggtgctgaaga

SEQ ID NO: 7490 - DNA, 20 bp, Artificial Sequence
  chemically synthesized
gtggagggtgctgaagacag

SEQ ID NO: 7491 - DNA, 20 bp, Artificial Sequence
  chemically synthesized
agggtgctgaagacagcagt

SEQ ID NO: 7492 - DNA, 20 bp, Artificial Sequence
  chemically synthesized
gggtgctgaagacagcagtc

SEQ ID NO: 7493 - DNA, 20 bp, Artificial Sequence
  chemically synthesized
ggtgctgaagacagcagtca

SEQ ID NO: 7494 - DNA, 20 bp, Artificial Sequence
  chemically synthesized
gaagacagcagtcagggact

SEQ ID NO: 7495 - DNA, 20 bp, Artificial Sequence
  chemically synthesized
agcagtcagggactcagcca

SEQ ID NO: 7496 - DNA, 20 bp, Artificial Sequence
  chemically synthesized
cagtcagggactcagccatg

SEQ ID NO: 7497 - DNA, 20 bp, Artificial Sequence
  chemically synthesized
agtcagggactcagccatgg

SEQ ID NO: 7498 - DNA, 20 bp, Artificial Sequence
  chemically synthesized
gtcagggactcagccatgga

SEQ ID NO: 7499 - DNA, 20 bp, Artificial Sequence
  chemically synthesized
gggactcagccatggagggc

SEQ ID NO: 7500 - DNA, 20 bp, Artificial Sequence
  chemically synthesized
tcagccatggagggccagct

SEQ ID NO: 7501 - DNA, 20 bp, Artificial Sequence
  chemically synthesized
gccatggagggccagcttgg

SEQ ID NO: 7502 - DNA, 20 bp, Artificial Sequence
  chemically synthesized
ccatggagggccagcttggt

SEQ ID NO: 7503 - DNA, 20 bp, Artificial Sequence
  chemically synthesized
catggagggccagcttggtg

SEQ ID NO: 7504 - DNA, 20 bp, Artificial Sequence
  chemically synthesized
cagcttggtggggaacaccg

SEQ ID NO: 7505 - DNA, 20 bp, Artificial Sequence
  chemically synthesized
ggtggggaacaccgtggtca

SEQ ID NO: 7506 - DNA, 20 bp, Artificial Sequence
  chemically synthesized
tggggaacaccgtggtcatg

SEQ ID NO: 7507 - DNA, 20 bp, Artificial Sequence
  chemically synthesized
ccgtggtcatggagcgcttc

SEQ ID NO: 7508 - DNA, 20 bp, Artificial Sequence
  chemically synthesized
ggtcatggagcgcttctgga

SEQ ID NO: 7509 - DNA, 20 bp, Artificial Sequence
  chemically synthesized
tcatggagcgcttctggatg

SEQ ID NO: 7510 - DNA, 20 bp, Artificial Sequence
  chemically synthesized
atggagcgcttctggatgga

SEQ ID NO: 7511 - DNA, 20 bp, Artificial Sequence
  chemically synthesized
tggagcgcttctggatggag

SEQ ID NO: 7512 - DNA, 20 bp, Artificial Sequence
  chemically synthesized
tctggatggagaggaatgca

SEQ ID NO: 7513 - DNA, 20 bp, Artificial Sequence
  chemically synthesized
ctggatggagaggaatgcaa

SEQ ID NO: 7514 - DNA, 20 bp, Artificial Sequence
  chemically synthesized
ggagaggaatgcaaaggcct

SEQ ID NO: 7515 - DNA, 20 bp, Artificial Sequence
  chemically synthesized
agaggaatgcaaaggccttg

SEQ ID NO: 7516 - DNA, 20 bp, Artificial Sequence
  chemically synthesized
gaggaatgcaaaggccttgg

SEQ ID NO: 7517 - DNA, 20 bp, Artificial Sequence
  chemically synthesized
gaatgcaaaggccttggagg

SEQ ID NO: 7518 - DNA, 20 bp, Artificial Sequence
  chemically synthesized
aatgcaaaggccttggagga

SEQ ID NO: 7519 - DNA, 20 bp, Artificial Sequence
  chemically synthesized
atgcaaaggccttggaggaa

SEQ ID NO: 7520 - DNA, 20 bp, Artificial Sequence
  chemically synthesized
tgcaaaggccttggaggaag

SEQ ID NO: 7521 - DNA, 20 bp, Artificial Sequence
  chemically synthesized
aaaggccttggaggaagggg

SEQ ID NO: 7522 - DNA, 20 bp, Artificial Sequence
  chemically synthesized
aaggccttggaggaaggggt

SEQ ID NO: 7523 - DNA, 20 bp, Artificial Sequence
  chemically synthesized
aggccttggaggaaggggtg

SEQ ID NO: 7524 - DNA, 20 bp, Artificial Sequence
  chemically synthesized
ggccttggaggaaggggtgg

SEQ ID NO: 7525 - DNA, 20 bp, Artificial Sequence
  chemically synthesized
cttggaggaaggggtggggg

SEQ ID NO: 7526 - DNA, 20 bp, Artificial Sequence
  chemically synthesized
gaggaaggggtgggggcagt

SEQ ID NO: 7527 - DNA, 20 bp, Artificial Sequence
  chemically synthesized
ggaaggggtgggggcagtga

SEQ ID NO: 7528 - DNA, 20 bp, Artificial Sequence
  chemically synthesized
gaaggggtgggggcagtgag

SEQ ID NO: 7529 - DNA, 20 bp, Artificial Sequence
  chemically synthesized
aaggggtgggggcagtgaga

SEQ ID NO: 7530 - DNA, 20 bp, Artificial Sequence
  chemically synthesized
ggggtgggggcagtgagagg

SEQ ID NO: 7531 - DNA, 20 bp, Artificial Sequence
  chemically synthesized
gggtgggggcagtgagaggg

SEQ ID NO: 7532 - DNA, 20 bp, Artificial Sequence
  chemically synthesized
ggtgggggcagtgagaggga

SEQ ID NO: 7533 - DNA, 20 bp, Artificial Sequence
  chemically synthesized
gggggcagtgagagggaggg

SEQ ID NO: 7534 - DNA, 20 bp, Artificial Sequence
  chemically synthesized
ggggcagtgagagggagggt

SEQ ID NO: 7535 - DNA, 20 bp, Artificial Sequence
  chemically synthesized
gggcagtgagagggagggtg

SEQ ID NO: 7536 - DNA, 20 bp, Artificial Sequence
  chemically synthesized
agggagggtggggctgtgct

SEQ ID NO: 7537 - DNA, 20 bp, Artificial Sequence
  chemically synthesized
ggagggtggggctgtgctca

SEQ ID NO: 7538 - DNA, 20 bp, Artificial Sequence
  chemically synthesized
gggtggggctgtgctcagag

SEQ ID NO: 7539 - DNA, 20 bp, Artificial Sequence
  chemically synthesized
ggtggggctgtgctcagagc

SEQ ID NO: 7540 - DNA, 20 bp, Artificial Sequence
  chemically synthesized
tggggctgtgctcagagcgg

SEQ ID NO: 7541 - DNA, 20 bp, Artificial Sequence
  chemically synthesized
ggctgtgctcagagcgggag

SEQ ID NO: 7542 - DNA, 20 bp, Artificial Sequence
  chemically synthesized
gctgtgctcagagcgggagt

SEQ ID NO: 7543 - DNA, 20 bp, Artificial Sequence
  chemically synthesized
gtgctcagagcgggagtggg

SEQ ID NO: 7544 - DNA, 20 bp, Artificial Sequence
  chemically synthesized
ctcagagcgggagtgggcag

SEQ ID NO: 7545 - DNA, 20 bp, Artificial Sequence
  chemically synthesized
cagagcgggagtgggcagtg

SEQ ID NO: 7546 - DNA, 20 bp, Artificial Sequence
  chemically synthesized
agagcgggagtgggcagtgg

SEQ ID NO: 7547 - DNA, 20 bp, Artificial Sequence
  chemically synthesized
ggagtgggcagtggaggtgt

SEQ ID NO: 7548 - DNA, 20 bp, Artificial Sequence
  chemically synthesized
agtgggcagtggaggtgtca

SEQ ID NO: 7549 - DNA, 20 bp, Artificial Sequence
  chemically synthesized
gtgggcagtggaggtgtcag

SEQ ID NO: 7550 - DNA, 20 bp, Artificial Sequence
  chemically synthesized
ggaggtgtcagaggcctccc

SEQ ID NO: 7551 - DNA, 20 bp, Artificial Sequence
  chemically synthesized
gaggtgtcagaggcctccct

SEQ ID NO: 7552 - DNA, 20 bp, Artificial Sequence
  chemically synthesized
agaggcctccctgggtcaaa

SEQ ID NO: 7553 - DNA, 20 bp, Artificial Sequence
  chemically synthesized
gaggcctccctgggtcaaat

SEQ ID NO: 7554 - DNA, 20 bp, Artificial Sequence
  chemically synthesized
aggcctccctgggtcaaatg

SEQ ID NO: 7555 - DNA, 20 bp, Artificial Sequence
  chemically synthesized
cctgggtcaaatggggtcct

SEQ ID NO: 7556 - DNA, 20 bp, Artificial Sequence
  chemically synthesized
gtcaaatggggtcctgagtg

SEQ ID NO: 7557 - DNA, 20 bp, Artificial Sequence
  chemically synthesized
tggggtcctgagtgtggctg

SEQ ID NO: 7558 - DNA, 20 bp, Artificial Sequence
  chemically synthesized
ggtcctgagtgtggctgcag

SEQ ID NO: 7559 - DNA, 20 bp, Artificial Sequence
  chemically synthesized
gtcctgagtgtggctgcagt

SEQ ID NO: 7560 - DNA, 20 bp, Artificial Sequence
  chemically synthesized
tcctgagtgtggctgcagtg

SEQ ID NO: 7561 - DNA, 20 bp, Artificial Sequence
  chemically synthesized
tgagtgtggctgcagtgggg

SEQ ID NO: 7562 - DNA, 20 bp, Artificial Sequence
  chemically synthesized
gagtgtggctgcagtgggga

SEQ ID NO: 7563 - DNA, 20 bp, Artificial Sequence
  chemically synthesized
tgtggctgcagtggggaagg

SEQ ID NO: 7564 - DNA, 20 bp, Artificial Sequence
  chemically synthesized
ggctgcagtggggaaggtgg

SEQ ID NO: 7565 - DNA, 20 bp, Artificial Sequence
  chemically synthesized
gtggggaaggtggaagtcac

SEQ ID NO: 7566 - DNA, 20 bp, Artificial Sequence
  chemically synthesized
tggaagtcactggtgtgaaa

SEQ ID NO: 7567 - DNA, 20 bp, Artificial Sequence
  chemically synthesized
tcactggtgtgaaaaagatg

SEQ ID NO: 7568 - DNA, 20 bp, Artificial Sequence
  chemically synthesized
actggtgtgaaaaagatgaa

SEQ ID NO: 7569 - DNA, 20 bp, Artificial Sequence
  chemically synthesized
gtgaaaaagatgaagagtta

SEQ ID NO: 7570 - DNA, 20 bp, Artificial Sequence
  chemically synthesized
aaaagatgaagagttatgga

SEQ ID NO: 7571 - DNA, 20 bp, Artificial Sequence
  chemically synthesized
gagttatggacagtcactta

SEQ ID NO: 7572 - DNA, 20 bp, Artificial Sequence
  chemically synthesized
agttatggacagtcacttac

SEQ ID NO: 7573 - DNA, 20 bp, Artificial Sequence
  chemically synthesized
gttatggacagtcacttaca

SEQ ID NO: 7574 - DNA, 20 bp, Artificial Sequence
  chemically synthesized
ttatggacagtcacttacag

SEQ ID NO: 7575 - DNA, 20 bp, Artificial Sequence
  chemically synthesized
tggacagtcacttacagggg

SEQ ID NO: 7576 - DNA, 20 bp, Artificial Sequence
  chemically synthesized
tacaggggcagtgtctgact

SEQ ID NO: 7577 - DNA, 20 bp, Artificial Sequence
  chemically synthesized
acaggggcagtgtctgactc

SEQ ID NO: 7578 - DNA, 20 bp, Artificial Sequence
  chemically synthesized
gggcagtgtctgactcagga

SEQ ID NO: 7579 - DNA, 20 bp, Artificial Sequence
  chemically synthesized
cagtgtctgactcaggacag

SEQ ID NO: 7580 - DNA, 20 bp, Artificial Sequence
  chemically synthesized
tgtctgactcaggacagtgg

SEQ ID NO: 7581 - DNA, 20 bp, Artificial Sequence
  chemically synthesized
gtctgactcaggacagtggc

SEQ ID NO: 7582 - DNA, 20 bp, Artificial Sequence
  chemically synthesized
tgactcaggacagtggcagg

SEQ ID NO: 7583 - DNA, 20 bp, Artificial Sequence
  chemically synthesized
gacagtggcaggaagtgacc

SEQ ID NO: 7584 - DNA, 20 bp, Artificial Sequence
  chemically synthesized
acagtggcaggaagtgacct

SEQ ID NO: 7585 - DNA, 20 bp, Artificial Sequence
  chemically synthesized
cagtggcaggaagtgacctg

SEQ ID NO: 7586 - DNA, 20 bp, Artificial Sequence
  chemically synthesized
gtggcaggaagtgacctggg

SEQ ID NO: 7587 - DNA, 20 bp, Artificial Sequence
  chemically synthesized
tggcaggaagtgacctgggg

SEQ ID NO: 7588 - DNA, 20 bp, Artificial Sequence
  chemically synthesized
caggaagtgacctggggagg

SEQ ID NO: 7589 - DNA, 20 bp, Artificial Sequence
  chemically synthesized
tgacctggggaggaagattc

SEQ ID NO: 7590 - DNA, 20 bp, Artificial Sequence
  chemically synthesized
gacctggggaggaagattct

SEQ ID NO: 7591 - DNA, 20 bp, Artificial Sequence
  chemically synthesized
aagattctgggcccctgact

SEQ ID NO: 7592 - DNA, 20 bp, Artificial Sequence
  chemically synthesized
ggcccctgactgagcctccc

SEQ ID NO: 7593 - DNA, 20 bp, Artificial Sequence
  chemically synthesized
gcccctgactgagcctcccc

SEQ ID NO: 7594 - DNA, 20 bp, Artificial Sequence
  chemically synthesized
gactgagcctccccaggatg

SEQ ID NO: 7595 - DNA, 20 bp, Artificial Sequence
  chemically synthesized
tccccaggatgtggtcctgc

SEQ ID NO: 7596 - DNA, 20 bp, Artificial Sequence
  chemically synthesized
ccccaggatgtggtcctgct

SEQ ID NO: 7597 - DNA, 20 bp, Artificial Sequence
  chemically synthesized
aggatgtggtcctgctgggt

SEQ ID NO: 7598 - DNA, 20 bp, Artificial Sequence
  chemically synthesized
ggatgtggtcctgctgggtc

SEQ ID NO: 7599 - DNA, 20 bp, Artificial Sequence
  chemically synthesized
gatgtggtcctgctgggtcg

SEQ ID NO: 7600 - DNA, 20 bp, Artificial Sequence
  chemically synthesized
atgtggtcctgctgggtcgg

SEQ ID NO: 7601 - DNA, 20 bp, Artificial Sequence
  chemically synthesized
tgtggtcctgctgggtcggg

SEQ ID NO: 7602 - DNA, 20 bp, Artificial Sequence
  chemically synthesized
cctgctgggtcggggggtga

SEQ ID NO: 7603 - DNA, 20 bp, Artificial Sequence
  chemically synthesized
ctgctgggtcggggggtgat

SEQ ID NO: 7604 - DNA, 20 bp, Artificial Sequence
  chemically synthesized
ggtcggggggtgataggaat

SEQ ID NO: 7605 - DNA, 20 bp, Artificial Sequence
  chemically synthesized
cggggggtgataggaatgag

SEQ ID NO: 7606 - DNA, 20 bp, Artificial Sequence
  chemically synthesized
ggtgataggaatgagaagac

SEQ ID NO: 7607 - DNA, 20 bp, Artificial Sequence
  chemically synthesized
gtgataggaatgagaagaca

SEQ ID NO: 7608 - DNA, 20 bp, Artificial Sequence
  chemically synthesized
ataggaatgagaagacaagg

SEQ ID NO: 7609 - DNA, 20 bp, Artificial Sequence
  chemically synthesized
tgagaagacaaggaagtcca

SEQ ID NO: 7610 - DNA, 20 bp, Artificial Sequence
  chemically synthesized
agaagacaaggaagtccaca

SEQ ID NO: 7611 - DNA, 20 bp, Artificial Sequence
  chemically synthesized
gacaaggaagtccacagagt

SEQ ID NO: 7612 - DNA, 20 bp, Artificial Sequence
  chemically synthesized
acaaggaagtccacagagtc

SEQ ID NO: 7613 - DNA, 20 bp, Artificial Sequence
  chemically synthesized
caaggaagtccacagagtca

SEQ ID NO: 7614 - DNA, 20 bp, Artificial Sequence
  chemically synthesized
agtccacagagtcagggtcc

SEQ ID NO: 7615 - DNA, 20 bp, Artificial Sequence
  chemically synthesized
gtccacagagtcagggtcca

SEQ ID NO: 7616 - DNA, 20 bp, Artificial Sequence
  chemically synthesized
cagagtcagggtccaaggcc

SEQ ID NO: 7617 - DNA, 20 bp, Artificial Sequence
  chemically synthesized
agtcagggtccaaggcctag

SEQ ID NO: 7618 - DNA, 20 bp, Artificial Sequence
  chemically synthesized
gtcagggtccaaggcctaga

SEQ ID NO: 7619 - DNA, 20 bp, Artificial Sequence
  chemically synthesized
cctagaaggtgttctgtttg

SEQ ID NO: 7620 - DNA, 20 bp, Artificial Sequence
  chemically synthesized
ctagaaggtgttctgtttgc

SEQ ID NO: 7621 - DNA, 20 bp, Artificial Sequence
  chemically synthesized
gaaggtgttctgtttgcagg

SEQ ID NO: 7622 - DNA, 20 bp, Artificial Sequence
  chemically synthesized
gtttgcaggtggatgctgca

SEQ ID NO: 7623 - DNA, 20 bp, Artificial Sequence
  chemically synthesized
ttgcaggtggatgctgcaaa

SEQ ID NO: 7624 - DNA, 20 bp, Artificial Sequence
  chemically synthesized
gcaggtggatgctgcaaaga

SEQ ID NO: 7625 - DNA, 20 bp, Artificial Sequence
  chemically synthesized
caggtggatgctgcaaagag

SEQ ID NO: 7626 - DNA, 20 bp, Artificial Sequence
  chemically synthesized
ggtggatgctgcaaagagag

SEQ ID NO: 7627 - DNA, 20 bp, Artificial Sequence
  chemically synthesized
atgctgcaaagagaggagct

SEQ ID NO: 7628 - DNA, 20 bp, Artificial Sequence
  chemically synthesized
tgctgcaaagagaggagctc

SEQ ID NO: 7629 - DNA, 20 bp, Artificial Sequence
  chemically synthesized
gctgcaaagagaggagctca

SEQ ID NO: 7630 - DNA, 20 bp, Artificial Sequence
  chemically synthesized
caaagagaggagctcagggc

SEQ ID NO: 7631 - DNA, 20 bp, Artificial Sequence
  chemically synthesized
aaagagaggagctcagggct

SEQ ID NO: 7632 - DNA, 20 bp, Artificial Sequence
  chemically synthesized
gagctcagggctgggacaac

SEQ ID NO: 7633 - DNA, 20 bp, Artificial Sequence
  chemically synthesized
gctcagggctgggacaactg

SEQ ID NO: 7634 - DNA, 20 bp, Artificial Sequence
  chemically synthesized
tgggacaactggagctgctc

SEQ ID NO: 7635 - DNA, 20 bp, Artificial Sequence
  chemically synthesized
gggacaactggagctgctct

SEQ ID NO: 7636 - DNA, 20 bp, Artificial Sequence
  chemically synthesized
aactggagctgctctgggtc

SEQ ID NO: 7637 - DNA, 20 bp, Artificial Sequence
  chemically synthesized
ctggagctgctctgggtctg

SEQ ID NO: 7638 - DNA, 20 bp, Artificial Sequence
  chemically synthesized
tggagctgctctgggtctgg

SEQ ID NO: 7639 - DNA, 20 bp, Artificial Sequence
  chemically synthesized
agctgctctgggtctggagg

SEQ ID NO: 7640 - DNA, 20 bp, Artificial Sequence
  chemically synthesized
tgctctgggtctggaggcag

SEQ ID NO: 7641 - DNA, 20 bp, Artificial Sequence
  chemically synthesized
ctctgggtctggaggcagca

SEQ ID NO: 7642 - DNA, 20 bp, Artificial Sequence
  chemically synthesized
ctgggtctggaggcagcaga

SEQ ID NO: 7643 - DNA, 20 bp, Artificial Sequence
  chemically synthesized
tgggtctggaggcagcagag

SEQ ID NO: 7644 - DNA, 20 bp, Artificial Sequence
  chemically synthesized
gggtctggaggcagcagaga

SEQ ID NO: 7645 - DNA, 20 bp, Artificial Sequence
  chemically synthesized
gtctggaggcagcagagagg

SEQ ID NO: 7646 - DNA, 20 bp, Artificial Sequence
  chemically synthesized
gaggcagcagagagggagcc

SEQ ID NO: 7647 - DNA, 20 bp, Artificial Sequence
  chemically synthesized
agggagcccagctctgtgtg

SEQ ID NO: 7648 - DNA, 20 bp, Artificial Sequence
  chemically synthesized
gggagcccagctctgtgtgc

SEQ ID NO: 7649 - DNA, 20 bp, Artificial Sequence
  chemically synthesized
agcccagctctgtgtgcagg

SEQ ID NO: 7650 - DNA, 20 bp, Artificial Sequence
  chemically synthesized
gctctgtgtgcaggaagacg

SEQ ID NO: 7651 - DNA, 20 bp, Artificial Sequence
  chemically synthesized
ctctgtgtgcaggaagacgt

SEQ ID NO: 7652 - DNA, 20 bp, Artificial Sequence
  chemically synthesized
gcaggaagacgtgggtgtgt

SEQ ID NO: 7653 - DNA, 20 bp, Artificial Sequence
  chemically synthesized
ggtgtgtgagtgtacgtgtg

SEQ ID NO: 7654 - DNA, 20 bp, Artificial Sequence
  chemically synthesized
gtgtgtgagtgtacgtgtgt

SEQ ID NO: 7655 - DNA, 20 bp, Artificial Sequence
  chemically synthesized
gtgtacgtgtgtgggtgtgt

SEQ ID NO: 7656 - DNA, 20 bp, Artificial Sequence
  chemically synthesized
tgtacgtgtgtgggtgtgtc

SEQ ID NO: 7657 - DNA, 20 bp, Artificial Sequence
  chemically synthesized
gtgtgtcaggtgtgtgtgtg

SEQ ID NO: 7658 - DNA, 20 bp, Artificial Sequence
  chemically synthesized
tgtgtcaggtgtgtgtgtgt

SEQ ID NO: 7659 - DNA, 20 bp, Artificial Sequence
  chemically synthesized
tgtcaggtgtgtgtgtgtgg

SEQ ID NO: 7660 - DNA, 20 bp, Artificial Sequence
  chemically synthesized
gtcaggtgtgtgtgtgtggg

SEQ ID NO: 7661 - DNA, 20 bp, Artificial Sequence
  chemically synthesized
tcaggtgtgtgtgtgtggga

SEQ ID NO: 7662 - DNA, 20 bp, Artificial Sequence
  chemically synthesized
aggtgtgtgtgtgtgggagg

SEQ ID NO: 7663 - DNA, 20 bp, Artificial Sequence
  chemically synthesized
gggagtatgaatgtgtgcat

SEQ ID NO: 7664 - DNA, 20 bp, Artificial Sequence
  chemically synthesized
tagcatgcatatgcacatgt

SEQ ID NO: 7665 - DNA, 20 bp, Artificial Sequence
  chemically synthesized
gcatgcatatgcacatgtga

SEQ ID NO: 7666 - DNA, 20 bp, Artificial Sequence
  chemically synthesized
tgcatatgcacatgtgagag

SEQ ID NO: 7667 - DNA, 20 bp, Artificial Sequence
  chemically synthesized
gcatatgcacatgtgagagt

SEQ ID NO: 7668 - DNA, 20 bp, Artificial Sequence
  chemically synthesized
tgcacatgtgagagtgggta

SEQ ID NO: 7669 - DNA, 20 bp, Artificial Sequence
  chemically synthesized
acatgtgagagtgggtacag

SEQ ID NO: 7670 - DNA, 20 bp, Artificial Sequence
  chemically synthesized
atgtgagagtgggtacagca

SEQ ID NO: 7671 - DNA, 20 bp, Artificial Sequence
  chemically synthesized
agagtgggtacagcagagcg

SEQ ID NO: 7672 - DNA, 20 bp, Artificial Sequence
  chemically synthesized
gtacagcagagcgtggtcat

SEQ ID NO: 7673 - DNA, 20 bp, Artificial Sequence
  chemically synthesized
gtgtgcaaatgtgtgttttt

SEQ ID NO: 7674 - DNA, 20 bp, Artificial Sequence
  chemically synthesized
caaatgtgtgtttttgagtg

SEQ ID NO: 7675 - DNA, 20 bp, Artificial Sequence
  chemically synthesized
tgtgtgtttttgagtgaagt

SEQ ID NO: 7676 - DNA, 20 bp, Artificial Sequence
  chemically synthesized
gagtgaagtgagcaatgtgt

SEQ ID NO: 7677 - DNA, 20 bp, Artificial Sequence
  chemically synthesized
tgagcaatgtgtgagtgtgt

SEQ ID NO: 7678 - DNA, 20 bp, Artificial Sequence
  chemically synthesized
gtgagtgtgtgagtgtgtgt

SEQ ID NO: 7679 - DNA, 20 bp, Artificial Sequence
  chemically synthesized
gtgagtgtgtgtgagtttgt

SEQ ID NO: 7680 - DNA, 20 bp, Artificial Sequence
  chemically synthesized
tgagtgtgtgtgagtttgtg

SEQ ID NO: 7681 - DNA, 20 bp, Artificial Sequence
  chemically synthesized
gagtgtgtgtgagtttgtga

SEQ ID NO: 7682 - DNA, 20 bp, Artificial Sequence
  chemically synthesized
gggcatgtgaatgtgtgtgt

SEQ ID NO: 7683 - DNA, 20 bp, Artificial Sequence
  chemically synthesized
aatgtgtgtgtcagtgctgt

SEQ ID NO: 7684 - DNA, 20 bp, Artificial Sequence
  chemically synthesized
atgtgtgtgtcagtgctgtc

SEQ ID NO: 7685 - DNA, 20 bp, Artificial Sequence
  chemically synthesized
tgtgtgtgtcagtgctgtca

SEQ ID NO: 7686 - DNA, 20 bp, Artificial Sequence
  chemically synthesized
gtgtcagtgctgtcagggtg

SEQ ID NO: 7687 - DNA, 20 bp, Artificial Sequence
  chemically synthesized
cagtgctgtcagggtgcaga

SEQ ID NO: 7688 - DNA, 20 bp, Artificial Sequence
  chemically synthesized
tgtcagggtgcagatggatc

SEQ ID NO: 7689 - DNA, 20 bp, Artificial Sequence
  chemically synthesized
gtcagggtgcagatggatca

SEQ ID NO: 7690 - DNA, 20 bp, Artificial Sequence
  chemically synthesized
tcagggtgcagatggatcaa

SEQ ID NO: 7691 - DNA, 20 bp, Artificial Sequence
  chemically synthesized
cagggtgcagatggatcaag

SEQ ID NO: 7692 - DNA, 20 bp, Artificial Sequence
  chemically synthesized
ggtgcagatggatcaagggg

SEQ ID NO: 7693 - DNA, 20 bp, Artificial Sequence
  chemically synthesized
gtgcagatggatcaaggggc

SEQ ID NO: 7694 - DNA, 20 bp, Artificial Sequence
  chemically synthesized
gcagatggatcaaggggcag

SEQ ID NO: 7695 - DNA, 20 bp, Artificial Sequence
  chemically synthesized
agatggatcaaggggcagga

SEQ ID NO: 7696 - DNA, 20 bp, Artificial Sequence
  chemically synthesized
gatggatcaaggggcaggag

SEQ ID NO: 7697 - DNA, 20 bp, Artificial Sequence
  chemically synthesized
ggggcaggagaggtacctgt

SEQ ID NO: 7698 - DNA, 20 bp, Artificial Sequence
  chemically synthesized
aggtacctgtgagatgacct

SEQ ID NO: 7699 - DNA, 20 bp, Artificial Sequence
  chemically synthesized
ggtacctgtgagatgacctc

SEQ ID NO: 7700 - DNA, 20 bp, Artificial Sequence
  chemically synthesized
ctgtgagatgacctcgggct

SEQ ID NO: 7701 - DNA, 20 bp, Artificial Sequence
  chemically synthesized
tgtgagatgacctcgggctg

SEQ ID NO: 7702 - DNA, 20 bp, Artificial Sequence
  chemically synthesized
gtgagatgacctcgggctga

SEQ ID NO: 7703 - DNA, 20 bp, Artificial Sequence
  chemically synthesized
tgagatgacctcgggctgag

SEQ ID NO: 7704 - DNA, 20 bp, Artificial Sequence
  chemically synthesized
agatgacctcgggctgaggg

SEQ ID NO: 7705 - DNA, 20 bp, Artificial Sequence
  chemically synthesized
cgggctgaggggagcaaatt

SEQ ID NO: 7706 - DNA, 20 bp, Artificial Sequence
  chemically synthesized
tgaggggagcaaatttagtg

SEQ ID NO: 7707 - DNA, 20 bp, Artificial Sequence
  chemically synthesized
gagcaaatttagtgtggaac

SEQ ID NO: 7708 - DNA, 20 bp, Artificial Sequence
  chemically synthesized
agcaaatttagtgtggaacg

SEQ ID NO: 7709 - DNA, 20 bp, Artificial Sequence
  chemically synthesized
ttagtgtggaacgaggtttc

SEQ ID NO: 7710 - DNA, 20 bp, Artificial Sequence
  chemically synthesized
tagtgtggaacgaggtttct

SEQ ID NO: 7711 - DNA, 20 bp, Artificial Sequence
  chemically synthesized
agtgtggaacgaggtttcta

SEQ ID NO: 7712 - DNA, 20 bp, Artificial Sequence
  chemically synthesized
gtggaacgaggtttctaggg

SEQ ID NO: 7713 - DNA, 20 bp, Artificial Sequence
  chemically synthesized
aacgaggtttctagggaagc

SEQ ID NO: 7714 - DNA, 20 bp, Artificial Sequence
  chemically synthesized
acgaggtttctagggaagcg

SEQ ID NO: 7715 - DNA, 20 bp, Artificial Sequence
  chemically synthesized
cgaggtttctagggaagcga

SEQ ID NO: 7716 - DNA, 20 bp, Artificial Sequence
  chemically synthesized
tttctagggaagcgagggca

SEQ ID NO: 7717 - DNA, 20 bp, Artificial Sequence
  chemically synthesized
ttctagggaagcgagggcaa

SEQ ID NO: 7718 - DNA, 20 bp, Artificial Sequence
  chemically synthesized
tctagggaagcgagggcaaa

SEQ ID NO: 7719 - DNA, 20 bp, Artificial Sequence
  chemically synthesized
gaagcgagggcaaagggcgc

SEQ ID NO: 7720 - DNA, 20 bp, Artificial Sequence
  chemically synthesized
aagcgagggcaaagggcgct

SEQ ID NO: 7721 - DNA, 20 bp, Artificial Sequence
  chemically synthesized
agcgagggcaaagggcgctg

SEQ ID NO: 7722 - DNA, 20 bp, Artificial Sequence
  chemically synthesized
cgagggcaaagggcgctggg

SEQ ID NO: 7723 - DNA, 20 bp, Artificial Sequence
  chemically synthesized
gagggcaaagggcgctgggg

SEQ ID NO: 7724 - DNA, 20 bp, Artificial Sequence
  chemically synthesized
gggcaaagggcgctggggag

SEQ ID NO: 7725 - DNA, 20 bp, Artificial Sequence
  chemically synthesized
ggcaaagggcgctggggagg

SEQ ID NO: 7726 - DNA, 20 bp, Artificial Sequence
  chemically synthesized
gctggggaggaggccttgcg

SEQ ID NO: 7727 - DNA, 20 bp, Artificial Sequence
  chemically synthesized
ggggaggaggccttgcgtgg

SEQ ID NO: 7728 - DNA, 20 bp, Artificial Sequence
  chemically synthesized
gggaggaggccttgcgtggt

SEQ ID NO: 7729 - DNA, 20 bp, Artificial Sequence
  chemically synthesized
ggaggaggccttgcgtggtg

SEQ ID NO: 7730 - DNA, 20 bp, Artificial Sequence
  chemically synthesized
gaggaggccttgcgtggtgg

SEQ ID NO: 7731 - DNA, 20 bp, Artificial Sequence
  chemically synthesized
ggccttgcgtggtgggggat

SEQ ID NO: 7732 - DNA, 20 bp, Artificial Sequence
  chemically synthesized
gccttgcgtggtgggggatg

SEQ ID NO: 7733 - DNA, 20 bp, Artificial Sequence
  chemically synthesized
gtggtgggggatgaggacaa

SEQ ID NO: 7734 - DNA, 20 bp, Artificial Sequence
  chemically synthesized
tggtgggggatgaggacaac

SEQ ID NO: 7735 - DNA, 20 bp, Artificial Sequence
  chemically synthesized
tgggggatgaggacaacagg

SEQ ID NO: 7736 - DNA, 20 bp, Artificial Sequence
  chemically synthesized
gggggatgaggacaacaggt

SEQ ID NO: 7737 - DNA, 20 bp, Artificial Sequence
  chemically synthesized
tgaggacaacaggtgggacc

SEQ ID NO: 7738 - DNA, 20 bp, Artificial Sequence
  chemically synthesized
aggacaacaggtgggacctg

SEQ ID NO: 7739 - DNA, 20 bp, Artificial Sequence
  chemically synthesized
ggacaacaggtgggacctgg

SEQ ID NO: 7740 - DNA, 20 bp, Artificial Sequence
  chemically synthesized
gacaacaggtgggacctgga

SEQ ID NO: 7741 - DNA, 20 bp, Artificial Sequence
  chemically synthesized
gggacctggagggttgtgct

SEQ ID NO: 7742 - DNA, 20 bp, Artificial Sequence
  chemically synthesized
gacctggagggttgtgcttg

SEQ ID NO: 7743 - DNA, 20 bp, Artificial Sequence
  chemically synthesized
cctggagggttgtgcttgga

SEQ ID NO: 7744 - DNA, 20 bp, Artificial Sequence
  chemically synthesized
ggagggttgtgcttggagag

SEQ ID NO: 7745 - DNA, 20 bp, Artificial Sequence
  chemically synthesized
gagggttgtgcttggagagt

SEQ ID NO: 7746 - DNA, 20 bp, Artificial Sequence
  chemically synthesized
tgtgcttggagagtgggcta

SEQ ID NO: 7747 - DNA, 20 bp, Artificial Sequence
  chemically synthesized
gcttggagagtgggctatgg

SEQ ID NO: 7748 - DNA, 20 bp, Artificial Sequence
  chemically synthesized
tgggctatggtggaatgacc

SEQ ID NO: 7749 - DNA, 20 bp, Artificial Sequence
  chemically synthesized
tggtggaatgacccagattt

SEQ ID NO: 7750 - DNA, 20 bp, Artificial Sequence
  chemically synthesized
ggtggaatgacccagattta

SEQ ID NO: 7751 - DNA, 20 bp, Artificial Sequence
  chemically synthesized
cccagatttaaggatctcaa

SEQ ID NO: 7752 - DNA, 20 bp, Artificial Sequence
  chemically synthesized
taaggatctcaatggaattt

SEQ ID NO: 7753 - DNA, 20 bp, Artificial Sequence
  chemically synthesized
ggatctcaatggaattttgg

SEQ ID NO: 7754 - DNA, 20 bp, Artificial Sequence
  chemically synthesized
gatctcaatggaattttggc

SEQ ID NO: 7755 - DNA, 20 bp, Artificial Sequence
  chemically synthesized
atctcaatggaattttggca

SEQ ID NO: 7756 - DNA, 20 bp, Artificial Sequence
  chemically synthesized
tctcaatggaattttggcag

SEQ ID NO: 7757 - DNA, 20 bp, Artificial Sequence
  chemically synthesized
tcaatggaattttggcaggg

SEQ ID NO: 7758 - DNA, 20 bp, Artificial Sequence
  chemically synthesized
caatggaattttggcagggg

SEQ ID NO: 7759 - DNA, 20 bp, Artificial Sequence
  chemically synthesized
aatggaattttggcagggga

SEQ ID NO: 7760 - DNA, 20 bp, Artificial Sequence
  chemically synthesized
tggcaggggagggactgttc

SEQ ID NO: 7761 - DNA, 20 bp, Artificial Sequence
  chemically synthesized
ggggagggactgttccagta

SEQ ID NO: 7762 - DNA, 20 bp, Artificial Sequence
  chemically synthesized
gactgttccagtatggattt

SEQ ID NO: 7763 - DNA, 20 bp, Artificial Sequence
  chemically synthesized
actgttccagtatggatttt

SEQ ID NO: 7764 - DNA, 20 bp, Artificial Sequence
  chemically synthesized
gttccagtatggattttagg

SEQ ID NO: 7765 - DNA, 20 bp, Artificial Sequence
  chemically synthesized
tatggattttaggaagaaca

SEQ ID NO: 7766 - DNA, 20 bp, Artificial Sequence
  chemically synthesized
atggattttaggaagaacac

SEQ ID NO: 7767 - DNA, 20 bp, Artificial Sequence
  chemically synthesized
tggattttaggaagaacaca

SEQ ID NO: 7768 - DNA, 20 bp, Artificial Sequence
  chemically synthesized
tttaggaagaacacagggcc

SEQ ID NO: 7769 - DNA, 20 bp, Artificial Sequence
  chemically synthesized
agaacacagggcccagcttc

SEQ ID NO: 7770 - DNA, 20 bp, Artificial Sequence
  chemically synthesized
aacacagggcccagcttctg

SEQ ID NO: 7771 - DNA, 20 bp, Artificial Sequence
  chemically synthesized
gcttctggagtctccaatct

SEQ ID NO: 7772 - DNA, 20 bp, Artificial Sequence
  chemically synthesized
cttctggagtctccaatctg

SEQ ID NO: 7773 - DNA, 20 bp, Artificial Sequence
  chemically synthesized
ttctggagtctccaatctga

SEQ ID NO: 7774 - DNA, 20 bp, Artificial Sequence
  chemically synthesized
tctggagtctccaatctgag

SEQ ID NO: 7775 - DNA, 20 bp, Artificial Sequence
  chemically synthesized
gagtctccaatctgagggga

SEQ ID NO: 7776 - DNA, 20 bp, Artificial Sequence
  chemically synthesized
agtctccaatctgaggggac

SEQ ID NO: 7777 - DNA, 20 bp, Artificial Sequence
  chemically synthesized
tctccaatctgaggggacag

SEQ ID NO: 7778 - DNA, 20 bp, Artificial Sequence
  chemically synthesized
atctgaggggacaggagcct

SEQ ID NO: 7779 - DNA, 20 bp, Artificial Sequence
  chemically synthesized
tgaggggacaggagccttag

SEQ ID NO: 7780 - DNA, 20 bp, Artificial Sequence
  chemically synthesized
aggggacaggagccttagaa

SEQ ID NO: 7781 - DNA, 20 bp, Artificial Sequence
  chemically synthesized
acaggagccttagaagagct

SEQ ID NO: 7782 - DNA, 20 bp, Artificial Sequence
  chemically synthesized
gccttagaagagctgagact

SEQ ID NO: 7783 - DNA, 20 bp, Artificial Sequence
  chemically synthesized
ccttagaagagctgagacta

SEQ ID NO: 7784 - DNA, 20 bp, Artificial Sequence
  chemically synthesized
aagagctgagactaaggccc

SEQ ID NO: 7785 - DNA, 20 bp, Artificial Sequence
  chemically synthesized
agagctgagactaaggcccg

SEQ ID NO: 7786 - DNA, 20 bp, Artificial Sequence
  chemically synthesized
gactaaggcccgaggtgatc

SEQ ID NO: 7787 - DNA, 20 bp, Artificial Sequence
  chemically synthesized
ctaaggcccgaggtgatctg

SEQ ID NO: 7788 - DNA, 20 bp, Artificial Sequence
  chemically synthesized
taaggcccgaggtgatctgg

SEQ ID NO: 7789 - DNA, 20 bp, Artificial Sequence
  chemically synthesized
gatctggaggcctctgccac

SEQ ID NO: 7790 - DNA, 20 bp, Artificial Sequence
  chemically synthesized
tggaggcctctgccactggc

SEQ ID NO: 7791 - DNA, 20 bp, Artificial Sequence
  chemically synthesized
ggcctctgccactggctgga

SEQ ID NO: 7792 - DNA, 20 bp, Artificial Sequence
  chemically synthesized
gcctctgccactggctggat

SEQ ID NO: 7793 - DNA, 20 bp, Artificial Sequence
  chemically synthesized
ctctgccactggctggatgg

SEQ ID NO: 7794 - DNA, 20 bp, Artificial Sequence
  chemically synthesized
tctgccactggctggatggg

SEQ ID NO: 7795 - DNA, 20 bp, Artificial Sequence
  chemically synthesized
gatgggaggaaaaccattca

SEQ ID NO: 7796 - DNA, 20 bp, Artificial Sequence
  chemically synthesized
cattcacagatcccccttct

SEQ ID NO: 7797 - DNA, 20 bp, Artificial Sequence
  chemically synthesized
attcacagatcccccttctc

SEQ ID NO: 7798 - DNA, 20 bp, Artificial Sequence
  chemically synthesized
cccttctcaggatgtgtgcc

SEQ ID NO: 7799 - DNA, 20 bp, Artificial Sequence
  chemically synthesized
ccttctcaggatgtgtgcct

SEQ ID NO: 7800 - DNA, 20 bp, Artificial Sequence
  chemically synthesized
tctcaggatgtgtgcctagg

SEQ ID NO: 7801 - DNA, 20 bp, Artificial Sequence
  chemically synthesized
ctcaggatgtgtgcctaggc

SEQ ID NO: 7802 - DNA, 20 bp, Artificial Sequence
  chemically synthesized
tcaggatgtgtgcctaggca

SEQ ID NO: 7803 - DNA, 20 bp, Artificial Sequence
  chemically synthesized
gatgtgtgcctaggcagggc

SEQ ID NO: 7804 - DNA, 20 bp, Artificial Sequence
  chemically synthesized
atgtgtgcctaggcagggcc

SEQ ID NO: 7805 - DNA, 20 bp, Artificial Sequence
  chemically synthesized
cccgccccctgtgcgtctcc

SEQ ID NO: 7806 - DNA, 20 bp, Artificial Sequence
  chemically synthesized
ctgtgcgtctcccagtcccc

SEQ ID NO: 7807 - DNA, 20 bp, Artificial Sequence
  chemically synthesized
gtctcccagtcccccagctc

SEQ ID NO: 7808 - DNA, 20 bp, Artificial Sequence
  chemically synthesized
tctcccagtcccccagctcc

SEQ ID NO: 7809 - DNA, 20 bp, Artificial Sequence
  chemically synthesized
agtcccccagctccaggatc

SEQ ID NO: 7810 - DNA, 20 bp, Artificial Sequence
  chemically synthesized
gtcccccagctccaggatcc

SEQ ID NO: 7811 - DNA, 20 bp, Artificial Sequence
  chemically synthesized
caggatccgggctttgcaca

SEQ ID NO: 7812 - DNA, 20 bp, Artificial Sequence
  chemically synthesized
acagctgatgtgaatatcct

SEQ ID NO: 7813 - DNA, 20 bp, Artificial Sequence
  chemically synthesized
aatatcctgagtcgtgtgca

SEQ ID NO: 7814 - DNA, 20 bp, Artificial Sequence
  chemically synthesized
atatcctgagtcgtgtgcat

SEQ ID NO: 7815 - DNA, 20 bp, Artificial Sequence
  chemically synthesized
gtgcatgggtgtgtgtgcac

SEQ ID NO: 7816 - DNA, 20 bp, Artificial Sequence
  chemically synthesized
tgggtgtgtgtgcaccagat

SEQ ID NO: 7817 - DNA, 20 bp, Artificial Sequence
  chemically synthesized
tgcgtgtgtatatttataca

SEQ ID NO: 7818 - DNA, 20 bp, Artificial Sequence
  chemically synthesized
tatatttatacatggtaata

SEQ ID NO: 7819 - DNA, 20 bp, Artificial Sequence
  chemically synthesized
atatttatacatggtaatat

SEQ ID NO: 7820 - DNA, 20 bp, Artificial Sequence
  chemically synthesized
atacatggtaatatgggtgc

SEQ ID NO: 7821 - DNA, 20 bp, Artificial Sequence
  chemically synthesized
taatatgggtgcgagtgtgt

SEQ ID NO: 7822 - DNA, 20 bp, Artificial Sequence
  chemically synthesized
atatgggtgcgagtgtgtaa

SEQ ID NO: 7823 - DNA, 20 bp, Artificial Sequence
  chemically synthesized
tgtgtgtaatgctcaaatgc

SEQ ID NO: 7824 - DNA, 20 bp, Artificial Sequence
  chemically synthesized
gtgtgtaatgctcaaatgct

SEQ ID NO: 7825 - DNA, 20 bp, Artificial Sequence
  chemically synthesized
tgtgtaatgctcaaatgctg

SEQ ID NO: 7826 - DNA, 20 bp, Artificial Sequence
  chemically synthesized
atgctcaaatgctggggtca

SEQ ID NO: 7827 - DNA, 20 bp, Artificial Sequence
  chemically synthesized
cctatgatgaccccccccca

SEQ ID NO: 7828 - DNA, 20 bp, Artificial Sequence
  chemically synthesized
ccccaaccaatccccccgcc

SEQ ID NO: 7829 - DNA, 20 bp, Artificial Sequence
  chemically synthesized
cccaaccaatccccccgccc

SEQ ID NO: 7830 - DNA, 20 bp, Artificial Sequence
  chemically synthesized
ccgcccaggttatgcctcct

SEQ ID NO: 7831 - DNA, 20 bp, Artificial Sequence
  chemically synthesized
cgcccaggttatgcctcctc

SEQ ID NO: 7832 - DNA, 20 bp, Artificial Sequence
  chemically synthesized
ggttatgcctcctcaggctt

SEQ ID NO: 7833 - DNA, 20 bp, Artificial Sequence
  chemically synthesized
ggtgccctgtctttaccctc

SEQ ID NO: 7834 - DNA, 20 bp, Artificial Sequence
  chemically synthesized
accctccggctccccacacc

SEQ ID NO: 7835 - DNA, 20 bp, Artificial Sequence
  chemically synthesized
ccctccggctccccacaccc

SEQ ID NO: 7836 - DNA, 20 bp, Artificial Sequence
  chemically synthesized
gctccccacacccaggctgc

SEQ ID NO: 7837 - DNA, 20 bp, Artificial Sequence
  chemically synthesized
ctcctgatgcccctctccca

SEQ ID NO: 7838 - DNA, 20 bp, Artificial Sequence
  chemically synthesized
tcctgatgcccctctcccac

SEQ ID NO: 7839 - DNA, 20 bp, Artificial Sequence
  chemically synthesized
cctgatgcccctctcccaca

SEQ ID NO: 7840 - DNA, 20 bp, Artificial Sequence
  chemically synthesized
ccacagggccacctcctgcc

SEQ ID NO: 7841 - DNA, 20 bp, Artificial Sequence
  chemically synthesized
gccacctcctgcccagcccc

SEQ ID NO: 7842 - DNA, 20 bp, Artificial Sequence
  chemically synthesized
ctcctgcccagcccctggca

SEQ ID NO: 7843 - DNA, 20 bp, Artificial Sequence
  chemically synthesized
ggcacagcgtctctgctcca

SEQ ID NO: 7844 - DNA, 20 bp, Artificial Sequence
  chemically synthesized
ctctgctccatggtctgctt

SEQ ID NO: 7845 - DNA, 20 bp, Artificial Sequence
  chemically synthesized
tgcttcagtctgcttgccct

SEQ ID NO: 7846 - DNA, 20 bp, Artificial Sequence
  chemically synthesized
gagcttcaacatcctgctgc

SEQ ID NO: 7847 - DNA, 20 bp, Artificial Sequence
  chemically synthesized
cttcaacatcctgctgctgg

SEQ ID NO: 7848 - DNA, 20 bp, Artificial Sequence
  chemically synthesized
ctggtggtcatctgtgtgac

SEQ ID NO: 7849 - DNA, 20 bp, Artificial Sequence
  chemically synthesized
tggtggtcatctgtgtgact

SEQ ID NO: 7850 - DNA, 20 bp, Artificial Sequence
  chemically synthesized
atctgtgtgactgggtccca

SEQ ID NO: 7851 - DNA, 20 bp, Artificial Sequence
  chemically synthesized
gtgtgactgggtcccaaagt

SEQ ID NO: 7852 - DNA, 20 bp, Artificial Sequence
  chemically synthesized
tgtgactgggtcccaaagtg

SEQ ID NO: 7853 - DNA, 20 bp, Artificial Sequence
  chemically synthesized
gtgactgggtcccaaagtga

SEQ ID NO: 7854 - DNA, 20 bp, Artificial Sequence
  chemically synthesized
gggtcccaaagtgagggtca

SEQ ID NO: 7855 - DNA, 20 bp, Artificial Sequence
  chemically synthesized
ggtcccaaagtgagggtcac

SEQ ID NO: 7856 - DNA, 20 bp, Artificial Sequence
  chemically synthesized
gtcccaaagtgagggtcacg

SEQ ID NO: 7857 - DNA, 20 bp, Artificial Sequence
  chemically synthesized
tcccaaagtgagggtcacgg

SEQ ID NO: 7858 - DNA, 20 bp, Artificial Sequence
  chemically synthesized
aaagtgagggtcacgggggc

SEQ ID NO: 7859 - DNA, 20 bp, Artificial Sequence
  chemically synthesized
gtgagggtcacgggggccag

SEQ ID NO: 7860 - DNA, 20 bp, Artificial Sequence
  chemically synthesized
tgagggtcacgggggccagc

SEQ ID NO: 7861 - DNA, 20 bp, Artificial Sequence
  chemically synthesized
gagggtcacgggggccagca

SEQ ID NO: 7862 - DNA, 20 bp, Artificial Sequence
  chemically synthesized
gtcacgggggccagcaggga

SEQ ID NO: 7863 - DNA, 20 bp, Artificial Sequence
  chemically synthesized
tcacgggggccagcagggat

SEQ ID NO: 7864 - DNA, 20 bp, Artificial Sequence
  chemically synthesized
gggggccagcagggatgggc

SEQ ID NO: 7865 - DNA, 20 bp, Artificial Sequence
  chemically synthesized
ggggccagcagggatgggca

SEQ ID NO: 7866 - DNA, 20 bp, Artificial Sequence
  chemically synthesized
gggccagcagggatgggcaa

SEQ ID NO: 7867 - DNA, 20 bp, Artificial Sequence
  chemically synthesized
ggccagcagggatgggcaag

SEQ ID NO: 7868 - DNA, 20 bp, Artificial Sequence
  chemically synthesized
cagcagggatgggcaagggg

SEQ ID NO: 7869 - DNA, 20 bp, Artificial Sequence
  chemically synthesized
agcagggatgggcaaggggt

SEQ ID NO: 7870 - DNA, 20 bp, Artificial Sequence
  chemically synthesized
gcagggatgggcaaggggta

SEQ ID NO: 7871 - DNA, 20 bp, Artificial Sequence
  chemically synthesized
ggatgggcaaggggtaggga

SEQ ID NO: 7872 - DNA, 20 bp, Artificial Sequence
  chemically synthesized
atgggcaaggggtagggaaa

SEQ ID NO: 7873 - DNA, 20 bp, Artificial Sequence
  chemically synthesized
aaggggtagggaaagagaca

SEQ ID NO: 7874 - DNA, 20 bp, Artificial Sequence
  chemically synthesized
aggggtagggaaagagacat

SEQ ID NO: 7875 - DNA, 20 bp, Artificial Sequence
  chemically synthesized
ggtagggaaagagacatggg

SEQ ID NO: 7876 - DNA, 20 bp, Artificial Sequence
  chemically synthesized
agggaaagagacatgggcag

SEQ ID NO: 7877 - DNA, 20 bp, Artificial Sequence
  chemically synthesized
acacagatgaccaccagcag

SEQ ID NO: 7878 - DNA, 20 bp, Artificial Sequence
  chemically synthesized
gggcatcaggagccggcagc

SEQ ID NO: 7879 - DNA, 20 bp, Artificial Sequence
  chemically synthesized
agcctgggtgtggggagccg

SEQ ID NO: 7880 - DNA, 20 bp, Artificial Sequence
  chemically synthesized
aggaggcataacctgggcgg

SEQ ID NO: 7881 - DNA, 20 bp, Artificial Sequence
  chemically synthesized
gattggttggggccatgggg

SEQ ID NO: 7882 - DNA, 20 bp, Artificial Sequence
  chemically synthesized
acacacccatgcacacgact

SEQ ID NO: 7883 - DNA, 20 bp, Artificial Sequence
  chemically synthesized
acatcagctgtgtgcaaagc

SEQ ID NO: 7884 - DNA, 20 bp, Artificial Sequence
  chemically synthesized
taggcacacatcctgagaag

SEQ ID NO: 7885 - DNA, 20 bp, Artificial Sequence
  chemically synthesized
catcctgagaagggggatct

SEQ ID NO: 7886 - DNA, 20 bp, Artificial Sequence
  chemically synthesized
ttccattgagatccttaaat

SEQ ID NO: 7887 - DNA, 20 bp, Artificial Sequence
  chemically synthesized
gggaggctcagtcaggggcc

SEQ ID NO: 7888 - DNA, 20 bp, Artificial Sequence
  chemically synthesized
ggtcacttcctgccactgtc

SEQ ID NO: 7889 - DNA, 20 bp, Artificial Sequence
  chemically synthesized
accaagctggccctccatgg

SEQ ID NO: 7890 - DNA, 20 bp, Artificial Sequence
  chemically synthesized
tcttcagcaccctccactca

SEQ ID NO: 7891 - DNA, 20 bp, Artificial Sequence
  chemically synthesized
cgacttatcaactcccaatg

SEQ ID NO: 7892 - DNA, 20 bp, Artificial Sequence
  chemically synthesized
ccctgaaaccagactgccca

SEQ ID NO: 7893 - DNA, 20 bp, Artificial Sequence
  chemically synthesized
tcacagtcgtagctacccga

SEQ ID NO: 7894 - DNA, 20 bp, Artificial Sequence
  chemically synthesized
tagctacccgattggattgc

SEQ ID NO: 7895 - DNA, 20 bp, Artificial Sequence
  chemically synthesized
tggattgctcggataattag

SEQ ID NO: 7896 - DNA, 20 bp, Artificial Sequence
  chemically synthesized
aaaagtttgaacataaaaga

SEQ ID NO: 7897 - DNA, 20 bp, Artificial Sequence
  chemically synthesized
cagggtctgcccaagatggg

SEQ ID NO: 7898 - DNA, 20 bp, Artificial Sequence
  chemically synthesized
actctggacatcaggcaagg

SEQ ID NO: 7899 - DNA, 20 bp, Artificial Sequence
  chemically synthesized
aggaggagtaaagatccctg

SEQ ID NO: 7900 - DNA, 20 bp, Artificial Sequence
  chemically synthesized
accccagcttactgtttgga

SEQ ID NO: 7901 - DNA, 20 bp, Artificial Sequence
  chemically synthesized
cacgttgaggagatggagct

SEQ ID NO: 7902 - DNA, 20 bp, Artificial Sequence
  chemically synthesized
ccgaggagaccaaaacaatt

SEQ ID NO: 7903 - DNA, 20 bp, Artificial Sequence
  chemically synthesized
caaagctcaagaacatttag

SEQ ID NO: 7904 - DNA, 20 bp, Artificial Sequence
  chemically synthesized
aaaagagatccagaactgac

SEQ ID NO: 7905 - DNA, 20 bp, Artificial Sequence
  chemically synthesized
tccagaactgacacggatgc

SEQ ID NO: 7906 - DNA, 20 bp, Artificial Sequence
  chemically synthesized
ggatgctagaattagcaggc

SEQ ID NO: 7907 - DNA, 20 bp, Artificial Sequence
  chemically synthesized
attatgttcaaaaaattaag

SEQ ID NO: 7908 - DNA, 20 bp, Artificial Sequence
  chemically synthesized
aaaaattaagtagaattgtg

SEQ ID NO: 7909 - DNA, 20 bp, Artificial Sequence
  chemically synthesized
tagaattgtggaggatattt

SEQ ID NO: 7910 - DNA, 20 bp, Artificial Sequence
  chemically synthesized
caggcgccgtggctcacgcc

SEQ ID NO: 7911 - DNA, 20 bp, Artificial Sequence
  chemically synthesized
tactcgggaggctgaggcag

SEQ ID NO: 7912 - DNA, 20 bp, Artificial Sequence
  chemically synthesized
gaaagaaaagaaaaaacaca

SEQ ID NO: 7913 - DNA, 20 bp, Artificial Sequence
  chemically synthesized
aaaatttagggccaggcact

SEQ ID NO: 7914 - DNA, 20 bp, Artificial Sequence
  chemically synthesized
ctttgggaggtcgacacggg

SEQ ID NO: 7915 - DNA, 20 bp, Artificial Sequence
  chemically synthesized
tacctgggaggctgaagtgg

SEQ ID NO: 7916 - DNA, 20 bp, Artificial Sequence
  chemically synthesized
cccaggaggtggaggccaca

SEQ ID NO: 7917 - DNA, 20 bp, Artificial Sequence
  chemically synthesized
ctgcattccagcctgggcaa

SEQ ID NO: 7918 - DNA, 20 bp, Artificial Sequence
  chemically synthesized
aatgaaacactgggagaaaa

SEQ ID NO: 7919 - DNA, 20 bp, Artificial Sequence
  chemically synthesized
aaagaattaaaaaatggaaa

SEQ ID NO: 7920 - DNA, 20 bp, Artificial Sequence
  chemically synthesized
aattaaaaaatggaaagaga

SEQ ID NO: 7921 - DNA, 20 bp, Artificial Sequence
  chemically synthesized
tgaaatctttaaaagaaaaa

SEQ ID NO: 7922 - DNA, 20 bp, Artificial Sequence
  chemically synthesized
agcagcatcccgtattctct

SEQ ID NO: 7923 - DNA, 20 bp, Artificial Sequence
  chemically synthesized
ctctgagtgttcactatgta

SEQ ID NO: 7924 - DNA, 20 bp, Artificial Sequence
  chemically synthesized
accgggtgccgtgtgggcac

SEQ ID NO: 7925 - DNA, 20 bp, Artificial Sequence
  chemically synthesized
tgggcactggagttgcagag

SEQ ID NO: 7926 - DNA, 20 bp, Artificial Sequence
  chemically synthesized
aggagatgctactggtgttc

SEQ ID NO: 7927 - DNA, 20 bp, Artificial Sequence
  chemically synthesized
tccctcggttggccagcctc

SEQ ID NO: 7928 - DNA, 20 bp, Artificial Sequence
  chemically synthesized
gttggccagcctcaggaatg

SEQ ID NO: 7929 - DNA, 20 bp, Artificial Sequence
  chemically synthesized
tacttgggaggctgaggtgg

SEQ ID NO: 7930 - DNA, 20 bp, Artificial Sequence
  chemically synthesized
tgggaggatggcttgagccc

SEQ ID NO: 7931 - DNA, 20 bp, Artificial Sequence
  chemically synthesized
tcagtcaagatttattacag

SEQ ID NO: 7932 - DNA, 20 bp, Artificial Sequence
  chemically synthesized
tattacagaaggatccaggg

SEQ ID NO: 7933 - DNA, 20 bp, Artificial Sequence
  chemically synthesized
tcttgggagatgagaggagc

SEQ ID NO: 7934 - DNA, 20 bp, Artificial Sequence
  chemically synthesized
tgagaggagcagggatcttc

SEQ ID NO: 7935 - DNA, 20 bp, Artificial Sequence
  chemically synthesized
cattcactcacacacacaca

SEQ ID NO: 7936 - DNA, 20 bp, Artificial Sequence
  chemically synthesized
acacacacacagagtcccag

SEQ ID NO: 7937 - DNA, 20 bp, Artificial Sequence
  chemically synthesized
catacgaggcacatgtgttc

SEQ ID NO: 7938 - DNA, 20 bp, Artificial Sequence
  chemically synthesized
cctctggcacatgcctttcc

SEQ ID NO: 7939 - DNA, 20 bp, Artificial Sequence
  chemically synthesized
acatgcctttcctggggtcc

SEQ ID NO: 7940 - DNA, 20 bp, Artificial Sequence
  chemically synthesized
ggtgaggtgagggaacaagc

SEQ ID NO: 7941 - DNA, 20 bp, Artificial Sequence
  chemically synthesized
ccctcctcagtccctgttca

SEQ ID NO: 7942 - DNA, 20 bp, Artificial Sequence
  chemically synthesized
cctcagtccctgttcacaga

SEQ ID NO: 7943 - DNA, 20 bp, Artificial Sequence
  chemically synthesized
tgcacacttgcctttcaaaa

SEQ ID NO: 7944 - DNA, 20 bp, Artificial Sequence
  chemically synthesized
caaaaatggatttcctctcc

SEQ ID NO: 7945 - DNA, 20 bp, Artificial Sequence
  chemically synthesized
cctctcctgggattcagcct

SEQ ID NO: 7946 - DNA, 20 bp, Artificial Sequence
  chemically synthesized
tggcccctcaccttgatgga

SEQ ID NO: 7947 - DNA, 20 bp, Artificial Sequence
  chemically synthesized
ttttcctccgagctcagctg

SEQ ID NO: 7948 - DNA, 20 bp, Artificial Sequence
  chemically synthesized
attcacgtggaggttgatgg

SEQ ID NO: 7949 - DNA, 20 bp, Artificial Sequence
  chemically synthesized
gttgatggtgggatggaacg

SEQ ID NO: 7950 - DNA, 20 bp, Artificial Sequence
  chemically synthesized
gggatggaacgcagggtcgg

SEQ ID NO: 7951 - DNA, 20 bp, Artificial Sequence
  chemically synthesized
aacgcagggtcggaggggtt

SEQ ID NO: 7952 - DNA, 20 bp, Artificial Sequence
  chemically synthesized
gaggggttcggggtggtggc

SEQ ID NO: 7953 - DNA, 20 bp, Artificial Sequence
  chemically synthesized
gttcggggtggtggcctggg

SEQ ID NO: 7954 - DNA, 20 bp, Artificial Sequence
  chemically synthesized
atcccaccatcaacctccac

SEQ ID NO: 7955 - DNA, 20 bp, Artificial Sequence
  chemically synthesized
aggggccaggcactcgcagg

SEQ ID NO: 7956 - DNA, 20 bp, Artificial Sequence
  chemically synthesized
tgtgcacgtatgtgcatatg

SEQ ID NO: 7957 - DNA, 20 bp, Artificial Sequence
  chemically synthesized
ctgggactctgtgtgtgtgt

SEQ ID NO: 7958 - DNA, 20 bp, Artificial Sequence
  chemically synthesized
gactctgtgtgtgtgtgtga

SEQ ID NO: 7959 - DNA, 20 bp, Artificial Sequence
  chemically synthesized
tgtgtatgtcgtgtatgtga

SEQ ID NO: 7960 - DNA, 20 bp, Artificial Sequence
  chemically synthesized
tgagagggtatgttgtgtgt

SEQ ID NO: 7961 - DNA, 20 bp, Artificial Sequence
  chemically synthesized
gtgttgtgtgtgtatgttgt

SEQ ID NO: 7962 - DNA, 20 bp, Artificial Sequence
  chemically synthesized
atgttgtgtgtatcttgtgt

SEQ ID NO: 7963 - DNA, 20 bp, Artificial Sequence
  chemically synthesized
tgtgcatgtgtgtatgttgt

SEQ ID NO: 7964 - DNA, 20 bp, Artificial Sequence
  chemically synthesized
tgcgagtgtatgttgtgtat

SEQ ID NO: 7965 - DNA, 20 bp, Artificial Sequence
  chemically synthesized
tgtgtgtatgtatgttgtgt

SEQ ID NO: 7966 - DNA, 20 bp, Artificial Sequence
  chemically synthesized
gtgttgtgtgtgtgtattgt

SEQ ID NO: 7967 - DNA, 20 bp, Artificial Sequence
  chemically synthesized
tatgtatgtttgtgtgttgt

SEQ ID NO: 7968 - DNA, 20 bp, Artificial Sequence
  chemically synthesized
tgtgcgtgtgtgtatgttgt

SEQ ID NO: 7969 - DNA, 20 bp, Artificial Sequence
  chemically synthesized
gtgtgttgtgtgtgtatgtt

SEQ ID NO: 7970 - DNA, 20 bp, Artificial Sequence
  chemically synthesized
gtgttatgtatgttgtgtgt

SEQ ID NO: 7971 - DNA, 20 bp, Artificial Sequence
  chemically synthesized
tgtgtgtgtgagtgtgttgc

SEQ ID NO: 7972 - DNA, 20 bp, Artificial Sequence
  chemically synthesized
tgtgtgtgtgtgtgtagagg

SEQ ID NO: 7973 - DNA, 20 bp, Artificial Sequence
  chemically synthesized
tgtgtgtgtgtagaggtggg

SEQ ID NO: 7974 - DNA, 20 bp, Artificial Sequence
  chemically synthesized
tgtgtagaggtggggtgagt

SEQ ID NO: 7975 - DNA, 20 bp, Artificial Sequence
  chemically synthesized
tagaggtggggtgagttggg

SEQ ID NO: 7976 - DNA, 20 bp, Artificial Sequence
  chemically synthesized
tcatctcccaagacccttcc

SEQ ID NO: 7977 - DNA, 20 bp, Artificial Sequence
  chemically synthesized
gacattttttttttagagac

SEQ ID NO: 7978 - DNA, 20 bp, Artificial Sequence
  chemically synthesized
tagagacaggagtgtagtgg

SEQ ID NO: 7979 - DNA, 20 bp, Artificial Sequence
  chemically synthesized
aaaaaaattttttagagaaa

SEQ ID NO: 7980 - DNA, 20 bp, Artificial Sequence
  chemically synthesized
taggcagaagggcaagagcc

SEQ ID NO: 7981 - DNA, 20 bp, Artificial Sequence
  chemically synthesized
agggcaagagccaggaatgg

SEQ ID NO: 7982 - DNA, 20 bp, Artificial Sequence
  chemically synthesized
aatggaggagtgtcaggtgt

SEQ ID NO: 7983 - DNA, 20 bp, Artificial Sequence
  chemically synthesized
tgtgggtgctggtggtggag

SEQ ID NO: 7984 - DNA, 20 bp, Artificial Sequence
  chemically synthesized
aggggcttggagcttaggaa

SEQ ID NO: 7985 - DNA, 20 bp, Artificial Sequence
  chemically synthesized
aggggattggttagctgggc

SEQ ID NO: 7986 - DNA, 20 bp, Artificial Sequence
  chemically synthesized
agggcagggcaggggacagg

SEQ ID NO: 7987 - DNA, 20 bp, Artificial Sequence
  chemically synthesized
gtacatagtgaacactcaga

SEQ ID NO: 7988 - DNA, 20 bp, Artificial Sequence
  chemically synthesized
gtgaacactcagagagaata

SEQ ID NO: 7989 - DNA, 20 bp, Artificial Sequence
  chemically synthesized
agagagaatacgggatgctg

SEQ ID NO: 7990 - DNA, 20 bp, Artificial Sequence
  chemically synthesized
gggatgctgctgaatcttct

SEQ ID NO: 7991 - DNA, 20 bp, Artificial Sequence
  chemically synthesized
gctgaatcttctgagggtga

SEQ ID NO: 7992 - DNA, 20 bp, Artificial Sequence
  chemically synthesized
cttctgagggtgacagaatt

SEQ ID NO: 7993 - DNA, 20 bp, Artificial Sequence
  chemically synthesized
caggaggcttggagagaggc

SEQ ID NO: 7994 - DNA, 20 bp, Artificial Sequence
  chemically synthesized
aggatttctgaaattaatgg

SEQ ID NO: 7995 - DNA, 20 bp, Artificial Sequence
  chemically synthesized
taatgggagagtgagctcac

SEQ ID NO: 7996 - DNA, 20 bp, Artificial Sequence
  chemically synthesized
accagtgagggaccgtctga

SEQ ID NO: 7997 - DNA, 20 bp, Artificial Sequence
  chemically synthesized
ccgcatttccctccagcagc

SEQ ID NO: 7998 - DNA, 20 bp, Artificial Sequence
  chemically synthesized
atttcaattatgcatgtatt

SEQ ID NO: 7999 - DNA, 20 bp, Artificial Sequence
  chemically synthesized
tctcccagtgtttcatttta

SEQ ID NO: 8000 - DNA, 20 bp, Artificial Sequence
  chemically synthesized
tctcactctgttgcccaggc

SEQ ID NO: 8001 - DNA, 20 bp, Artificial Sequence
  chemically synthesized
gagacggttttgccatgtag

SEQ ID NO: 8002 - DNA, 20 bp, Artificial Sequence
  chemically synthesized
gtgtcgacctcccaaagtgc

SEQ ID NO: 8003 - DNA, 20 bp, Artificial Sequence
  chemically synthesized
cttttttttttttttggagg

SEQ ID NO: 8004 - DNA, 20 bp, Artificial Sequence
  chemically synthesized
tctcgctctgttgcccaggc

SEQ ID NO: 8005 - DNA, 20 bp, Artificial Sequence
  chemically synthesized
ctcactgcaagctctgcctc

SEQ ID NO: 8006 - DNA, 20 bp, Artificial Sequence
  chemically synthesized
cattctcctgcctcagcctc

SEQ ID NO: 8007 - DNA, 20 bp, Artificial Sequence
  chemically synthesized
ttttgtatttttagtagaga

SEQ ID NO: 8008 - DNA, 20 bp, Artificial Sequence
  chemically synthesized
tggggtttcaccatgttagc

SEQ ID NO: 8009 - DNA, 20 bp, Artificial Sequence
  chemically synthesized
gccttggcctcccacagtgc

SEQ ID NO: 8010 - DNA, 20 bp, Artificial Sequence
  chemically synthesized
acttaattttttgaacataa

SEQ ID NO: 8011 - DNA, 20 bp, Artificial Sequence
  chemically synthesized
ttctagcatccgtgtcagtt

SEQ ID NO: 8012 - DNA, 20 bp, Artificial Sequence
  chemically synthesized
acattgtcaatttcaccttg

SEQ ID NO: 8013 - DNA, 20 bp, Artificial Sequence
  chemically synthesized
caatttcaccttgttgggtg

SEQ ID NO: 8014 - DNA, 20 bp, Artificial Sequence
  chemically synthesized
aatgttcttgagctttgctc

SEQ ID NO: 8015 - DNA, 20 bp, Artificial Sequence
  chemically synthesized
cgggatgcagttaagcaact

SEQ ID NO: 8016 - DNA, 20 bp, Artificial Sequence
  chemically synthesized
agctccatctcctcaacgtg

SEQ ID NO: 8017 - DNA, 20 bp, Artificial Sequence
  chemically synthesized
actctctccaaacagtaagc

SEQ ID NO: 8018 - DNA, 20 bp, Artificial Sequence
  chemically synthesized
acagtaagctggggtgatcg

SEQ ID NO: 8019 - DNA, 20 bp, Artificial Sequence
  chemically synthesized
ttgtttgcttcttatccctc

SEQ ID NO: 8020 - DNA, 20 bp, Artificial Sequence
  chemically synthesized
actcctccttgcctgatgtc

SEQ ID NO: 8021 - DNA, 20 bp, Artificial Sequence
  chemically synthesized
taattatccgagcaatccaa

SEQ ID NO: 8022 - DNA, 20 bp, Artificial Sequence
  chemically synthesized
aaaatggaagcatggagaaa

SEQ ID NO: 8023 - DNA, 20 bp, Artificial Sequence
  chemically synthesized
ccctgtgggcagtctggttt

SEQ ID NO: 8024 - DNA, 20 bp, Artificial Sequence
  chemically synthesized
gtgggcagtctggtttcagg

SEQ ID NO: 8025 - DNA, 20 bp, Artificial Sequence
  chemically synthesized
tgctgggctgacccagcatt

SEQ ID NO: 8026 - DNA, 20 bp, Artificial Sequence
  chemically synthesized
gggaagcaggacaggaccct

SEQ ID NO: 8027 - DNA, 20 bp, Artificial Sequence
  chemically synthesized
aggacaggaccctctgagtg

SEQ ID NO: 8028 - DNA, 20 bp, Artificial Sequence
  chemically synthesized
accgtggtcatggagcgctt

SEQ ID NO: 8029 - DNA, 20 bp, Artificial Sequence
  chemically synthesized
tggagcgcttctggatggag

SEQ ID NO: 8030 - DNA, 20 bp, Artificial Sequence
  chemically synthesized
aatgcaaaggccttggagga

SEQ ID NO: 8031 - DNA, 20 bp, Artificial Sequence
  chemically synthesized
ggggtgggggcagtgagagg

SEQ ID NO: 8032 - DNA, 20 bp, Artificial Sequence
  chemically synthesized
ggtggggctgtgctcagagc

SEQ ID NO: 8033 - DNA, 20 bp, Artificial Sequence
  chemically synthesized
tggaggtgtcagaggcctcc

SEQ ID NO: 8034 - DNA, 20 bp, Artificial Sequence
  chemically synthesized
agaggcctccctgggtcaaa

SEQ ID NO: 8035 - DNA, 20 bp, Artificial Sequence
  chemically synthesized
tccctgggtcaaatggggtc

SEQ ID NO: 8036 - DNA, 20 bp, Artificial Sequence
  chemically synthesized
tcactggtgtgaaaaagatg

SEQ ID NO: 8037 - DNA, 20 bp, Artificial Sequence
  chemically synthesized
ggcccctgactgagcctccc

SEQ ID NO: 8038 - DNA, 20 bp, Artificial Sequence
  chemically synthesized
ctccccaggatgtggtcctg

SEQ ID NO: 8039 - DNA, 20 bp, Artificial Sequence
  chemically synthesized
gatgtggtcctgctgggtcg

SEQ ID NO: 8040 - DNA, 20 bp, Artificial Sequence
  chemically synthesized
ctgctgggtcggggggtgat

SEQ ID NO: 8041 - DNA, 20 bp, Artificial Sequence
  chemically synthesized
tgagaagacaaggaagtcca

SEQ ID NO: 8042 - DNA, 20 bp, Artificial Sequence
  chemically synthesized
gacaaggaagtccacagagt

SEQ ID NO: 8043 - DNA, 20 bp, Artificial Sequence
  chemically synthesized
agaaggtgttctgtttgcag

SEQ ID NO: 8044 - DNA, 20 bp, Artificial Sequence
  chemically synthesized
ctgggacaactggagctgct

SEQ ID NO: 8045 - DNA, 20 bp, Artificial Sequence
  chemically synthesized
agctctgtgtgcaggaagac

SEQ ID NO: 8046 - DNA, 20 bp, Artificial Sequence
  chemically synthesized
gtgcaggaagacgtgggtgt

SEQ ID NO: 8047 - DNA, 20 bp, Artificial Sequence
  chemically synthesized
gggtgtgtgagtgtacgtgt

SEQ ID NO: 8048 - DNA, 20 bp, Artificial Sequence
  chemically synthesized
tcaggtgtgtgtgtgtggga

SEQ ID NO: 8049 - DNA, 20 bp, Artificial Sequence
  chemically synthesized
gtgtgtgtgtgggagggagt

SEQ ID NO: 8050 - DNA, 20 bp, Artificial Sequence
  chemically synthesized
tagcatgcatatgcacatgt

SEQ ID NO: 8051 - DNA, 20 bp, Artificial Sequence
  chemically synthesized
atgcatatgcacatgtgaga

SEQ ID NO: 8052 - DNA, 20 bp, Artificial Sequence
  chemically synthesized
gggtacagcagagcgtggtc

SEQ ID NO: 8053 - DNA, 20 bp, Artificial Sequence
  chemically synthesized
gtgtgtgcaaatgtgtgttt

SEQ ID NO: 8054 - DNA, 20 bp, Artificial Sequence
  chemically synthesized
ttgagtgaagtgagcaatgt

SEQ ID NO: 8055 - DNA, 20 bp, Artificial Sequence
  chemically synthesized
agtgagcaatgtgtgagtgt

SEQ ID NO: 8056 - DNA, 20 bp, Artificial Sequence
  chemically synthesized
gtgtgagtgtgtgagtgtgt

SEQ ID NO: 8057 - DNA, 20 bp, Artificial Sequence
  chemically synthesized
gtgtgagtttgtgagggcat

SEQ ID NO: 8058 - DNA, 20 bp, Artificial Sequence
  chemically synthesized
aatgtgtgtgtcagtgctgt

SEQ ID NO: 8059 - DNA, 20 bp, Artificial Sequence
  chemically synthesized
tcagtgctgtcagggtgcag

SEQ ID NO: 8060 - DNA, 20 bp, Artificial Sequence
  chemically synthesized
ggaggaggccttgcgtggtg

SEQ ID NO: 8061 - DNA, 20 bp, Artificial Sequence
  chemically synthesized
aggacaacaggtgggacctg

SEQ ID NO: 8062 - DNA, 20 bp, Artificial Sequence
  chemically synthesized
gacctggagggttgtgcttg

SEQ ID NO: 8063 - DNA, 20 bp, Artificial Sequence
  chemically synthesized
gcttggagagtgggctatgg

SEQ ID NO: 8064 - DNA, 20 bp, Artificial Sequence
  chemically synthesized
tggtggaatgacccagattt

SEQ ID NO: 8065 - DNA, 20 bp, Artificial Sequence
  chemically synthesized
cccagatttaaggatctcaa

SEQ ID NO: 8066 - DNA, 20 bp, Artificial Sequence
  chemically synthesized
aggggagggactgttccagt

SEQ ID NO: 8067 - DNA, 20 bp, Artificial Sequence
  chemically synthesized
agaacacagggcccagcttc

SEQ ID NO: 8068 - DNA, 20 bp, Artificial Sequence
  chemically synthesized
ctggaggcctctgccactgg

SEQ ID NO: 8069 - DNA, 20 bp, Artificial Sequence
  chemically synthesized
cattcacagatcccccttct

SEQ ID NO: 8070 - DNA, 20 bp, Artificial Sequence
  chemically synthesized
ggatgtgtgcctaggcaggg

SEQ ID NO: 8071 - DNA, 20 bp, Artificial Sequence
  chemically synthesized
gtctcccagtcccccagctc

SEQ ID NO: 8072 - DNA, 20 bp, Artificial Sequence
  chemically synthesized
gggctttgcacacagctgat

SEQ ID NO: 8073 - DNA, 20 bp, Artificial Sequence
  chemically synthesized
acacagctgatgtgaatatc

SEQ ID NO: 8074 - DNA, 20 bp, Artificial Sequence
  chemically synthesized
gaatatcctgagtcgtgtgc

SEQ ID NO: 8075 - DNA, 20 bp, Artificial Sequence
  chemically synthesized
gtatatttatacatggtaat

SEQ ID NO: 8076 - DNA, 20 bp, Artificial Sequence
  chemically synthesized
ttatacatggtaatatgggt

SEQ ID NO: 8077 - DNA, 20 bp, Artificial Sequence
  chemically synthesized
taatatgggtgcgagtgtgt

SEQ ID NO: 8078 - DNA, 20 bp, Artificial Sequence
  chemically synthesized
tgtgtgtaatgctcaaatgc

SEQ ID NO: 8079 - DNA, 20 bp, Artificial Sequence
  chemically synthesized
gctggtggtcatctgtgtga

SEQ ID NO: 8080 - DNA, 20 bp, Artificial Sequence
  chemically synthesized
gtgtgactgggtcccaaagt

SEQ ID NO: 8081 - DNA, 20 bp, Artificial Sequence
  chemically synthesized
tgagggtcacgggggccagc

SEQ ID NO: 8082 - DNA, 20 bp, Artificial Sequence
  chemically synthesized
ggggccagcagggatgggca

SEQ ID NO: 8083 - DNA, 20 bp, Artificial Sequence
  chemically synthesized
cgccctttgccctcgcttcc

SEQ ID NO: 8084 - DNA, 20 bp, Artificial Sequence
  chemically synthesized
ggggaggctcagtcaggggc

SEQ ID NO: 8085 - DNA, 20 bp, Artificial Sequence
  chemically synthesized
tgggaagagttcttctctcc

SEQ ID NO: 8086 - DNA, 20 bp, Artificial Sequence
  chemically synthesized
atccagaactgacacggatg

SEQ ID NO: 8087 - DNA, 20 bp, Artificial Sequence
  chemically synthesized
cattatgttcaaaaaattaa

SEQ ID NO: 8088 - DNA, 20 bp, Artificial Sequence
  chemically synthesized
ctactcgggaggctgaggca

SEQ ID NO: 8089 - DNA, 20 bp, Artificial Sequence
  chemically synthesized
tccgcctccaaaaaaaaaaa

SEQ ID NO: 8090 - DNA, 20 bp, Artificial Sequence
  chemically synthesized
ctccaaaaaaaaaaaaaaga

SEQ ID NO: 8091 - DNA, 20 bp, Artificial Sequence
  chemically synthesized
aaaaaaaaaaaaaagaaaag

SEQ ID NO: 8092 - DNA, 20 bp, Artificial Sequence
  chemically synthesized
aaaaaaaaagaaaagaaaga

SEQ ID NO: 8093 - DNA, 20 bp, Artificial Sequence
  chemically synthesized
tggatggaaataatggaaga

SEQ ID NO: 8094 - DNA, 20 bp, Artificial Sequence
  chemically synthesized
aatggaagatgagaaatgcg

SEQ ID NO: 8095 - DNA, 20 bp, Artificial Sequence
  chemically synthesized
ctctataaaatgaaacactg

SEQ ID NO: 8096 - DNA, 20 bp, Artificial Sequence
  chemically synthesized
aaatgaaacactgggagaaa

SEQ ID NO: 8097 - DNA, 20 bp, Artificial Sequence
  chemically synthesized
aaaagaattaaaaaatggaa

SEQ ID NO: 8098 - DNA, 20 bp, Artificial Sequence
  chemically synthesized
atgcataattgaaatcttta

SEQ ID NO: 8099 - DNA, 20 bp, Artificial Sequence
  chemically synthesized
tttaaaagaaaaagggggta

SEQ ID NO: 8100 - DNA, 20 bp, Artificial Sequence
  chemically synthesized
agctcactctcccattaatt

SEQ ID NO: 8101 - DNA, 20 bp, Artificial Sequence
  chemically synthesized
gacagagggggagcaaagcc

SEQ ID NO: 8102 - DNA, 20 bp, Artificial Sequence
  chemically synthesized
caaattaaaaaaaatttttt

SEQ ID NO: 8103 - DNA, 20 bp, Artificial Sequence
  chemically synthesized
ggtacatagtgaacactcag

SEQ ID NO: 8104 - DNA, 20 bp, Artificial Sequence
  chemically synthesized
tgctgaatcttctgagggtg

SEQ ID NO: 8105 - DNA, 20 bp, Artificial Sequence
  chemically synthesized
tgtgatctccattttacaca

SEQ ID NO: 8106 - DNA, 20 bp, Artificial Sequence
  chemically synthesized
acacgagaaaatggaagcat

SEQ ID NO: 8107 - DNA, 20 bp, Artificial Sequence
  chemically synthesized
acacattgctcacttcactc

SEQ ID NO: 8108 - DNA, 20 bp, Artificial Sequence
  chemically synthesized
cttctctccccagaaacaat

SEQ ID NO: 8109 - DNA, 20 bp, Artificial Sequence
  chemically synthesized
tccccagaaacaatcaaaac

SEQ ID NO: 8110 - DNA, 20 bp, Artificial Sequence
  chemically synthesized
agctgagagtccgaggagac

SEQ ID NO: 8111 - DNA, 20 bp, Artificial Sequence
  chemically synthesized
caaggcatgcaatgaaacgg

SEQ ID NO: 8112 - DNA, 20 bp, Artificial Sequence
  chemically synthesized
gaattagcaggcaaggatgg

SEQ ID NO: 8113 - DNA, 20 bp, Artificial Sequence
  chemically synthesized
ccaggtgaacttctagagat

SEQ ID NO: 8114 - DNA, 20 bp, Artificial Sequence
  chemically synthesized
aactacaatgtctgaaatga

SEQ ID NO: 8115 - DNA, 20 bp, Artificial Sequence
  chemically synthesized
aaaagaaaagaaagaaaaga

SEQ ID NO: 8116 - DNA, 20 bp, Artificial Sequence
  chemically synthesized
gactagtctgggcagcatgg

SEQ ID NO: 8117 - DNA, 20 bp, Artificial Sequence
  chemically synthesized
ggcaaaacccctctacatgg

SEQ ID NO: 8118 - DNA, 20 bp, Artificial Sequence
  chemically synthesized
tgccactggctggatgggag

SEQ ID NO: 8119 - DNA, 20 bp, Artificial Sequence
  chemically synthesized
gaggaggcataacctgggcg

SEQ ID NO: 8120 - DNA, 20 bp, Artificial Sequence
  chemically synthesized
ggccatgggggggggtcatc

SEQ ID NO: 8121 - DNA, 20 bp, Artificial Sequence
  chemically synthesized
cctgagaagggggatctgtg

SEQ ID NO: 8122 - DNA, 20 bp, Artificial Sequence
  chemically synthesized
tcttctaaggctcctgtccc

SEQ ID NO: 8123 - DNA, 20 bp, Artificial Sequence
  chemically synthesized
tcctccccagcgccctttgc

SEQ ID NO: 8124 - DNA, 20 bp, Artificial Sequence
  chemically synthesized
cctccactcagagggtcctg

SEQ ID NO: 8125 - DNA, 20 bp, Artificial Sequence
  chemically synthesized
tgcaccagcattcaatttct

SEQ ID NO: 8126 - DNA, 20 bp, Artificial Sequence
  chemically synthesized
tggagatcacagtcgtagct

SEQ ID NO: 8127 - DNA, 20 bp, Artificial Sequence
  chemically synthesized
atcacagtcgtagctacccg

SEQ ID NO: 8128 - DNA, 20 bp, Artificial Sequence
  chemically synthesized
tagatgagttaaaatatgta

SEQ ID NO: 8129 - DNA, 20 bp, Artificial Sequence
  chemically synthesized
atgtaatgtgcttcttaggc

SEQ ID NO: 8130 - DNA, 20 bp, Artificial Sequence
  chemically synthesized
aacagacaactatagaacat

SEQ ID NO: 8131 - DNA, 20 bp, Artificial Sequence
  chemically synthesized
aacaggaaccctccgatcac

SEQ ID NO: 8132 - DNA, 20 bp, Artificial Sequence
  chemically synthesized
accctccgatcaccccagct

SEQ ID NO: 8133 - DNA, 20 bp, Artificial Sequence
  chemically synthesized
aaacgatcaaactgactcta

SEQ ID NO: 8134 - DNA, 20 bp, Artificial Sequence
  chemically synthesized
gacaatgtctggcagccaat

SEQ ID NO: 8135 - DNA, 20 bp, Artificial Sequence
  chemically synthesized
aatggcatgaacccgggagg

SEQ ID NO: 8136 - DNA, 20 bp, Artificial Sequence
  chemically synthesized
ctctaaattctgtcaccctc

SEQ ID NO: 8137 - DNA, 20 bp, Artificial Sequence
  chemically synthesized
ttgggaggctgaggtgggag

SEQ ID NO: 8138 - DNA, 20 bp, Artificial Sequence
  chemically synthesized
aagatacttaggtccttcag

SEQ ID NO: 8139 - DNA, 20 bp, Artificial Sequence
  chemically synthesized
ctgcacacttgcctttcaaa

SEQ ID NO: 8140 - DNA, 20 bp, Artificial Sequence
  chemically synthesized
tcaaaaatggatttcctctc

SEQ ID NO: 8141 - DNA, 20 bp, Artificial Sequence
  chemically synthesized
ggctggggctggggcagagg

SEQ ID NO: 8142 - DNA, 20 bp, Artificial Sequence
  chemically synthesized
ccatttttgaaaggcaagtg

SEQ ID NO: 8143 - DNA, 20 bp, Artificial Sequence
  chemically synthesized
aaaggcaagtgtgcagtttc

SEQ ID NO: 8144 - DNA, 20 bp, Artificial Sequence
  chemically synthesized
tgctccccctctgtctcagc

SEQ ID NO: 8145 - DNA, 20 bp, Artificial Sequence
  chemically synthesized
gactgaggagggcccgacac

SEQ ID NO: 8146 - DNA, 20 bp, Artificial Sequence
  chemically synthesized
acgtatgtgcatatgaggaa

SEQ ID NO: 8147 - DNA, 20 bp, Artificial Sequence
  chemically synthesized
tgtgtattgtgtgagtgtat

SEQ ID NO: 8148 - DNA, 20 bp, Artificial Sequence
  chemically synthesized
gtgtgtgtgttagtgtgtgt

SEQ ID NO: 8149 - DNA, 20 bp, Artificial Sequence
  chemically synthesized
atgttgcccaggctggtggg

SEQ ID NO: 8150 - DNA, 20 bp, Artificial Sequence
  chemically synthesized
tccatggaggcaggaggagc

SEQ ID NO: 8151 - DNA, 20 bp, Artificial Sequence
  chemically synthesized
aggcaggaggagcaggggct

SEQ ID NO: 8152 - DNA, 20 bp, Artificial Sequence
  chemically synthesized
caggggcttggagcttagga

SEQ ID NO: 8153 - DNA, 20 bp, Artificial Sequence
  chemically synthesized
cttctgagggtgacagaatt

SEQ ID NO: 8154 - DNA, 20 bp, Artificial Sequence
  chemically synthesized
cagaatttagagtttgagca

SEQ ID NO: 8155 - DNA, 20 bp, Artificial Sequence
  chemically synthesized
gcaggaggcttggagagagg

SEQ ID NO: 8156 - DNA, 20 bp, Artificial Sequence
  chemically synthesized
catcttccacttgtctcagc

SEQ ID NO: 8157 - DNA, 20 bp, Artificial Sequence
  chemically synthesized
ctgctaccccctttttcttt

SEQ ID NO: 8158 - DNA, 20 bp, Artificial Sequence
  chemically synthesized
tttttaattcttttttctcc

SEQ ID NO: 8159 - DNA, 20 bp, Artificial Sequence
  chemically synthesized
cccctcccctcctttccttc

SEQ ID NO: 8160 - DNA, 20 bp, Artificial Sequence
  chemically synthesized
tgttgcccaggctggaatgc

SEQ ID NO: 8161 - DNA, 20 bp, Artificial Sequence
  chemically synthesized
taaaaatttttttttgtaga

SEQ ID NO: 8162 - DNA, 20 bp, Artificial Sequence
  chemically synthesized
gagacggttttgccatgtag

SEQ ID NO: 8163 - DNA, 20 bp, Artificial Sequence
  chemically synthesized
agtcttgagctcctgggctc

SEQ ID NO: 8164 - DNA, 20 bp, Artificial Sequence
  chemically synthesized
cgtgtcgacctcccaaagtg

SEQ ID NO: 8165 - DNA, 20 bp, Artificial Sequence
  chemically synthesized
tcttccattatttccatcca

SEQ ID NO: 8166 - DNA, 20 bp, Artificial Sequence
  chemically synthesized
ttttgtatttttagtagaga

SEQ ID NO: 8167 - DNA, 20 bp, Artificial Sequence
  chemically synthesized
cgccttggcctcccacagtg

SEQ ID NO: 8168 - DNA, 20 bp, Artificial Sequence
  chemically synthesized
tgagccacggcgcctggcca

SEQ ID NO: 8169 - DNA, 20 bp, Artificial Sequence
  chemically synthesized
tgttttttcatttcagacat

SEQ ID NO: 8170 - DNA, 20 bp, Artificial Sequence
  chemically synthesized
taatgggatatggctataat

SEQ ID NO: 8171 - DNA, 20 bp, Artificial Sequence
  chemically synthesized
atgaacctcctcgttatgca

SEQ ID NO: 8172 - DNA, 20 bp, Artificial Sequence
  chemically synthesized
cctcgttatgcattgtgttt

SEQ ID NO: 8173 - DNA, 20 bp, Artificial Sequence
  chemically synthesized
ttcattgcatgccttgtaat

SEQ ID NO: 8174 - DNA, 20 bp, Artificial Sequence
  chemically synthesized
ttgtattcctctaaatgttc

SEQ ID NO: 8175 - DNA, 20 bp, Artificial Sequence
  chemically synthesized
atgcagttaagcaacttaga

SEQ ID NO: 8176 - DNA, 20 bp, Artificial Sequence
  chemically synthesized
aagcaacttagagtcagttt

SEQ ID NO: 8177 - DNA, 20 bp, Artificial Sequence
  chemically synthesized
gtttgatcgtttgaactctt

SEQ ID NO: 8178 - DNA, 20 bp, Artificial Sequence
  chemically synthesized
tggggtgatcggagggttcc

SEQ ID NO: 8179 - DNA, 20 bp, Artificial Sequence
  chemically synthesized
gtgatcggagggttcctgtt

SEQ ID NO: 8180 - DNA, 20 bp, Artificial Sequence
  chemically synthesized
agctgccatgttctatagtt

SEQ ID NO: 8181 - DNA, 20 bp, Artificial Sequence
  chemically synthesized
catgttctatagttgtctgt

SEQ ID NO: 8182 - DNA, 20 bp, Artificial Sequence
  chemically synthesized
tctatagttgtctgtttttg

SEQ ID NO: 8183 - DNA, 20 bp, Artificial Sequence
  chemically synthesized
tagttgtctgtttttgtttt

SEQ ID NO: 8184 - DNA, 20 bp, Artificial Sequence
  chemically synthesized
ctgggctaccctgtgggcag

SEQ ID NO: 8185 - DNA, 20 bp, Artificial Sequence
  chemically synthesized
cagggactcagccatggagg

SEQ ID NO: 8186 - DNA, 20 bp, Artificial Sequence
  chemically synthesized
tggggaacaccgtggtcatg

SEQ ID NO: 8187 - DNA, 20 bp, Artificial Sequence
  chemically synthesized
ggcaggaagtgacctgggga

SEQ ID NO: 8188 - DNA, 20 bp, Artificial Sequence
  chemically synthesized
ggtccaaggcctagaaggtg

SEQ ID NO: 8189 - DNA, 20 bp, Artificial Sequence
  chemically synthesized
ggtcatgagtgtgtgcaaat

SEQ ID NO: 8190 - DNA, 20 bp, Artificial Sequence
  chemically synthesized
gtgtgagtgtgtgagtgtgt

SEQ ID NO: 8191 - DNA, 20 bp, Artificial Sequence
  chemically synthesized
ggagcaaatttagtgtggaa

SEQ ID NO: 8192 - DNA, 20 bp, Artificial Sequence
  chemically synthesized
aacaggtgggacctggaggg

SEQ ID NO: 8193 - DNA, 20 bp, Artificial Sequence
  chemically synthesized
agtgggctatggtggaatga

SEQ ID NO: 8194 - DNA, 20 bp, Artificial Sequence
  chemically synthesized
caggggagggactgttccag

SEQ ID NO: 8195 - DNA, 20 bp, Artificial Sequence
  chemically synthesized
attttaggaagaacacaggg

SEQ ID NO: 8196 - DNA, 20 bp, Artificial Sequence
  chemically synthesized
cagtcccccagctccaggat

SEQ ID NO: 8197 - DNA, 20 bp, Artificial Sequence
  chemically synthesized
gtgtgcatgggtgtgtgtgc

SEQ ID NO: 8198 - DNA, 20 bp, Artificial Sequence
  chemically synthesized
cccgcccaggttatgcctcc

SEQ ID NO: 8199 - DNA, 20 bp, Artificial Sequence
  chemically synthesized
cacagcgtctctgctccatg

SEQ ID NO: 8200 - DNA, 20 bp, Artificial Sequence
  chemically synthesized
ctgctccatggtctgcttca

SEQ ID NO: 8201 - DNA, 20 bp, Artificial Sequence
  chemically synthesized
tctgcttcagtctgcttgcc

SEQ ID NO: 8202 - DNA, 22 bp, Artificial Sequence
  chemically synthesized
cccatgtctctttccctacccc

SEQ ID NO: 8203 - DNA, 22 bp, Artificial Sequence
  chemically synthesized
tttccctaccccttgcccatcc

SEQ ID NO: 8204 - DNA, 22 bp, Artificial Sequence
  chemically synthesized
tccctaccccttgcccatccct

SEQ ID NO: 8205 - DNA, 22 bp, Artificial Sequence
  chemically synthesized
ccctaccccttgcccatccctg

SEQ ID NO: 8206 - DNA, 22 bp, Artificial Sequence
  chemically synthesized
cctaccccttgcccatccctgc

SEQ ID NO: 8207 - DNA, 22 bp, Artificial Sequence
  chemically synthesized
ccccttgcccatccctgctggc

SEQ ID NO: 8208 - DNA, 22 bp, Artificial Sequence
  chemically synthesized
gcccatccctgctggcccccgt

SEQ ID NO: 8209 - DNA, 22 bp, Artificial Sequence
  chemically synthesized
cccatccctgctggcccccgtg

SEQ ID NO: 8210 - DNA, 22 bp, Artificial Sequence
  chemically synthesized
ctggcccccgtgaccctcactt

SEQ ID NO: 8211 - DNA, 22 bp, Artificial Sequence
  chemically synthesized
gcccccgtgaccctcactttgg

SEQ ID NO: 8212 - DNA, 22 bp, Artificial Sequence
  chemically synthesized
actttgggacccagtcacacag

SEQ ID NO: 8213 - DNA, 22 bp, Artificial Sequence
  chemically synthesized
tgggacccagtcacacagatga

SEQ ID NO: 8214 - DNA, 22 bp, Artificial Sequence
  chemically synthesized
gggacccagtcacacagatgac

SEQ ID NO: 8215 - DNA, 22 bp, Artificial Sequence
  chemically synthesized
ggacccagtcacacagatgacc

SEQ ID NO: 8216 - DNA, 22 bp, Artificial Sequence
  chemically synthesized
aagctcagggcaagcagactga

SEQ ID NO: 8217 - DNA, 22 bp, Artificial Sequence
  chemically synthesized
agggcaagcagactgaagcaga

SEQ ID NO: 8218 - DNA, 22 bp, Artificial Sequence
  chemically synthesized
aagcagaccatggagcagagac

SEQ ID NO: 8219 - DNA, 22 bp, Artificial Sequence
  chemically synthesized
tgccaggggctgggcaggaggt

SEQ ID NO: 8220 - DNA, 22 bp, Artificial Sequence
  chemically synthesized
ggcaggaggtggccctgtggga

SEQ ID NO: 8221 - DNA, 22 bp, Artificial Sequence
  chemically synthesized
tgggagaggggcatcaggagcc

SEQ ID NO: 8222 - DNA, 22 bp, Artificial Sequence
  chemically synthesized
ggtgtggggagccggagggtaa

SEQ ID NO: 8223 - DNA, 22 bp, Artificial Sequence
  chemically synthesized
aggaggcataacctgggcgggg

SEQ ID NO: 8224 - DNA, 22 bp, Artificial Sequence
  chemically synthesized
ggcggggggattggttggggcc

SEQ ID NO: 8225 - DNA, 22 bp, Artificial Sequence
  chemically synthesized
gttggggccatgggggggggtc

SEQ ID NO: 8226 - DNA, 22 bp, Artificial Sequence
  chemically synthesized
gggccatgggggggggtcatca

SEQ ID NO: 8227 - DNA, 22 bp, Artificial Sequence
  chemically synthesized
tgaccccagcatttgagcatta

SEQ ID NO: 8228 - DNA, 22 bp, Artificial Sequence
  chemically synthesized
gaccccagcatttgagcattac

SEQ ID NO: 8229 - DNA, 22 bp, Artificial Sequence
  chemically synthesized
accccagcatttgagcattaca

SEQ ID NO: 8230 - DNA, 22 bp, Artificial Sequence
  chemically synthesized
gagcattacacacacactctta

SEQ ID NO: 8231 - DNA, 22 bp, Artificial Sequence
  chemically synthesized
agcattacacacacactcttac

SEQ ID NO: 8232 - DNA, 22 bp, Artificial Sequence
  chemically synthesized
cacacacactcttacacactcg

SEQ ID NO: 8233 - DNA, 22 bp, Artificial Sequence
  chemically synthesized
ttacacactcgcacccatatta

SEQ ID NO: 8234 - DNA, 22 bp, Artificial Sequence
  chemically synthesized
acacactcgcacccatattacc

SEQ ID NO: 8235 - DNA, 22 bp, Artificial Sequence
  chemically synthesized
cacactcgcacccatattacca

SEQ ID NO: 8236 - DNA, 22 bp, Artificial Sequence
  chemically synthesized
gcacccatattaccatgtataa

SEQ ID NO: 8237 - DNA, 22 bp, Artificial Sequence
  chemically synthesized
ccatgtataaatatacacacgc

SEQ ID NO: 8238 - DNA, 22 bp, Artificial Sequence
  chemically synthesized
atctggtgcacacacacccatg

SEQ ID NO: 8239 - DNA, 22 bp, Artificial Sequence
  chemically synthesized
gtgcacacacacccatgcacac

SEQ ID NO: 8240 - DNA, 22 bp, Artificial Sequence
  chemically synthesized
aggatattcacatcagctgtgt

SEQ ID NO: 8241 - DNA, 22 bp, Artificial Sequence
  chemically synthesized
acatcagctgtgtgcaaagccc

SEQ ID NO: 8242 - DNA, 22 bp, Artificial Sequence
  chemically synthesized
tgtgcaaagcccggatcctgga

SEQ ID NO: 8243 - DNA, 22 bp, Artificial Sequence
  chemically synthesized
gagctgggggactgggagacgc

SEQ ID NO: 8244 - DNA, 22 bp, Artificial Sequence
  chemically synthesized
ggggactgggagacgcacaggg

SEQ ID NO: 8245 - DNA, 22 bp, Artificial Sequence
  chemically synthesized
ggagacgcacagggggcggggg

SEQ ID NO: 8246 - DNA, 22 bp, Artificial Sequence
  chemically synthesized
cctaggcacacatcctgagaag

SEQ ID NO: 8247 - DNA, 22 bp, Artificial Sequence
  chemically synthesized
ggcacacatcctgagaaggggg

SEQ ID NO: 8248 - DNA, 22 bp, Artificial Sequence
  chemically synthesized
agaagggggatctgtgaatggt

SEQ ID NO: 8249 - DNA, 22 bp, Artificial Sequence
  chemically synthesized
tgaatggttttcctcccatcca

SEQ ID NO: 8250 - DNA, 22 bp, Artificial Sequence
  chemically synthesized
tcctcccatccagccagtggca

SEQ ID NO: 8251 - DNA, 22 bp, Artificial Sequence
  chemically synthesized
cctcccatccagccagtggcag

SEQ ID NO: 8252 - DNA, 22 bp, Artificial Sequence
  chemically synthesized
ctcccatccagccagtggcaga

SEQ ID NO: 8253 - DNA, 22 bp, Artificial Sequence
  chemically synthesized
ccatccagccagtggcagaggc

SEQ ID NO: 8254 - DNA, 22 bp, Artificial Sequence
  chemically synthesized
cagatcacctcgggccttagtc

SEQ ID NO: 8255 - DNA, 22 bp, Artificial Sequence
  chemically synthesized
gggccttagtctcagctcttct

SEQ ID NO: 8256 - DNA, 22 bp, Artificial Sequence
  chemically synthesized
agtctcagctcttctaaggctc

SEQ ID NO: 8257 - DNA, 22 bp, Artificial Sequence
  chemically synthesized
gtctcagctcttctaaggctcc

SEQ ID NO: 8258 - DNA, 22 bp, Artificial Sequence
  chemically synthesized
agctcttctaaggctcctgtcc

SEQ ID NO: 8259 - DNA, 22 bp, Artificial Sequence
  chemically synthesized
ttctaaggctcctgtcccctca

SEQ ID NO: 8260 - DNA, 22 bp, Artificial Sequence
  chemically synthesized
ctaaggctcctgtcccctcaga

SEQ ID NO: 8261 - DNA, 22 bp, Artificial Sequence
  chemically synthesized
taaggctcctgtcccctcagat

SEQ ID NO: 8262 - DNA, 22 bp, Artificial Sequence
  chemically synthesized
aggctcctgtcccctcagattg

SEQ ID NO: 8263 - DNA, 22 bp, Artificial Sequence
  chemically synthesized
ctgtcccctcagattggagact

SEQ ID NO: 8264 - DNA, 22 bp, Artificial Sequence
  chemically synthesized
tcccctcagattggagactcca

SEQ ID NO: 8265 - DNA, 22 bp, Artificial Sequence
  chemically synthesized
agattggagactccagaagctg

SEQ ID NO: 8266 - DNA, 22 bp, Artificial Sequence
  chemically synthesized
gagactccagaagctgggccct

SEQ ID NO: 8267 - DNA, 22 bp, Artificial Sequence
  chemically synthesized
cagaagctgggccctgtgttct

SEQ ID NO: 8268 - DNA, 22 bp, Artificial Sequence
  chemically synthesized
ggccctgtgttcttcctaaaat

SEQ ID NO: 8269 - DNA, 22 bp, Artificial Sequence
  chemically synthesized
tgttcttcctaaaatccatact

SEQ ID NO: 8270 - DNA, 22 bp, Artificial Sequence
  chemically synthesized
ttcctaaaatccatactggaac

SEQ ID NO: 8271 - DNA, 22 bp, Artificial Sequence
  chemically synthesized
cctaaaatccatactggaacag

SEQ ID NO: 8272 - DNA, 22 bp, Artificial Sequence
  chemically synthesized
ctaaaatccatactggaacagt

SEQ ID NO: 8273 - DNA, 22 bp, Artificial Sequence
  chemically synthesized
aaatccatactggaacagtccc

SEQ ID NO: 8274 - DNA, 22 bp, Artificial Sequence
  chemically synthesized
gaacagtccctcccctgccaaa

SEQ ID NO: 8275 - DNA, 22 bp, Artificial Sequence
  chemically synthesized
ccctgccaaaattccattgaga

SEQ ID NO: 8276 - DNA, 22 bp, Artificial Sequence
  chemically synthesized
ccaaaattccattgagatcctt

SEQ ID NO: 8277 - DNA, 22 bp, Artificial Sequence
  chemically synthesized
cattgagatccttaaatctggg

SEQ ID NO: 8278 - DNA, 22 bp, Artificial Sequence
  chemically synthesized
agatccttaaatctgggtcatt

SEQ ID NO: 8279 - DNA, 22 bp, Artificial Sequence
  chemically synthesized
aaatctgggtcattccaccata

SEQ ID NO: 8280 - DNA, 22 bp, Artificial Sequence
  chemically synthesized
aatctgggtcattccaccatag

SEQ ID NO: 8281 - DNA, 22 bp, Artificial Sequence
  chemically synthesized
ggtcattccaccatagcccact

SEQ ID NO: 8282 - DNA, 22 bp, Artificial Sequence
  chemically synthesized
caccatagcccactctccaagc

SEQ ID NO: 8283 - DNA, 22 bp, Artificial Sequence
  chemically synthesized
tccaagcacaaccctccaggtc

SEQ ID NO: 8284 - DNA, 22 bp, Artificial Sequence
  chemically synthesized
caagcacaaccctccaggtccc

SEQ ID NO: 8285 - DNA, 22 bp, Artificial Sequence
  chemically synthesized
caggtcccacctgttgtcctca

SEQ ID NO: 8286 - DNA, 22 bp, Artificial Sequence
  chemically synthesized
ttgtcctcatcccccaccacgc

SEQ ID NO: 8287 - DNA, 22 bp, Artificial Sequence
  chemically synthesized
tcctcatcccccaccacgcaag

SEQ ID NO: 8288 - DNA, 22 bp, Artificial Sequence
  chemically synthesized
atcccccaccacgcaaggcctc

SEQ ID NO: 8289 - DNA, 22 bp, Artificial Sequence
  chemically synthesized
ctccccagcgccctttgccctc

SEQ ID NO: 8290 - DNA, 22 bp, Artificial Sequence
  chemically synthesized
cccagcgccctttgccctcgct

SEQ ID NO: 8291 - DNA, 22 bp, Artificial Sequence
  chemically synthesized
tgccctcgcttccctagaaacc

SEQ ID NO: 8292 - DNA, 22 bp, Artificial Sequence
  chemically synthesized
gccctcgcttccctagaaacct

SEQ ID NO: 8293 - DNA, 22 bp, Artificial Sequence
  chemically synthesized
ccctcgcttccctagaaacctc

SEQ ID NO: 8294 - DNA, 22 bp, Artificial Sequence
  chemically synthesized
gcttccctagaaacctcgttcc

SEQ ID NO: 8295 - DNA, 22 bp, Artificial Sequence
  chemically synthesized
ccctagaaacctcgttccacac

SEQ ID NO: 8296 - DNA, 22 bp, Artificial Sequence
  chemically synthesized
cctagaaacctcgttccacact

SEQ ID NO: 8297 - DNA, 22 bp, Artificial Sequence
  chemically synthesized
gaaacctcgttccacactaaat

SEQ ID NO: 8298 - DNA, 22 bp, Artificial Sequence
  chemically synthesized
gttccacactaaatttgctccc

SEQ ID NO: 8299 - DNA, 22 bp, Artificial Sequence
  chemically synthesized
cacactaaatttgctcccctca

SEQ ID NO: 8300 - DNA, 22 bp, Artificial Sequence
  chemically synthesized
aatttgctcccctcagcccgag

SEQ ID NO: 8301 - DNA, 22 bp, Artificial Sequence
  chemically synthesized
gctcccctcagcccgaggtcat

SEQ ID NO: 8302 - DNA, 22 bp, Artificial Sequence
  chemically synthesized
ctcccctcagcccgaggtcatc

SEQ ID NO: 8303 - DNA, 22 bp, Artificial Sequence
  chemically synthesized
ccctcagcccgaggtcatctca

SEQ ID NO: 8304 - DNA, 22 bp, Artificial Sequence
  chemically synthesized
agcccgaggtcatctcacaggt

SEQ ID NO: 8305 - DNA, 22 bp, Artificial Sequence
  chemically synthesized
acaggtacctctcctgcccctt

SEQ ID NO: 8306 - DNA, 22 bp, Artificial Sequence
  chemically synthesized
tcctgccccttgatccatctgc

SEQ ID NO: 8307 - DNA, 22 bp, Artificial Sequence
  chemically synthesized
ctgccccttgatccatctgcac

SEQ ID NO: 8308 - DNA, 22 bp, Artificial Sequence
  chemically synthesized
ccccttgatccatctgcaccct

SEQ ID NO: 8309 - DNA, 22 bp, Artificial Sequence
  chemically synthesized
gatccatctgcaccctgacagc

SEQ ID NO: 8310 - DNA, 22 bp, Artificial Sequence
  chemically synthesized
atccatctgcaccctgacagca

SEQ ID NO: 8311 - DNA, 22 bp, Artificial Sequence
  chemically synthesized
caccctgacagcactgacacac

SEQ ID NO: 8312 - DNA, 22 bp, Artificial Sequence
  chemically synthesized
acagcactgacacacacattca

SEQ ID NO: 8313 - DNA, 22 bp, Artificial Sequence
  chemically synthesized
acacacacattcacatgccctc

SEQ ID NO: 8314 - DNA, 22 bp, Artificial Sequence
  chemically synthesized
acatgccctcacaaactcacac

SEQ ID NO: 8315 - DNA, 22 bp, Artificial Sequence
  chemically synthesized
acaaactcacacacactcacac

SEQ ID NO: 8316 - DNA, 22 bp, Artificial Sequence
  chemically synthesized
acacacactcacacactcacac

SEQ ID NO: 8317 - DNA, 22 bp, Artificial Sequence
  chemically synthesized
acacactcacacattgctcact

SEQ ID NO: 8318 - DNA, 22 bp, Artificial Sequence
  chemically synthesized
acacattgctcacttcactcaa

SEQ ID NO: 8319 - DNA, 22 bp, Artificial Sequence
  chemically synthesized
ctcacttcactcaaaaacacac

SEQ ID NO: 8320 - DNA, 22 bp, Artificial Sequence
  chemically synthesized
acttcactcaaaaacacacatt

SEQ ID NO: 8321 - DNA, 22 bp, Artificial Sequence
  chemically synthesized
cactcaaaaacacacatttgca

SEQ ID NO: 8322 - DNA, 22 bp, Artificial Sequence
  chemically synthesized
actcaaaaacacacatttgcac

SEQ ID NO: 8323 - DNA, 22 bp, Artificial Sequence
  chemically synthesized
aaaaacacacatttgcacacac

SEQ ID NO: 8324 - DNA, 22 bp, Artificial Sequence
  chemically synthesized
gcacacactcatgaccacgctc

SEQ ID NO: 8325 - DNA, 22 bp, Artificial Sequence
  chemically synthesized
cacacactcatgaccacgctct

SEQ ID NO: 8326 - DNA, 22 bp, Artificial Sequence
  chemically synthesized
atgaccacgctctgctgtaccc

SEQ ID NO: 8327 - DNA, 22 bp, Artificial Sequence
  chemically synthesized
tgctgtacccactctcacatgt

SEQ ID NO: 8328 - DNA, 22 bp, Artificial Sequence
  chemically synthesized
ctgtacccactctcacatgtgc

SEQ ID NO: 8329 - DNA, 22 bp, Artificial Sequence
  chemically synthesized
tacccactctcacatgtgcata

SEQ ID NO: 8330 - DNA, 22 bp, Artificial Sequence
  chemically synthesized
tcacatgtgcatatgcatgcta

SEQ ID NO: 8331 - DNA, 22 bp, Artificial Sequence
  chemically synthesized
acatgtgcatatgcatgctaat

SEQ ID NO: 8332 - DNA, 22 bp, Artificial Sequence
  chemically synthesized
atgcacacattcatactccctc

SEQ ID NO: 8333 - DNA, 22 bp, Artificial Sequence
  chemically synthesized
atactccctcccacacacacac

SEQ ID NO: 8334 - DNA, 22 bp, Artificial Sequence
  chemically synthesized
cctcccacacacacacacctga

SEQ ID NO: 8335 - DNA, 22 bp, Artificial Sequence
  chemically synthesized
ccacacacacacacctgacaca

SEQ ID NO: 8336 - DNA, 22 bp, Artificial Sequence
  chemically synthesized
acacacccacacacgtacactc

SEQ ID NO: 8337 - DNA, 22 bp, Artificial Sequence
  chemically synthesized
acacacccacgtcttcctgcac

SEQ ID NO: 8338 - DNA, 22 bp, Artificial Sequence
  chemically synthesized
cctgcacacagagctgggctcc

SEQ ID NO: 8339 - DNA, 22 bp, Artificial Sequence
  chemically synthesized
ctgcacacagagctgggctccc

SEQ ID NO: 8340 - DNA, 22 bp, Artificial Sequence
  chemically synthesized
cacacagagctgggctccctct

SEQ ID NO: 8341 - DNA, 22 bp, Artificial Sequence
  chemically synthesized
ggctccctctctgctgcctcca

SEQ ID NO: 8342 - DNA, 22 bp, Artificial Sequence
  chemically synthesized
cctctctgctgcctccagaccc

SEQ ID NO: 8343 - DNA, 22 bp, Artificial Sequence
  chemically synthesized
tctgctgcctccagacccagag

SEQ ID NO: 8344 - DNA, 22 bp, Artificial Sequence
  chemically synthesized
tgctgcctccagacccagagca

SEQ ID NO: 8345 - DNA, 22 bp, Artificial Sequence
  chemically synthesized
ctgcctccagacccagagcagc

SEQ ID NO: 8346 - DNA, 22 bp, Artificial Sequence
  chemically synthesized
cctccagacccagagcagctcc

SEQ ID NO: 8347 - DNA, 22 bp, Artificial Sequence
  chemically synthesized
cagacccagagcagctccagtt

SEQ ID NO: 8348 - DNA, 22 bp, Artificial Sequence
  chemically synthesized
cagttgtcccagccctgagctc

SEQ ID NO: 8349 - DNA, 22 bp, Artificial Sequence
  chemically synthesized
tcccagccctgagctcctctct

SEQ ID NO: 8350 - DNA, 22 bp, Artificial Sequence
  chemically synthesized
agctcctctctttgcagcatcc

SEQ ID NO: 8351 - DNA, 22 bp, Artificial Sequence
  chemically synthesized
ctctctttgcagcatccacctg

SEQ ID NO: 8352 - DNA, 22 bp, Artificial Sequence
  chemically synthesized
tctttgcagcatccacctgcaa

SEQ ID NO: 8353 - DNA, 22 bp, Artificial Sequence
  chemically synthesized
tttgcagcatccacctgcaaac

SEQ ID NO: 8354 - DNA, 22 bp, Artificial Sequence
  chemically synthesized
tgcagcatccacctgcaaacag

SEQ ID NO: 8355 - DNA, 22 bp, Artificial Sequence
  chemically synthesized
gcagcatccacctgcaaacaga

SEQ ID NO: 8356 - DNA, 22 bp, Artificial Sequence
  chemically synthesized
cagcatccacctgcaaacagaa

SEQ ID NO: 8357 - DNA, 22 bp, Artificial Sequence
  chemically synthesized
caaacagaacaccttctaggcc

SEQ ID NO: 8358 - DNA, 22 bp, Artificial Sequence
  chemically synthesized
ctaggccttggaccctgactct

SEQ ID NO: 8359 - DNA, 22 bp, Artificial Sequence
  chemically synthesized
taggccttggaccctgactctg

SEQ ID NO: 8360 - DNA, 22 bp, Artificial Sequence
  chemically synthesized
ggccttggaccctgactctgtg

SEQ ID NO: 8361 - DNA, 22 bp, Artificial Sequence
  chemically synthesized
ggaccctgactctgtggacttc

SEQ ID NO: 8362 - DNA, 22 bp, Artificial Sequence
  chemically synthesized
gaccctgactctgtggacttcc

SEQ ID NO: 8363 - DNA, 22 bp, Artificial Sequence
  chemically synthesized
actctgtggacttccttgtctt

SEQ ID NO: 8364 - DNA, 22 bp, Artificial Sequence
  chemically synthesized
tgtggacttccttgtcttctca

SEQ ID NO: 8365 - DNA, 22 bp, Artificial Sequence
  chemically synthesized
tggacttccttgtcttctcatt

SEQ ID NO: 8366 - DNA, 22 bp, Artificial Sequence
  chemically synthesized
ccttgtcttctcattcctatca

SEQ ID NO: 8367 - DNA, 22 bp, Artificial Sequence
  chemically synthesized
cttgtcttctcattcctatcac

SEQ ID NO: 8368 - DNA, 22 bp, Artificial Sequence
  chemically synthesized
gtcttctcattcctatcacccc

SEQ ID NO: 8369 - DNA, 22 bp, Artificial Sequence
  chemically synthesized
tcttctcattcctatcaccccc

SEQ ID NO: 8370 - DNA, 22 bp, Artificial Sequence
  chemically synthesized
ctcattcctatcaccccccgac

SEQ ID NO: 8371 - DNA, 22 bp, Artificial Sequence
  chemically synthesized
tcattcctatcaccccccgacc

SEQ ID NO: 8372 - DNA, 22 bp, Artificial Sequence
  chemically synthesized
attcctatcaccccccgaccca

SEQ ID NO: 8373 - DNA, 22 bp, Artificial Sequence
  chemically synthesized
ctatcaccccccgacccagcag

SEQ ID NO: 8374 - DNA, 22 bp, Artificial Sequence
  chemically synthesized
tcaccccccgacccagcaggac

SEQ ID NO: 8375 - DNA, 22 bp, Artificial Sequence
  chemically synthesized
gggaggctcagtcaggggccca

SEQ ID NO: 8376 - DNA, 22 bp, Artificial Sequence
  chemically synthesized
agtcaggggcccagaatcttcc

SEQ ID NO: 8377 - DNA, 22 bp, Artificial Sequence
  chemically synthesized
cctccccaggtcacttcctgcc

SEQ ID NO: 8378 - DNA, 22 bp, Artificial Sequence
  chemically synthesized
ctccccaggtcacttcctgcca

SEQ ID NO: 8379 - DNA, 22 bp, Artificial Sequence
  chemically synthesized
cccaggtcacttcctgccactg

SEQ ID NO: 8380 - DNA, 22 bp, Artificial Sequence
  chemically synthesized
cctgccactgtcctgagtcaga

SEQ ID NO: 8381 - DNA, 22 bp, Artificial Sequence
  chemically synthesized
ctgccactgtcctgagtcagac

SEQ ID NO: 8382 - DNA, 22 bp, Artificial Sequence
  chemically synthesized
ccactgtcctgagtcagacact

SEQ ID NO: 8383 - DNA, 22 bp, Artificial Sequence
  chemically synthesized
tcctgagtcagacactgcccct

SEQ ID NO: 8384 - DNA, 22 bp, Artificial Sequence
  chemically synthesized
agtcagacactgcccctgtaag

SEQ ID NO: 8385 - DNA, 22 bp, Artificial Sequence
  chemically synthesized
cccctgtaagtgactgtccata

SEQ ID NO: 8386 - DNA, 22 bp, Artificial Sequence
  chemically synthesized
taagtgactgtccataactctt

SEQ ID NO: 8387 - DNA, 22 bp, Artificial Sequence
  chemically synthesized
tccataactcttcatctttttc

SEQ ID NO: 8388 - DNA, 22 bp, Artificial Sequence
  chemically synthesized
ttcatctttttcacaccagtga

SEQ ID NO: 8389 - DNA, 22 bp, Artificial Sequence
  chemically synthesized
catctttttcacaccagtgact

SEQ ID NO: 8390 - DNA, 22 bp, Artificial Sequence
  chemically synthesized
atctttttcacaccagtgactt

SEQ ID NO: 8391 - DNA, 22 bp, Artificial Sequence
  chemically synthesized
tttcacaccagtgacttccacc

SEQ ID NO: 8392 - DNA, 22 bp, Artificial Sequence
  chemically synthesized
ttcacaccagtgacttccacct

SEQ ID NO: 8393 - DNA, 22 bp, Artificial Sequence
  chemically synthesized
tcacaccagtgacttccacctt

SEQ ID NO: 8394 - DNA, 22 bp, Artificial Sequence
  chemically synthesized
cacaccagtgacttccaccttc

SEQ ID NO: 8395 - DNA, 22 bp, Artificial Sequence
  chemically synthesized
acaccagtgacttccaccttcc

SEQ ID NO: 8396 - DNA, 22 bp, Artificial Sequence
  chemically synthesized
ccaccttccccactgcagccac

SEQ ID NO: 8397 - DNA, 22 bp, Artificial Sequence
  chemically synthesized
caccttccccactgcagccaca

SEQ ID NO: 8398 - DNA, 22 bp, Artificial Sequence
  chemically synthesized
ccccactgcagccacactcagg

SEQ ID NO: 8399 - DNA, 22 bp, Artificial Sequence
  chemically synthesized
cccactgcagccacactcagga

SEQ ID NO: 8400 - DNA, 22 bp, Artificial Sequence
  chemically synthesized
cagccacactcaggaccccatt

SEQ ID NO: 8401 - DNA, 22 bp, Artificial Sequence
  chemically synthesized
aggaccccatttgacccaggga

SEQ ID NO: 8402 - DNA, 22 bp, Artificial Sequence
  chemically synthesized
gacccagggaggcctctgacac

SEQ ID NO: 8403 - DNA, 22 bp, Artificial Sequence
  chemically synthesized
acccagggaggcctctgacacc

SEQ ID NO: 8404 - DNA, 22 bp, Artificial Sequence
  chemically synthesized
tgacacctccactgcccactcc

SEQ ID NO: 8405 - DNA, 22 bp, Artificial Sequence
  chemically synthesized
acacctccactgcccactcccg

SEQ ID NO: 8406 - DNA, 22 bp, Artificial Sequence
  chemically synthesized
cactgcccactcccgctctgag

SEQ ID NO: 8407 - DNA, 22 bp, Artificial Sequence
  chemically synthesized
cccactcccgctctgagcacag

SEQ ID NO: 8408 - DNA, 22 bp, Artificial Sequence
  chemically synthesized
ccgctctgagcacagccccacc

SEQ ID NO: 8409 - DNA, 22 bp, Artificial Sequence
  chemically synthesized
tgagcacagccccaccctccct

SEQ ID NO: 8410 - DNA, 22 bp, Artificial Sequence
  chemically synthesized
agcacagccccaccctccctct

SEQ ID NO: 8411 - DNA, 22 bp, Artificial Sequence
  chemically synthesized
cctctcactgcccccacccctt

SEQ ID NO: 8412 - DNA, 22 bp, Artificial Sequence
  chemically synthesized
tcactgcccccaccccttcctc

SEQ ID NO: 8413 - DNA, 22 bp, Artificial Sequence
  chemically synthesized
actgcccccaccccttcctcca

SEQ ID NO: 8414 - DNA, 22 bp, Artificial Sequence
  chemically synthesized
cccccaccccttcctccaaggc

SEQ ID NO: 8415 - DNA, 22 bp, Artificial Sequence
  chemically synthesized
cctccaaggcctttgcattcct

SEQ ID NO: 8416 - DNA, 22 bp, Artificial Sequence
  chemically synthesized
ctccaaggcctttgcattcctc

SEQ ID NO: 8417 - DNA, 22 bp, Artificial Sequence
  chemically synthesized
caaggcctttgcattcctctcc

SEQ ID NO: 8418 - DNA, 22 bp, Artificial Sequence
  chemically synthesized
tgcattcctctccatccagaag

SEQ ID NO: 8419 - DNA, 22 bp, Artificial Sequence
  chemically synthesized
gcattcctctccatccagaagc

SEQ ID NO: 8420 - DNA, 22 bp, Artificial Sequence
  chemically synthesized
cattcctctccatccagaagcg

SEQ ID NO: 8421 - DNA, 22 bp, Artificial Sequence
  chemically synthesized
ctctccatccagaagcgctcca

SEQ ID NO: 8422 - DNA, 22 bp, Artificial Sequence
  chemically synthesized
tccatccagaagcgctccatga

SEQ ID NO: 8423 - DNA, 22 bp, Artificial Sequence
  chemically synthesized
catccagaagcgctccatgacc

SEQ ID NO: 8424 - DNA, 22 bp, Artificial Sequence
  chemically synthesized
catgaccacggtgttccccacc

SEQ ID NO: 8425 - DNA, 22 bp, Artificial Sequence
  chemically synthesized
cccaccaagctggccctccatg

SEQ ID NO: 8426 - DNA, 22 bp, Artificial Sequence
  chemically synthesized
gccctccatggctgagtccctg

SEQ ID NO: 8427 - DNA, 22 bp, Artificial Sequence
  chemically synthesized
catggctgagtccctgactgct

SEQ ID NO: 8428 - DNA, 22 bp, Artificial Sequence
  chemically synthesized
agtccctgactgctgtcttcag

SEQ ID NO: 8429 - DNA, 22 bp, Artificial Sequence
  chemically synthesized
actgctgtcttcagcaccctcc

SEQ ID NO: 8430 - DNA, 22 bp, Artificial Sequence
  chemically synthesized
ctgtcttcagcaccctccactc

SEQ ID NO: 8431 - DNA, 22 bp, Artificial Sequence
  chemically synthesized
tcttcagcaccctccactcaga

SEQ ID NO: 8432 - DNA, 22 bp, Artificial Sequence
  chemically synthesized
cagcaccctccactcagagggt

SEQ ID NO: 8433 - DNA, 22 bp, Artificial Sequence
  chemically synthesized
agcaccctccactcagagggtc

SEQ ID NO: 8434 - DNA, 22 bp, Artificial Sequence
  chemically synthesized
cactcagagggtcctgtcctgc

SEQ ID NO: 8435 - DNA, 22 bp, Artificial Sequence
  chemically synthesized
agagggtcctgtcctgcttccc

SEQ ID NO: 8436 - DNA, 22 bp, Artificial Sequence
  chemically synthesized
tcctgcttcccagtccgactta

SEQ ID NO: 8437 - DNA, 22 bp, Artificial Sequence
  chemically synthesized
cttcccagtccgacttatcaac

SEQ ID NO: 8438 - DNA, 22 bp, Artificial Sequence
  chemically synthesized
cccagtccgacttatcaactcc

SEQ ID NO: 8439 - DNA, 22 bp, Artificial Sequence
  chemically synthesized
ccagtccgacttatcaactccc

SEQ ID NO: 8440 - DNA, 22 bp, Artificial Sequence
  chemically synthesized
atcaactcccaatgctgggtca

SEQ ID NO: 8441 - DNA, 22 bp, Artificial Sequence
  chemically synthesized
tcaactcccaatgctgggtcag

SEQ ID NO: 8442 - DNA, 22 bp, Artificial Sequence
  chemically synthesized
ccaatgctgggtcagcccagca

SEQ ID NO: 8443 - DNA, 22 bp, Artificial Sequence
  chemically synthesized
ggtcagcccagcaacgtgtctg

SEQ ID NO: 8444 - DNA, 22 bp, Artificial Sequence
  chemically synthesized
tatatccaccctgaaaccagac

SEQ ID NO: 8445 - DNA, 22 bp, Artificial Sequence
  chemically synthesized
aaaccagactgcccacagggta

SEQ ID NO: 8446 - DNA, 22 bp, Artificial Sequence
  chemically synthesized
cccacagggtagcccagctgtg

SEQ ID NO: 8447 - DNA, 22 bp, Artificial Sequence
  chemically synthesized
tgcctccaggtagctctgagat

SEQ ID NO: 8448 - DNA, 22 bp, Artificial Sequence
  chemically synthesized
caggtagctctgagatcatgca

SEQ ID NO: 8449 - DNA, 22 bp, Artificial Sequence
  chemically synthesized
tgagatcatgcaccagcattca

SEQ ID NO: 8450 - DNA, 22 bp, Artificial Sequence
  chemically synthesized
agatcatgcaccagcattcaat

SEQ ID NO: 8451 - DNA, 22 bp, Artificial Sequence
  chemically synthesized
aatttctccatgcttccatttt

SEQ ID NO: 8452 - DNA, 22 bp, Artificial Sequence
  chemically synthesized
ctccatgcttccattttctcgt

SEQ ID NO: 8453 - DNA, 22 bp, Artificial Sequence
  chemically synthesized
tccatgcttccattttctcgtg

SEQ ID NO: 8454 - DNA, 22 bp, Artificial Sequence
  chemically synthesized
catgcttccattttctcgtgtg

SEQ ID NO: 8455 - DNA, 22 bp, Artificial Sequence
  chemically synthesized
ccattttctcgtgtgtaaaatg

SEQ ID NO: 8456 - DNA, 22 bp, Artificial Sequence
  chemically synthesized
cattttctcgtgtgtaaaatgg

SEQ ID NO: 8457 - DNA, 22 bp, Artificial Sequence
  chemically synthesized
tctcgtgtgtaaaatggagatc

SEQ ID NO: 8458 - DNA, 22 bp, Artificial Sequence
  chemically synthesized
ctcgtgtgtaaaatggagatca

SEQ ID NO: 8459 - DNA, 22 bp, Artificial Sequence
  chemically synthesized
tcgtgtgtaaaatggagatcac

SEQ ID NO: 8460 - DNA, 22 bp, Artificial Sequence
  chemically synthesized
gtgtgtaaaatggagatcacag

SEQ ID NO: 8461 - DNA, 22 bp, Artificial Sequence
  chemically synthesized
cccgattggattgctcggataa

SEQ ID NO: 8462 - DNA, 22 bp, Artificial Sequence
  chemically synthesized
gattgctcggataattagatga

SEQ ID NO: 8463 - DNA, 22 bp, Artificial Sequence
  chemically synthesized
ctcggataattagatgagttaa

SEQ ID NO: 8464 - DNA, 22 bp, Artificial Sequence
  chemically synthesized
ggataattagatgagttaaaat

SEQ ID NO: 8465 - DNA, 22 bp, Artificial Sequence
  chemically synthesized
gatgagttaaaatatgtaatgt

SEQ ID NO: 8466 - DNA, 22 bp, Artificial Sequence
  chemically synthesized
aaatatgtaatgtgcttcttag

SEQ ID NO: 8467 - DNA, 22 bp, Artificial Sequence
  chemically synthesized
cttaggcaaaagtttgaacata

SEQ ID NO: 8468 - DNA, 22 bp, Artificial Sequence
  chemically synthesized
ttaggcaaaagtttgaacataa

SEQ ID NO: 8469 - DNA, 22 bp, Artificial Sequence
  chemically synthesized
aggcaaaagtttgaacataaaa

SEQ ID NO: 8470 - DNA, 22 bp, Artificial Sequence
  chemically synthesized
ggcaaaagtttgaacataaaag

SEQ ID NO: 8471 - DNA, 22 bp, Artificial Sequence
  chemically synthesized
gaacataaaagacagggtctgc

SEQ ID NO: 8472 - DNA, 22 bp, Artificial Sequence
  chemically synthesized
aacataaaagacagggtctgcc

SEQ ID NO: 8473 - DNA, 22 bp, Artificial Sequence
  chemically synthesized
cccaagatgggaagagttcttc

SEQ ID NO: 8474 - DNA, 22 bp, Artificial Sequence
  chemically synthesized
ttctctccccagaaacaatcaa

SEQ ID NO: 8475 - DNA, 22 bp, Artificial Sequence
  chemically synthesized
ctctccccagaaacaatcaaaa

SEQ ID NO: 8476 - DNA, 22 bp, Artificial Sequence
  chemically synthesized
tctccccagaaacaatcaaaac

SEQ ID NO: 8477 - DNA, 22 bp, Artificial Sequence
  chemically synthesized
tccccagaaacaatcaaaacaa

SEQ ID NO: 8478 - DNA, 22 bp, Artificial Sequence
  chemically synthesized
cccagaaacaatcaaaacaaaa

SEQ ID NO: 8479 - DNA, 22 bp, Artificial Sequence
  chemically synthesized
tagaacatggcagctttcaaga

SEQ ID NO: 8480 - DNA, 22 bp, Artificial Sequence
  chemically synthesized
tcaagactctggacatcaggca

SEQ ID NO: 8481 - DNA, 22 bp, Artificial Sequence
  chemically synthesized
caagactctggacatcaggcaa

SEQ ID NO: 8482 - DNA, 22 bp, Artificial Sequence
  chemically synthesized
aagactctggacatcaggcaag

SEQ ID NO: 8483 - DNA, 22 bp, Artificial Sequence
  chemically synthesized
tggacatcaggcaaggaggagt

SEQ ID NO: 8484 - DNA, 22 bp, Artificial Sequence
  chemically synthesized
gacatcaggcaaggaggagtaa

SEQ ID NO: 8485 - DNA, 22 bp, Artificial Sequence
  chemically synthesized
agggataagaagcaaacaacag

SEQ ID NO: 8486 - DNA, 22 bp, Artificial Sequence
  chemically synthesized
cgatcaccccagcttactgttt

SEQ ID NO: 8487 - DNA, 22 bp, Artificial Sequence
  chemically synthesized
actgtttggagagagtctgcag

SEQ ID NO: 8488 - DNA, 22 bp, Artificial Sequence
  chemically synthesized
ctgtttggagagagtctgcagg

SEQ ID NO: 8489 - DNA, 22 bp, Artificial Sequence
  chemically synthesized
tttggagagagtctgcaggtta

SEQ ID NO: 8490 - DNA, 22 bp, Artificial Sequence
  chemically synthesized
ggagagagtctgcaggttacag

SEQ ID NO: 8491 - DNA, 22 bp, Artificial Sequence
  chemically synthesized
gagagagtctgcaggttacagg

SEQ ID NO: 8492 - DNA, 22 bp, Artificial Sequence
  chemically synthesized
caggttacaggccaggaaaggg

SEQ ID NO: 8493 - DNA, 22 bp, Artificial Sequence
  chemically synthesized
caggccaggaaagggaagtcca

SEQ ID NO: 8494 - DNA, 22 bp, Artificial Sequence
  chemically synthesized
cccacgttgaggagatggagct

SEQ ID NO: 8495 - DNA, 22 bp, Artificial Sequence
  chemically synthesized
aggagatggagctgagagtccg

SEQ ID NO: 8496 - DNA, 22 bp, Artificial Sequence
  chemically synthesized
agagtccgaggagaccaaaaca

SEQ ID NO: 8497 - DNA, 22 bp, Artificial Sequence
  chemically synthesized
agagttcaaacgatcaaactga

SEQ ID NO: 8498 - DNA, 22 bp, Artificial Sequence
  chemically synthesized
aaacgatcaaactgactctaag

SEQ ID NO: 8499 - DNA, 22 bp, Artificial Sequence
  chemically synthesized
actctaagttgcttaactgcat

SEQ ID NO: 8500 - DNA, 22 bp, Artificial Sequence
  chemically synthesized
taagttgcttaactgcatcccg

SEQ ID NO: 8501 - DNA, 22 bp, Artificial Sequence
  chemically synthesized
agttgcttaactgcatcccgga

SEQ ID NO: 8502 - DNA, 22 bp, Artificial Sequence
  chemically synthesized
cttaactgcatcccggagcaaa

SEQ ID NO: 8503 - DNA, 22 bp, Artificial Sequence
  chemically synthesized
aactgcatcccggagcaaagct

SEQ ID NO: 8504 - DNA, 22 bp, Artificial Sequence
  chemically synthesized
actgcatcccggagcaaagctc

SEQ ID NO: 8505 - DNA, 22 bp, Artificial Sequence
  chemically synthesized
catcccggagcaaagctcaaga

SEQ ID NO: 8506 - DNA, 22 bp, Artificial Sequence
  chemically synthesized
aagaacatttagaggaatacaa

SEQ ID NO: 8507 - DNA, 22 bp, Artificial Sequence
  chemically synthesized
agaggaatacaaaaatatccag

SEQ ID NO: 8508 - DNA, 22 bp, Artificial Sequence
  chemically synthesized
gaggaatacaaaaatatccagc

SEQ ID NO: 8509 - DNA, 22 bp, Artificial Sequence
  chemically synthesized
acaatgtctggcagccaatcaa

SEQ ID NO: 8510 - DNA, 22 bp, Artificial Sequence
  chemically synthesized
gcagccaatcaaagattacaag

SEQ ID NO: 8511 - DNA, 22 bp, Artificial Sequence
  chemically synthesized
caaggcatgcaatgaaacggga

SEQ ID NO: 8512 - DNA, 22 bp, Artificial Sequence
  chemically synthesized
ataaatatcaaaagagatccag

SEQ ID NO: 8513 - DNA, 22 bp, Artificial Sequence
  chemically synthesized
acacggatgctagaattagcag

SEQ ID NO: 8514 - DNA, 22 bp, Artificial Sequence
  chemically synthesized
gaattagcaggcaaggatggta

SEQ ID NO: 8515 - DNA, 22 bp, Artificial Sequence
  chemically synthesized
gcaggcaaggatggtaaaacag

SEQ ID NO: 8516 - DNA, 22 bp, Artificial Sequence
  chemically synthesized
tagccatatcccattatgttca

SEQ ID NO: 8517 - DNA, 22 bp, Artificial Sequence
  chemically synthesized
tgttcaaaaaattaagtagaat

SEQ ID NO: 8518 - DNA, 22 bp, Artificial Sequence
  chemically synthesized
aaaaaattaagtagaattgtgg

SEQ ID NO: 8519 - DNA, 22 bp, Artificial Sequence
  chemically synthesized
agtagaattgtggaggatattt

SEQ ID NO: 8520 - DNA, 22 bp, Artificial Sequence
  chemically synthesized
tggaggatatttaagagtcccc

SEQ ID NO: 8521 - DNA, 22 bp, Artificial Sequence
  chemically synthesized
aagagtccccaggtgaacttct

SEQ ID NO: 8522 - DNA, 22 bp, Artificial Sequence
  chemically synthesized
agagtccccaggtgaacttcta

SEQ ID NO: 8523 - DNA, 22 bp, Artificial Sequence
  chemically synthesized
ctagagataaaaactacaatgt

SEQ ID NO: 8524 - DNA, 22 bp, Artificial Sequence
  chemically synthesized
tagagataaaaactacaatgtc

SEQ ID NO: 8525 - DNA, 22 bp, Artificial Sequence
  chemically synthesized
gagataaaaactacaatgtctg

SEQ ID NO: 8526 - DNA, 22 bp, Artificial Sequence
  chemically synthesized
caatgtctgaaatgaaaaaaca

SEQ ID NO: 8527 - DNA, 22 bp, Artificial Sequence
  chemically synthesized
aaatgaaaaaacacactggcca

SEQ ID NO: 8528 - DNA, 22 bp, Artificial Sequence
  chemically synthesized
gccaggcgccgtggctcacgcc

SEQ ID NO: 8529 - DNA, 22 bp, Artificial Sequence
  chemically synthesized
acgcctggaatcccagcactgt

SEQ ID NO: 8530 - DNA, 22 bp, Artificial Sequence
  chemically synthesized
gaatcccagcactgtgggaggc

SEQ ID NO: 8531 - DNA, 22 bp, Artificial Sequence
  chemically synthesized
tgggaggccaaggcgggcagat

SEQ ID NO: 8532 - DNA, 22 bp, Artificial Sequence
  chemically synthesized
gctaacatggtgaaaccccatc

SEQ ID NO: 8533 - DNA, 22 bp, Artificial Sequence
  chemically synthesized
acatggtgaaaccccatctcta

SEQ ID NO: 8534 - DNA, 22 bp, Artificial Sequence
  chemically synthesized
tactaaaaatacaaaaaattag

SEQ ID NO: 8535 - DNA, 22 bp, Artificial Sequence
  chemically synthesized
ctaaaaatacaaaaaattagcc

SEQ ID NO: 8536 - DNA, 22 bp, Artificial Sequence
  chemically synthesized
aaaatacaaaaaattagccaga

SEQ ID NO: 8537 - DNA, 22 bp, Artificial Sequence
  chemically synthesized
gccagacgtggtggcaggcgcc

SEQ ID NO: 8538 - DNA, 22 bp, Artificial Sequence
  chemically synthesized
tagtcccagctactcgggaggc

SEQ ID NO: 8539 - DNA, 22 bp, Artificial Sequence
  chemically synthesized
ctcgggaggctgaggcaggaga

SEQ ID NO: 8540 - DNA, 22 bp, Artificial Sequence
  chemically synthesized
gggaggctgaggcaggagaatg

SEQ ID NO: 8541 - DNA, 22 bp, Artificial Sequence
  chemically synthesized
aggcaggagaatggcatgaacc

SEQ ID NO: 8542 - DNA, 22 bp, Artificial Sequence
  chemically synthesized
gcagtgagccaagatcgcgcca

SEQ ID NO: 8543 - DNA, 22 bp, Artificial Sequence
  chemically synthesized
cagtgagccaagatcgcgccac

SEQ ID NO: 8544 - DNA, 22 bp, Artificial Sequence
  chemically synthesized
cactccggcctgggcaacagag

SEQ ID NO: 8545 - DNA, 22 bp, Artificial Sequence
  chemically synthesized
cggcctgggcaacagagcgaga

SEQ ID NO: 8546 - DNA, 22 bp, Artificial Sequence
  chemically synthesized
ggcaacagagcgagactccgcc

SEQ ID NO: 8547 - DNA, 22 bp, Artificial Sequence
  chemically synthesized
cgcctccaaaaaaaaaaaaaag

SEQ ID NO: 8548 - DNA, 22 bp, Artificial Sequence
  chemically synthesized
caaaaaaaaaaaaaagaaaaga

SEQ ID NO: 8549 - DNA, 22 bp, Artificial Sequence
  chemically synthesized
gatggaaataatggaagatgag

SEQ ID NO: 8550 - DNA, 22 bp, Artificial Sequence
  chemically synthesized
agggccaggcactgtggatcac

SEQ ID NO: 8551 - DNA, 22 bp, Artificial Sequence
  chemically synthesized
gggccaggcactgtggatcaca

SEQ ID NO: 8552 - DNA, 22 bp, Artificial Sequence
  chemically synthesized
tggatcacatctgtaatcccag

SEQ ID NO: 8553 - DNA, 22 bp, Artificial Sequence
  chemically synthesized
taatcccagcactttgggaggt

SEQ ID NO: 8554 - DNA, 22 bp, Artificial Sequence
  chemically synthesized
tgggaggtcgacacggggggaa

SEQ ID NO: 8555 - DNA, 22 bp, Artificial Sequence
  chemically synthesized
gggaggtcgacacggggggaat

SEQ ID NO: 8556 - DNA, 22 bp, Artificial Sequence
  chemically synthesized
ggaggtcgacacggggggaatc

SEQ ID NO: 8557 - DNA, 22 bp, Artificial Sequence
  chemically synthesized
gagcccaggagctcaagactag

SEQ ID NO: 8558 - DNA, 22 bp, Artificial Sequence
  chemically synthesized
agcccaggagctcaagactagt

SEQ ID NO: 8559 - DNA, 22 bp, Artificial Sequence
  chemically synthesized
aagactagtctgggcagcatgg

SEQ ID NO: 8560 - DNA, 22 bp, Artificial Sequence
  chemically synthesized
gtctgggcagcatggcaaaacc

SEQ ID NO: 8561 - DNA, 22 bp, Artificial Sequence
  chemically synthesized
ggcagcatggcaaaacccctct

SEQ ID NO: 8562 - DNA, 22 bp, Artificial Sequence
  chemically synthesized
tacatggcaaaaccgtctctac

SEQ ID NO: 8563 - DNA, 22 bp, Artificial Sequence
  chemically synthesized
catggcaaaaccgtctctacaa

SEQ ID NO: 8564 - DNA, 22 bp, Artificial Sequence
  chemically synthesized
tacaaaaaaaaatttttaatta

SEQ ID NO: 8565 - DNA, 22 bp, Artificial Sequence
  chemically synthesized
caaaaaaaaatttttaattagc

SEQ ID NO: 8566 - DNA, 22 bp, Artificial Sequence
  chemically synthesized
ttaattagccaggtgtggtgcc

SEQ ID NO: 8567 - DNA, 22 bp, Artificial Sequence
  chemically synthesized
taattagccaggtgtggtgcca

SEQ ID NO: 8568 - DNA, 22 bp, Artificial Sequence
  chemically synthesized
aattagccaggtgtggtgccac

SEQ ID NO: 8569 - DNA, 22 bp, Artificial Sequence
  chemically synthesized
attagccaggtgtggtgccaca

SEQ ID NO: 8570 - DNA, 22 bp, Artificial Sequence
  chemically synthesized
gccaggtgtggtgccacatgcc

SEQ ID NO: 8571 - DNA, 22 bp, Artificial Sequence
  chemically synthesized
tagtcccagctacctgggaggc

SEQ ID NO: 8572 - DNA, 22 bp, Artificial Sequence
  chemically synthesized
cctgggaggctgaagtggaagg

SEQ ID NO: 8573 - DNA, 22 bp, Artificial Sequence
  chemically synthesized
ggaggctgaagtggaaggatcg

SEQ ID NO: 8574 - DNA, 22 bp, Artificial Sequence
  chemically synthesized
aagtggaaggatcgcctgagcc

SEQ ID NO: 8575 - DNA, 22 bp, Artificial Sequence
  chemically synthesized
agcccaggaggtggaggccaca

SEQ ID NO: 8576 - DNA, 22 bp, Artificial Sequence
  chemically synthesized
tgacaagctactgcattccagc

SEQ ID NO: 8577 - DNA, 22 bp, Artificial Sequence
  chemically synthesized
ctgcattccagcctgggcaaca

SEQ ID NO: 8578 - DNA, 22 bp, Artificial Sequence
  chemically synthesized
cattccagcctgggcaacagag

SEQ ID NO: 8579 - DNA, 22 bp, Artificial Sequence
  chemically synthesized
cagcctgggcaacagagtgaga

SEQ ID NO: 8580 - DNA, 22 bp, Artificial Sequence
  chemically synthesized
ggcaacagagtgagatgagaga

SEQ ID NO: 8581 - DNA, 22 bp, Artificial Sequence
  chemically synthesized
tagttaacttaatgaacagcaa

SEQ ID NO: 8582 - DNA, 22 bp, Artificial Sequence
  chemically synthesized
agttaacttaatgaacagcaat

SEQ ID NO: 8583 - DNA, 22 bp, Artificial Sequence
  chemically synthesized
gttaacttaatgaacagcaata

SEQ ID NO: 8584 - DNA, 22 bp, Artificial Sequence
  chemically synthesized
acttaatgaacagcaataactc

SEQ ID NO: 8585 - DNA, 22 bp, Artificial Sequence
  chemically synthesized
aatgaacagcaataactctata

SEQ ID NO: 8586 - DNA, 22 bp, Artificial Sequence
  chemically synthesized
atgaacagcaataactctataa

SEQ ID NO: 8587 - DNA, 22 bp, Artificial Sequence
  chemically synthesized
tataaaatgaaacactgggaga

SEQ ID NO: 8588 - DNA, 22 bp, Artificial Sequence
  chemically synthesized
taaaatgaaacactgggagaaa

SEQ ID NO: 8589 - DNA, 22 bp, Artificial Sequence
  chemically synthesized
ggagaaaaaagaattaaaaaat

SEQ ID NO: 8590 - DNA, 22 bp, Artificial Sequence
  chemically synthesized
aaaaatggaaagagaatgagtg

SEQ ID NO: 8591 - DNA, 22 bp, Artificial Sequence
  chemically synthesized
tgggacccttaatacatgcata

SEQ ID NO: 8592 - DNA, 22 bp, Artificial Sequence
  chemically synthesized
aatacatgcataattgaaatct

SEQ ID NO: 8593 - DNA, 22 bp, Artificial Sequence
  chemically synthesized
atacatgcataattgaaatctt

SEQ ID NO: 8594 - DNA, 22 bp, Artificial Sequence
  chemically synthesized
aaatctttaaaagaaaaagggg

SEQ ID NO: 8595 - DNA, 22 bp, Artificial Sequence
  chemically synthesized
taaaagaaaaagggggtagcag

SEQ ID NO: 8596 - DNA, 22 bp, Artificial Sequence
  chemically synthesized
aaaagaaaaagggggtagcaga

SEQ ID NO: 8597 - DNA, 22 bp, Artificial Sequence
  chemically synthesized
aaagaaaaagggggtagcagaa

SEQ ID NO: 8598 - DNA, 22 bp, Artificial Sequence
  chemically synthesized
agacaagtggaagatgggcccc

SEQ ID NO: 8599 - DNA, 22 bp, Artificial Sequence
  chemically synthesized
atcagtgtcagctcccatgatg

SEQ ID NO: 8600 - DNA, 22 bp, Artificial Sequence
  chemically synthesized
ccatgatgacgttcccccagcc

SEQ ID NO: 8601 - DNA, 22 bp, Artificial Sequence
  chemically synthesized
ccccagcccccaccacccgggc

SEQ ID NO: 8602 - DNA, 22 bp, Artificial Sequence
  chemically synthesized
ctggagggaaatgcggtgactt

SEQ ID NO: 8603 - DNA, 22 bp, Artificial Sequence
  chemically synthesized
gagggaaatgcggtgactttgc

SEQ ID NO: 8604 - DNA, 22 bp, Artificial Sequence
  chemically synthesized
tgctacatcccttcagacggtc

SEQ ID NO: 8605 - DNA, 22 bp, Artificial Sequence
  chemically synthesized
gctacatcccttcagacggtcc

SEQ ID NO: 8606 - DNA, 22 bp, Artificial Sequence
  chemically synthesized
ctacatcccttcagacggtccc

SEQ ID NO: 8607 - DNA, 22 bp, Artificial Sequence
  chemically synthesized
catcccttcagacggtccctca

SEQ ID NO: 8608 - DNA, 22 bp, Artificial Sequence
  chemically synthesized
cagacggtccctcactggtgtc

SEQ ID NO: 8609 - DNA, 22 bp, Artificial Sequence
  chemically synthesized
agacggtccctcactggtgtcc

SEQ ID NO: 8610 - DNA, 22 bp, Artificial Sequence
  chemically synthesized
actggtgtccctcagcccattc

SEQ ID NO: 8611 - DNA, 22 bp, Artificial Sequence
  chemically synthesized
gtgtccctcagcccattcgcgt

SEQ ID NO: 8612 - DNA, 22 bp, Artificial Sequence
  chemically synthesized
agcccattcgcgtgagctcact

SEQ ID NO: 8613 - DNA, 22 bp, Artificial Sequence
  chemically synthesized
gcgtgagctcactctcccatta

SEQ ID NO: 8614 - DNA, 22 bp, Artificial Sequence
  chemically synthesized
actctcccattaatttcagaaa

SEQ ID NO: 8615 - DNA, 22 bp, Artificial Sequence
  chemically synthesized
tcccattaatttcagaaatcct

SEQ ID NO: 8616 - DNA, 22 bp, Artificial Sequence
  chemically synthesized
ccattaatttcagaaatcctgg

SEQ ID NO: 8617 - DNA, 22 bp, Artificial Sequence
  chemically synthesized
atttcagaaatcctggcctctc

SEQ ID NO: 8618 - DNA, 22 bp, Artificial Sequence
  chemically synthesized
cagaaatcctggcctctctcca

SEQ ID NO: 8619 - DNA, 22 bp, Artificial Sequence
  chemically synthesized
agaaatcctggcctctctccaa

SEQ ID NO: 8620 - DNA, 22 bp, Artificial Sequence
  chemically synthesized
gcctctctccaagcctcctgct

SEQ ID NO: 8621 - DNA, 22 bp, Artificial Sequence
  chemically synthesized
tctccaagcctcctgctcaaac

SEQ ID NO: 8622 - DNA, 22 bp, Artificial Sequence
  chemically synthesized
tccaagcctcctgctcaaactc

SEQ ID NO: 8623 - DNA, 22 bp, Artificial Sequence
  chemically synthesized
caagcctcctgctcaaactcta

SEQ ID NO: 8624 - DNA, 22 bp, Artificial Sequence
  chemically synthesized
ctgctcaaactctaaattctgt

SEQ ID NO: 8625 - DNA, 22 bp, Artificial Sequence
  chemically synthesized
ctcaaactctaaattctgtcac

SEQ ID NO: 8626 - DNA, 22 bp, Artificial Sequence
  chemically synthesized
aaactctaaattctgtcaccct

SEQ ID NO: 8627 - DNA, 22 bp, Artificial Sequence
  chemically synthesized
taaattctgtcaccctcagaag

SEQ ID NO: 8628 - DNA, 22 bp, Artificial Sequence
  chemically synthesized
aattctgtcaccctcagaagat

SEQ ID NO: 8629 - DNA, 22 bp, Artificial Sequence
  chemically synthesized
tgtcaccctcagaagattcagc

SEQ ID NO: 8630 - DNA, 22 bp, Artificial Sequence
  chemically synthesized
tcaccctcagaagattcagcag

SEQ ID NO: 8631 - DNA, 22 bp, Artificial Sequence
  chemically synthesized
agaagattcagcagcatcccgt

SEQ ID NO: 8632 - DNA, 22 bp, Artificial Sequence
  chemically synthesized
agcagcatcccgtattctctct

SEQ ID NO: 8633 - DNA, 22 bp, Artificial Sequence
  chemically synthesized
tctctgagtgttcactatgtac

SEQ ID NO: 8634 - DNA, 22 bp, Artificial Sequence
  chemically synthesized
tctgagtgttcactatgtaccg

SEQ ID NO: 8635 - DNA, 22 bp, Artificial Sequence
  chemically synthesized
tgagtgttcactatgtaccggg

SEQ ID NO: 8636 - DNA, 22 bp, Artificial Sequence
  chemically synthesized
agtgttcactatgtaccgggtg

SEQ ID NO: 8637 - DNA, 22 bp, Artificial Sequence
  chemically synthesized
actatgtaccgggtgccgtgtg

SEQ ID NO: 8638 - DNA, 22 bp, Artificial Sequence
  chemically synthesized
tgtaccgggtgccgtgtgggca

SEQ ID NO: 8639 - DNA, 22 bp, Artificial Sequence
  chemically synthesized
gagttgcagaggagagtgaggc

SEQ ID NO: 8640 - DNA, 22 bp, Artificial Sequence
  chemically synthesized
cagaggagagtgaggcggacag

SEQ ID NO: 8641 - DNA, 22 bp, Artificial Sequence
  chemically synthesized
tgcctgtggggacaccgcctgg

SEQ ID NO: 8642 - DNA, 22 bp, Artificial Sequence
  chemically synthesized
cctgtggggacaccgcctggtg

SEQ ID NO: 8643 - DNA, 22 bp, Artificial Sequence
  chemically synthesized
tggggacaccgcctggtgggaa

SEQ ID NO: 8644 - DNA, 22 bp, Artificial Sequence
  chemically synthesized
gtgggaagtccagccagccccc

SEQ ID NO: 8645 - DNA, 22 bp, Artificial Sequence
  chemically synthesized
cagagagaggagatgctactgg

SEQ ID NO: 8646 - DNA, 22 bp, Artificial Sequence
  chemically synthesized
ctggtgttcctgagtggtcctc

SEQ ID NO: 8647 - DNA, 22 bp, Artificial Sequence
  chemically synthesized
gtgttcctgagtggtcctcggg

SEQ ID NO: 8648 - DNA, 22 bp, Artificial Sequence
  chemically synthesized
ctgagtggtcctcgggagggac

SEQ ID NO: 8649 - DNA, 22 bp, Artificial Sequence
  chemically synthesized
agtggtcctcgggagggacctc

SEQ ID NO: 8650 - DNA, 22 bp, Artificial Sequence
  chemically synthesized
gggagggacctcctatccctcc

SEQ ID NO: 8651 - DNA, 22 bp, Artificial Sequence
  chemically synthesized
ctatccctcctgtcccctgccc

SEQ ID NO: 8652 - DNA, 22 bp, Artificial Sequence
  chemically synthesized
tccctcctgtcccctgccctgc

SEQ ID NO: 8653 - DNA, 22 bp, Artificial Sequence
  chemically synthesized
ctgtcccctgccctgccctgcc

SEQ ID NO: 8654 - DNA, 22 bp, Artificial Sequence
  chemically synthesized
tcccctgccctgccctgcccag

SEQ ID NO: 8655 - DNA, 22 bp, Artificial Sequence
  chemically synthesized
ccctgccctgcccagcaccggc

SEQ ID NO: 8656 - DNA, 22 bp, Artificial Sequence
  chemically synthesized
ccctgcccagcaccggccctcc

SEQ ID NO: 8657 - DNA, 22 bp, Artificial Sequence
  chemically synthesized
cccagcaccggccctccctcgg

SEQ ID NO: 8658 - DNA, 22 bp, Artificial Sequence
  chemically synthesized
cctcggttggccagcctcagga

SEQ ID NO: 8659 - DNA, 22 bp, Artificial Sequence
  chemically synthesized
ggttggccagcctcaggaatga

SEQ ID NO: 8660 - DNA, 22 bp, Artificial Sequence
  chemically synthesized
gccagcctcaggaatgaggagt

SEQ ID NO: 8661 - DNA, 22 bp, Artificial Sequence
  chemically synthesized
aggaatgaggagtccctcattc

SEQ ID NO: 8662 - DNA, 22 bp, Artificial Sequence
  chemically synthesized
attccagcccagctaaccaatc

SEQ ID NO: 8663 - DNA, 22 bp, Artificial Sequence
  chemically synthesized
cagcccagctaaccaatcccct

SEQ ID NO: 8664 - DNA, 22 bp, Artificial Sequence
  chemically synthesized
accaatccccttcctaagctcc

SEQ ID NO: 8665 - DNA, 22 bp, Artificial Sequence
  chemically synthesized
cctaagctccaagcccctgctc

SEQ ID NO: 8666 - DNA, 22 bp, Artificial Sequence
  chemically synthesized
ctaagctccaagcccctgctcc

SEQ ID NO: 8667 - DNA, 22 bp, Artificial Sequence
  chemically synthesized
agctccaagcccctgctcctcc

SEQ ID NO: 8668 - DNA, 22 bp, Artificial Sequence
  chemically synthesized
caagcccctgctcctcctgcct

SEQ ID NO: 8669 - DNA, 22 bp, Artificial Sequence
  chemically synthesized
ctcctcctgcctccatggaacc

SEQ ID NO: 8670 - DNA, 22 bp, Artificial Sequence
  chemically synthesized
ctcctgcctccatggaacccgg

SEQ ID NO: 8671 - DNA, 22 bp, Artificial Sequence
  chemically synthesized
ctgcctccatggaacccggctc

SEQ ID NO: 8672 - DNA, 22 bp, Artificial Sequence
  chemically synthesized
cctccatggaacccggctccac

SEQ ID NO: 8673 - DNA, 22 bp, Artificial Sequence
  chemically synthesized
catggaacccggctccaccacc

SEQ ID NO: 8674 - DNA, 22 bp, Artificial Sequence
  chemically synthesized
caccaccagcacccacacacct

SEQ ID NO: 8675 - DNA, 22 bp, Artificial Sequence
  chemically synthesized
acactcctccattcctggctct

SEQ ID NO: 8676 - DNA, 22 bp, Artificial Sequence
  chemically synthesized
ctccattcctggctcttgccct

SEQ ID NO: 8677 - DNA, 22 bp, Artificial Sequence
  chemically synthesized
cattcctggctcttgcccttct

SEQ ID NO: 8678 - DNA, 22 bp, Artificial Sequence
  chemically synthesized
ctggctcttgcccttctgccta

SEQ ID NO: 8679 - DNA, 22 bp, Artificial Sequence
  chemically synthesized
gctcttgcccttctgcctagca

SEQ ID NO: 8680 - DNA, 22 bp, Artificial Sequence
  chemically synthesized
ttgcccttctgcctagcactgc

SEQ ID NO: 8681 - DNA, 22 bp, Artificial Sequence
  chemically synthesized
gcccttctgcctagcactgctc

SEQ ID NO: 8682 - DNA, 22 bp, Artificial Sequence
  chemically synthesized
cccttctgcctagcactgctca

SEQ ID NO: 8683 - DNA, 22 bp, Artificial Sequence
  chemically synthesized
ctgcctagcactgctcagatct

SEQ ID NO: 8684 - DNA, 22 bp, Artificial Sequence
  chemically synthesized
tgcctagcactgctcagatctc

SEQ ID NO: 8685 - DNA, 22 bp, Artificial Sequence
  chemically synthesized
cctagcactgctcagatctctc

SEQ ID NO: 8686 - DNA, 22 bp, Artificial Sequence
  chemically synthesized
gcactgctcagatctctctcac

SEQ ID NO: 8687 - DNA, 22 bp, Artificial Sequence
  chemically synthesized
ctcagatctctctcaccttaaa

SEQ ID NO: 8688 - DNA, 22 bp, Artificial Sequence
  chemically synthesized
agatctctctcaccttaaaatc

SEQ ID NO: 8689 - DNA, 22 bp, Artificial Sequence
  chemically synthesized
tctcaccttaaaatcttttccc

SEQ ID NO: 8690 - DNA, 22 bp, Artificial Sequence
  chemically synthesized
tcaccttaaaatcttttcccac

SEQ ID NO: 8691 - DNA, 22 bp, Artificial Sequence
  chemically synthesized
accttaaaatcttttcccacca

SEQ ID NO: 8692 - DNA, 22 bp, Artificial Sequence
  chemically synthesized
aaaatcttttcccaccagcctg

SEQ ID NO: 8693 - DNA, 22 bp, Artificial Sequence
  chemically synthesized
aaatcttttcccaccagcctgg

SEQ ID NO: 8694 - DNA, 22 bp, Artificial Sequence
  chemically synthesized
ttcccaccagcctgggcaacat

SEQ ID NO: 8695 - DNA, 22 bp, Artificial Sequence
  chemically synthesized
tcccaccagcctgggcaacata

SEQ ID NO: 8696 - DNA, 22 bp, Artificial Sequence
  chemically synthesized
cccaccagcctgggcaacatag

SEQ ID NO: 8697 - DNA, 22 bp, Artificial Sequence
  chemically synthesized
ccaccagcctgggcaacatagc

SEQ ID NO: 8698 - DNA, 22 bp, Artificial Sequence
  chemically synthesized
ggcaacatagcaagaccccatt

SEQ ID NO: 8699 - DNA, 22 bp, Artificial Sequence
  chemically synthesized
ctctaaaaaattttttttaatt

SEQ ID NO: 8700 - DNA, 22 bp, Artificial Sequence
  chemically synthesized
tctaaaaaattttttttaattt

SEQ ID NO: 8701 - DNA, 22 bp, Artificial Sequence
  chemically synthesized
taaaaaattttttttaatttgc

SEQ ID NO: 8702 - DNA, 22 bp, Artificial Sequence
  chemically synthesized
aaaaattttttttaatttgcca

SEQ ID NO: 8703 - DNA, 22 bp, Artificial Sequence
  chemically synthesized
tttttaatttgccaggcacagt

SEQ ID NO: 8704 - DNA, 22 bp, Artificial Sequence
  chemically synthesized
ttttaatttgccaggcacagtg

SEQ ID NO: 8705 - DNA, 22 bp, Artificial Sequence
  chemically synthesized
tttaatttgccaggcacagtgg

SEQ ID NO: 8706 - DNA, 22 bp, Artificial Sequence
  chemically synthesized
ttaatttgccaggcacagtggt

SEQ ID NO: 8707 - DNA, 22 bp, Artificial Sequence
  chemically synthesized
taatttgccaggcacagtggtg

SEQ ID NO: 8708 - DNA, 22 bp, Artificial Sequence
  chemically synthesized
aatttgccaggcacagtggtgc

SEQ ID NO: 8709 - DNA, 22 bp, Artificial Sequence
  chemically synthesized
atttgccaggcacagtggtgca

SEQ ID NO: 8710 - DNA, 22 bp, Artificial Sequence
  chemically synthesized
gccaggcacagtggtgcacacc

SEQ ID NO: 8711 - DNA, 22 bp, Artificial Sequence
  chemically synthesized
ccaggcacagtggtgcacacct

SEQ ID NO: 8712 - DNA, 22 bp, Artificial Sequence
  chemically synthesized
taagtcctaactacttgggagg

SEQ ID NO: 8713 - DNA, 22 bp, Artificial Sequence
  chemically synthesized
actacttgggaggctgaggtgg

SEQ ID NO: 8714 - DNA, 22 bp, Artificial Sequence
  chemically synthesized
cttgggaggctgaggtgggagg

SEQ ID NO: 8715 - DNA, 22 bp, Artificial Sequence
  chemically synthesized
gggaggctgaggtgggaggatg

SEQ ID NO: 8716 - DNA, 22 bp, Artificial Sequence
  chemically synthesized
ggaggctgaggtgggaggatgg

SEQ ID NO: 8717 - DNA, 22 bp, Artificial Sequence
  chemically synthesized
aggtgggaggatggcttgagcc

SEQ ID NO: 8718 - DNA, 22 bp, Artificial Sequence
  chemically synthesized
gagcccaggagttcgaggttgc

SEQ ID NO: 8719 - DNA, 22 bp, Artificial Sequence
  chemically synthesized
agcccaggagttcgaggttgca

SEQ ID NO: 8720 - DNA, 22 bp, Artificial Sequence
  chemically synthesized
gaggttgcagtgagctatgatc

SEQ ID NO: 8721 - DNA, 22 bp, Artificial Sequence
  chemically synthesized
cagtgagctatgatcctgccac

SEQ ID NO: 8722 - DNA, 22 bp, Artificial Sequence
  chemically synthesized
tgatcctgccactacactcctg

SEQ ID NO: 8723 - DNA, 22 bp, Artificial Sequence
  chemically synthesized
ccactacactcctgtctctaaa

SEQ ID NO: 8724 - DNA, 22 bp, Artificial Sequence
  chemically synthesized
cactcctgtctctaaaaaaaaa

SEQ ID NO: 8725 - DNA, 22 bp, Artificial Sequence
  chemically synthesized
ctgtctctaaaaaaaaaatgtc

SEQ ID NO: 8726 - DNA, 22 bp, Artificial Sequence
  chemically synthesized
tctctaaaaaaaaaatgtccaa

SEQ ID NO: 8727 - DNA, 22 bp, Artificial Sequence
  chemically synthesized
taaaaaaaaaatgtccaagata

SEQ ID NO: 8728 - DNA, 22 bp, Artificial Sequence
  chemically synthesized
aaaaaaaaatgtccaagatact

SEQ ID NO: 8729 - DNA, 22 bp, Artificial Sequence
  chemically synthesized
aggtccttcagtcaagatttat

SEQ ID NO: 8730 - DNA, 22 bp, Artificial Sequence
  chemically synthesized
ggtccttcagtcaagatttatt

SEQ ID NO: 8731 - DNA, 22 bp, Artificial Sequence
  chemically synthesized
cagtcaagatttattacagaag

SEQ ID NO: 8732 - DNA, 22 bp, Artificial Sequence
  chemically synthesized
agtcaagatttattacagaagg

SEQ ID NO: 8733 - DNA, 22 bp, Artificial Sequence
  chemically synthesized
attacagaaggatccagggaag

SEQ ID NO: 8734 - DNA, 22 bp, Artificial Sequence
  chemically synthesized
ttacagaaggatccagggaagg

SEQ ID NO: 8735 - DNA, 22 bp, Artificial Sequence
  chemically synthesized
cagaaggatccagggaagggtc

SEQ ID NO: 8736 - DNA, 22 bp, Artificial Sequence
  chemically synthesized
gggagatgagaggagcagggat

SEQ ID NO: 8737 - DNA, 22 bp, Artificial Sequence
  chemically synthesized
ggagatgagaggagcagggatc

SEQ ID NO: 8738 - DNA, 22 bp, Artificial Sequence
  chemically synthesized
ccaggatctctctgtgctcacg

SEQ ID NO: 8739 - DNA, 22 bp, Artificial Sequence
  chemically synthesized
caggatctctctgtgctcacgt

SEQ ID NO: 8740 - DNA, 22 bp, Artificial Sequence
  chemically synthesized
tctgtgctcacgtcccccaccc

SEQ ID NO: 8741 - DNA, 22 bp, Artificial Sequence
  chemically synthesized
tgtgctcacgtcccccacccat

SEQ ID NO: 8742 - DNA, 22 bp, Artificial Sequence
  chemically synthesized
tgctcacgtcccccacccatcc

SEQ ID NO: 8743 - DNA, 22 bp, Artificial Sequence
  chemically synthesized
acgtcccccacccatcccaact

SEQ ID NO: 8744 - DNA, 22 bp, Artificial Sequence
  chemically synthesized
accccacctctacacacacaca

SEQ ID NO: 8745 - DNA, 22 bp, Artificial Sequence
  chemically synthesized
tacacacacacacacacacaca

SEQ ID NO: 8746 - DNA, 22 bp, Artificial Sequence
  chemically synthesized
cacacacacacacacacacata

SEQ ID NO: 8747 - DNA, 22 bp, Artificial Sequence
  chemically synthesized
acacacacactcacgcaacaca

SEQ ID NO: 8748 - DNA, 22 bp, Artificial Sequence
  chemically synthesized
acgcaacacactcacacacaca

SEQ ID NO: 8749 - DNA, 22 bp, Artificial Sequence
  chemically synthesized
acacacacaacatacataacac

SEQ ID NO: 8750 - DNA, 22 bp, Artificial Sequence
  chemically synthesized
acaacatacacacacaacacac

SEQ ID NO: 8751 - DNA, 22 bp, Artificial Sequence
  chemically synthesized
gcacaacatacacacacgcaca

SEQ ID NO: 8752 - DNA, 22 bp, Artificial Sequence
  chemically synthesized
acacaacacacaaacatacata

SEQ ID NO: 8753 - DNA, 22 bp, Artificial Sequence
  chemically synthesized
acacaatacacacacacaacac

SEQ ID NO: 8754 - DNA, 22 bp, Artificial Sequence
  chemically synthesized
atacacaacatacatacacaca

SEQ ID NO: 8755 - DNA, 22 bp, Artificial Sequence
  chemically synthesized
acatacacaacatacactcgca

SEQ ID NO: 8756 - DNA, 22 bp, Artificial Sequence
  chemically synthesized
gcacaacatacacacatgcaca

SEQ ID NO: 8757 - DNA, 22 bp, Artificial Sequence
  chemically synthesized
acacacaagatacacacaacat

SEQ ID NO: 8758 - DNA, 22 bp, Artificial Sequence
  chemically synthesized
acacaacatacacacacaacac

SEQ ID NO: 8759 - DNA, 22 bp, Artificial Sequence
  chemically synthesized
tcacacacaacataccctctca

SEQ ID NO: 8760 - DNA, 22 bp, Artificial Sequence
  chemically synthesized
acacacaacataccctctcaca

SEQ ID NO: 8761 - DNA, 22 bp, Artificial Sequence
  chemically synthesized
tcacatacacgacatacacaca

SEQ ID NO: 8762 - DNA, 22 bp, Artificial Sequence
  chemically synthesized
acatacacgacatacacacaca

SEQ ID NO: 8763 - DNA, 22 bp, Artificial Sequence
  chemically synthesized
tcgcgcacatatacacacacac

SEQ ID NO: 8764 - DNA, 22 bp, Artificial Sequence
  chemically synthesized
gcgcacatatacacacacacaa

SEQ ID NO: 8765 - DNA, 22 bp, Artificial Sequence
  chemically synthesized
actcacacacacacacagagtc

SEQ ID NO: 8766 - DNA, 22 bp, Artificial Sequence
  chemically synthesized
acacacacacacagagtcccag

SEQ ID NO: 8767 - DNA, 22 bp, Artificial Sequence
  chemically synthesized
aatctgcattcctcatatgcac

SEQ ID NO: 8768 - DNA, 22 bp, Artificial Sequence
  chemically synthesized
cattcctcatatgcacatacgt

SEQ ID NO: 8769 - DNA, 22 bp, Artificial Sequence
  chemically synthesized
ctcatatgcacatacgtgcaca

SEQ ID NO: 8770 - DNA, 22 bp, Artificial Sequence
  chemically synthesized
atatgcacatacgtgcacacgc

SEQ ID NO: 8771 - DNA, 22 bp, Artificial Sequence
  chemically synthesized
ttgggttgggaggagaagggca

SEQ ID NO: 8772 - DNA, 22 bp, Artificial Sequence
  chemically synthesized
gggttgggaggagaagggcagg

SEQ ID NO: 8773 - DNA, 22 bp, Artificial Sequence
  chemically synthesized
ggttgggaggagaagggcaggc

SEQ ID NO: 8774 - DNA, 22 bp, Artificial Sequence
  chemically synthesized
ggaggagaagggcaggcagtta

SEQ ID NO: 8775 - DNA, 22 bp, Artificial Sequence
  chemically synthesized
tcttccagatctccccacacct

SEQ ID NO: 8776 - DNA, 22 bp, Artificial Sequence
  chemically synthesized
ccagatctccccacacctctgg

SEQ ID NO: 8777 - DNA, 22 bp, Artificial Sequence
  chemically synthesized
cagatctccccacacctctggc

SEQ ID NO: 8778 - DNA, 22 bp, Artificial Sequence
  chemically synthesized
cccacacctctggcacatgcct

SEQ ID NO: 8779 - DNA, 22 bp, Artificial Sequence
  chemically synthesized
tggcacatgcctttcctggggt

SEQ ID NO: 8780 - DNA, 22 bp, Artificial Sequence
  chemically synthesized
gcacatgcctttcctggggtcc

SEQ ID NO: 8781 - DNA, 22 bp, Artificial Sequence
  chemically synthesized
tcctggggtcctggggtagaca

SEQ ID NO: 8782 - DNA, 22 bp, Artificial Sequence
  chemically synthesized
cctggggtcctggggtagacag

SEQ ID NO: 8783 - DNA, 22 bp, Artificial Sequence
  chemically synthesized
ctggggtcctggggtagacagg

SEQ ID NO: 8784 - DNA, 22 bp, Artificial Sequence
  chemically synthesized
gggtcctggggtagacaggaag

SEQ ID NO: 8785 - DNA, 22 bp, Artificial Sequence
  chemically synthesized
gggtagacaggaaggtgaggtg

SEQ ID NO: 8786 - DNA, 22 bp, Artificial Sequence
  chemically synthesized
ctcagtccctgttcacagagtg

SEQ ID NO: 8787 - DNA, 22 bp, Artificial Sequence
  chemically synthesized
agtccctgttcacagagtgggt

SEQ ID NO: 8788 - DNA, 22 bp, Artificial Sequence
  chemically synthesized
ttcacagagtgggtgcggcaga

SEQ ID NO: 8789 - DNA, 22 bp, Artificial Sequence
  chemically synthesized
acagagtgggtgcggcagagac

SEQ ID NO: 8790 - DNA, 22 bp, Artificial Sequence
  chemically synthesized
aaagggacagagcaatcatgag

SEQ ID NO: 8791 - DNA, 22 bp, Artificial Sequence
  chemically synthesized
agacagagggggagcaaagccg

SEQ ID NO: 8792 - DNA, 22 bp, Artificial Sequence
  chemically synthesized
cacacttgcctttcaaaaatgg

SEQ ID NO: 8793 - DNA, 22 bp, Artificial Sequence
  chemically synthesized
gcctttcaaaaatggatttcct

SEQ ID NO: 8794 - DNA, 22 bp, Artificial Sequence
  chemically synthesized
cctttcaaaaatggatttcctc

SEQ ID NO: 8795 - DNA, 22 bp, Artificial Sequence
  chemically synthesized
tcaaaaatggatttcctctcct

SEQ ID NO: 8796 - DNA, 22 bp, Artificial Sequence
  chemically synthesized
caaaaatggatttcctctcctg

SEQ ID NO: 8797 - DNA, 22 bp, Artificial Sequence
  chemically synthesized
aaaaatggatttcctctcctgg

SEQ ID NO: 8798 - DNA, 22 bp, Artificial Sequence
  chemically synthesized
cctctcctgggattcagcctgc

SEQ ID NO: 8799 - DNA, 22 bp, Artificial Sequence
  chemically synthesized
ctctcctgggattcagcctgcg

SEQ ID NO: 8800 - DNA, 22 bp, Artificial Sequence
  chemically synthesized
tcctgggattcagcctgcgagt

SEQ ID NO: 8801 - DNA, 22 bp, Artificial Sequence
  chemically synthesized
ctgggattcagcctgcgagtgc

SEQ ID NO: 8802 - DNA, 22 bp, Artificial Sequence
  chemically synthesized
ggattcagcctgcgagtgcctg

SEQ ID NO: 8803 - DNA, 22 bp, Artificial Sequence
  chemically synthesized
agcctgcgagtgcctggcccct

SEQ ID NO: 8804 - DNA, 22 bp, Artificial Sequence
  chemically synthesized
cgagtgcctggcccctcacctt

SEQ ID NO: 8805 - DNA, 22 bp, Artificial Sequence
  chemically synthesized
gcccctcaccttgatggaaagg

SEQ ID NO: 8806 - DNA, 22 bp, Artificial Sequence
  chemically synthesized
accttgatggaaaggatggtca

SEQ ID NO: 8807 - DNA, 22 bp, Artificial Sequence
  chemically synthesized
gatggaaaggatggtcattttc

SEQ ID NO: 8808 - DNA, 22 bp, Artificial Sequence
  chemically synthesized
atggaaaggatggtcattttcc

SEQ ID NO: 8809 - DNA, 22 bp, Artificial Sequence
  chemically synthesized
tcctccgagctcagctgctgga

SEQ ID NO: 8810 - DNA, 22 bp, Artificial Sequence
  chemically synthesized
cctccgagctcagctgctggat

SEQ ID NO: 8811 - DNA, 22 bp, Artificial Sequence
  chemically synthesized
ctccgagctcagctgctggata

SEQ ID NO: 8812 - DNA, 22 bp, Artificial Sequence
  chemically synthesized
cgagctcagctgctggatatct

SEQ ID NO: 8813 - DNA, 22 bp, Artificial Sequence
  chemically synthesized
agctgctggatatcttgaaagt

SEQ ID NO: 8814 - DNA, 22 bp, Artificial Sequence
  chemically synthesized
ctggatatcttgaaagtccttg

SEQ ID NO: 8815 - DNA, 22 bp, Artificial Sequence
  chemically synthesized
gatatcttgaaagtccttggcc

SEQ ID NO: 8816 - DNA, 22 bp, Artificial Sequence
  chemically synthesized
gaaagtccttggccatgatggg

SEQ ID NO: 8817 - DNA, 22 bp, Artificial Sequence
  chemically synthesized
aaagtccttggccatgatgggg

SEQ ID NO: 8818 - DNA, 22 bp, Artificial Sequence
  chemically synthesized
ggccatgatggggcccgggctg

SEQ ID NO: 8819 - DNA, 22 bp, Artificial Sequence
  chemically synthesized
gccatgatggggcccgggctgg

SEQ ID NO: 8820 - DNA, 22 bp, Artificial Sequence
  chemically synthesized
gagctggagctggagctgggct

SEQ ID NO: 8821 - DNA, 22 bp, Artificial Sequence
  chemically synthesized
gagctggagctgggctgggctg

SEQ ID NO: 8822 - DNA, 22 bp, Artificial Sequence
  chemically synthesized
gagctgggctgggctgggctga

SEQ ID NO: 8823 - DNA, 22 bp, Artificial Sequence
  chemically synthesized
ggctgggctgggctgaggttgc

SEQ ID NO: 8824 - DNA, 22 bp, Artificial Sequence
  chemically synthesized
ggctgggctgaggttgctctga

SEQ ID NO: 8825 - DNA, 22 bp, Artificial Sequence
  chemically synthesized
ggctgaggttgctctgagggct

SEQ ID NO: 8826 - DNA, 22 bp, Artificial Sequence
  chemically synthesized
aggttgctctgagggctggggc

SEQ ID NO: 8827 - DNA, 22 bp, Artificial Sequence
  chemically synthesized
ctctgagggctggggctggggc

SEQ ID NO: 8828 - DNA, 22 bp, Artificial Sequence
  chemically synthesized
tgagggctggggctggggcaga

SEQ ID NO: 8829 - DNA, 22 bp, Artificial Sequence
  chemically synthesized
agggctggggctggggcagagg

SEQ ID NO: 8830 - DNA, 22 bp, Artificial Sequence
  chemically synthesized
gggctggggcagaggtgcagat

SEQ ID NO: 8831 - DNA, 22 bp, Artificial Sequence
  chemically synthesized
gggcagaggtgcagattcacgt

SEQ ID NO: 8832 - DNA, 22 bp, Artificial Sequence
  chemically synthesized
acgtggaggttgatggtgggat

SEQ ID NO: 8833 - DNA, 22 bp, Artificial Sequence
  chemically synthesized
atggtgggatggaacgcagggt

SEQ ID NO: 8834 - DNA, 22 bp, Artificial Sequence
  chemically synthesized
ggggtggtggcctgggtaggat

SEQ ID NO: 8835 - DNA, 22 bp, Artificial Sequence
  chemically synthesized
agatcctacccaggccaccacc

SEQ ID NO: 8836 - DNA, 22 bp, Artificial Sequence
  chemically synthesized
cccaggccaccaccccgaaccc

SEQ ID NO: 8837 - DNA, 22 bp, Artificial Sequence
  chemically synthesized
cgaccctgcgttccatcccacc

SEQ ID NO: 8838 - DNA, 22 bp, Artificial Sequence
  chemically synthesized
cgttccatcccaccatcaacct

SEQ ID NO: 8839 - DNA, 22 bp, Artificial Sequence
  chemically synthesized
catcccaccatcaacctccacg

SEQ ID NO: 8840 - DNA, 22 bp, Artificial Sequence
  chemically synthesized
cacgtgaatctgcacctctgcc

SEQ ID NO: 8841 - DNA, 22 bp, Artificial Sequence
  chemically synthesized
cacctctgccccagccccagcc

SEQ ID NO: 8842 - DNA, 22 bp, Artificial Sequence
  chemically synthesized
tgccccagccccagccctcaga

SEQ ID NO: 8843 - DNA, 22 bp, Artificial Sequence
  chemically synthesized
ccccagccccagccctcagagc

SEQ ID NO: 8844 - DNA, 22 bp, Artificial Sequence
  chemically synthesized
agagcaacctcagcccagccca

SEQ ID NO: 8845 - DNA, 22 bp, Artificial Sequence
  chemically synthesized
agcccagcccagcccagctcca

SEQ ID NO: 8846 - DNA, 22 bp, Artificial Sequence
  chemically synthesized
cagctccagctccagcccgggc

SEQ ID NO: 8847 - DNA, 22 bp, Artificial Sequence
  chemically synthesized
cagctccagcccgggccccatc

SEQ ID NO: 8848 - DNA, 22 bp, Artificial Sequence
  chemically synthesized
cagcccgggccccatcatggcc

SEQ ID NO: 8849 - DNA, 22 bp, Artificial Sequence
  chemically synthesized
tcaagatatccagcagctgagc

SEQ ID NO: 8850 - DNA, 22 bp, Artificial Sequence
  chemically synthesized
caagatatccagcagctgagct

SEQ ID NO: 8851 - DNA, 22 bp, Artificial Sequence
  chemically synthesized
aagatatccagcagctgagctc

SEQ ID NO: 8852 - DNA, 22 bp, Artificial Sequence
  chemically synthesized
agctcggaggaaaatgaccatc

SEQ ID NO: 8853 - DNA, 22 bp, Artificial Sequence
  chemically synthesized
ggaggaaaatgaccatcctttc

SEQ ID NO: 8854 - DNA, 22 bp, Artificial Sequence
  chemically synthesized
tccatcaaggtgaggggccagg

SEQ ID NO: 8855 - DNA, 22 bp, Artificial Sequence
  chemically synthesized
ccatcaaggtgaggggccaggc

SEQ ID NO: 8856 - DNA, 22 bp, Artificial Sequence
  chemically synthesized
catcaaggtgaggggccaggca

SEQ ID NO: 8857 - DNA, 22 bp, Artificial Sequence
  chemically synthesized
gcaggctgaatcccaggagagg

SEQ ID NO: 8858 - DNA, 22 bp, Artificial Sequence
  chemically synthesized
aatcccaggagaggaaatccat

SEQ ID NO: 8859 - DNA, 22 bp, Artificial Sequence
  chemically synthesized
ttgaaaggcaagtgtgcagttt

SEQ ID NO: 8860 - DNA, 22 bp, Artificial Sequence
  chemically synthesized
tgaaaggcaagtgtgcagtttc

SEQ ID NO: 8861 - DNA, 22 bp, Artificial Sequence
  chemically synthesized
gaaaggcaagtgtgcagtttct

SEQ ID NO: 8862 - DNA, 22 bp, Artificial Sequence
  chemically synthesized
aaaggcaagtgtgcagtttctg

SEQ ID NO: 8863 - DNA, 22 bp, Artificial Sequence
  chemically synthesized
ctgcggctttgctccccctctg

SEQ ID NO: 8864 - DNA, 22 bp, Artificial Sequence
  chemically synthesized
tgcggctttgctccccctctgt

SEQ ID NO: 8865 - DNA, 22 bp, Artificial Sequence
  chemically synthesized
cggctttgctccccctctgtct

SEQ ID NO: 8866 - DNA, 22 bp, Artificial Sequence
  chemically synthesized
tgctccccctctgtctcagctc

SEQ ID NO: 8867 - DNA, 22 bp, Artificial Sequence
  chemically synthesized
gctccccctctgtctcagctca

SEQ ID NO: 8868 - DNA, 22 bp, Artificial Sequence
  chemically synthesized
ctccccctctgtctcagctcat

SEQ ID NO: 8869 - DNA, 22 bp, Artificial Sequence
  chemically synthesized
cccctctgtctcagctcatgat

SEQ ID NO: 8870 - DNA, 22 bp, Artificial Sequence
  chemically synthesized
tgtctcagctcatgattgctct

SEQ ID NO: 8871 - DNA, 22 bp, Artificial Sequence
  chemically synthesized
tctcagctcatgattgctctgt

SEQ ID NO: 8872 - DNA, 22 bp, Artificial Sequence
  chemically synthesized
agctcatgattgctctgtccct

SEQ ID NO: 8873 - DNA, 22 bp, Artificial Sequence
  chemically synthesized
atgattgctctgtccctttgag

SEQ ID NO: 8874 - DNA, 22 bp, Artificial Sequence
  chemically synthesized
ctctgtccctttgaggtctctg

SEQ ID NO: 8875 - DNA, 22 bp, Artificial Sequence
  chemically synthesized
tgtccctttgaggtctctgccg

SEQ ID NO: 8876 - DNA, 22 bp, Artificial Sequence
  chemically synthesized
tccctttgaggtctctgccgca

SEQ ID NO: 8877 - DNA, 22 bp, Artificial Sequence
  chemically synthesized
tgaggtctctgccgcacccact

SEQ ID NO: 8878 - DNA, 22 bp, Artificial Sequence
  chemically synthesized
gaggtctctgccgcacccactc

SEQ ID NO: 8879 - DNA, 22 bp, Artificial Sequence
  chemically synthesized
aggtctctgccgcacccactct

SEQ ID NO: 8880 - DNA, 22 bp, Artificial Sequence
  chemically synthesized
tgccgcacccactctgtgaaca

SEQ ID NO: 8881 - DNA, 22 bp, Artificial Sequence
  chemically synthesized
ccgcacccactctgtgaacagg

SEQ ID NO: 8882 - DNA, 22 bp, Artificial Sequence
  chemically synthesized
tgtgaacagggactgaggaggg

SEQ ID NO: 8883 - DNA, 22 bp, Artificial Sequence
  chemically synthesized
tgaacagggactgaggagggcc

SEQ ID NO: 8884 - DNA, 22 bp, Artificial Sequence
  chemically synthesized
aggagggcccgacacccccgct

SEQ ID NO: 8885 - DNA, 22 bp, Artificial Sequence
  chemically synthesized
gttccctcacctcaccttcctg

SEQ ID NO: 8886 - DNA, 22 bp, Artificial Sequence
  chemically synthesized
ttccctcacctcaccttcctgt

SEQ ID NO: 8887 - DNA, 22 bp, Artificial Sequence
  chemically synthesized
cctcacctcaccttcctgtcta

SEQ ID NO: 8888 - DNA, 22 bp, Artificial Sequence
  chemically synthesized
acctcaccttcctgtctacccc

SEQ ID NO: 8889 - DNA, 22 bp, Artificial Sequence
  chemically synthesized
accttcctgtctaccccaggac

SEQ ID NO: 8890 - DNA, 22 bp, Artificial Sequence
  chemically synthesized
cctgtctaccccaggaccccag

SEQ ID NO: 8891 - DNA, 22 bp, Artificial Sequence
  chemically synthesized
ctgtctaccccaggaccccagg

SEQ ID NO: 8892 - DNA, 22 bp, Artificial Sequence
  chemically synthesized
tctaccccaggaccccaggaaa

SEQ ID NO: 8893 - DNA, 22 bp, Artificial Sequence
  chemically synthesized
ccccaggaccccaggaaaggca

SEQ ID NO: 8894 - DNA, 22 bp, Artificial Sequence
  chemically synthesized
gaagataactgcctgcccttct

SEQ ID NO: 8895 - DNA, 22 bp, Artificial Sequence
  chemically synthesized
cctgcccttctcctcccaaccc

SEQ ID NO: 8896 - DNA, 22 bp, Artificial Sequence
  chemically synthesized
cccttctcctcccaacccaaga

SEQ ID NO: 8897 - DNA, 22 bp, Artificial Sequence
  chemically synthesized
ctcctcccaacccaagaacaca

SEQ ID NO: 8898 - DNA, 22 bp, Artificial Sequence
  chemically synthesized
tcctcccaacccaagaacacat

SEQ ID NO: 8899 - DNA, 22 bp, Artificial Sequence
  chemically synthesized
ctcccaacccaagaacacatgt

SEQ ID NO: 8900 - DNA, 22 bp, Artificial Sequence
  chemically synthesized
ccaacccaagaacacatgtgcc

SEQ ID NO: 8901 - DNA, 22 bp, Artificial Sequence
  chemically synthesized
gtatgtgcgtgtgcacgtatgt

SEQ ID NO: 8902 - DNA, 22 bp, Artificial Sequence
  chemically synthesized
agctgggactctgtgtgtgtgt

SEQ ID NO: 8903 - DNA, 22 bp, Artificial Sequence
  chemically synthesized
ggactctgtgtgtgtgtgtgag

SEQ ID NO: 8904 - DNA, 22 bp, Artificial Sequence
  chemically synthesized
tgtgtgtgtgtgtgagtgaatg

SEQ ID NO: 8905 - DNA, 22 bp, Artificial Sequence
  chemically synthesized
tgtgtgtgtgtgagtgaatgtt

SEQ ID NO: 8906 - DNA, 22 bp, Artificial Sequence
  chemically synthesized
tgtgtgtgtatatgtgcgcgag

SEQ ID NO: 8907 - DNA, 22 bp, Artificial Sequence
  chemically synthesized
tgtgtgtgtatgtcgtgtatgt

SEQ ID NO: 8908 - DNA, 22 bp, Artificial Sequence
  chemically synthesized
tgtgtgagagtgtgttgtgtgt

SEQ ID NO: 8909 - DNA, 22 bp, Artificial Sequence
  chemically synthesized
tgtgtgtatgttgtgtgagtat

SEQ ID NO: 8910 - DNA, 22 bp, Artificial Sequence
  chemically synthesized
tgtgagtatatgttgtgtgtat

SEQ ID NO: 8911 - DNA, 22 bp, Artificial Sequence
  chemically synthesized
tgtgtatcttgtgtgtgagtgt

SEQ ID NO: 8912 - DNA, 22 bp, Artificial Sequence
  chemically synthesized
gtgtgtgagtgtatgttgtgtg

SEQ ID NO: 8913 - DNA, 22 bp, Artificial Sequence
  chemically synthesized
tgtgtgagtgtatgttgtgtgt

SEQ ID NO: 8914 - DNA, 22 bp, Artificial Sequence
  chemically synthesized
tgtgttgtgtgtgtatcttgtg

SEQ ID NO: 8915 - DNA, 22 bp, Artificial Sequence
  chemically synthesized
tgtgtgtatcttgtgcatgtgt

SEQ ID NO: 8916 - DNA, 22 bp, Artificial Sequence
  chemically synthesized
gtgcatgtgtgtatgttgtgcg

SEQ ID NO: 8917 - DNA, 22 bp, Artificial Sequence
  chemically synthesized
tgcatgtgtgtatgttgtgcga

SEQ ID NO: 8918 - DNA, 22 bp, Artificial Sequence
  chemically synthesized
tgcgagtgtatgttgtgtatgt

SEQ ID NO: 8919 - DNA, 22 bp, Artificial Sequence
  chemically synthesized
tgtatgtgagtgtgtgtatgtt

SEQ ID NO: 8920 - DNA, 22 bp, Artificial Sequence
  chemically synthesized
tgtgtatgttgtgtgtatgtat

SEQ ID NO: 8921 - DNA, 22 bp, Artificial Sequence
  chemically synthesized
tgtgtatgtatgttgtgtatga

SEQ ID NO: 8922 - DNA, 22 bp, Artificial Sequence
  chemically synthesized
tgtatgagtgtgtgtatgttgt

SEQ ID NO: 8923 - DNA, 22 bp, Artificial Sequence
  chemically synthesized
tgtgtgtgtacgttgtgtatgt

SEQ ID NO: 8924 - DNA, 22 bp, Artificial Sequence
  chemically synthesized
tgtatgttgtgtgtgtgttgtg

SEQ ID NO: 8925 - DNA, 22 bp, Artificial Sequence
  chemically synthesized
tgtgtgtgttgtgtgtgtgtat

SEQ ID NO: 8926 - DNA, 22 bp, Artificial Sequence
  chemically synthesized
tgtgtgtgtattgtgtgagtgt

SEQ ID NO: 8927 - DNA, 22 bp, Artificial Sequence
  chemically synthesized
tgtgagtgtatgtatgtttgtg

SEQ ID NO: 8928 - DNA, 22 bp, Artificial Sequence
  chemically synthesized
gtgtgttgtgtgagtgttgtgt

SEQ ID NO: 8929 - DNA, 22 bp, Artificial Sequence
  chemically synthesized
tgtgttgtgtgagtgttgtgta

SEQ ID NO: 8930 - DNA, 22 bp, Artificial Sequence
  chemically synthesized
tgtgagtgttgtgtatgttgtg

SEQ ID NO: 8931 - DNA, 22 bp, Artificial Sequence
  chemically synthesized
tgtatgttgtgcgtgtgtgtat

SEQ ID NO: 8932 - DNA, 22 bp, Artificial Sequence
  chemically synthesized
tgcgtgtgtgtatgttgtgcga

SEQ ID NO: 8933 - DNA, 22 bp, Artificial Sequence
  chemically synthesized
tgcgagtgtgtgtgttgtgtgt

SEQ ID NO: 8934 - DNA, 22 bp, Artificial Sequence
  chemically synthesized
tgtgtgtatgttgtgagtgtgt

SEQ ID NO: 8935 - DNA, 22 bp, Artificial Sequence
  chemically synthesized
tgagtgtgttatgtatgttgtg

SEQ ID NO: 8936 - DNA, 22 bp, Artificial Sequence
  chemically synthesized
tgtatgttgtgtgtgtgagtgt

SEQ ID NO: 8937 - DNA, 22 bp, Artificial Sequence
  chemically synthesized
tgtgtgtgagtgtgttgcgtga

SEQ ID NO: 8938 - DNA, 22 bp, Artificial Sequence
  chemically synthesized
cgtgagtgtgtgtgttagtgtg

SEQ ID NO: 8939 - DNA, 22 bp, Artificial Sequence
  chemically synthesized
gtgtgtgtatgtgattgtatgt

SEQ ID NO: 8940 - DNA, 22 bp, Artificial Sequence
  chemically synthesized
tatgtgtgtgtgtgtgtgtgtg

SEQ ID NO: 8941 - DNA, 22 bp, Artificial Sequence
  chemically synthesized
ggatgggtgggggacgtgagca

SEQ ID NO: 8942 - DNA, 22 bp, Artificial Sequence
  chemically synthesized
gaagatccctgctcctctcatc

SEQ ID NO: 8943 - DNA, 22 bp, Artificial Sequence
  chemically synthesized
ctcctctcatctcccaagaccc

SEQ ID NO: 8944 - DNA, 22 bp, Artificial Sequence
  chemically synthesized
ctctcatctcccaagacccttc

SEQ ID NO: 8945 - DNA, 22 bp, Artificial Sequence
  chemically synthesized
tcatctcccaagacccttccct

SEQ ID NO: 8946 - DNA, 22 bp, Artificial Sequence
  chemically synthesized
atctcccaagacccttccctgg

SEQ ID NO: 8947 - DNA, 22 bp, Artificial Sequence
  chemically synthesized
ccaagacccttccctggatcct

SEQ ID NO: 8948 - DNA, 22 bp, Artificial Sequence
  chemically synthesized
ccctggatccttctgtaataaa

SEQ ID NO: 8949 - DNA, 22 bp, Artificial Sequence
  chemically synthesized
cctggatccttctgtaataaat

SEQ ID NO: 8950 - DNA, 22 bp, Artificial Sequence
  chemically synthesized
gatccttctgtaataaatcttg

SEQ ID NO: 8951 - DNA, 22 bp, Artificial Sequence
  chemically synthesized
ctgtaataaatcttgactgaag

SEQ ID NO: 8952 - DNA, 22 bp, Artificial Sequence
  chemically synthesized
tgtaataaatcttgactgaagg

SEQ ID NO: 8953 - DNA, 22 bp, Artificial Sequence
  chemically synthesized
taataaatcttgactgaaggac

SEQ ID NO: 8954 - DNA, 22 bp, Artificial Sequence
  chemically synthesized
gactgaaggacctaagtatctt

SEQ ID NO: 8955 - DNA, 22 bp, Artificial Sequence
  chemically synthesized
actgaaggacctaagtatcttg

SEQ ID NO: 8956 - DNA, 22 bp, Artificial Sequence
  chemically synthesized
aaggacctaagtatcttggaca

SEQ ID NO: 8957 - DNA, 22 bp, Artificial Sequence
  chemically synthesized
agtatcttggacattttttttt

SEQ ID NO: 8958 - DNA, 22 bp, Artificial Sequence
  chemically synthesized
ggacattttttttttagagaca

SEQ ID NO: 8959 - DNA, 22 bp, Artificial Sequence
  chemically synthesized
gacattttttttttagagacag

SEQ ID NO: 8960 - DNA, 22 bp, Artificial Sequence
  chemically synthesized
tttttttagagacaggagtgta

SEQ ID NO: 8961 - DNA, 22 bp, Artificial Sequence
  chemically synthesized
ttttttagagacaggagtgtag

SEQ ID NO: 8962 - DNA, 22 bp, Artificial Sequence
  chemically synthesized
tttttagagacaggagtgtagt

SEQ ID NO: 8963 - DNA, 22 bp, Artificial Sequence
  chemically synthesized
ttttagagacaggagtgtagtg

SEQ ID NO: 8964 - DNA, 22 bp, Artificial Sequence
  chemically synthesized
tttagagacaggagtgtagtgg

SEQ ID NO: 8965 - DNA, 22 bp, Artificial Sequence
  chemically synthesized
ttagagacaggagtgtagtggc

SEQ ID NO: 8966 - DNA, 22 bp, Artificial Sequence
  chemically synthesized
tagagacaggagtgtagtggca

SEQ ID NO: 8967 - DNA, 22 bp, Artificial Sequence
  chemically synthesized
agagacaggagtgtagtggcag

SEQ ID NO: 8968 - DNA, 22 bp, Artificial Sequence
  chemically synthesized
gagacaggagtgtagtggcagg

SEQ ID NO: 8969 - DNA, 22 bp, Artificial Sequence
  chemically synthesized
actgcaacctcgaactcctggg

SEQ ID NO: 8970 - DNA, 22 bp, Artificial Sequence
  chemically synthesized
caacctcgaactcctgggctca

SEQ ID NO: 8971 - DNA, 22 bp, Artificial Sequence
  chemically synthesized
gaactcctgggctcaagccatc

SEQ ID NO: 8972 - DNA, 22 bp, Artificial Sequence
  chemically synthesized
ctgggctcaagccatcctccca

SEQ ID NO: 8973 - DNA, 22 bp, Artificial Sequence
  chemically synthesized
ggctcaagccatcctcccacct

SEQ ID NO: 8974 - DNA, 22 bp, Artificial Sequence
  chemically synthesized
aagccatcctcccacctcagcc

SEQ ID NO: 8975 - DNA, 22 bp, Artificial Sequence
  chemically synthesized
ccacctcagcctcccaagtagt

SEQ ID NO: 8976 - DNA, 22 bp, Artificial Sequence
  chemically synthesized
agcctcccaagtagttaggact

SEQ ID NO: 8977 - DNA, 22 bp, Artificial Sequence
  chemically synthesized
ccaagtagttaggacttacagg

SEQ ID NO: 8978 - DNA, 22 bp, Artificial Sequence
  chemically synthesized
ggacttacaggtgtgcaccact

SEQ ID NO: 8979 - DNA, 22 bp, Artificial Sequence
  chemically synthesized
acaggtgtgcaccactgtgcct

SEQ ID NO: 8980 - DNA, 22 bp, Artificial Sequence
  chemically synthesized
caggtgtgcaccactgtgcctg

SEQ ID NO: 8981 - DNA, 22 bp, Artificial Sequence
  chemically synthesized
tgcctggcaaattaaaaaaaat

SEQ ID NO: 8982 - DNA, 22 bp, Artificial Sequence
  chemically synthesized
gcaaattaaaaaaaatttttta

SEQ ID NO: 8983 - DNA, 22 bp, Artificial Sequence
  chemically synthesized
aaaaaaattttttagagaaatg

SEQ ID NO: 8984 - DNA, 22 bp, Artificial Sequence
  chemically synthesized
tttagagaaatggggtcttgct

SEQ ID NO: 8985 - DNA, 22 bp, Artificial Sequence
  chemically synthesized
ttagagaaatggggtcttgcta

SEQ ID NO: 8986 - DNA, 22 bp, Artificial Sequence
  chemically synthesized
tagagaaatggggtcttgctat

SEQ ID NO: 8987 - DNA, 22 bp, Artificial Sequence
  chemically synthesized
agagaaatggggtcttgctatg

SEQ ID NO: 8988 - DNA, 22 bp, Artificial Sequence
  chemically synthesized
gagaaatggggtcttgctatgt

SEQ ID NO: 8989 - DNA, 22 bp, Artificial Sequence
  chemically synthesized
gctatgttgcccaggctggtgg

SEQ ID NO: 8990 - DNA, 22 bp, Artificial Sequence
  chemically synthesized
ctatgttgcccaggctggtggg

SEQ ID NO: 8991 - DNA, 22 bp, Artificial Sequence
  chemically synthesized
tgttgcccaggctggtgggaaa

SEQ ID NO: 8992 - DNA, 22 bp, Artificial Sequence
  chemically synthesized
cccaggctggtgggaaaagatt

SEQ ID NO: 8993 - DNA, 22 bp, Artificial Sequence
  chemically synthesized
gtgggaaaagattttaaggtga

SEQ ID NO: 8994 - DNA, 22 bp, Artificial Sequence
  chemically synthesized
taaggtgagagagatctgagca

SEQ ID NO: 8995 - DNA, 22 bp, Artificial Sequence
  chemically synthesized
aaggtgagagagatctgagcag

SEQ ID NO: 8996 - DNA, 22 bp, Artificial Sequence
  chemically synthesized
aggtgagagagatctgagcagt

SEQ ID NO: 8997 - DNA, 22 bp, Artificial Sequence
  chemically synthesized
agcagtgctaggcagaagggca

SEQ ID NO: 8998 - DNA, 22 bp, Artificial Sequence
  chemically synthesized
ggcagaagggcaagagccagga

SEQ ID NO: 8999 - DNA, 22 bp, Artificial Sequence
  chemically synthesized
gtggtggagccgggttccatgg

SEQ ID NO: 9000 - DNA, 22 bp, Artificial Sequence
  chemically synthesized
catggaggcaggaggagcaggg

SEQ ID NO: 9001 - DNA, 22 bp, Artificial Sequence
  chemically synthesized
ggagcttaggaaggggattggt

SEQ ID NO: 9002 - DNA, 22 bp, Artificial Sequence
  chemically synthesized
gagcttaggaaggggattggtt

SEQ ID NO: 9003 - DNA, 22 bp, Artificial Sequence
  chemically synthesized
aggaaggggattggttagctgg

SEQ ID NO: 9004 - DNA, 22 bp, Artificial Sequence
  chemically synthesized
ggaaggggattggttagctggg

SEQ ID NO: 9005 - DNA, 22 bp, Artificial Sequence
  chemically synthesized
gttagctgggctggaatgaggg

SEQ ID NO: 9006 - DNA, 22 bp, Artificial Sequence
  chemically synthesized
gctgggctggaatgagggactc

SEQ ID NO: 9007 - DNA, 22 bp, Artificial Sequence
  chemically synthesized
ggctggaatgagggactcctca

SEQ ID NO: 9008 - DNA, 22 bp, Artificial Sequence
  chemically synthesized
gaatgagggactcctcattcct

SEQ ID NO: 9009 - DNA, 22 bp, Artificial Sequence
  chemically synthesized
ctcattcctgaggctggccaac

SEQ ID NO: 9010 - DNA, 22 bp, Artificial Sequence
  chemically synthesized
attcctgaggctggccaaccga

SEQ ID NO: 9011 - DNA, 22 bp, Artificial Sequence
  chemically synthesized
ctgaggctggccaaccgaggga

SEQ ID NO: 9012 - DNA, 22 bp, Artificial Sequence
  chemically synthesized
aggctggccaaccgagggaggg

SEQ ID NO: 9013 - DNA, 22 bp, Artificial Sequence
  chemically synthesized
gccaaccgagggagggccggtg

SEQ ID NO: 9014 - DNA, 22 bp, Artificial Sequence
  chemically synthesized
ggcagggcagggcaggggacag

SEQ ID NO: 9015 - DNA, 22 bp, Artificial Sequence
  chemically synthesized
ccgaggaccactcaggaacacc

SEQ ID NO: 9016 - DNA, 22 bp, Artificial Sequence
  chemically synthesized
aggaacaccagtagcatctcct

SEQ ID NO: 9017 - DNA, 22 bp, Artificial Sequence
  chemically synthesized
ctctctctgtagggggctggct

SEQ ID NO: 9018 - DNA, 22 bp, Artificial Sequence
  chemically synthesized
tctctgtagggggctggctgga

SEQ ID NO: 9019 - DNA, 22 bp, Artificial Sequence
  chemically synthesized
tctgtagggggctggctggact

SEQ ID NO: 9020 - DNA, 22 bp, Artificial Sequence
  chemically synthesized
tgtagggggctggctggacttc

SEQ ID NO: 9021 - DNA, 22 bp, Artificial Sequence
  chemically synthesized
tagggggctggctggacttccc

SEQ ID NO: 9022 - DNA, 22 bp, Artificial Sequence
  chemically synthesized
gctggacttcccaccaggcggt

SEQ ID NO: 9023 - DNA, 22 bp, Artificial Sequence
  chemically synthesized
gacttcccaccaggcggtgtcc

SEQ ID NO: 9024 - DNA, 22 bp, Artificial Sequence
  chemically synthesized
cccaccaggcggtgtccccaca

SEQ ID NO: 9025 - DNA, 22 bp, Artificial Sequence
  chemically synthesized
ccaccaggcggtgtccccacag

SEQ ID NO: 9026 - DNA, 22 bp, Artificial Sequence
  chemically synthesized
tccgcctcactctcctctgcaa

SEQ ID NO: 9027 - DNA, 22 bp, Artificial Sequence
  chemically synthesized
actctcctctgcaactccagtg

SEQ ID NO: 9028 - DNA, 22 bp, Artificial Sequence
  chemically synthesized
tcctctgcaactccagtgccca

SEQ ID NO: 9029 - DNA, 22 bp, Artificial Sequence
  chemically synthesized
ctctgcaactccagtgcccaca

SEQ ID NO: 9030 - DNA, 22 bp, Artificial Sequence
  chemically synthesized
tgcaactccagtgcccacacgg

SEQ ID NO: 9031 - DNA, 22 bp, Artificial Sequence
  chemically synthesized
caactccagtgcccacacggca

SEQ ID NO: 9032 - DNA, 22 bp, Artificial Sequence
  chemically synthesized
cagtgcccacacggcacccggt

SEQ ID NO: 9033 - DNA, 22 bp, Artificial Sequence
  chemically synthesized
agagagaatacgggatgctgct

SEQ ID NO: 9034 - DNA, 22 bp, Artificial Sequence
  chemically synthesized
ctgaatcttctgagggtgacag

SEQ ID NO: 9035 - DNA, 22 bp, Artificial Sequence
  chemically synthesized
aatcttctgagggtgacagaat

SEQ ID NO: 9036 - DNA, 22 bp, Artificial Sequence
  chemically synthesized
ctgagggtgacagaatttagag

SEQ ID NO: 9037 - DNA, 22 bp, Artificial Sequence
  chemically synthesized
tgagggtgacagaatttagagt

SEQ ID NO: 9038 - DNA, 22 bp, Artificial Sequence
  chemically synthesized
agggtgacagaatttagagttt

SEQ ID NO: 9039 - DNA, 22 bp, Artificial Sequence
  chemically synthesized
agagtttgagcaggaggcttgg

SEQ ID NO: 9040 - DNA, 22 bp, Artificial Sequence
  chemically synthesized
gagtttgagcaggaggcttgga

SEQ ID NO: 9041 - DNA, 22 bp, Artificial Sequence
  chemically synthesized
gagcaggaggcttggagagagg

SEQ ID NO: 9042 - DNA, 22 bp, Artificial Sequence
  chemically synthesized
agcaggaggcttggagagaggc

SEQ ID NO: 9043 - DNA, 22 bp, Artificial Sequence
  chemically synthesized
ggagagaggccaggatttctga

SEQ ID NO: 9044 - DNA, 22 bp, Artificial Sequence
  chemically synthesized
gagagaggccaggatttctgaa

SEQ ID NO: 9045 - DNA, 22 bp, Artificial Sequence
  chemically synthesized
ctgaaattaatgggagagtgag

SEQ ID NO: 9046 - DNA, 22 bp, Artificial Sequence
  chemically synthesized
tgaaattaatgggagagtgagc

SEQ ID NO: 9047 - DNA, 22 bp, Artificial Sequence
  chemically synthesized
aaattaatgggagagtgagctc

SEQ ID NO: 9048 - DNA, 22 bp, Artificial Sequence
  chemically synthesized
atgggagagtgagctcacgcga

SEQ ID NO: 9049 - DNA, 22 bp, Artificial Sequence
  chemically synthesized
acgcgaatgggctgagggacac

SEQ ID NO: 9050 - DNA, 22 bp, Artificial Sequence
  chemically synthesized
agggacaccagtgagggaccgt

SEQ ID NO: 9051 - DNA, 22 bp, Artificial Sequence
  chemically synthesized
aagggatgtagcaaagtcaccg

SEQ ID NO: 9052 - DNA, 22 bp, Artificial Sequence
  chemically synthesized
ccctccagcagcccgggtggtg

SEQ ID NO: 9053 - DNA, 22 bp, Artificial Sequence
  chemically synthesized
cctccagcagcccgggtggtgg

SEQ ID NO: 9054 - DNA, 22 bp, Artificial Sequence
  chemically synthesized
cagcagcccgggtggtgggggc

SEQ ID NO: 9055 - DNA, 22 bp, Artificial Sequence
  chemically synthesized
ggggaacgtcatcatgggagct

SEQ ID NO: 9056 - DNA, 22 bp, Artificial Sequence
  chemically synthesized
acactgatcagctgctcaccgg

SEQ ID NO: 9057 - DNA, 22 bp, Artificial Sequence
  chemically synthesized
atcagctgctcaccggggccca

SEQ ID NO: 9058 - DNA, 22 bp, Artificial Sequence
  chemically synthesized
ctcaccggggcccatcttccac

SEQ ID NO: 9059 - DNA, 22 bp, Artificial Sequence
  chemically synthesized
accggggcccatcttccacttg

SEQ ID NO: 9060 - DNA, 22 bp, Artificial Sequence
  chemically synthesized
ccacttgtctcagcacttgatt

SEQ ID NO: 9061 - DNA, 22 bp, Artificial Sequence
  chemically synthesized
cacttgtctcagcacttgattt

SEQ ID NO: 9062 - DNA, 22 bp, Artificial Sequence
  chemically synthesized
gtctcagcacttgatttttttc

SEQ ID NO: 9063 - DNA, 22 bp, Artificial Sequence
  chemically synthesized
tctcagcacttgatttttttct

SEQ ID NO: 9064 - DNA, 22 bp, Artificial Sequence
  chemically synthesized
agcacttgatttttttctgcta

SEQ ID NO: 9065 - DNA, 22 bp, Artificial Sequence
  chemically synthesized
gatttttttctgctaccccctt

SEQ ID NO: 9066 - DNA, 22 bp, Artificial Sequence
  chemically synthesized
atttttttctgctacccccttt

SEQ ID NO: 9067 - DNA, 22 bp, Artificial Sequence
  chemically synthesized
ttttctgctaccccctttttct

SEQ ID NO: 9068 - DNA, 22 bp, Artificial Sequence
  chemically synthesized
tttctgctaccccctttttctt

SEQ ID NO: 9069 - DNA, 22 bp, Artificial Sequence
  chemically synthesized
ttctgctaccccctttttcttt

SEQ ID NO: 9070 - DNA, 22 bp, Artificial Sequence
  chemically synthesized
tctgctaccccctttttctttt

SEQ ID NO: 9071 - DNA, 22 bp, Artificial Sequence
  chemically synthesized
ctgctaccccctttttctttta

SEQ ID NO: 9072 - DNA, 22 bp, Artificial Sequence
  chemically synthesized
tgctaccccctttttcttttaa

SEQ ID NO: 9073 - DNA, 22 bp, Artificial Sequence
  chemically synthesized
ctaccccctttttcttttaaag

SEQ ID NO: 9074 - DNA, 22 bp, Artificial Sequence
  chemically synthesized
ccccctttttcttttaaagatt

SEQ ID NO: 9075 - DNA, 22 bp, Artificial Sequence
  chemically synthesized
tttcttttaaagatttcaatta

SEQ ID NO: 9076 - DNA, 22 bp, Artificial Sequence
  chemically synthesized
ttcttttaaagatttcaattat

SEQ ID NO: 9077 - DNA, 22 bp, Artificial Sequence
  chemically synthesized
tcttttaaagatttcaattatg

SEQ ID NO: 9078 - DNA, 22 bp, Artificial Sequence
  chemically synthesized
cttttaaagatttcaattatgc

SEQ ID NO: 9079 - DNA, 22 bp, Artificial Sequence
  chemically synthesized
ttttaaagatttcaattatgca

SEQ ID NO: 9080 - DNA, 22 bp, Artificial Sequence
  chemically synthesized
ttaaagatttcaattatgcatg

SEQ ID NO: 9081 - DNA, 22 bp, Artificial Sequence
  chemically synthesized
taaagatttcaattatgcatgt

SEQ ID NO: 9082 - DNA, 22 bp, Artificial Sequence
  chemically synthesized
aaagatttcaattatgcatgta

SEQ ID NO: 9083 - DNA, 22 bp, Artificial Sequence
  chemically synthesized
aagatttcaattatgcatgtat

SEQ ID NO: 9084 - DNA, 22 bp, Artificial Sequence
  chemically synthesized
caattatgcatgtattaagggt

SEQ ID NO: 9085 - DNA, 22 bp, Artificial Sequence
  chemically synthesized
aattatgcatgtattaagggtc

SEQ ID NO: 9086 - DNA, 22 bp, Artificial Sequence
  chemically synthesized
tgcatgtattaagggtcccaca

SEQ ID NO: 9087 - DNA, 22 bp, Artificial Sequence
  chemically synthesized
agggtcccacagctcactcatt

SEQ ID NO: 9088 - DNA, 22 bp, Artificial Sequence
  chemically synthesized
actcattctctttccatttttt

SEQ ID NO: 9089 - DNA, 22 bp, Artificial Sequence
  chemically synthesized
attctctttccattttttaatt

SEQ ID NO: 9090 - DNA, 22 bp, Artificial Sequence
  chemically synthesized
tctttccattttttaattcttt

SEQ ID NO: 9091 - DNA, 22 bp, Artificial Sequence
  chemically synthesized
tttccattttttaattcttttt

SEQ ID NO: 9092 - DNA, 22 bp, Artificial Sequence
  chemically synthesized
tccattttttaattcttttttc

SEQ ID NO: 9093 - DNA, 22 bp, Artificial Sequence
  chemically synthesized
ccattttttaattcttttttct

SEQ ID NO: 9094 - DNA, 22 bp, Artificial Sequence
  chemically synthesized
cattttttaattcttttttctc

SEQ ID NO: 9095 - DNA, 22 bp, Artificial Sequence
  chemically synthesized
tttaattcttttttctcccagt

SEQ ID NO: 9096 - DNA, 22 bp, Artificial Sequence
  chemically synthesized
ttaattcttttttctcccagtg

SEQ ID NO: 9097 - DNA, 22 bp, Artificial Sequence
  chemically synthesized
taattcttttttctcccagtgt

SEQ ID NO: 9098 - DNA, 22 bp, Artificial Sequence
  chemically synthesized
aattcttttttctcccagtgtt

SEQ ID NO: 9099 - DNA, 22 bp, Artificial Sequence
  chemically synthesized
attcttttttctcccagtgttt

SEQ ID NO: 9100 - DNA, 22 bp, Artificial Sequence
  chemically synthesized
ttttttctcccagtgtttcatt

SEQ ID NO: 9101 - DNA, 22 bp, Artificial Sequence
  chemically synthesized
ttttctcccagtgtttcatttt

SEQ ID NO: 9102 - DNA, 22 bp, Artificial Sequence
  chemically synthesized
tttctcccagtgtttcatttta

SEQ ID NO: 9103 - DNA, 22 bp, Artificial Sequence
  chemically synthesized
ttctcccagtgtttcattttat

SEQ ID NO: 9104 - DNA, 22 bp, Artificial Sequence
  chemically synthesized
tctcccagtgtttcattttata

SEQ ID NO: 9105 - DNA, 22 bp, Artificial Sequence
  chemically synthesized
ctcccagtgtttcattttatag

SEQ ID NO: 9106 - DNA, 22 bp, Artificial Sequence
  chemically synthesized
tcccagtgtttcattttataga

SEQ ID NO: 9107 - DNA, 22 bp, Artificial Sequence
  chemically synthesized
ccagtgtttcattttatagagt

SEQ ID NO: 9108 - DNA, 22 bp, Artificial Sequence
  chemically synthesized
cattttatagagttattgctgt

SEQ ID NO: 9109 - DNA, 22 bp, Artificial Sequence
  chemically synthesized
attttatagagttattgctgtt

SEQ ID NO: 9110 - DNA, 22 bp, Artificial Sequence
  chemically synthesized
tatagagttattgctgttcatt

SEQ ID NO: 9111 - DNA, 22 bp, Artificial Sequence
  chemically synthesized
atagagttattgctgttcatta

SEQ ID NO: 9112 - DNA, 22 bp, Artificial Sequence
  chemically synthesized
tagagttattgctgttcattaa

SEQ ID NO: 9113 - DNA, 22 bp, Artificial Sequence
  chemically synthesized
ttgctgttcattaagttaacta

SEQ ID NO: 9114 - DNA, 22 bp, Artificial Sequence
  chemically synthesized
ctgttcattaagttaactaaaa

SEQ ID NO: 9115 - DNA, 22 bp, Artificial Sequence
  chemically synthesized
ttcattaagttaactaaaattt

SEQ ID NO: 9116 - DNA, 22 bp, Artificial Sequence
  chemically synthesized
attaagttaactaaaattttcc

SEQ ID NO: 9117 - DNA, 22 bp, Artificial Sequence
  chemically synthesized
agttaactaaaattttcccctt

SEQ ID NO: 9118 - DNA, 22 bp, Artificial Sequence
  chemically synthesized
actaaaattttccccttcccct

SEQ ID NO: 9119 - DNA, 22 bp, Artificial Sequence
  chemically synthesized
aaattttccccttcccctcccc

SEQ ID NO: 9120 - DNA, 22 bp, Artificial Sequence
  chemically synthesized
tccccttcccctccccctcccc

SEQ ID NO: 9121 - DNA, 22 bp, Artificial Sequence
  chemically synthesized
ccccttcccctccccctcccct

SEQ ID NO: 9122 - DNA, 22 bp, Artificial Sequence
  chemically synthesized
cccttcccctccccctcccctc

SEQ ID NO: 9123 - DNA, 22 bp, Artificial Sequence
  chemically synthesized
cccctccccctcccctcccctc

SEQ ID NO: 9124 - DNA, 22 bp, Artificial Sequence
  chemically synthesized
ccctccccctcccctcccctcc

SEQ ID NO: 9125 - DNA, 22 bp, Artificial Sequence
  chemically synthesized
cccctcccctcccctcctttcc

SEQ ID NO: 9126 - DNA, 22 bp, Artificial Sequence
  chemically synthesized
ccctcccctcctttccttccct

SEQ ID NO: 9127 - DNA, 22 bp, Artificial Sequence
  chemically synthesized
ccctcctttccttccctcgctt

SEQ ID NO: 9128 - DNA, 22 bp, Artificial Sequence
  chemically synthesized
ctttccttccctcgcttcccct

SEQ ID NO: 9129 - DNA, 22 bp, Artificial Sequence
  chemically synthesized
tccttccctcgcttcccctccc

SEQ ID NO: 9130 - DNA, 22 bp, Artificial Sequence
  chemically synthesized
ccttccctcgcttcccctcccc

SEQ ID NO: 9131 - DNA, 22 bp, Artificial Sequence
  chemically synthesized
cttccctcgcttcccctcccct

SEQ ID NO: 9132 - DNA, 22 bp, Artificial Sequence
  chemically synthesized
ccctcgcttcccctcccctctc

SEQ ID NO: 9133 - DNA, 22 bp, Artificial Sequence
  chemically synthesized
cctcgcttcccctcccctctct

SEQ ID NO: 9134 - DNA, 22 bp, Artificial Sequence
  chemically synthesized
gcttcccctcccctctctctct

SEQ ID NO: 9135 - DNA, 22 bp, Artificial Sequence
  chemically synthesized
cccctcccctctctctctctca

SEQ ID NO: 9136 - DNA, 22 bp, Artificial Sequence
  chemically synthesized
ccctcccctctctctctctcat

SEQ ID NO: 9137 - DNA, 22 bp, Artificial Sequence
  chemically synthesized
ccctctctctctctcatctcac

SEQ ID NO: 9138 - DNA, 22 bp, Artificial Sequence
  chemically synthesized
tctctctctcatctcactctgt

SEQ ID NO: 9139 - DNA, 22 bp, Artificial Sequence
  chemically synthesized
tctctctcatctcactctgttg

SEQ ID NO: 9140 - DNA, 22 bp, Artificial Sequence
  chemically synthesized
tctctcatctcactctgttgcc

SEQ ID NO: 9141 - DNA, 22 bp, Artificial Sequence
  chemically synthesized
tctcatctcactctgttgccca

SEQ ID NO: 9142 - DNA, 22 bp, Artificial Sequence
  chemically synthesized
tcatctcactctgttgcccagg

SEQ ID NO: 9143 - DNA, 22 bp, Artificial Sequence
  chemically synthesized
atctcactctgttgcccaggct

SEQ ID NO: 9144 - DNA, 22 bp, Artificial Sequence
  chemically synthesized
actctgttgcccaggctggaat

SEQ ID NO: 9145 - DNA, 22 bp, Artificial Sequence
  chemically synthesized
tgttgcccaggctggaatgcag

SEQ ID NO: 9146 - DNA, 22 bp, Artificial Sequence
  chemically synthesized
ttgcccaggctggaatgcagta

SEQ ID NO: 9147 - DNA, 22 bp, Artificial Sequence
  chemically synthesized
cccaggctggaatgcagtagct

SEQ ID NO: 9148 - DNA, 22 bp, Artificial Sequence
  chemically synthesized
gaatgcagtagcttgtcacaac

SEQ ID NO: 9149 - DNA, 22 bp, Artificial Sequence
  chemically synthesized
gtcacaactcactgtggcctcc

SEQ ID NO: 9150 - DNA, 22 bp, Artificial Sequence
  chemically synthesized
tcacaactcactgtggcctcca

SEQ ID NO: 9151 - DNA, 22 bp, Artificial Sequence
  chemically synthesized
actgtggcctccacctcctggg

SEQ ID NO: 9152 - DNA, 22 bp, Artificial Sequence
  chemically synthesized
tggcctccacctcctgggctca

SEQ ID NO: 9153 - DNA, 22 bp, Artificial Sequence
  chemically synthesized
cacctcctgggctcaggcgatc

SEQ ID NO: 9154 - DNA, 22 bp, Artificial Sequence
  chemically synthesized
ctgggctcaggcgatccttcca

SEQ ID NO: 9155 - DNA, 22 bp, Artificial Sequence
  chemically synthesized
ggctcaggcgatccttccactt

SEQ ID NO: 9156 - DNA, 22 bp, Artificial Sequence
  chemically synthesized
aggcgatccttccacttcagcc

SEQ ID NO: 9157 - DNA, 22 bp, Artificial Sequence
  chemically synthesized
ccacttcagcctcccaggtagc

SEQ ID NO: 9158 - DNA, 22 bp, Artificial Sequence
  chemically synthesized
cacttcagcctcccaggtagct

SEQ ID NO: 9159 - DNA, 22 bp, Artificial Sequence
  chemically synthesized
cagcctcccaggtagctgggac

SEQ ID NO: 9160 - DNA, 22 bp, Artificial Sequence
  chemically synthesized
agcctcccaggtagctgggact

SEQ ID NO: 9161 - DNA, 22 bp, Artificial Sequence
  chemically synthesized
ccaggtagctgggactataggc

SEQ ID NO: 9162 - DNA, 22 bp, Artificial Sequence
  chemically synthesized
ggactataggcatgtggcacca

SEQ ID NO: 9163 - DNA, 22 bp, Artificial Sequence
  chemically synthesized
taggcatgtggcaccacacctg

SEQ ID NO: 9164 - DNA, 22 bp, Artificial Sequence
  chemically synthesized
gctaattaaaaatttttttttg

SEQ ID NO: 9165 - DNA, 22 bp, Artificial Sequence
  chemically synthesized
attaaaaatttttttttgtaga

SEQ ID NO: 9166 - DNA, 22 bp, Artificial Sequence
  chemically synthesized
aaaatttttttttgtagagacg

SEQ ID NO: 9167 - DNA, 22 bp, Artificial Sequence
  chemically synthesized
ttttttgtagagacggttttgc

SEQ ID NO: 9168 - DNA, 22 bp, Artificial Sequence
  chemically synthesized
tttttgtagagacggttttgcc

SEQ ID NO: 9169 - DNA, 22 bp, Artificial Sequence
  chemically synthesized
ttttgtagagacggttttgcca

SEQ ID NO: 9170 - DNA, 22 bp, Artificial Sequence
  chemically synthesized
tttgtagagacggttttgccat

SEQ ID NO: 9171 - DNA, 22 bp, Artificial Sequence
  chemically synthesized
ttgtagagacggttttgccatg

SEQ ID NO: 9172 - DNA, 22 bp, Artificial Sequence
  chemically synthesized
tgtagagacggttttgccatgt

SEQ ID NO: 9173 - DNA, 22 bp, Artificial Sequence
  chemically synthesized
gtagagacggttttgccatgta

SEQ ID NO: 9174 - DNA, 22 bp, Artificial Sequence
  chemically synthesized
tagagacggttttgccatgtag

SEQ ID NO: 9175 - DNA, 22 bp, Artificial Sequence
  chemically synthesized
tgccatgtagaggggttttgcc

SEQ ID NO: 9176 - DNA, 22 bp, Artificial Sequence
  chemically synthesized
gccatgtagaggggttttgcca

SEQ ID NO: 9177 - DNA, 22 bp, Artificial Sequence
  chemically synthesized
ccatgtagaggggttttgccat

SEQ ID NO: 9178 - DNA, 22 bp, Artificial Sequence
  chemically synthesized
tgccatgctgcccagactagtc

SEQ ID NO: 9179 - DNA, 22 bp, Artificial Sequence
  chemically synthesized
gccatgctgcccagactagtct

SEQ ID NO: 9180 - DNA, 22 bp, Artificial Sequence
  chemically synthesized
ccatgctgcccagactagtctt

SEQ ID NO: 9181 - DNA, 22 bp, Artificial Sequence
  chemically synthesized
cccagactagtcttgagctcct

SEQ ID NO: 9182 - DNA, 22 bp, Artificial Sequence
  chemically synthesized
gtcttgagctcctgggctcaag

SEQ ID NO: 9183 - DNA, 22 bp, Artificial Sequence
  chemically synthesized
gagctcctgggctcaagtgatt

SEQ ID NO: 9184 - DNA, 22 bp, Artificial Sequence
  chemically synthesized
agctcctgggctcaagtgattc

SEQ ID NO: 9185 - DNA, 22 bp, Artificial Sequence
  chemically synthesized
ctgggctcaagtgattcccccc

SEQ ID NO: 9186 - DNA, 22 bp, Artificial Sequence
  chemically synthesized
ggctcaagtgattccccccgtg

SEQ ID NO: 9187 - DNA, 22 bp, Artificial Sequence
  chemically synthesized
aagtgattccccccgtgtcgac

SEQ ID NO: 9188 - DNA, 22 bp, Artificial Sequence
  chemically synthesized
cccccgtgtcgacctcccaaag

SEQ ID NO: 9189 - DNA, 22 bp, Artificial Sequence
  chemically synthesized
ccaaagtgctgggattacagat

SEQ ID NO: 9190 - DNA, 22 bp, Artificial Sequence
  chemically synthesized
ggattacagatgtgatccacag

SEQ ID NO: 9191 - DNA, 22 bp, Artificial Sequence
  chemically synthesized
cagatgtgatccacagtgcctg

SEQ ID NO: 9192 - DNA, 22 bp, Artificial Sequence
  chemically synthesized
gccctaaatttttcttacgcat

SEQ ID NO: 9193 - DNA, 22 bp, Artificial Sequence
  chemically synthesized
aatttttcttacgcatttctca

SEQ ID NO: 9194 - DNA, 22 bp, Artificial Sequence
  chemically synthesized
ttcttacgcatttctcatcttc

SEQ ID NO: 9195 - DNA, 22 bp, Artificial Sequence
  chemically synthesized
tcttacgcatttctcatcttcc

SEQ ID NO: 9196 - DNA, 22 bp, Artificial Sequence
  chemically synthesized
cttacgcatttctcatcttcca

SEQ ID NO: 9197 - DNA, 22 bp, Artificial Sequence
  chemically synthesized
ttacgcatttctcatcttccat

SEQ ID NO: 9198 - DNA, 22 bp, Artificial Sequence
  chemically synthesized
acgcatttctcatcttccatta

SEQ ID NO: 9199 - DNA, 22 bp, Artificial Sequence
  chemically synthesized
cgcatttctcatcttccattat

SEQ ID NO: 9200 - DNA, 22 bp, Artificial Sequence
  chemically synthesized
ctcatcttccattatttccatc

SEQ ID NO: 9201 - DNA, 22 bp, Artificial Sequence
  chemically synthesized
tcatcttccattatttccatcc

SEQ ID NO: 9202 - DNA, 22 bp, Artificial Sequence
  chemically synthesized
atcttccattatttccatccag

SEQ ID NO: 9203 - DNA, 22 bp, Artificial Sequence
  chemically synthesized
ccattatttccatccagtgtgt

SEQ ID NO: 9204 - DNA, 22 bp, Artificial Sequence
  chemically synthesized
cattatttccatccagtgtgtt

SEQ ID NO: 9205 - DNA, 22 bp, Artificial Sequence
  chemically synthesized
tttccatccagtgtgttttttc

SEQ ID NO: 9206 - DNA, 22 bp, Artificial Sequence
  chemically synthesized
ccatccagtgtgttttttcttt

SEQ ID NO: 9207 - DNA, 22 bp, Artificial Sequence
  chemically synthesized
catccagtgtgttttttctttt

SEQ ID NO: 9208 - DNA, 22 bp, Artificial Sequence
  chemically synthesized
tttcttttctttcttttctttt

SEQ ID NO: 9209 - DNA, 22 bp, Artificial Sequence
  chemically synthesized
ttcttttctttcttttcttttt

SEQ ID NO: 9210 - DNA, 22 bp, Artificial Sequence
  chemically synthesized
tcttttctttcttttctttttt

SEQ ID NO: 9211 - DNA, 22 bp, Artificial Sequence
  chemically synthesized
cttttctttcttttcttttttt

SEQ ID NO: 9212 - DNA, 22 bp, Artificial Sequence
  chemically synthesized
ttttctttcttttctttttttt

SEQ ID NO: 9213 - DNA, 22 bp, Artificial Sequence
  chemically synthesized
ttctttcttttctttttttttt

SEQ ID NO: 9214 - DNA, 22 bp, Artificial Sequence
  chemically synthesized
tctttcttttcttttttttttt

SEQ ID NO: 9215 - DNA, 22 bp, Artificial Sequence
  chemically synthesized
ctttcttttctttttttttttt

SEQ ID NO: 9216 - DNA, 22 bp, Artificial Sequence
  chemically synthesized
tttcttttcttttttttttttt

SEQ ID NO: 9217 - DNA, 22 bp, Artificial Sequence
  chemically synthesized
tcttttcttttttttttttttg

SEQ ID NO: 9218 - DNA, 22 bp, Artificial Sequence
  chemically synthesized
cttttcttttttttttttttgg

SEQ ID NO: 9219 - DNA, 22 bp, Artificial Sequence
  chemically synthesized
ttttcttttttttttttttgga

SEQ ID NO: 9220 - DNA, 22 bp, Artificial Sequence
  chemically synthesized
ttcttttttttttttttggagg

SEQ ID NO: 9221 - DNA, 22 bp, Artificial Sequence
  chemically synthesized
tcttttttttttttttggaggc

SEQ ID NO: 9222 - DNA, 22 bp, Artificial Sequence
  chemically synthesized
cttttttttttttttggaggcg

SEQ ID NO: 9223 - DNA, 22 bp, Artificial Sequence
  chemically synthesized
ttttttttttttttggaggcgg

SEQ ID NO: 9224 - DNA, 22 bp, Artificial Sequence
  chemically synthesized
ttttttttttttggaggcggag

SEQ ID NO: 9225 - DNA, 22 bp, Artificial Sequence
  chemically synthesized
tttttttttttggaggcggagt

SEQ ID NO: 9226 - DNA, 22 bp, Artificial Sequence
  chemically synthesized
ttttttttttggaggcggagtc

SEQ ID NO: 9227 - DNA, 22 bp, Artificial Sequence
  chemically synthesized
tttttttttggaggcggagtct

SEQ ID NO: 9228 - DNA, 22 bp, Artificial Sequence
  chemically synthesized
ttttttttggaggcggagtctc

SEQ ID NO: 9229 - DNA, 22 bp, Artificial Sequence
  chemically synthesized
tttttttggaggcggagtctcg

SEQ ID NO: 9230 - DNA, 22 bp, Artificial Sequence
  chemically synthesized
ttttttggaggcggagtctcgc

SEQ ID NO: 9231 - DNA, 22 bp, Artificial Sequence
  chemically synthesized
tttttggaggcggagtctcgct

SEQ ID NO: 9232 - DNA, 22 bp, Artificial Sequence
  chemically synthesized
ttttggaggcggagtctcgctc

SEQ ID NO: 9233 - DNA, 22 bp, Artificial Sequence
  chemically synthesized
tttggaggcggagtctcgctct

SEQ ID NO: 9234 - DNA, 22 bp, Artificial Sequence
  chemically synthesized
ttggaggcggagtctcgctctg

SEQ ID NO: 9235 - DNA, 22 bp, Artificial Sequence
  chemically synthesized
tggaggcggagtctcgctctgt

SEQ ID NO: 9236 - DNA, 22 bp, Artificial Sequence
  chemically synthesized
ggaggcggagtctcgctctgtt

SEQ ID NO: 9237 - DNA, 22 bp, Artificial Sequence
  chemically synthesized
gaggcggagtctcgctctgttg

SEQ ID NO: 9238 - DNA, 22 bp, Artificial Sequence
  chemically synthesized
gctctgttgcccaggccggagt

SEQ ID NO: 9239 - DNA, 22 bp, Artificial Sequence
  chemically synthesized
tgttgcccaggccggagtgcag

SEQ ID NO: 9240 - DNA, 22 bp, Artificial Sequence
  chemically synthesized
ttgcccaggccggagtgcagtg

SEQ ID NO: 9241 - DNA, 22 bp, Artificial Sequence
  chemically synthesized
cccaggccggagtgcagtggcg

SEQ ID NO: 9242 - DNA, 22 bp, Artificial Sequence
  chemically synthesized
ggctcactgcaagctctgcctc

SEQ ID NO: 9243 - DNA, 22 bp, Artificial Sequence
  chemically synthesized
gctcactgcaagctctgcctcc

SEQ ID NO: 9244 - DNA, 22 bp, Artificial Sequence
  chemically synthesized
actgcaagctctgcctcccggg

SEQ ID NO: 9245 - DNA, 22 bp, Artificial Sequence
  chemically synthesized
caagctctgcctcccgggttca

SEQ ID NO: 9246 - DNA, 22 bp, Artificial Sequence
  chemically synthesized
tgcctcccgggttcatgccatt

SEQ ID NO: 9247 - DNA, 22 bp, Artificial Sequence
  chemically synthesized
cctcccgggttcatgccattct

SEQ ID NO: 9248 - DNA, 22 bp, Artificial Sequence
  chemically synthesized
ccgggttcatgccattctcctg

SEQ ID NO: 9249 - DNA, 22 bp, Artificial Sequence
  chemically synthesized
atgccattctcctgcctcagcc

SEQ ID NO: 9250 - DNA, 22 bp, Artificial Sequence
  chemically synthesized
tcctgcctcagcctcccgagta

SEQ ID NO: 9251 - DNA, 22 bp, Artificial Sequence
  chemically synthesized
ctgcctcagcctcccgagtagc

SEQ ID NO: 9252 - DNA, 22 bp, Artificial Sequence
  chemically synthesized
cctcagcctcccgagtagctgg

SEQ ID NO: 9253 - DNA, 22 bp, Artificial Sequence
  chemically synthesized
agcctcccgagtagctgggact

SEQ ID NO: 9254 - DNA, 22 bp, Artificial Sequence
  chemically synthesized
ccgagtagctgggactacaggc

SEQ ID NO: 9255 - DNA, 22 bp, Artificial Sequence
  chemically synthesized
ggactacaggcgcctgccacca

SEQ ID NO: 9256 - DNA, 22 bp, Artificial Sequence
  chemically synthesized
caggcgcctgccaccacgtctg

SEQ ID NO: 9257 - DNA, 22 bp, Artificial Sequence
  chemically synthesized
ccaccacgtctggctaattttt

SEQ ID NO: 9258 - DNA, 22 bp, Artificial Sequence
  chemically synthesized
gctaattttttgtatttttagt

SEQ ID NO: 9259 - DNA, 22 bp, Artificial Sequence
  chemically synthesized
attttttgtatttttagtagag

SEQ ID NO: 9260 - DNA, 22 bp, Artificial Sequence
  chemically synthesized
tttgtatttttagtagagatgg

SEQ ID NO: 9261 - DNA, 22 bp, Artificial Sequence
  chemically synthesized
ttgtatttttagtagagatggg

SEQ ID NO: 9262 - DNA, 22 bp, Artificial Sequence
  chemically synthesized
tgtatttttagtagagatgggg

SEQ ID NO: 9263 - DNA, 22 bp, Artificial Sequence
  chemically synthesized
gtatttttagtagagatggggt

SEQ ID NO: 9264 - DNA, 22 bp, Artificial Sequence
  chemically synthesized
tatttttagtagagatggggtt

SEQ ID NO: 9265 - DNA, 22 bp, Artificial Sequence
  chemically synthesized
ttagtagagatggggtttcacc

SEQ ID NO: 9266 - DNA, 22 bp, Artificial Sequence
  chemically synthesized
tagtagagatggggtttcacca

SEQ ID NO: 9267 - DNA, 22 bp, Artificial Sequence
  chemically synthesized
agtagagatggggtttcaccat

SEQ ID NO: 9268 - DNA, 22 bp, Artificial Sequence
  chemically synthesized
gtagagatggggtttcaccatg

SEQ ID NO: 9269 - DNA, 22 bp, Artificial Sequence
  chemically synthesized
caccatgttagccaggatggtg

SEQ ID NO: 9270 - DNA, 22 bp, Artificial Sequence
  chemically synthesized
accatgttagccaggatggtgt

SEQ ID NO: 9271 - DNA, 22 bp, Artificial Sequence
  chemically synthesized
gccaggatggtgtcgatctcct

SEQ ID NO: 9272 - DNA, 22 bp, Artificial Sequence
  chemically synthesized
ctgacctcatgatctgcccgcc

SEQ ID NO: 9273 - DNA, 22 bp, Artificial Sequence
  chemically synthesized
acctcatgatctgcccgccttg

SEQ ID NO: 9274 - DNA, 22 bp, Artificial Sequence
  chemically synthesized
atgatctgcccgccttggcctc

SEQ ID NO: 9275 - DNA, 22 bp, Artificial Sequence
  chemically synthesized
cccgccttggcctcccacagtg

SEQ ID NO: 9276 - DNA, 22 bp, Artificial Sequence
  chemically synthesized
ggcctcccacagtgctgggatt

SEQ ID NO: 9277 - DNA, 22 bp, Artificial Sequence
  chemically synthesized
gcctcccacagtgctgggattc

SEQ ID NO: 9278 - DNA, 22 bp, Artificial Sequence
  chemically synthesized
ccacagtgctgggattccaggc

SEQ ID NO: 9279 - DNA, 22 bp, Artificial Sequence
  chemically synthesized
ggattccaggcgtgagccacgg

SEQ ID NO: 9280 - DNA, 22 bp, Artificial Sequence
  chemically synthesized
caggcgtgagccacggcgcctg

SEQ ID NO: 9281 - DNA, 22 bp, Artificial Sequence
  chemically synthesized
gccagtgtgttttttcatttca

SEQ ID NO: 9282 - DNA, 22 bp, Artificial Sequence
  chemically synthesized
tttcatttcagacattgtagtt

SEQ ID NO: 9283 - DNA, 22 bp, Artificial Sequence
  chemically synthesized
ttcatttcagacattgtagttt

SEQ ID NO: 9284 - DNA, 22 bp, Artificial Sequence
  chemically synthesized
tcatttcagacattgtagtttt

SEQ ID NO: 9285 - DNA, 22 bp, Artificial Sequence
  chemically synthesized
catttcagacattgtagttttt

SEQ ID NO: 9286 - DNA, 22 bp, Artificial Sequence
  chemically synthesized
atttcagacattgtagttttta

SEQ ID NO: 9287 - DNA, 22 bp, Artificial Sequence
  chemically synthesized
cagacattgtagtttttatctc

SEQ ID NO: 9288 - DNA, 22 bp, Artificial Sequence
  chemically synthesized
agacattgtagtttttatctct

SEQ ID NO: 9289 - DNA, 22 bp, Artificial Sequence
  chemically synthesized
tagtttttatctctagaagttc

SEQ ID NO: 9290 - DNA, 22 bp, Artificial Sequence
  chemically synthesized
ttatctctagaagttcacctgg

SEQ ID NO: 9291 - DNA, 22 bp, Artificial Sequence
  chemically synthesized
tatctctagaagttcacctggg

SEQ ID NO: 9292 - DNA, 22 bp, Artificial Sequence
  chemically synthesized
atctctagaagttcacctgggg

SEQ ID NO: 9293 - DNA, 22 bp, Artificial Sequence
  chemically synthesized
tctctagaagttcacctgggga

SEQ ID NO: 9294 - DNA, 22 bp, Artificial Sequence
  chemically synthesized
tagaagttcacctggggactct

SEQ ID NO: 9295 - DNA, 22 bp, Artificial Sequence
  chemically synthesized
gaagttcacctggggactctta

SEQ ID NO: 9296 - DNA, 22 bp, Artificial Sequence
  chemically synthesized
acctggggactcttaaatatcc

SEQ ID NO: 9297 - DNA, 22 bp, Artificial Sequence
  chemically synthesized
gggactcttaaatatcctccac

SEQ ID NO: 9298 - DNA, 22 bp, Artificial Sequence
  chemically synthesized
ttaaatatcctccacaattcta

SEQ ID NO: 9299 - DNA, 22 bp, Artificial Sequence
  chemically synthesized
aaatatcctccacaattctact

SEQ ID NO: 9300 - DNA, 22 bp, Artificial Sequence
  chemically synthesized
aatatcctccacaattctactt

SEQ ID NO: 9301 - DNA, 22 bp, Artificial Sequence
  chemically synthesized
cacaattctacttaattttttg

SEQ ID NO: 9302 - DNA, 22 bp, Artificial Sequence
  chemically synthesized
tacttaattttttgaacataat

SEQ ID NO: 9303 - DNA, 22 bp, Artificial Sequence
  chemically synthesized
cttaattttttgaacataatgg

SEQ ID NO: 9304 - DNA, 22 bp, Artificial Sequence
  chemically synthesized
aattttttgaacataatgggat

SEQ ID NO: 9305 - DNA, 22 bp, Artificial Sequence
  chemically synthesized
attttttgaacataatgggata

SEQ ID NO: 9306 - DNA, 22 bp, Artificial Sequence
  chemically synthesized
tttgaacataatgggatatggc

SEQ ID NO: 9307 - DNA, 22 bp, Artificial Sequence
  chemically synthesized
ttgaacataatgggatatggct

SEQ ID NO: 9308 - DNA, 22 bp, Artificial Sequence
  chemically synthesized
tgaacataatgggatatggcta

SEQ ID NO: 9309 - DNA, 22 bp, Artificial Sequence
  chemically synthesized
gaacataatgggatatggctat

SEQ ID NO: 9310 - DNA, 22 bp, Artificial Sequence
  chemically synthesized
aacataatgggatatggctata

SEQ ID NO: 9311 - DNA, 22 bp, Artificial Sequence
  chemically synthesized
taatatctgttttaccatcctt

SEQ ID NO: 9312 - DNA, 22 bp, Artificial Sequence
  chemically synthesized
ttttaccatccttgcctgctaa

SEQ ID NO: 9313 - DNA, 22 bp, Artificial Sequence
  chemically synthesized
taccatccttgcctgctaattc

SEQ ID NO: 9314 - DNA, 22 bp, Artificial Sequence
  chemically synthesized
accatccttgcctgctaattct

SEQ ID NO: 9315 - DNA, 22 bp, Artificial Sequence
  chemically synthesized
ccatccttgcctgctaattcta

SEQ ID NO: 9316 - DNA, 22 bp, Artificial Sequence
  chemically synthesized
gcctgctaattctagcatccgt

SEQ ID NO: 9317 - DNA, 22 bp, Artificial Sequence
  chemically synthesized
cctgctaattctagcatccgtg

SEQ ID NO: 9318 - DNA, 22 bp, Artificial Sequence
  chemically synthesized
ctaattctagcatccgtgtcag

SEQ ID NO: 9319 - DNA, 22 bp, Artificial Sequence
  chemically synthesized
attctagcatccgtgtcagttc

SEQ ID NO: 9320 - DNA, 22 bp, Artificial Sequence
  chemically synthesized
tagcatccgtgtcagttctgga

SEQ ID NO: 9321 - DNA, 22 bp, Artificial Sequence
  chemically synthesized
gcatccgtgtcagttctggatc

SEQ ID NO: 9322 - DNA, 22 bp, Artificial Sequence
  chemically synthesized
tggatctcttttgatatttatg

SEQ ID NO: 9323 - DNA, 22 bp, Artificial Sequence
  chemically synthesized
gatctcttttgatatttatgaa

SEQ ID NO: 9324 - DNA, 22 bp, Artificial Sequence
  chemically synthesized
ttttgatatttatgaacctcct

SEQ ID NO: 9325 - DNA, 22 bp, Artificial Sequence
  chemically synthesized
ttgatatttatgaacctcctcg

SEQ ID NO: 9326 - DNA, 22 bp, Artificial Sequence
  chemically synthesized
tgatatttatgaacctcctcgt

SEQ ID NO: 9327 - DNA, 22 bp, Artificial Sequence
  chemically synthesized
gatatttatgaacctcctcgtt

SEQ ID NO: 9328 - DNA, 22 bp, Artificial Sequence
  chemically synthesized
atatttatgaacctcctcgtta

SEQ ID NO: 9329 - DNA, 22 bp, Artificial Sequence
  chemically synthesized
atgaacctcctcgttatgcatt

SEQ ID NO: 9330 - DNA, 22 bp, Artificial Sequence
  chemically synthesized
tgaacctcctcgttatgcattg

SEQ ID NO: 9331 - DNA, 22 bp, Artificial Sequence
  chemically synthesized
ctcgttatgcattgtgttttcc

SEQ ID NO: 9332 - DNA, 22 bp, Artificial Sequence
  chemically synthesized
gttatgcattgtgttttcccgt

SEQ ID NO: 9333 - DNA, 22 bp, Artificial Sequence
  chemically synthesized
tgcattgtgttttcccgtttca

SEQ ID NO: 9334 - DNA, 22 bp, Artificial Sequence
  chemically synthesized
tgttttcccgtttcattgcatg

SEQ ID NO: 9335 - DNA, 22 bp, Artificial Sequence
  chemically synthesized
tcccgtttcattgcatgccttg

SEQ ID NO: 9336 - DNA, 22 bp, Artificial Sequence
  chemically synthesized
cccgtttcattgcatgccttgt

SEQ ID NO: 9337 - DNA, 22 bp, Artificial Sequence
  chemically synthesized
ccgtttcattgcatgccttgta

SEQ ID NO: 9338 - DNA, 22 bp, Artificial Sequence
  chemically synthesized
cattgcatgccttgtaatcttt

SEQ ID NO: 9339 - DNA, 22 bp, Artificial Sequence
  chemically synthesized
attgcatgccttgtaatctttg

SEQ ID NO: 9340 - DNA, 22 bp, Artificial Sequence
  chemically synthesized
catgccttgtaatctttgattg

SEQ ID NO: 9341 - DNA, 22 bp, Artificial Sequence
  chemically synthesized
gtaatctttgattggctgccag

SEQ ID NO: 9342 - DNA, 22 bp, Artificial Sequence
  chemically synthesized
taatctttgattggctgccaga

SEQ ID NO: 9343 - DNA, 22 bp, Artificial Sequence
  chemically synthesized
tgattggctgccagacattgtc

SEQ ID NO: 9344 - DNA, 22 bp, Artificial Sequence
  chemically synthesized
gattggctgccagacattgtca

SEQ ID NO: 9345 - DNA, 22 bp, Artificial Sequence
  chemically synthesized
attggctgccagacattgtcaa

SEQ ID NO: 9346 - DNA, 22 bp, Artificial Sequence
  chemically synthesized
gctgccagacattgtcaatttc

SEQ ID NO: 9347 - DNA, 22 bp, Artificial Sequence
  chemically synthesized
ccagacattgtcaatttcacct

SEQ ID NO: 9348 - DNA, 22 bp, Artificial Sequence
  chemically synthesized
tcaatttcaccttgttgggtgc

SEQ ID NO: 9349 - DNA, 22 bp, Artificial Sequence
  chemically synthesized
caccttgttgggtgctggatat

SEQ ID NO: 9350 - DNA, 22 bp, Artificial Sequence
  chemically synthesized
accttgttgggtgctggatatt

SEQ ID NO: 9351 - DNA, 22 bp, Artificial Sequence
  chemically synthesized
gttgggtgctggatatttttgt

SEQ ID NO: 9352 - DNA, 22 bp, Artificial Sequence
  chemically synthesized
ttgggtgctggatatttttgta

SEQ ID NO: 9353 - DNA, 22 bp, Artificial Sequence
  chemically synthesized
ggtgctggatatttttgtattc

SEQ ID NO: 9354 - DNA, 22 bp, Artificial Sequence
  chemically synthesized
gatatttttgtattcctctaaa

SEQ ID NO: 9355 - DNA, 22 bp, Artificial Sequence
  chemically synthesized
ttgtattcctctaaatgttctt

SEQ ID NO: 9356 - DNA, 22 bp, Artificial Sequence
  chemically synthesized
tgtattcctctaaatgttcttg

SEQ ID NO: 9357 - DNA, 22 bp, Artificial Sequence
  chemically synthesized
gtattcctctaaatgttcttga

SEQ ID NO: 9358 - DNA, 22 bp, Artificial Sequence
  chemically synthesized
tattcctctaaatgttcttgag

SEQ ID NO: 9359 - DNA, 22 bp, Artificial Sequence
  chemically synthesized
ctctaaatgttcttgagctttg

SEQ ID NO: 9360 - DNA, 22 bp, Artificial Sequence
  chemically synthesized
taaatgttcttgagctttgctc

SEQ ID NO: 9361 - DNA, 22 bp, Artificial Sequence
  chemically synthesized
aatgttcttgagctttgctccg

SEQ ID NO: 9362 - DNA, 22 bp, Artificial Sequence
  chemically synthesized
ttgagctttgctccgggatgca

SEQ ID NO: 9363 - DNA, 22 bp, Artificial Sequence
  chemically synthesized
gagctttgctccgggatgcagt

SEQ ID NO: 9364 - DNA, 22 bp, Artificial Sequence
  chemically synthesized
agctttgctccgggatgcagtt

SEQ ID NO: 9365 - DNA, 22 bp, Artificial Sequence
  chemically synthesized
tgctccgggatgcagttaagca

SEQ ID NO: 9366 - DNA, 22 bp, Artificial Sequence
  chemically synthesized
gctccgggatgcagttaagcaa

SEQ ID NO: 9367 - DNA, 22 bp, Artificial Sequence
  chemically synthesized
ctccgggatgcagttaagcaac

SEQ ID NO: 9368 - DNA, 22 bp, Artificial Sequence
  chemically synthesized
cgggatgcagttaagcaactta

SEQ ID NO: 9369 - DNA, 22 bp, Artificial Sequence
  chemically synthesized
agcaacttagagtcagtttgat

SEQ ID NO: 9370 - DNA, 22 bp, Artificial Sequence
  chemically synthesized
agagtcagtttgatcgtttgaa

SEQ ID NO: 9371 - DNA, 22 bp, Artificial Sequence
  chemically synthesized
gagtcagtttgatcgtttgaac

SEQ ID NO: 9372 - DNA, 22 bp, Artificial Sequence
  chemically synthesized
gatcgtttgaactcttaattgt

SEQ ID NO: 9373 - DNA, 22 bp, Artificial Sequence
  chemically synthesized
atcgtttgaactcttaattgtt

SEQ ID NO: 9374 - DNA, 22 bp, Artificial Sequence
  chemically synthesized
gaactcttaattgttttggtct

SEQ ID NO: 9375 - DNA, 22 bp, Artificial Sequence
  chemically synthesized
aactcttaattgttttggtctc

SEQ ID NO: 9376 - DNA, 22 bp, Artificial Sequence
  chemically synthesized
ttaattgttttggtctcctcgg

SEQ ID NO: 9377 - DNA, 22 bp, Artificial Sequence
  chemically synthesized
aattgttttggtctcctcggac

SEQ ID NO: 9378 - DNA, 22 bp, Artificial Sequence
  chemically synthesized
attgttttggtctcctcggact

SEQ ID NO: 9379 - DNA, 22 bp, Artificial Sequence
  chemically synthesized
ttttggtctcctcggactctca

SEQ ID NO: 9380 - DNA, 22 bp, Artificial Sequence
  chemically synthesized
tggtctcctcggactctcagct

SEQ ID NO: 9381 - DNA, 22 bp, Artificial Sequence
  chemically synthesized
ggtctcctcggactctcagctc

SEQ ID NO: 9382 - DNA, 22 bp, Artificial Sequence
  chemically synthesized
gtctcctcggactctcagctcc

SEQ ID NO: 9383 - DNA, 22 bp, Artificial Sequence
  chemically synthesized
ctcggactctcagctccatctc

SEQ ID NO: 9384 - DNA, 22 bp, Artificial Sequence
  chemically synthesized
ggactctcagctccatctcctc

SEQ ID NO: 9385 - DNA, 22 bp, Artificial Sequence
  chemically synthesized
tcagctccatctcctcaacgtg

SEQ ID NO: 9386 - DNA, 22 bp, Artificial Sequence
  chemically synthesized
agctccatctcctcaacgtggg

SEQ ID NO: 9387 - DNA, 22 bp, Artificial Sequence
  chemically synthesized
catctcctcaacgtggggagtc

SEQ ID NO: 9388 - DNA, 22 bp, Artificial Sequence
  chemically synthesized
ctcaacgtggggagtctcttgg

SEQ ID NO: 9389 - DNA, 22 bp, Artificial Sequence
  chemically synthesized
aacgtggggagtctcttgggct

SEQ ID NO: 9390 - DNA, 22 bp, Artificial Sequence
  chemically synthesized
ttgggctctgcctggacttccc

SEQ ID NO: 9391 - DNA, 22 bp, Artificial Sequence
  chemically synthesized
gggctctgcctggacttccctt

SEQ ID NO: 9392 - DNA, 22 bp, Artificial Sequence
  chemically synthesized
ggctctgcctggacttcccttt

SEQ ID NO: 9393 - DNA, 22 bp, Artificial Sequence
  chemically synthesized
tgcctggacttccctttcctgg

SEQ ID NO: 9394 - DNA, 22 bp, Artificial Sequence
  chemically synthesized
cctggacttccctttcctggcc

SEQ ID NO: 9395 - DNA, 22 bp, Artificial Sequence
  chemically synthesized
gacttccctttcctggcctgta

SEQ ID NO: 9396 - DNA, 22 bp, Artificial Sequence
  chemically synthesized
ccctttcctggcctgtaacctg

SEQ ID NO: 9397 - DNA, 22 bp, Artificial Sequence
  chemically synthesized
cctttcctggcctgtaacctgc

SEQ ID NO: 9398 - DNA, 22 bp, Artificial Sequence
  chemically synthesized
tcctggcctgtaacctgcagac

SEQ ID NO: 9399 - DNA, 22 bp, Artificial Sequence
  chemically synthesized
cctggcctgtaacctgcagact

SEQ ID NO: 9400 - DNA, 22 bp, Artificial Sequence
  chemically synthesized
ctggcctgtaacctgcagactc

SEQ ID NO: 9401 - DNA, 22 bp, Artificial Sequence
  chemically synthesized
gcctgtaacctgcagactctct

SEQ ID NO: 9402 - DNA, 22 bp, Artificial Sequence
  chemically synthesized
taacctgcagactctctccaaa

SEQ ID NO: 9403 - DNA, 22 bp, Artificial Sequence
  chemically synthesized
cagactctctccaaacagtaag

SEQ ID NO: 9404 - DNA, 22 bp, Artificial Sequence
  chemically synthesized
tctccaaacagtaagctggggt

SEQ ID NO: 9405 - DNA, 22 bp, Artificial Sequence
  chemically synthesized
tccaaacagtaagctggggtga

SEQ ID NO: 9406 - DNA, 22 bp, Artificial Sequence
  chemically synthesized
caaacagtaagctggggtgatc

SEQ ID NO: 9407 - DNA, 22 bp, Artificial Sequence
  chemically synthesized
gggtgatcggagggttcctgtt

SEQ ID NO: 9408 - DNA, 22 bp, Artificial Sequence
  chemically synthesized
ctgttgtttgcttcttatccct

SEQ ID NO: 9409 - DNA, 22 bp, Artificial Sequence
  chemically synthesized
ttgtttgcttcttatccctcag

SEQ ID NO: 9410 - DNA, 22 bp, Artificial Sequence
  chemically synthesized
tttgcttcttatccctcaggga

SEQ ID NO: 9411 - DNA, 22 bp, Artificial Sequence
  chemically synthesized
gcttcttatccctcagggatct

SEQ ID NO: 9412 - DNA, 22 bp, Artificial Sequence
  chemically synthesized
cttcttatccctcagggatctt

SEQ ID NO: 9413 - DNA, 22 bp, Artificial Sequence
  chemically synthesized
cttatccctcagggatctttac

SEQ ID NO: 9414 - DNA, 22 bp, Artificial Sequence
  chemically synthesized
ttatccctcagggatctttact

SEQ ID NO: 9415 - DNA, 22 bp, Artificial Sequence
  chemically synthesized
atccctcagggatctttactcc

SEQ ID NO: 9416 - DNA, 22 bp, Artificial Sequence
  chemically synthesized
tccctcagggatctttactcct

SEQ ID NO: 9417 - DNA, 22 bp, Artificial Sequence
  chemically synthesized
agggatctttactcctccttgc

SEQ ID NO: 9418 - DNA, 22 bp, Artificial Sequence
  chemically synthesized
tactcctccttgcctgatgtcc

SEQ ID NO: 9419 - DNA, 22 bp, Artificial Sequence
  chemically synthesized
actcctccttgcctgatgtcca

SEQ ID NO: 9420 - DNA, 22 bp, Artificial Sequence
  chemically synthesized
ctcctccttgcctgatgtccag

SEQ ID NO: 9421 - DNA, 22 bp, Artificial Sequence
  chemically synthesized
ctccttgcctgatgtccagagt

SEQ ID NO: 9422 - DNA, 22 bp, Artificial Sequence
  chemically synthesized
cttgcctgatgtccagagtctt

SEQ ID NO: 9423 - DNA, 22 bp, Artificial Sequence
  chemically synthesized
gcctgatgtccagagtcttgaa

SEQ ID NO: 9424 - DNA, 22 bp, Artificial Sequence
  chemically synthesized
cctgatgtccagagtcttgaaa

SEQ ID NO: 9425 - DNA, 22 bp, Artificial Sequence
  chemically synthesized
atgtccagagtcttgaaagctg

SEQ ID NO: 9426 - DNA, 22 bp, Artificial Sequence
  chemically synthesized
gaaagctgccatgttctatagt

SEQ ID NO: 9427 - DNA, 22 bp, Artificial Sequence
  chemically synthesized
aaagctgccatgttctatagtt

SEQ ID NO: 9428 - DNA, 22 bp, Artificial Sequence
  chemically synthesized
ccatgttctatagttgtctgtt

SEQ ID NO: 9429 - DNA, 22 bp, Artificial Sequence
  chemically synthesized
tatagttgtctgtttttgtttt

SEQ ID NO: 9430 - DNA, 22 bp, Artificial Sequence
  chemically synthesized
tagttgtctgtttttgttttga

SEQ ID NO: 9431 - DNA, 22 bp, Artificial Sequence
  chemically synthesized
tctgtttttgttttgattgttt

SEQ ID NO: 9432 - DNA, 22 bp, Artificial Sequence
  chemically synthesized
tttttgttttgattgtttctgg

SEQ ID NO: 9433 - DNA, 22 bp, Artificial Sequence
  chemically synthesized
ttgttttgattgtttctgggga

SEQ ID NO: 9434 - DNA, 22 bp, Artificial Sequence
  chemically synthesized
tgttttgattgtttctggggag

SEQ ID NO: 9435 - DNA, 22 bp, Artificial Sequence
  chemically synthesized
gttttgattgtttctggggaga

SEQ ID NO: 9436 - DNA, 22 bp, Artificial Sequence
  chemically synthesized
ttttgattgtttctggggagag

SEQ ID NO: 9437 - DNA, 22 bp, Artificial Sequence
  chemically synthesized
tgattgtttctggggagagaag

SEQ ID NO: 9438 - DNA, 22 bp, Artificial Sequence
  chemically synthesized
gattgtttctggggagagaaga

SEQ ID NO: 9439 - DNA, 22 bp, Artificial Sequence
  chemically synthesized
attgtttctggggagagaagaa

SEQ ID NO: 9440 - DNA, 22 bp, Artificial Sequence
  chemically synthesized
tttctggggagagaagaactct

SEQ ID NO: 9441 - DNA, 22 bp, Artificial Sequence
  chemically synthesized
ctggggagagaagaactcttcc

SEQ ID NO: 9442 - DNA, 22 bp, Artificial Sequence
  chemically synthesized
tggggagagaagaactcttccc

SEQ ID NO: 9443 - DNA, 22 bp, Artificial Sequence
  chemically synthesized
gggagagaagaactcttcccat

SEQ ID NO: 9444 - DNA, 22 bp, Artificial Sequence
  chemically synthesized
ttcccatcttgggcagaccctg

SEQ ID NO: 9445 - DNA, 22 bp, Artificial Sequence
  chemically synthesized
cccatcttgggcagaccctgtc

SEQ ID NO: 9446 - DNA, 22 bp, Artificial Sequence
  chemically synthesized
ccatcttgggcagaccctgtct

SEQ ID NO: 9447 - DNA, 22 bp, Artificial Sequence
  chemically synthesized
gggcagaccctgtcttttatgt

SEQ ID NO: 9448 - DNA, 22 bp, Artificial Sequence
  chemically synthesized
ggcagaccctgtcttttatgtt

SEQ ID NO: 9449 - DNA, 22 bp, Artificial Sequence
  chemically synthesized
tcttttatgttcaaacttttgc

SEQ ID NO: 9450 - DNA, 22 bp, Artificial Sequence
  chemically synthesized
ttatgttcaaacttttgcctaa

SEQ ID NO: 9451 - DNA, 22 bp, Artificial Sequence
  chemically synthesized
tatgttcaaacttttgcctaag

SEQ ID NO: 9452 - DNA, 22 bp, Artificial Sequence
  chemically synthesized
atgttcaaacttttgcctaaga

SEQ ID NO: 9453 - DNA, 22 bp, Artificial Sequence
  chemically synthesized
tgttcaaacttttgcctaagaa

SEQ ID NO: 9454 - DNA, 22 bp, Artificial Sequence
  chemically synthesized
aaacttttgcctaagaagcaca

SEQ ID NO: 9455 - DNA, 22 bp, Artificial Sequence
  chemically synthesized
ttgcctaagaagcacattacat

SEQ ID NO: 9456 - DNA, 22 bp, Artificial Sequence
  chemically synthesized
tgcctaagaagcacattacata

SEQ ID NO: 9457 - DNA, 22 bp, Artificial Sequence
  chemically synthesized
gcctaagaagcacattacatat

SEQ ID NO: 9458 - DNA, 22 bp, Artificial Sequence
  chemically synthesized
cctaagaagcacattacatatt

SEQ ID NO: 9459 - DNA, 22 bp, Artificial Sequence
  chemically synthesized
agaagcacattacatattttaa

SEQ ID NO: 9460 - DNA, 22 bp, Artificial Sequence
  chemically synthesized
catattttaactcatctaatta

SEQ ID NO: 9461 - DNA, 22 bp, Artificial Sequence
  chemically synthesized
taactcatctaattatccgagc

SEQ ID NO: 9462 - DNA, 22 bp, Artificial Sequence
  chemically synthesized
aactcatctaattatccgagca

SEQ ID NO: 9463 - DNA, 22 bp, Artificial Sequence
  chemically synthesized
actcatctaattatccgagcaa

SEQ ID NO: 9464 - DNA, 22 bp, Artificial Sequence
  chemically synthesized
atctaattatccgagcaatcca

SEQ ID NO: 9465 - DNA, 22 bp, Artificial Sequence
  chemically synthesized
attatccgagcaatccaatcgg

SEQ ID NO: 9466 - DNA, 22 bp, Artificial Sequence
  chemically synthesized
tccgagcaatccaatcgggtag

SEQ ID NO: 9467 - DNA, 22 bp, Artificial Sequence
  chemically synthesized
cgactgtgatctccattttaca

SEQ ID NO: 9468 - DNA, 22 bp, Artificial Sequence
  chemically synthesized
tgatctccattttacacacgag

SEQ ID NO: 9469 - DNA, 22 bp, Artificial Sequence
  chemically synthesized
cattttacacacgagaaaatgg

SEQ ID NO: 9470 - DNA, 22 bp, Artificial Sequence
  chemically synthesized
tacacacgagaaaatggaagca

SEQ ID NO: 9471 - DNA, 22 bp, Artificial Sequence
  chemically synthesized
acacacgagaaaatggaagcat

SEQ ID NO: 9472 - DNA, 22 bp, Artificial Sequence
  chemically synthesized
cacacgagaaaatggaagcatg

SEQ ID NO: 9473 - DNA, 22 bp, Artificial Sequence
  chemically synthesized
aatgctggtgcatgatctcaga

SEQ ID NO: 9474 - DNA, 22 bp, Artificial Sequence
  chemically synthesized
gtgcatgatctcagagctacct

SEQ ID NO: 9475 - DNA, 22 bp, Artificial Sequence
  chemically synthesized
agagctacctggaggcacagct

SEQ ID NO: 9476 - DNA, 22 bp, Artificial Sequence
  chemically synthesized
cctggaggcacagctgggctac

SEQ ID NO: 9477 - DNA, 22 bp, Artificial Sequence
  chemically synthesized
gaggcacagctgggctaccctg

SEQ ID NO: 9478 - DNA, 22 bp, Artificial Sequence
  chemically synthesized
ggctaccctgtgggcagtctgg

SEQ ID NO: 9479 - DNA, 22 bp, Artificial Sequence
  chemically synthesized
ccctgtgggcagtctggtttca

SEQ ID NO: 9480 - DNA, 22 bp, Artificial Sequence
  chemically synthesized
tgggcagtctggtttcagggtg

SEQ ID NO: 9481 - DNA, 22 bp, Artificial Sequence
  chemically synthesized
gtttcagggtggatatacagac

SEQ ID NO: 9482 - DNA, 22 bp, Artificial Sequence
  chemically synthesized
cagggtggatatacagacacgt

SEQ ID NO: 9483 - DNA, 22 bp, Artificial Sequence
  chemically synthesized
agggtggatatacagacacgtt

SEQ ID NO: 9484 - DNA, 22 bp, Artificial Sequence
  chemically synthesized
ctgggctgacccagcattggga

SEQ ID NO: 9485 - DNA, 22 bp, Artificial Sequence
  chemically synthesized
ggctgacccagcattgggagtt

SEQ ID NO: 9486 - DNA, 22 bp, Artificial Sequence
  chemically synthesized
acccagcattgggagttgataa

SEQ ID NO: 9487 - DNA, 22 bp, Artificial Sequence
  chemically synthesized
ggagttgataagtcggactggg

SEQ ID NO: 9488 - DNA, 22 bp, Artificial Sequence
  chemically synthesized
ataagtcggactgggaagcagg

SEQ ID NO: 9489 - DNA, 22 bp, Artificial Sequence
  chemically synthesized
ggaagcaggacaggaccctctg

SEQ ID NO: 9490 - DNA, 22 bp, Artificial Sequence
  chemically synthesized
tgagtggagggtgctgaagaca

SEQ ID NO: 9491 - DNA, 22 bp, Artificial Sequence
  chemically synthesized
agtggagggtgctgaagacagc

SEQ ID NO: 9492 - DNA, 22 bp, Artificial Sequence
  chemically synthesized
aagacagcagtcagggactcag

SEQ ID NO: 9493 - DNA, 22 bp, Artificial Sequence
  chemically synthesized
agccatggagggccagcttggt

SEQ ID NO: 9494 - DNA, 22 bp, Artificial Sequence
  chemically synthesized
ggtggggaacaccgtggtcatg

SEQ ID NO: 9495 - DNA, 22 bp, Artificial Sequence
  chemically synthesized
gtggggaacaccgtggtcatgg

SEQ ID NO: 9496 - DNA, 22 bp, Artificial Sequence
  chemically synthesized
ctggatggagaggaatgcaaag

SEQ ID NO: 9497 - DNA, 22 bp, Artificial Sequence
  chemically synthesized
tggatggagaggaatgcaaagg

SEQ ID NO: 9498 - DNA, 22 bp, Artificial Sequence
  chemically synthesized
gatggagaggaatgcaaaggcc

SEQ ID NO: 9499 - DNA, 22 bp, Artificial Sequence
  chemically synthesized
ggaggaaggggtgggggcagtg

SEQ ID NO: 9500 - DNA, 22 bp, Artificial Sequence
  chemically synthesized
gaggaaggggtgggggcagtga

SEQ ID NO: 9501 - DNA, 22 bp, Artificial Sequence
  chemically synthesized
tgctcagagcgggagtgggcag

SEQ ID NO: 9502 - DNA, 22 bp, Artificial Sequence
  chemically synthesized
agagcgggagtgggcagtggag

SEQ ID NO: 9503 - DNA, 22 bp, Artificial Sequence
  chemically synthesized
cctgggtcaaatggggtcctga

SEQ ID NO: 9504 - DNA, 22 bp, Artificial Sequence
  chemically synthesized
ggtcaaatggggtcctgagtgt

SEQ ID NO: 9505 - DNA, 22 bp, Artificial Sequence
  chemically synthesized
agtgtggctgcagtggggaagg

SEQ ID NO: 9506 - DNA, 22 bp, Artificial Sequence
  chemically synthesized
cagtggggaaggtggaagtcac

SEQ ID NO: 9507 - DNA, 22 bp, Artificial Sequence
  chemically synthesized
gtgtgaaaaagatgaagagtta

SEQ ID NO: 9508 - DNA, 22 bp, Artificial Sequence
  chemically synthesized
tggacagtcacttacaggggca

SEQ ID NO: 9509 - DNA, 22 bp, Artificial Sequence
  chemically synthesized
acaggggcagtgtctgactcag

SEQ ID NO: 9510 - DNA, 22 bp, Artificial Sequence
  chemically synthesized
caggggcagtgtctgactcagg

SEQ ID NO: 9511 - DNA, 22 bp, Artificial Sequence
  chemically synthesized
actcaggacagtggcaggaagt

SEQ ID NO: 9512 - DNA, 22 bp, Artificial Sequence
  chemically synthesized
aggacagtggcaggaagtgacc

SEQ ID NO: 9513 - DNA, 22 bp, Artificial Sequence
  chemically synthesized
gggaggaagattctgggcccct

SEQ ID NO: 9514 - DNA, 22 bp, Artificial Sequence
  chemically synthesized
tgggcccctgactgagcctccc

SEQ ID NO: 9515 - DNA, 22 bp, Artificial Sequence
  chemically synthesized
ggcccctgactgagcctcccca

SEQ ID NO: 9516 - DNA, 22 bp, Artificial Sequence
  chemically synthesized
actgagcctccccaggatgtgg

SEQ ID NO: 9517 - DNA, 22 bp, Artificial Sequence
  chemically synthesized
agcctccccaggatgtggtcct

SEQ ID NO: 9518 - DNA, 22 bp, Artificial Sequence
  chemically synthesized
cccaggatgtggtcctgctggg

SEQ ID NO: 9519 - DNA, 22 bp, Artificial Sequence
  chemically synthesized
ctgggtcggggggtgataggaa

SEQ ID NO: 9520 - DNA, 22 bp, Artificial Sequence
  chemically synthesized
ggtcggggggtgataggaatga

SEQ ID NO: 9521 - DNA, 22 bp, Artificial Sequence
  chemically synthesized
gaaggtgttctgtttgcaggtg

SEQ ID NO: 9522 - DNA, 22 bp, Artificial Sequence
  chemically synthesized
tgtttgcaggtggatgctgcaa

SEQ ID NO: 9523 - DNA, 22 bp, Artificial Sequence
  chemically synthesized
tttgcaggtggatgctgcaaag

SEQ ID NO: 9524 - DNA, 22 bp, Artificial Sequence
  chemically synthesized
gcaggtggatgctgcaaagaga

SEQ ID NO: 9525 - DNA, 22 bp, Artificial Sequence
  chemically synthesized
caggtggatgctgcaaagagag

SEQ ID NO: 9526 - DNA, 22 bp, Artificial Sequence
  chemically synthesized
caaagagaggagctcagggctg

SEQ ID NO: 9527 - DNA, 22 bp, Artificial Sequence
  chemically synthesized
agggctgggacaactggagctg

SEQ ID NO: 9528 - DNA, 22 bp, Artificial Sequence
  chemically synthesized
ggacaactggagctgctctggg

SEQ ID NO: 9529 - DNA, 22 bp, Artificial Sequence
  chemically synthesized
gagctgctctgggtctggaggc

SEQ ID NO: 9530 - DNA, 22 bp, Artificial Sequence
  chemically synthesized
ctctgggtctggaggcagcaga

SEQ ID NO: 9531 - DNA, 22 bp, Artificial Sequence
  chemically synthesized
tgggtctggaggcagcagagag

SEQ ID NO: 9532 - DNA, 22 bp, Artificial Sequence
  chemically synthesized
ggtctggaggcagcagagaggg

SEQ ID NO: 9533 - DNA, 22 bp, Artificial Sequence
  chemically synthesized
gaggcagcagagagggagccca

SEQ ID NO: 9534 - DNA, 22 bp, Artificial Sequence
  chemically synthesized
tgtgtgcaggaagacgtgggtg

SEQ ID NO: 9535 - DNA, 22 bp, Artificial Sequence
  chemically synthesized
tgtgcaggaagacgtgggtgtg

SEQ ID NO: 9536 - DNA, 22 bp, Artificial Sequence
  chemically synthesized
gcatgcatatgcacatgtgaga

SEQ ID NO: 9537 - DNA, 22 bp, Artificial Sequence
  chemically synthesized
ttgagtgaagtgagcaatgtgt

SEQ ID NO: 9538 - DNA, 22 bp, Artificial Sequence
  chemically synthesized
tgagtgaagtgagcaatgtgtg

SEQ ID NO: 9539 - DNA, 22 bp, Artificial Sequence
  chemically synthesized
gagtgaagtgagcaatgtgtga

SEQ ID NO: 9540 - DNA, 22 bp, Artificial Sequence
  chemically synthesized
agtgaagtgagcaatgtgtgag

SEQ ID NO: 9541 - DNA, 22 bp, Artificial Sequence
  chemically synthesized
gtgagggcatgtgaatgtgtgt

SEQ ID NO: 9542 - DNA, 22 bp, Artificial Sequence
  chemically synthesized
tgagggcatgtgaatgtgtgtg

SEQ ID NO: 9543 - DNA, 22 bp, Artificial Sequence
  chemically synthesized
tcagggtgcagatggatcaagg

SEQ ID NO: 9544 - DNA, 22 bp, Artificial Sequence
  chemically synthesized
tgagatgacctcgggctgaggg

SEQ ID NO: 9545 - DNA, 22 bp, Artificial Sequence
  chemically synthesized
gggctgaggggagcaaatttag

SEQ ID NO: 9546 - DNA, 22 bp, Artificial Sequence
  chemically synthesized
aggggagcaaatttagtgtgga

SEQ ID NO: 9547 - DNA, 22 bp, Artificial Sequence
  chemically synthesized
agtgtggaacgaggtttctagg

SEQ ID NO: 9548 - DNA, 22 bp, Artificial Sequence
  chemically synthesized
gtgtggaacgaggtttctaggg

SEQ ID NO: 9549 - DNA, 22 bp, Artificial Sequence
  chemically synthesized
ctagggaagcgagggcaaaggg

SEQ ID NO: 9550 - DNA, 22 bp, Artificial Sequence
  chemically synthesized
tagggaagcgagggcaaagggc

SEQ ID NO: 9551 - DNA, 22 bp, Artificial Sequence
  chemically synthesized
gggaagcgagggcaaagggcgc

SEQ ID NO: 9552 - DNA, 22 bp, Artificial Sequence
  chemically synthesized
gggaggaggccttgcgtggtgg

SEQ ID NO: 9553 - DNA, 22 bp, Artificial Sequence
  chemically synthesized
gcgtggtgggggatgaggacaa

SEQ ID NO: 9554 - DNA, 22 bp, Artificial Sequence
  chemically synthesized
cgtggtgggggatgaggacaac

SEQ ID NO: 9555 - DNA, 22 bp, Artificial Sequence
  chemically synthesized
gagggttgtgcttggagagtgg

SEQ ID NO: 9556 - DNA, 22 bp, Artificial Sequence
  chemically synthesized
tgcttggagagtgggctatggt

SEQ ID NO: 9557 - DNA, 22 bp, Artificial Sequence
  chemically synthesized
ggagagtgggctatggtggaat

SEQ ID NO: 9558 - DNA, 22 bp, Artificial Sequence
  chemically synthesized
gagagtgggctatggtggaatg

SEQ ID NO: 9559 - DNA, 22 bp, Artificial Sequence
  chemically synthesized
tggtggaatgacccagatttaa

SEQ ID NO: 9560 - DNA, 22 bp, Artificial Sequence
  chemically synthesized
aaggatctcaatggaattttgg

SEQ ID NO: 9561 - DNA, 22 bp, Artificial Sequence
  chemically synthesized
aggatctcaatggaattttggc

SEQ ID NO: 9562 - DNA, 22 bp, Artificial Sequence
  chemically synthesized
aatggaattttggcaggggagg

SEQ ID NO: 9563 - DNA, 22 bp, Artificial Sequence
  chemically synthesized
tggcaggggagggactgttcca

SEQ ID NO: 9564 - DNA, 22 bp, Artificial Sequence
  chemically synthesized
ggcaggggagggactgttccag

SEQ ID NO: 9565 - DNA, 22 bp, Artificial Sequence
  chemically synthesized
gcaggggagggactgttccagt

SEQ ID NO: 9566 - DNA, 22 bp, Artificial Sequence
  chemically synthesized
ttccagtatggattttaggaag

SEQ ID NO: 9567 - DNA, 22 bp, Artificial Sequence
  chemically synthesized
cagtatggattttaggaagaac

SEQ ID NO: 9568 - DNA, 22 bp, Artificial Sequence
  chemically synthesized
taggaagaacacagggcccagc

SEQ ID NO: 9569 - DNA, 22 bp, Artificial Sequence
  chemically synthesized
aggaagaacacagggcccagct

SEQ ID NO: 9570 - DNA, 22 bp, Artificial Sequence
  chemically synthesized
ggaagaacacagggcccagctt

SEQ ID NO: 9571 - DNA, 22 bp, Artificial Sequence
  chemically synthesized
ctggagtctccaatctgagggg

SEQ ID NO: 9572 - DNA, 22 bp, Artificial Sequence
  chemically synthesized
tggagtctccaatctgagggga

SEQ ID NO: 9573 - DNA, 22 bp, Artificial Sequence
  chemically synthesized
gagtctccaatctgaggggaca

SEQ ID NO: 9574 - DNA, 22 bp, Artificial Sequence
  chemically synthesized
caatctgaggggacaggagcct

SEQ ID NO: 9575 - DNA, 22 bp, Artificial Sequence
  chemically synthesized
aggggacaggagccttagaaga

SEQ ID NO: 9576 - DNA, 22 bp, Artificial Sequence
  chemically synthesized
agaagagctgagactaaggccc

SEQ ID NO: 9577 - DNA, 22 bp, Artificial Sequence
  chemically synthesized
gaagagctgagactaaggcccg

SEQ ID NO: 9578 - DNA, 22 bp, Artificial Sequence
  chemically synthesized
agactaaggcccgaggtgatct

SEQ ID NO: 9579 - DNA, 22 bp, Artificial Sequence
  chemically synthesized
aggcccgaggtgatctggaggc

SEQ ID NO: 9580 - DNA, 22 bp, Artificial Sequence
  chemically synthesized
gaggcctctgccactggctgga

SEQ ID NO: 9581 - DNA, 22 bp, Artificial Sequence
  chemically synthesized
tgccactggctggatgggagga

SEQ ID NO: 9582 - DNA, 22 bp, Artificial Sequence
  chemically synthesized
ccactggctggatgggaggaaa

SEQ ID NO: 9583 - DNA, 22 bp, Artificial Sequence
  chemically synthesized
gctggatgggaggaaaaccatt

SEQ ID NO: 9584 - DNA, 22 bp, Artificial Sequence
  chemically synthesized
gatgggaggaaaaccattcaca

SEQ ID NO: 9585 - DNA, 22 bp, Artificial Sequence
  chemically synthesized
acagatcccccttctcaggatg

SEQ ID NO: 9586 - DNA, 22 bp, Artificial Sequence
  chemically synthesized
ctcaggatgtgtgcctaggcag

SEQ ID NO: 9587 - DNA, 22 bp, Artificial Sequence
  chemically synthesized
tcaggatgtgtgcctaggcagg

SEQ ID NO: 9588 - DNA, 22 bp, Artificial Sequence
  chemically synthesized
aggatgtgtgcctaggcagggc

SEQ ID NO: 9589 - DNA, 22 bp, Artificial Sequence
  chemically synthesized
ggcagggccgggtctgcccccc

SEQ ID NO: 9590 - DNA, 22 bp, Artificial Sequence
  chemically synthesized
cccccccgccccctgtgcgtct

SEQ ID NO: 9591 - DNA, 22 bp, Artificial Sequence
  chemically synthesized
tgcgtctcccagtcccccagct

SEQ ID NO: 9592 - DNA, 22 bp, Artificial Sequence
  chemically synthesized
ccagtcccccagctccaggatc

SEQ ID NO: 9593 - DNA, 22 bp, Artificial Sequence
  chemically synthesized
caggatccgggctttgcacaca

SEQ ID NO: 9594 - DNA, 22 bp, Artificial Sequence
  chemically synthesized
tgcacacagctgatgtgaatat

SEQ ID NO: 9595 - DNA, 22 bp, Artificial Sequence
  chemically synthesized
gcacacagctgatgtgaatatc

SEQ ID NO: 9596 - DNA, 22 bp, Artificial Sequence
  chemically synthesized
cacacagctgatgtgaatatcc

SEQ ID NO: 9597 - DNA, 22 bp, Artificial Sequence
  chemically synthesized
atgtgaatatcctgagtcgtgt

SEQ ID NO: 9598 - DNA, 22 bp, Artificial Sequence
  chemically synthesized
agtcgtgtgcatgggtgtgtgt

SEQ ID NO: 9599 - DNA, 22 bp, Artificial Sequence
  chemically synthesized
gctgcgtgtgtatatttataca

SEQ ID NO: 9600 - DNA, 22 bp, Artificial Sequence
  chemically synthesized
cgtgtgtatatttatacatggt

SEQ ID NO: 9601 - DNA, 22 bp, Artificial Sequence
  chemically synthesized
atacatggtaatatgggtgcga

SEQ ID NO: 9602 - DNA, 22 bp, Artificial Sequence
  chemically synthesized
tacatggtaatatgggtgcgag

SEQ ID NO: 9603 - DNA, 22 bp, Artificial Sequence
  chemically synthesized
aaatgctggggtcaaagcctat

SEQ ID NO: 9604 - DNA, 22 bp, Artificial Sequence
  chemically synthesized
gggtcaaagcctatgatgaccc

SEQ ID NO: 9605 - DNA, 22 bp, Artificial Sequence
  chemically synthesized
tgatgacccccccccatggccc

SEQ ID NO: 9606 - DNA, 22 bp, Artificial Sequence
  chemically synthesized
tgcctcctcaggcttcggtgcc

SEQ ID NO: 9607 - DNA, 22 bp, Artificial Sequence
  chemically synthesized
ctcaggcttcggtgccctgtct

SEQ ID NO: 9608 - DNA, 22 bp, Artificial Sequence
  chemically synthesized
aggcttcggtgccctgtcttta

SEQ ID NO: 9609 - DNA, 22 bp, Artificial Sequence
  chemically synthesized
cggtgccctgtctttaccctcc

SEQ ID NO: 9610 - DNA, 22 bp, Artificial Sequence
  chemically synthesized
ggtgccctgtctttaccctccg

SEQ ID NO: 9611 - DNA, 22 bp, Artificial Sequence
  chemically synthesized
tctttaccctccggctccccac

SEQ ID NO: 9612 - DNA, 22 bp, Artificial Sequence
  chemically synthesized
taccctccggctccccacaccc

SEQ ID NO: 9613 - DNA, 22 bp, Artificial Sequence
  chemically synthesized
accctccggctccccacaccca

SEQ ID NO: 9614 - DNA, 22 bp, Artificial Sequence
  chemically synthesized
ccctccggctccccacacccag

SEQ ID NO: 9615 - DNA, 22 bp, Artificial Sequence
  chemically synthesized
cggctccccacacccaggctgc

SEQ ID NO: 9616 - DNA, 22 bp, Artificial Sequence
  chemically synthesized
cccacacccaggctgccggctc

SEQ ID NO: 9617 - DNA, 22 bp, Artificial Sequence
  chemically synthesized
ccggctcctgatgcccctctcc

SEQ ID NO: 9618 - DNA, 22 bp, Artificial Sequence
  chemically synthesized
ctgatgcccctctcccacaggg

SEQ ID NO: 9619 - DNA, 22 bp, Artificial Sequence
  chemically synthesized
atgcccctctcccacagggcca

SEQ ID NO: 9620 - DNA, 22 bp, Artificial Sequence
  chemically synthesized
tcccacagggccacctcctgcc

SEQ ID NO: 9621 - DNA, 22 bp, Artificial Sequence
  chemically synthesized
ccacagggccacctcctgccca

SEQ ID NO: 9622 - DNA, 22 bp, Artificial Sequence
  chemically synthesized
ctgcccagcccctggcacagcg

SEQ ID NO: 9623 - DNA, 22 bp, Artificial Sequence
  chemically synthesized
cccagcccctggcacagcgtct

SEQ ID NO: 9624 - DNA, 22 bp, Artificial Sequence
  chemically synthesized
gcacagcgtctctgctccatgg

SEQ ID NO: 9625 - DNA, 22 bp, Artificial Sequence
  chemically synthesized
tgctccatggtctgcttcagtc

SEQ ID NO: 9626 - DNA, 22 bp, Artificial Sequence
  chemically synthesized
ctccatggtctgcttcagtctg

SEQ ID NO: 9627 - DNA, 22 bp, Artificial Sequence
  chemically synthesized
catggtctgcttcagtctgctt

SEQ ID NO: 9628 - DNA, 22 bp, Artificial Sequence
  chemically synthesized
cttcagtctgcttgccctgagc

SEQ ID NO: 9629 - DNA, 22 bp, Artificial Sequence
  chemically synthesized
cagtctgcttgccctgagcttc

SEQ ID NO: 9630 - DNA, 22 bp, Artificial Sequence
  chemically synthesized
agtctgcttgccctgagcttca

SEQ ID NO: 9631 - DNA, 22 bp, Artificial Sequence
  chemically synthesized
cttgccctgagcttcaacatcc

SEQ ID NO: 9632 - DNA, 22 bp, Artificial Sequence
  chemically synthesized
gccctgagcttcaacatcctgc

SEQ ID NO: 9633 - DNA, 22 bp, Artificial Sequence
  chemically synthesized
ccctgagcttcaacatcctgct

SEQ ID NO: 9634 - DNA, 22 bp, Artificial Sequence
  chemically synthesized
agcttcaacatcctgctgctgg

SEQ ID NO: 9635 - DNA, 22 bp, Artificial Sequence
  chemically synthesized
caacatcctgctgctggtggtc

SEQ ID NO: 9636 - DNA, 22 bp, Artificial Sequence
  chemically synthesized
aacatcctgctgctggtggtca

SEQ ID NO: 9637 - DNA, 22 bp, Artificial Sequence
  chemically synthesized
ctgctggtggtcatctgtgtga

SEQ ID NO: 9638 - DNA, 22 bp, Artificial Sequence
  chemically synthesized
ctggtggtcatctgtgtgactg

SEQ ID NO: 9639 - DNA, 22 bp, Artificial Sequence
  chemically synthesized
gtggtcatctgtgtgactgggt

SEQ ID NO: 9640 - DNA, 22 bp, Artificial Sequence
  chemically synthesized
tgtgactgggtcccaaagtgag

SEQ ID NO: 9641 - DNA, 22 bp, Artificial Sequence
  chemically synthesized
ggtcccaaagtgagggtcacgg

SEQ ID NO: 9642 - DNA, 20 bp, Artificial Sequence
  chemically synthesized
cttcagatagattatatctg

SEQ ID NO: 9643 - DNA, 20 bp, Artificial Sequence
  chemically synthesized
gatagattatatctggagtg

SEQ ID NO: 9644 - DNA, 20 bp, Artificial Sequence
  chemically synthesized
aatcctgccacctatgtatc

SEQ ID NO: 9645 - DNA, 20 bp, Artificial Sequence
  chemically synthesized
tgccacctatgtatctggca

SEQ ID NO: 9646 - DNA, 20 bp, Artificial Sequence
  chemically synthesized
ctatgtatctggcatagtgt

SEQ ID NO: 9647 - DNA, 20 bp, Artificial Sequence
  chemically synthesized
gagtcctcataaatgcttac

SEQ ID NO: 9648 - DNA, 20 bp, Artificial Sequence
  chemically synthesized
cataaatgcttactggtttg

SEQ ID NO: 9649 - DNA, 20 bp, Artificial Sequence
  chemically synthesized
ataaatgcttactggtttga

SEQ ID NO: 9650 - DNA, 20 bp, Artificial Sequence
  chemically synthesized
taaatgcttactggtttgaa

SEQ ID NO: 9651 - DNA, 20 bp, Artificial Sequence
  chemically synthesized
tggtttgaagggcaacaaaa

SEQ ID NO: 9652 - DNA, 20 bp, Artificial Sequence
  chemically synthesized
aagggcaacaaaatagtgaa

SEQ ID NO: 9653 - DNA, 20 bp, Artificial Sequence
  chemically synthesized
gggcaacaaaatagtgaaca

SEQ ID NO: 9654 - DNA, 20 bp, Artificial Sequence
  chemically synthesized
acagagtgaaaatccccact

SEQ ID NO: 9655 - DNA, 20 bp, Artificial Sequence
  chemically synthesized
gaaaatccccactaagatcc

SEQ ID NO: 9656 - DNA, 20 bp, Artificial Sequence
  chemically synthesized
aaaatccccactaagatcct

SEQ ID NO: 9657 - DNA, 20 bp, Artificial Sequence
  chemically synthesized
ccccactaagatcctgggtc

SEQ ID NO: 9658 - DNA, 20 bp, Artificial Sequence
  chemically synthesized
taagatcctgggtccagaaa

SEQ ID NO: 9659 - DNA, 20 bp, Artificial Sequence
  chemically synthesized
atcctgggtccagaaaaaga

SEQ ID NO: 9660 - DNA, 20 bp, Artificial Sequence
  chemically synthesized
tcctgggtccagaaaaagat

SEQ ID NO: 9661 - DNA, 20 bp, Artificial Sequence
  chemically synthesized
aaaaagatgggaaacctgtt

SEQ ID NO: 9662 - DNA, 20 bp, Artificial Sequence
  chemically synthesized
aacctgtttagctcacccgt

SEQ ID NO: 9663 - DNA, 20 bp, Artificial Sequence
  chemically synthesized
ttagctcacccgtgagccca

SEQ ID NO: 9664 - DNA, 20 bp, Artificial Sequence
  chemically synthesized
agcccatagttaaaactctt

SEQ ID NO: 9665 - DNA, 20 bp, Artificial Sequence
  chemically synthesized
agttaaaactctttagacaa

SEQ ID NO: 9666 - DNA, 20 bp, Artificial Sequence
  chemically synthesized
gttaaaactctttagacaac

SEQ ID NO: 9667 - DNA, 20 bp, Artificial Sequence
  chemically synthesized
caacaggttgtttccgttta

SEQ ID NO: 9668 - DNA, 20 bp, Artificial Sequence
  chemically synthesized
acaggttgtttccgtttaca

SEQ ID NO: 9669 - DNA, 20 bp, Artificial Sequence
  chemically synthesized
tttacagagaacaataatat

SEQ ID NO: 9670 - DNA, 20 bp, Artificial Sequence
  chemically synthesized
ttacagagaacaataatatt

SEQ ID NO: 9671 - DNA, 20 bp, Artificial Sequence
  chemically synthesized
cagagaacaataatattggg

SEQ ID NO: 9672 - DNA, 20 bp, Artificial Sequence
  chemically synthesized
gaacaataatattgggtggt

SEQ ID NO: 9673 - DNA, 20 bp, Artificial Sequence
  chemically synthesized
ttgggtggtgagcatctgtg

SEQ ID NO: 9674 - DNA, 20 bp, Artificial Sequence
  chemically synthesized
tgggtggtgagcatctgtgt

SEQ ID NO: 9675 - DNA, 20 bp, Artificial Sequence
  chemically synthesized
gggtggtgagcatctgtgtg

SEQ ID NO: 9676 - DNA, 20 bp, Artificial Sequence
  chemically synthesized
ggtggtgagcatctgtgtgg

SEQ ID NO: 9677 - DNA, 20 bp, Artificial Sequence
  chemically synthesized
gtgagcatctgtgtgggggt

SEQ ID NO: 9678 - DNA, 20 bp, Artificial Sequence
  chemically synthesized
tgagcatctgtgtgggggtt

SEQ ID NO: 9679 - DNA, 20 bp, Artificial Sequence
  chemically synthesized
gagcatctgtgtgggggttg

SEQ ID NO: 9680 - DNA, 20 bp, Artificial Sequence
  chemically synthesized
catctgtgtgggggttgggg

SEQ ID NO: 9681 - DNA, 20 bp, Artificial Sequence
  chemically synthesized
atctgtgtgggggttggggt

SEQ ID NO: 9682 - DNA, 20 bp, Artificial Sequence
  chemically synthesized
gtgtgggggttggggtggga

SEQ ID NO: 9683 - DNA, 20 bp, Artificial Sequence
  chemically synthesized
tgtgggggttggggtgggat

SEQ ID NO: 9684 - DNA, 20 bp, Artificial Sequence
  chemically synthesized
gtgggggttggggtgggata

SEQ ID NO: 9685 - DNA, 20 bp, Artificial Sequence
  chemically synthesized
tgggggttggggtgggatag

SEQ ID NO: 9686 - DNA, 20 bp, Artificial Sequence
  chemically synthesized
ttggggtgggataggggata

SEQ ID NO: 9687 - DNA, 20 bp, Artificial Sequence
  chemically synthesized
tggggtgggataggggatac

SEQ ID NO: 9688 - DNA, 20 bp, Artificial Sequence
  chemically synthesized
ggggtgggataggggatacg

SEQ ID NO: 9689 - DNA, 20 bp, Artificial Sequence
  chemically synthesized
ggtgggataggggatacggg

SEQ ID NO: 9690 - DNA, 20 bp, Artificial Sequence
  chemically synthesized
tgggataggggatacgggga

SEQ ID NO: 9691 - DNA, 20 bp, Artificial Sequence
  chemically synthesized
gataggggatacggggagag

SEQ ID NO: 9692 - DNA, 20 bp, Artificial Sequence
  chemically synthesized
taggggatacggggagagtg

SEQ ID NO: 9693 - DNA, 20 bp, Artificial Sequence
  chemically synthesized
atacggggagagtggagaaa

SEQ ID NO: 9694 - DNA, 20 bp, Artificial Sequence
  chemically synthesized
tacggggagagtggagaaaa

SEQ ID NO: 9695 - DNA, 20 bp, Artificial Sequence
  chemically synthesized
acggggagagtggagaaaaa

SEQ ID NO: 9696 - DNA, 20 bp, Artificial Sequence
  chemically synthesized
cggggagagtggagaaaaag

SEQ ID NO: 9697 - DNA, 20 bp, Artificial Sequence
  chemically synthesized
gagtggagaaaaaggggaca

SEQ ID NO: 9698 - DNA, 20 bp, Artificial Sequence
  chemically synthesized
agtggagaaaaaggggacac

SEQ ID NO: 9699 - DNA, 20 bp, Artificial Sequence
  chemically synthesized
gtggagaaaaaggggacaca

SEQ ID NO: 9700 - DNA, 20 bp, Artificial Sequence
  chemically synthesized
ggggacacagggttaatgtg

SEQ ID NO: 9701 - DNA, 20 bp, Artificial Sequence
  chemically synthesized
cacagggttaatgtgaagtc

SEQ ID NO: 9702 - DNA, 20 bp, Artificial Sequence
  chemically synthesized
acagggttaatgtgaagtcc

SEQ ID NO: 9703 - DNA, 20 bp, Artificial Sequence
  chemically synthesized
aggatccccctctacattta

SEQ ID NO: 9704 - DNA, 20 bp, Artificial Sequence
  chemically synthesized
tccccctctacatttaaagt

SEQ ID NO: 9705 - DNA, 20 bp, Artificial Sequence
  chemically synthesized
tctacatttaaagttggttt

SEQ ID NO: 9706 - DNA, 20 bp, Artificial Sequence
  chemically synthesized
catttaaagttggtttaagt

SEQ ID NO: 9707 - DNA, 20 bp, Artificial Sequence
  chemically synthesized
tttaagttggctttaattaa

SEQ ID NO: 9708 - DNA, 20 bp, Artificial Sequence
  chemically synthesized
tttaattaatagcaactctt

SEQ ID NO: 9709 - DNA, 20 bp, Artificial Sequence
  chemically synthesized
atagcaactcttaagataat

SEQ ID NO: 9710 - DNA, 20 bp, Artificial Sequence
  chemically synthesized
tcagaattttcttaaccttt

SEQ ID NO: 9711 - DNA, 20 bp, Artificial Sequence
  chemically synthesized
cttttagccttactgttgaa

SEQ ID NO: 9712 - DNA, 20 bp, Artificial Sequence
  chemically synthesized
tgtacaaatcatttgcttct

SEQ ID NO: 9713 - DNA, 20 bp, Artificial Sequence
  chemically synthesized
caaatcatttgcttcttgga

SEQ ID NO: 9714 - DNA, 20 bp, Artificial Sequence
  chemically synthesized
taatttcttttactaaaatg

SEQ ID NO: 9715 - DNA, 20 bp, Artificial Sequence
  chemically synthesized
aatttcttttactaaaatgt

SEQ ID NO: 9716 - DNA, 20 bp, Artificial Sequence
  chemically synthesized
ctaaaatgtgggcttttgac

SEQ ID NO: 9717 - DNA, 20 bp, Artificial Sequence
  chemically synthesized
gatgaatgtaaatgttcttc

SEQ ID NO: 9718 - DNA, 20 bp, Artificial Sequence
  chemically synthesized
ttattctttatattttctaa

SEQ ID NO: 9719 - DNA, 20 bp, Artificial Sequence
  chemically synthesized
attttctaacagattctgtg

SEQ ID NO: 9720 - DNA, 20 bp, Artificial Sequence
  chemically synthesized
ttctaacagattctgtgtag

SEQ ID NO: 9721 - DNA, 20 bp, Artificial Sequence
  chemically synthesized
tctaacagattctgtgtagt

SEQ ID NO: 9722 - DNA, 20 bp, Artificial Sequence
  chemically synthesized
cagattctgtgtagtgggat

SEQ ID NO: 9723 - DNA, 20 bp, Artificial Sequence
  chemically synthesized
attctgtgtagtgggatgag

SEQ ID NO: 9724 - DNA, 20 bp, Artificial Sequence
  chemically synthesized
tctgtgtagtgggatgagca

SEQ ID NO: 9725 - DNA, 20 bp, Artificial Sequence
  chemically synthesized
agaacaaaaacaaaataatc

SEQ ID NO: 9726 - DNA, 20 bp, Artificial Sequence
  chemically synthesized
caaaaacaaaataatccagt

SEQ ID NO: 9727 - DNA, 20 bp, Artificial Sequence
  chemically synthesized
acaaaataatccagtgagaa

SEQ ID NO: 9728 - DNA, 20 bp, Artificial Sequence
  chemically synthesized
aaagcccgtaaataaacctt

SEQ ID NO: 9729 - DNA, 20 bp, Artificial Sequence
  chemically synthesized
ccgtaaataaaccttcagac

SEQ ID NO: 9730 - DNA, 20 bp, Artificial Sequence
  chemically synthesized
gtaaataaaccttcagacca

SEQ ID NO: 9731 - DNA, 20 bp, Artificial Sequence
  chemically synthesized
cagaccagagatctattctc

SEQ ID NO: 9732 - DNA, 20 bp, Artificial Sequence
  chemically synthesized
tctattctctagcttatttt

SEQ ID NO: 9733 - DNA, 20 bp, Artificial Sequence
  chemically synthesized
tattttaagctcaacttaaa

SEQ ID NO: 9734 - DNA, 20 bp, Artificial Sequence
  chemically synthesized
tttaagctcaacttaaaaag

SEQ ID NO: 9735 - DNA, 20 bp, Artificial Sequence
  chemically synthesized
ttaactccaccctccttcaa

SEQ ID NO: 9736 - DNA, 20 bp, Artificial Sequence
  chemically synthesized
ccaccctccttcaaaagaaa

SEQ ID NO: 9737 - DNA, 20 bp, Artificial Sequence
  chemically synthesized
gtctatatgattgatttgca

SEQ ID NO: 9738 - DNA, 20 bp, Artificial Sequence
  chemically synthesized
attgatttgcacagctcatc

SEQ ID NO: 9739 - DNA, 20 bp, Artificial Sequence
  chemically synthesized
atttgcacagctcatctggc

SEQ ID NO: 9740 - DNA, 20 bp, Artificial Sequence
  chemically synthesized
tgcacagctcatctggccag

SEQ ID NO: 9741 - DNA, 20 bp, Artificial Sequence
  chemically synthesized
cacagctcatctggccagaa

SEQ ID NO: 9742 - DNA, 20 bp, Artificial Sequence
  chemically synthesized
ctcatctggccagaagagct

SEQ ID NO: 9743 - DNA, 20 bp, Artificial Sequence
  chemically synthesized
tgagacatccgttcccctac

SEQ ID NO: 9744 - DNA, 20 bp, Artificial Sequence
  chemically synthesized
gagagtttcttgtaggggaa

SEQ ID NO: 9745 - DNA, 20 bp, Artificial Sequence
  chemically synthesized
ttgtaggggaacggatgtct

SEQ ID NO: 9746 - DNA, 20 bp, Artificial Sequence
  chemically synthesized
aacggatgtctcagctcttc

SEQ ID NO: 9747 - DNA, 20 bp, Artificial Sequence
  chemically synthesized
gatgtctcagctcttctggc

SEQ ID NO: 9748 - DNA, 20 bp, Artificial Sequence
  chemically synthesized
ctcagctcttctggccagat

SEQ ID NO: 9749 - DNA, 20 bp, Artificial Sequence
  chemically synthesized
agctgtgcaaatcaatcata

SEQ ID NO: 9750 - DNA, 20 bp, Artificial Sequence
  chemically synthesized
gtgcaaatcaatcatataga

SEQ ID NO: 9751 - DNA, 20 bp, Artificial Sequence
  chemically synthesized
caatcatatagacagtataa

SEQ ID NO: 9752 - DNA, 20 bp, Artificial Sequence
  chemically synthesized
tcatatagacagtataaaag

SEQ ID NO: 9753 - DNA, 20 bp, Artificial Sequence
  chemically synthesized
catatagacagtataaaagt

SEQ ID NO: 9754 - DNA, 20 bp, Artificial Sequence
  chemically synthesized
aggaaatgctgtttcttttg

SEQ ID NO: 9755 - DNA, 20 bp, Artificial Sequence
  chemically synthesized
ggaaatgctgtttcttttga

SEQ ID NO: 9756 - DNA, 20 bp, Artificial Sequence
  chemically synthesized
aaatgctgtttcttttgaag

SEQ ID NO: 9757 - DNA, 20 bp, Artificial Sequence
  chemically synthesized
aatgctgtttcttttgaagg

SEQ ID NO: 9758 - DNA, 20 bp, Artificial Sequence
  chemically synthesized
atgctgtttcttttgaagga

SEQ ID NO: 9759 - DNA, 20 bp, Artificial Sequence
  chemically synthesized
ctgtttcttttgaaggaggg

SEQ ID NO: 9760 - DNA, 20 bp, Artificial Sequence
  chemically synthesized
gtttcttttgaaggagggtg

SEQ ID NO: 9761 - DNA, 20 bp, Artificial Sequence
  chemically synthesized
gagggtggagttaaatcatt

SEQ ID NO: 9762 - DNA, 20 bp, Artificial Sequence
  chemically synthesized
ttaaatcattaagtgtattg

SEQ ID NO: 9763 - DNA, 20 bp, Artificial Sequence
  chemically synthesized
taaatcattaagtgtattga

SEQ ID NO: 9764 - DNA, 20 bp, Artificial Sequence
  chemically synthesized
ttaagtgtattgaaggcgaa

SEQ ID NO: 9765 - DNA, 20 bp, Artificial Sequence
  chemically synthesized
gtattgaaggcgaaaagaat

SEQ ID NO: 9766 - DNA, 20 bp, Artificial Sequence
  chemically synthesized
attgaaggcgaaaagaatca

SEQ ID NO: 9767 - DNA, 20 bp, Artificial Sequence
  chemically synthesized
aggcgaaaagaatcagagaa

SEQ ID NO: 9768 - DNA, 20 bp, Artificial Sequence
  chemically synthesized
agagaacagttcttcttttt

SEQ ID NO: 9769 - DNA, 20 bp, Artificial Sequence
  chemically synthesized
acagttcttctttttaagtt

SEQ ID NO: 9770 - DNA, 20 bp, Artificial Sequence
  chemically synthesized
ttttaagttgagcttaaaat

SEQ ID NO: 9771 - DNA, 20 bp, Artificial Sequence
  chemically synthesized
aagttgagcttaaaataagc

SEQ ID NO: 9772 - DNA, 20 bp, Artificial Sequence
  chemically synthesized
gttgagcttaaaataagcta

SEQ ID NO: 9773 - DNA, 20 bp, Artificial Sequence
  chemically synthesized
gcttaaaataagctagagaa

SEQ ID NO: 9774 - DNA, 20 bp, Artificial Sequence
  chemically synthesized
taagctagagaatagatctc

SEQ ID NO: 9775 - DNA, 20 bp, Artificial Sequence
  chemically synthesized
gagaatagatctctggtctg

SEQ ID NO: 9776 - DNA, 20 bp, Artificial Sequence
  chemically synthesized
agaatagatctctggtctga

SEQ ID NO: 9777 - DNA, 20 bp, Artificial Sequence
  chemically synthesized
ctggtctgaaggtttattta

SEQ ID NO: 9778 - DNA, 20 bp, Artificial Sequence
  chemically synthesized
tggtctgaaggtttatttac

SEQ ID NO: 9779 - DNA, 20 bp, Artificial Sequence
  chemically synthesized
tatttacgggcttttctcac

SEQ ID NO: 9780 - DNA, 20 bp, Artificial Sequence
  chemically synthesized
tctctgctcatcccactaca

SEQ ID NO: 9781 - DNA, 20 bp, Artificial Sequence
  chemically synthesized
tcccactacacagaatctgt

SEQ ID NO: 9782 - DNA, 20 bp, Artificial Sequence
  chemically synthesized
agaatctgttagaaaatata

SEQ ID NO: 9783 - DNA, 20 bp, Artificial Sequence
  chemically synthesized
gttagaaaatataaagaata

SEQ ID NO: 9784 - DNA, 20 bp, Artificial Sequence
  chemically synthesized
ttagaaaatataaagaataa

SEQ ID NO: 9785 - DNA, 20 bp, Artificial Sequence
  chemically synthesized
atataaagaataaaggatat

SEQ ID NO: 9786 - DNA, 20 bp, Artificial Sequence
  chemically synthesized
ataaagaataaaggatatca

SEQ ID NO: 9787 - DNA, 20 bp, Artificial Sequence
  chemically synthesized
agaataaaggatatcagagc

SEQ ID NO: 9788 - DNA, 20 bp, Artificial Sequence
  chemically synthesized
ataaaggatatcagagctag

SEQ ID NO: 9789 - DNA, 20 bp, Artificial Sequence
  chemically synthesized
gaagaacatttacattcatc

SEQ ID NO: 9790 - DNA, 20 bp, Artificial Sequence
  chemically synthesized
atttacattcatctagtcaa

SEQ ID NO: 9791 - DNA, 20 bp, Artificial Sequence
  chemically synthesized
ctagtcaaaagcccacattt

SEQ ID NO: 9792 - DNA, 20 bp, Artificial Sequence
  chemically synthesized
aaaagcccacattttagtaa

SEQ ID NO: 9793 - DNA, 20 bp, Artificial Sequence
  chemically synthesized
agtaaaagaaattactatcc

SEQ ID NO: 9794 - DNA, 20 bp, Artificial Sequence
  chemically synthesized
aaaagaaattactatccaag

SEQ ID NO: 9795 - DNA, 20 bp, Artificial Sequence
  chemically synthesized
aagaagcaaatgatttgtac

SEQ ID NO: 9796 - DNA, 20 bp, Artificial Sequence
  chemically synthesized
aaatgatttgtacaagatca

SEQ ID NO: 9797 - DNA, 20 bp, Artificial Sequence
  chemically synthesized
aatgatttgtacaagatcac

SEQ ID NO: 9798 - DNA, 20 bp, Artificial Sequence
  chemically synthesized
atgatttgtacaagatcaca

SEQ ID NO: 9799 - DNA, 20 bp, Artificial Sequence
  chemically synthesized
aagatcacagggcttttcaa

SEQ ID NO: 9800 - DNA, 20 bp, Artificial Sequence
  chemically synthesized
tcacagggcttttcaacagt

SEQ ID NO: 9801 - DNA, 20 bp, Artificial Sequence
  chemically synthesized
cacagggcttttcaacagta

SEQ ID NO: 9802 - DNA, 20 bp, Artificial Sequence
  chemically synthesized
cttttcaacagtaaggctaa

SEQ ID NO: 9803 - DNA, 20 bp, Artificial Sequence
  chemically synthesized
ttttcaacagtaaggctaaa

SEQ ID NO: 9804 - DNA, 20 bp, Artificial Sequence
  chemically synthesized
aacagtaaggctaaaaggtt

SEQ ID NO: 9805 - DNA, 20 bp, Artificial Sequence
  chemically synthesized
aagaaaattctgattatctt

SEQ ID NO: 9806 - DNA, 20 bp, Artificial Sequence
  chemically synthesized
gaaaattctgattatcttaa

SEQ ID NO: 9807 - DNA, 20 bp, Artificial Sequence
  chemically synthesized
ttaagagttgctattaatta

SEQ ID NO: 9808 - DNA, 20 bp, Artificial Sequence
  chemically synthesized
acttaaaccaactttaaatg

SEQ ID NO: 9809 - DNA, 20 bp, Artificial Sequence
  chemically synthesized
ttaaaccaactttaaatgta

SEQ ID NO: 9810 - DNA, 20 bp, Artificial Sequence
  chemically synthesized
taaaccaactttaaatgtag

SEQ ID NO: 9811 - DNA, 20 bp, Artificial Sequence
  chemically synthesized
aaaccaactttaaatgtaga

SEQ ID NO: 9812 - DNA, 20 bp, Artificial Sequence
  chemically synthesized
aaccaactttaaatgtagag

SEQ ID NO: 9813 - DNA, 20 bp, Artificial Sequence
  chemically synthesized
accaactttaaatgtagagg

SEQ ID NO: 9814 - DNA, 20 bp, Artificial Sequence
  chemically synthesized
ttaaatgtagagggggatcc

SEQ ID NO: 9815 - DNA, 20 bp, Artificial Sequence
  chemically synthesized
atcccaccccaacccccaca

SEQ ID NO: 9816 - DNA, 20 bp, Artificial Sequence
  chemically synthesized
atattattgttctctgtaaa

SEQ ID NO: 9817 - DNA, 20 bp, Artificial Sequence
  chemically synthesized
cggaaacaacctgttgtcta

SEQ ID NO: 9818 - DNA, 20 bp, Artificial Sequence
  chemically synthesized
gaaacaacctgttgtctaaa

SEQ ID NO: 9819 - DNA, 20 bp, Artificial Sequence
  chemically synthesized
tgtctaaagagttttaacta

SEQ ID NO: 9820 - DNA, 20 bp, Artificial Sequence
  chemically synthesized
gtctaaagagttttaactat

SEQ ID NO: 9821 - DNA, 20 bp, Artificial Sequence
  chemically synthesized
gagttttaactatgggctca

SEQ ID NO: 9822 - DNA, 20 bp, Artificial Sequence
  chemically synthesized
agttttaactatgggctcac

SEQ ID NO: 9823 - DNA, 20 bp, Artificial Sequence
  chemically synthesized
ttaactatgggctcacgggt

SEQ ID NO: 9824 - DNA, 20 bp, Artificial Sequence
  chemically synthesized
gggctcacgggtgagctaaa

SEQ ID NO: 9825 - DNA, 20 bp, Artificial Sequence
  chemically synthesized
ggctcacgggtgagctaaac

SEQ ID NO: 9826 - DNA, 20 bp, Artificial Sequence
  chemically synthesized
acaggtttcccatctttttc

SEQ ID NO: 9827 - DNA, 20 bp, Artificial Sequence
  chemically synthesized
ttcccatctttttctggacc

SEQ ID NO: 9828 - DNA, 20 bp, Artificial Sequence
  chemically synthesized
tcccatctttttctggaccc

SEQ ID NO: 9829 - DNA, 20 bp, Artificial Sequence
  chemically synthesized
tttttctggacccaggatct

SEQ ID NO: 9830 - DNA, 20 bp, Artificial Sequence
  chemically synthesized
ttctggacccaggatcttag

SEQ ID NO: 9831 - DNA, 20 bp, Artificial Sequence
  chemically synthesized
tctggacccaggatcttagt

SEQ ID NO: 9832 - DNA, 20 bp, Artificial Sequence
  chemically synthesized
ctggacccaggatcttagtg

SEQ ID NO: 9833 - DNA, 20 bp, Artificial Sequence
  chemically synthesized
tattttgttgcccttcaaac

SEQ ID NO: 9834 - DNA, 20 bp, Artificial Sequence
  chemically synthesized
ttgttgcccttcaaaccagt

SEQ ID NO: 9835 - DNA, 20 bp, Artificial Sequence
  chemically synthesized
tcaaaccagtaagcatttat

SEQ ID NO: 9836 - DNA, 20 bp, Artificial Sequence
  chemically synthesized
caaaccagtaagcatttatg

SEQ ID NO: 9837 - DNA, 20 bp, Artificial Sequence
  chemically synthesized
tatgaggactcacactatgc

SEQ ID NO: 9838 - DNA, 20 bp, Artificial Sequence
  chemically synthesized
ctcacactatgccagataca

SEQ ID NO: 9839 - DNA, 20 bp, Artificial Sequence
  chemically synthesized
tcacactatgccagatacat

SEQ ID NO: 9840 - DNA, 20 bp, Artificial Sequence
  chemically synthesized
cactatgccagatacatagg

SEQ ID NO: 9841 - DNA, 20 bp, Artificial Sequence
  chemically synthesized
tatgccagatacataggtgg

SEQ ID NO: 9842 - DNA, 20 bp, Artificial Sequence
  chemically synthesized
atgccagatacataggtggc

SEQ ID NO: 9843 - DNA, 20 bp, Artificial Sequence
  chemically synthesized
ggtggcaggattcttcactc

SEQ ID NO: 9844 - DNA, 20 bp, Artificial Sequence
  chemically synthesized
ctccagatataatctatctg

SEQ ID NO: 9845 - DNA, 20 bp, Artificial Sequence
  chemically synthesized
gatagattatatctggagtg

SEQ ID NO: 9846 - DNA, 20 bp, Artificial Sequence
  chemically synthesized
acctatgtatctggcatagt

SEQ ID NO: 9847 - DNA, 20 bp, Artificial Sequence
  chemically synthesized
aagggcaacaaaatagtgaa

SEQ ID NO: 9848 - DNA, 20 bp, Artificial Sequence
  chemically synthesized
tgaaaatccccactaagatc

SEQ ID NO: 9849 - DNA, 20 bp, Artificial Sequence
  chemically synthesized
gtttacagagaacaataata

SEQ ID NO: 9850 - DNA, 20 bp, Artificial Sequence
  chemically synthesized
tgggtggtgagcatctgtgt

SEQ ID NO: 9851 - DNA, 20 bp, Artificial Sequence
  chemically synthesized
gtgagcatctgtgtgggggt

SEQ ID NO: 9852 - DNA, 20 bp, Artificial Sequence
  chemically synthesized
catctgtgtgggggttgggg

SEQ ID NO: 9853 - DNA, 20 bp, Artificial Sequence
  chemically synthesized
gtgggggttggggtgggata

SEQ ID NO: 9854 - DNA, 20 bp, Artificial Sequence
  chemically synthesized
ggtgggataggggatacggg

SEQ ID NO: 9855 - DNA, 20 bp, Artificial Sequence
  chemically synthesized
gagtggagaaaaaggggaca

SEQ ID NO: 9856 - DNA, 20 bp, Artificial Sequence
  chemically synthesized
cacagggttaatgtgaagtc

SEQ ID NO: 9857 - DNA, 20 bp, Artificial Sequence
  chemically synthesized
atagcaactcttaagataat

SEQ ID NO: 9858 - DNA, 20 bp, Artificial Sequence
  chemically synthesized
ttgtacaaatcatttgcttc

SEQ ID NO: 9859 - DNA, 20 bp, Artificial Sequence
  chemically synthesized
aaatgtgggcttttgactag

SEQ ID NO: 9860 - DNA, 20 bp, Artificial Sequence
  chemically synthesized
ttctaacagattctgtgtag

SEQ ID NO: 9861 - DNA, 20 bp, Artificial Sequence
  chemically synthesized
ggagagtttcttgtagggga

SEQ ID NO: 9862 - DNA, 20 bp, Artificial Sequence
  chemically synthesized
aaatgctgtttcttttgaag

SEQ ID NO: 9863 - DNA, 20 bp, Artificial Sequence
  chemically synthesized
ctgtttcttttgaaggaggg

SEQ ID NO: 9864 - DNA, 20 bp, Artificial Sequence
  chemically synthesized
ttaagtgtattgaaggcgaa

SEQ ID NO: 9865 - DNA, 20 bp, Artificial Sequence
  chemically synthesized
gttgagcttaaaataagcta

SEQ ID NO: 9866 - DNA, 20 bp, Artificial Sequence
  chemically synthesized
ttatttacgggcttttctca

SEQ ID NO: 9867 - DNA, 20 bp, Artificial Sequence
  chemically synthesized
tctctgctcatcccactaca

SEQ ID NO: 9868 - DNA, 20 bp, Artificial Sequence
  chemically synthesized
agaatctgttagaaaatata

SEQ ID NO: 9869 - DNA, 20 bp, Artificial Sequence
  chemically synthesized
gttagaaaatataaagaata

SEQ ID NO: 9870 - DNA, 20 bp, Artificial Sequence
  chemically synthesized
aagaaaattctgattatctt

SEQ ID NO: 9871 - DNA, 20 bp, Artificial Sequence
  chemically synthesized
aaccaactttaaatgtagag

SEQ ID NO: 9872 - DNA, 20 bp, Artificial Sequence
  chemically synthesized
cggaaacaacctgttgtcta

SEQ ID NO: 9873 - DNA, 20 bp, Artificial Sequence
  chemically synthesized
agagttttaactatgggctc

SEQ ID NO: 9874 - DNA, 20 bp, Artificial Sequence
  chemically synthesized
ttcccatctttttctggacc

SEQ ID NO: 9875 - DNA, 20 bp, Artificial Sequence
  chemically synthesized
tctggacccaggatcttagt

SEQ ID NO: 9876 - DNA, 20 bp, Artificial Sequence
  chemically synthesized
tatgccagatacataggtgg

SEQ ID NO: 9877 - DNA, 20 bp, Artificial Sequence
  chemically synthesized
agatagattatatctggagt

SEQ ID NO: 9878 - DNA, 20 bp, Artificial Sequence
  chemically synthesized
tccccactaagatcctgggt

SEQ ID NO: 9879 - DNA, 20 bp, Artificial Sequence
  chemically synthesized
ataggggatacggggagagt

SEQ ID NO: 9880 - DNA, 20 bp, Artificial Sequence
  chemically synthesized
aatagcaactcttaagataa

SEQ ID NO: 9881 - DNA, 20 bp, Artificial Sequence
  chemically synthesized
acaaaaacaaaataatccag

SEQ ID NO: 9882 - DNA, 20 bp, Artificial Sequence
  chemically synthesized
tttaactccaccctccttca

SEQ ID NO: 9883 - DNA, 20 bp, Artificial Sequence
  chemically synthesized
ctgagacatccgttccccta

SEQ ID NO: 9884 - DNA, 20 bp, Artificial Sequence
  chemically synthesized
attaagtgtattgaaggcga

SEQ ID NO: 9885 - DNA, 20 bp, Artificial Sequence
  chemically synthesized
agttgagcttaaaataagct

SEQ ID NO: 9886 - DNA, 20 bp, Artificial Sequence
  chemically synthesized
ttctctgctcatcccactac

SEQ ID NO: 9887 - DNA, 20 bp, Artificial Sequence
  chemically synthesized
atcccactacacagaatctg

SEQ ID NO: 9888 - DNA, 20 bp, Artificial Sequence
  chemically synthesized
cagaatctgttagaaaatat

SEQ ID NO: 9889 - DNA, 20 bp, Artificial Sequence
  chemically synthesized
caaaagcccacattttagta

SEQ ID NO: 9890 - DNA, 20 bp, Artificial Sequence
  chemically synthesized
caacagtaaggctaaaaggt

SEQ ID NO: 9891 - DNA, 20 bp, Artificial Sequence
  chemically synthesized
ctcacccgtgagcccatagt

SEQ ID NO: 9892 - DNA, 20 bp, Artificial Sequence
  chemically synthesized
tagtgggatgagcagagaac

SEQ ID NO: 9893 - DNA, 20 bp, Artificial Sequence
  chemically synthesized
ggcatagtgtgagtcctcat

SEQ ID NO: 9894 - DNA, 20 bp, Artificial Sequence
  chemically synthesized
gtgagtcctcataaatgctt

SEQ ID NO: 9895 - DNA, 20 bp, Artificial Sequence
  chemically synthesized
ggtccagaaaaagatgggaa

SEQ ID NO: 9896 - DNA, 20 bp, Artificial Sequence
  chemically synthesized
ttaaaactctttagacaaca

SEQ ID NO: 9897 - DNA, 20 bp, Artificial Sequence
  chemically synthesized
ctctttagacaacaggttgt

SEQ ID NO: 9898 - DNA, 20 bp, Artificial Sequence
  chemically synthesized
gatccccctctacatttaaa

SEQ ID NO: 9899 - DNA, 20 bp, Artificial Sequence
  chemically synthesized
tacatttaaagttggtttaa

SEQ ID NO: 9900 - DNA, 20 bp, Artificial Sequence
  chemically synthesized
cctgtgatcttgtacaaatc

SEQ ID NO: 9901 - DNA, 20 bp, Artificial Sequence
  chemically synthesized
gtaatttcttttactaaaat

SEQ ID NO: 9902 - DNA, 20 bp, Artificial Sequence
  chemically synthesized
ctttattctttatattttct

SEQ ID NO: 9903 - DNA, 20 bp, Artificial Sequence
  chemically synthesized
ttcagaccagagatctattc

SEQ ID NO: 9904 - DNA, 20 bp, Artificial Sequence
  chemically synthesized
acttaaaaagaagaactgtt

SEQ ID NO: 9905 - DNA, 20 bp, Artificial Sequence
  chemically synthesized
cttttcgccttcaatacact

SEQ ID NO: 9906 - DNA, 20 bp, Artificial Sequence
  chemically synthesized
ttcctacttttatactgtct

SEQ ID NO: 9907 - DNA, 20 bp, Artificial Sequence
  chemically synthesized
tacttttatactgtctatat

SEQ ID NO: 9908 - DNA, 20 bp, Artificial Sequence
  chemically synthesized
gacagtataaaagtaggaaa

SEQ ID NO: 9909 - DNA, 20 bp, Artificial Sequence
  chemically synthesized
gaacagttcttctttttaag

SEQ ID NO: 9910 - DNA, 20 bp, Artificial Sequence
  chemically synthesized
agagaatagatctctggtct

SEQ ID NO: 9911 - DNA, 20 bp, Artificial Sequence
  chemically synthesized
tctggtctgaaggtttattt

SEQ ID NO: 9912 - DNA, 20 bp, Artificial Sequence
  chemically synthesized
tttatttacgggcttttctc

SEQ ID NO: 9913 - DNA, 20 bp, Artificial Sequence
  chemically synthesized
gggcttttctcactggatta

SEQ ID NO: 9914 - DNA, 20 bp, Artificial Sequence
  chemically synthesized
gaaattactatccaagaagc

SEQ ID NO: 9915 - DNA, 20 bp, Artificial Sequence
  chemically synthesized
aaatgatttgtacaagatca

SEQ ID NO: 9916 - DNA, 20 bp, Artificial Sequence
  chemically synthesized
aggctaaaaggttaagaaaa

SEQ ID NO: 9917 - DNA, 20 bp, Artificial Sequence
  chemically synthesized
cggaaacaacctgttgtcta

SEQ ID NO: 9918 - DNA, 20 bp, Artificial Sequence
  chemically synthesized
tgggctcacgggtgagctaa

SEQ ID NO: 9919 - DNA, 20 bp, Artificial Sequence
  chemically synthesized
ttctggacccaggatcttag

SEQ ID NO: 9920 - DNA, 20 bp, Artificial Sequence
  chemically synthesized
ctatgccagatacataggtg

SEQ ID NO: 9921 - DNA, 22 bp, Artificial Sequence
  chemically synthesized
cagatagattatatctggagtg

SEQ ID NO: 9922 - DNA, 22 bp, Artificial Sequence
  chemically synthesized
agatagattatatctggagtga

SEQ ID NO: 9923 - DNA, 22 bp, Artificial Sequence
  chemically synthesized
tatctggagtgaagaatcctgc

SEQ ID NO: 9924 - DNA, 22 bp, Artificial Sequence
  chemically synthesized
gagtgaagaatcctgccaccta

SEQ ID NO: 9925 - DNA, 22 bp, Artificial Sequence
  chemically synthesized
ccacctatgtatctggcatagt

SEQ ID NO: 9926 - DNA, 22 bp, Artificial Sequence
  chemically synthesized
tgtatctggcatagtgtgagtc

SEQ ID NO: 9927 - DNA, 22 bp, Artificial Sequence
  chemically synthesized
gcatagtgtgagtcctcataaa

SEQ ID NO: 9928 - DNA, 22 bp, Artificial Sequence
  chemically synthesized
ataaatgcttactggtttgaag

SEQ ID NO: 9929 - DNA, 22 bp, Artificial Sequence
  chemically synthesized
actggtttgaagggcaacaaaa

SEQ ID NO: 9930 - DNA, 22 bp, Artificial Sequence
  chemically synthesized
ctggtttgaagggcaacaaaat

SEQ ID NO: 9931 - DNA, 22 bp, Artificial Sequence
  chemically synthesized
gtttgaagggcaacaaaatagt

SEQ ID NO: 9932 - DNA, 22 bp, Artificial Sequence
  chemically synthesized
gaagggcaacaaaatagtgaac

SEQ ID NO: 9933 - DNA, 22 bp, Artificial Sequence
  chemically synthesized
aagggcaacaaaatagtgaaca

SEQ ID NO: 9934 - DNA, 22 bp, Artificial Sequence
  chemically synthesized
agatcctgggtccagaaaaaga

SEQ ID NO: 9935 - DNA, 22 bp, Artificial Sequence
  chemically synthesized
ggtccagaaaaagatgggaaac

SEQ ID NO: 9936 - DNA, 22 bp, Artificial Sequence
  chemically synthesized
tttagctcacccgtgagcccat

SEQ ID NO: 9937 - DNA, 22 bp, Artificial Sequence
  chemically synthesized
agctcacccgtgagcccatagt

SEQ ID NO: 9938 - DNA, 22 bp, Artificial Sequence
  chemically synthesized
gctcacccgtgagcccatagtt

SEQ ID NO: 9939 - DNA, 22 bp, Artificial Sequence
  chemically synthesized
acccgtgagcccatagttaaaa

SEQ ID NO: 9940 - DNA, 22 bp, Artificial Sequence
  chemically synthesized
aaactctttagacaacaggttg

SEQ ID NO: 9941 - DNA, 22 bp, Artificial Sequence
  chemically synthesized
tttagacaacaggttgtttccg

SEQ ID NO: 9942 - DNA, 22 bp, Artificial Sequence
  chemically synthesized
tagacaacaggttgtttccgtt

SEQ ID NO: 9943 - DNA, 22 bp, Artificial Sequence
  chemically synthesized
agacaacaggttgtttccgttt

SEQ ID NO: 9944 - DNA, 22 bp, Artificial Sequence
  chemically synthesized
gacaacaggttgtttccgttta

SEQ ID NO: 9945 - DNA, 22 bp, Artificial Sequence
  chemically synthesized
tttccgtttacagagaacaata

SEQ ID NO: 9946 - DNA, 22 bp, Artificial Sequence
  chemically synthesized
ccgtttacagagaacaataata

SEQ ID NO: 9947 - DNA, 22 bp, Artificial Sequence
  chemically synthesized
cgtttacagagaacaataatat

SEQ ID NO: 9948 - DNA, 22 bp, Artificial Sequence
  chemically synthesized
acagagaacaataatattgggt

SEQ ID NO: 9949 - DNA, 22 bp, Artificial Sequence
  chemically synthesized
cagagaacaataatattgggtg

SEQ ID NO: 9950 - DNA, 22 bp, Artificial Sequence
  chemically synthesized
ggtggtgagcatctgtgtgggg

SEQ ID NO: 9951 - DNA, 22 bp, Artificial Sequence
  chemically synthesized
tgtgggggttggggtgggatag

SEQ ID NO: 9952 - DNA, 22 bp, Artificial Sequence
  chemically synthesized
gggtgggataggggatacgggg

SEQ ID NO: 9953 - DNA, 22 bp, Artificial Sequence
  chemically synthesized
atgtgaagtccaggatccccct

SEQ ID NO: 9954 - DNA, 22 bp, Artificial Sequence
  chemically synthesized
tacatttaaagttggtttaagt

SEQ ID NO: 9955 - DNA, 22 bp, Artificial Sequence
  chemically synthesized
catttaaagttggtttaagttg

SEQ ID NO: 9956 - DNA, 22 bp, Artificial Sequence
  chemically synthesized
aaagttggtttaagttggcttt

SEQ ID NO: 9957 - DNA, 22 bp, Artificial Sequence
  chemically synthesized
aagttggtttaagttggcttta

SEQ ID NO: 9958 - DNA, 22 bp, Artificial Sequence
  chemically synthesized
gtttaagttggctttaattaat

SEQ ID NO: 9959 - DNA, 22 bp, Artificial Sequence
  chemically synthesized
aagttggctttaattaatagca

SEQ ID NO: 9960 - DNA, 22 bp, Artificial Sequence
  chemically synthesized
agttggctttaattaatagcaa

SEQ ID NO: 9961 - DNA, 22 bp, Artificial Sequence
  chemically synthesized
gctttaattaatagcaactctt

SEQ ID NO: 9962 - DNA, 22 bp, Artificial Sequence
  chemically synthesized
taattaatagcaactcttaaga

SEQ ID NO: 9963 - DNA, 22 bp, Artificial Sequence
  chemically synthesized
aattaatagcaactcttaagat

SEQ ID NO: 9964 - DNA, 22 bp, Artificial Sequence
  chemically synthesized
attaatagcaactcttaagata

SEQ ID NO: 9965 - DNA, 22 bp, Artificial Sequence
  chemically synthesized
atagcaactcttaagataatca

SEQ ID NO: 9966 - DNA, 22 bp, Artificial Sequence
  chemically synthesized
ttaagataatcagaattttctt

SEQ ID NO: 9967 - DNA, 22 bp, Artificial Sequence
  chemically synthesized
aagataatcagaattttcttaa

SEQ ID NO: 9968 - DNA, 22 bp, Artificial Sequence
  chemically synthesized
agataatcagaattttcttaac

SEQ ID NO: 9969 - DNA, 22 bp, Artificial Sequence
  chemically synthesized
tcttaaccttttagccttactg

SEQ ID NO: 9970 - DNA, 22 bp, Artificial Sequence
  chemically synthesized
cttaaccttttagccttactgt

SEQ ID NO: 9971 - DNA, 22 bp, Artificial Sequence
  chemically synthesized
ttaaccttttagccttactgtt

SEQ ID NO: 9972 - DNA, 22 bp, Artificial Sequence
  chemically synthesized
aaccttttagccttactgttga

SEQ ID NO: 9973 - DNA, 22 bp, Artificial Sequence
  chemically synthesized
accttttagccttactgttgaa

SEQ ID NO: 9974 - DNA, 22 bp, Artificial Sequence
  chemically synthesized
ttagccttactgttgaaaagcc

SEQ ID NO: 9975 - DNA, 22 bp, Artificial Sequence
  chemically synthesized
tagccttactgttgaaaagccc

SEQ ID NO: 9976 - DNA, 22 bp, Artificial Sequence
  chemically synthesized
agccttactgttgaaaagccct

SEQ ID NO: 9977 - DNA, 22 bp, Artificial Sequence
  chemically synthesized
gccttactgttgaaaagccctg

SEQ ID NO: 9978 - DNA, 22 bp, Artificial Sequence
  chemically synthesized
actgttgaaaagccctgtgatc

SEQ ID NO: 9979 - DNA, 22 bp, Artificial Sequence
  chemically synthesized
ctgttgaaaagccctgtgatct

SEQ ID NO: 9980 - DNA, 22 bp, Artificial Sequence
  chemically synthesized
ttgaaaagccctgtgatcttgt

SEQ ID NO: 9981 - DNA, 22 bp, Artificial Sequence
  chemically synthesized
aaaagccctgtgatcttgtaca

SEQ ID NO: 9982 - DNA, 22 bp, Artificial Sequence
  chemically synthesized
tgatcttgtacaaatcatttgc

SEQ ID NO: 9983 - DNA, 22 bp, Artificial Sequence
  chemically synthesized
gtacaaatcatttgcttcttgg

SEQ ID NO: 9984 - DNA, 22 bp, Artificial Sequence
  chemically synthesized
tacaaatcatttgcttcttgga

SEQ ID NO: 9985 - DNA, 22 bp, Artificial Sequence
  chemically synthesized
gcttcttggatagtaatttctt

SEQ ID NO: 9986 - DNA, 22 bp, Artificial Sequence
  chemically synthesized
cttcttggatagtaatttcttt

SEQ ID NO: 9987 - DNA, 22 bp, Artificial Sequence
  chemically synthesized
cttggatagtaatttcttttac

SEQ ID NO: 9988 - DNA, 22 bp, Artificial Sequence
  chemically synthesized
ttggatagtaatttcttttact

SEQ ID NO: 9989 - DNA, 22 bp, Artificial Sequence
  chemically synthesized
ggatagtaatttcttttactaa

SEQ ID NO: 9990 - DNA, 22 bp, Artificial Sequence
  chemically synthesized
gatagtaatttcttttactaaa

SEQ ID NO: 9991 - DNA, 22 bp, Artificial Sequence
  chemically synthesized
cttttactaaaatgtgggcttt

SEQ ID NO: 9992 - DNA, 22 bp, Artificial Sequence
  chemically synthesized
ttttactaaaatgtgggctttt

SEQ ID NO: 9993 - DNA, 22 bp, Artificial Sequence
  chemically synthesized
ttactaaaatgtgggcttttga

SEQ ID NO: 9994 - DNA, 22 bp, Artificial Sequence
  chemically synthesized
tactaaaatgtgggcttttgac

SEQ ID NO: 9995 - DNA, 22 bp, Artificial Sequence
  chemically synthesized
actaaaatgtgggcttttgact

SEQ ID NO: 9996 - DNA, 22 bp, Artificial Sequence
  chemically synthesized
ctaaaatgtgggcttttgacta

SEQ ID NO: 9997 - DNA, 22 bp, Artificial Sequence
  chemically synthesized
aaatgtgggcttttgactagat

SEQ ID NO: 9998 - DNA, 22 bp, Artificial Sequence
  chemically synthesized
ttgactagatgaatgtaaatgt

SEQ ID NO: 9999 - DNA, 22 bp, Artificial Sequence
  chemically synthesized
tgactagatgaatgtaaatgtt

SEQ ID NO: 10000 - DNA, 22 bp, Artificial Sequence
  chemically synthesized
gactagatgaatgtaaatgttc

SEQ ID NO: 10001 - DNA, 22 bp, Artificial Sequence
  chemically synthesized
actagatgaatgtaaatgttct

SEQ ID NO: 10002 - DNA, 22 bp, Artificial Sequence
  chemically synthesized
gatgaatgtaaatgttcttcta

SEQ ID NO: 10003 - DNA, 22 bp, Artificial Sequence
  chemically synthesized
ttctagctctgatatcctttat

SEQ ID NO: 10004 - DNA, 22 bp, Artificial Sequence
  chemically synthesized
ctagctctgatatcctttattc

SEQ ID NO: 10005 - DNA, 22 bp, Artificial Sequence
  chemically synthesized
tagctctgatatcctttattct

SEQ ID NO: 10006 - DNA, 22 bp, Artificial Sequence
  chemically synthesized
gctctgatatcctttattcttt

SEQ ID NO: 10007 - DNA, 22 bp, Artificial Sequence
  chemically synthesized
tgatatcctttattctttatat

SEQ ID NO: 10008 - DNA, 22 bp, Artificial Sequence
  chemically synthesized
atatcctttattctttatattt

SEQ ID NO: 10009 - DNA, 22 bp, Artificial Sequence
  chemically synthesized
tattctttatattttctaacag

SEQ ID NO: 10010 - DNA, 22 bp, Artificial Sequence
  chemically synthesized
attctttatattttctaacaga

SEQ ID NO: 10011 - DNA, 22 bp, Artificial Sequence
  chemically synthesized
ttctttatattttctaacagat

SEQ ID NO: 10012 - DNA, 22 bp, Artificial Sequence
  chemically synthesized
tttatattttctaacagattct

SEQ ID NO: 10013 - DNA, 22 bp, Artificial Sequence
  chemically synthesized
tatattttctaacagattctgt

SEQ ID NO: 10014 - DNA, 22 bp, Artificial Sequence
  chemically synthesized
atattttctaacagattctgtg

SEQ ID NO: 10015 - DNA, 22 bp, Artificial Sequence
  chemically synthesized
tattttctaacagattctgtgt

SEQ ID NO: 10016 - DNA, 22 bp, Artificial Sequence
  chemically synthesized
tctaacagattctgtgtagtgg

SEQ ID NO: 10017 - DNA, 22 bp, Artificial Sequence
  chemically synthesized
ctaacagattctgtgtagtggg

SEQ ID NO: 10018 - DNA, 22 bp, Artificial Sequence
  chemically synthesized
taacagattctgtgtagtggga

SEQ ID NO: 10019 - DNA, 22 bp, Artificial Sequence
  chemically synthesized
acagattctgtgtagtgggatg

SEQ ID NO: 10020 - DNA, 22 bp, Artificial Sequence
  chemically synthesized
tgtgtagtgggatgagcagaga

SEQ ID NO: 10021 - DNA, 22 bp, Artificial Sequence
  chemically synthesized
tgtagtgggatgagcagagaac

SEQ ID NO: 10022 - DNA, 22 bp, Artificial Sequence
  chemically synthesized
cagaccagagatctattctcta

SEQ ID NO: 10023 - DNA, 22 bp, Artificial Sequence
  chemically synthesized
agaccagagatctattctctag

SEQ ID NO: 10024 - DNA, 22 bp, Artificial Sequence
  chemically synthesized
ttctctagcttattttaagctc

SEQ ID NO: 10025 - DNA, 22 bp, Artificial Sequence
  chemically synthesized
tctagcttattttaagctcaac

SEQ ID NO: 10026 - DNA, 22 bp, Artificial Sequence
  chemically synthesized
tagcttattttaagctcaactt

SEQ ID NO: 10027 - DNA, 22 bp, Artificial Sequence
  chemically synthesized
gcttattttaagctcaacttaa

SEQ ID NO: 10028 - DNA, 22 bp, Artificial Sequence
  chemically synthesized
attttaagctcaacttaaaaag

SEQ ID NO: 10029 - DNA, 22 bp, Artificial Sequence
  chemically synthesized
ttttaagctcaacttaaaaaga

SEQ ID NO: 10030 - DNA, 22 bp, Artificial Sequence
  chemically synthesized
taagctcaacttaaaaagaaga

SEQ ID NO: 10031 - DNA, 22 bp, Artificial Sequence
  chemically synthesized
aagctcaacttaaaaagaagaa

SEQ ID NO: 10032 - DNA, 22 bp, Artificial Sequence
  chemically synthesized
agctcaacttaaaaagaagaac

SEQ ID NO: 10033 - DNA, 22 bp, Artificial Sequence
  chemically synthesized
aacttaaaaagaagaactgttc

SEQ ID NO: 10034 - DNA, 22 bp, Artificial Sequence
  chemically synthesized
aaaaagaagaactgttctctga

SEQ ID NO: 10035 - DNA, 22 bp, Artificial Sequence
  chemically synthesized
aaaagaagaactgttctctgat

SEQ ID NO: 10036 - DNA, 22 bp, Artificial Sequence
  chemically synthesized
ttctctgattcttttcgccttc

SEQ ID NO: 10037 - DNA, 22 bp, Artificial Sequence
  chemically synthesized
tctgattcttttcgccttcaat

SEQ ID NO: 10038 - DNA, 22 bp, Artificial Sequence
  chemically synthesized
tgattcttttcgccttcaatac

SEQ ID NO: 10039 - DNA, 22 bp, Artificial Sequence
  chemically synthesized
attcttttcgccttcaatacac

SEQ ID NO: 10040 - DNA, 22 bp, Artificial Sequence
  chemically synthesized
ttttcgccttcaatacacttaa

SEQ ID NO: 10041 - DNA, 22 bp, Artificial Sequence
  chemically synthesized
ttcgccttcaatacacttaatg

SEQ ID NO: 10042 - DNA, 22 bp, Artificial Sequence
  chemically synthesized
tcgccttcaatacacttaatga

SEQ ID NO: 10043 - DNA, 22 bp, Artificial Sequence
  chemically synthesized
cgccttcaatacacttaatgat

SEQ ID NO: 10044 - DNA, 22 bp, Artificial Sequence
  chemically synthesized
gccttcaatacacttaatgatt

SEQ ID NO: 10045 - DNA, 22 bp, Artificial Sequence
  chemically synthesized
caatacacttaatgatttaact

SEQ ID NO: 10046 - DNA, 22 bp, Artificial Sequence
  chemically synthesized
aatacacttaatgatttaactc

SEQ ID NO: 10047 - DNA, 22 bp, Artificial Sequence
  chemically synthesized
aatgatttaactccaccctcct

SEQ ID NO: 10048 - DNA, 22 bp, Artificial Sequence
  chemically synthesized
atgatttaactccaccctcctt

SEQ ID NO: 10049 - DNA, 22 bp, Artificial Sequence
  chemically synthesized
aactccaccctccttcaaaaga

SEQ ID NO: 10050 - DNA, 22 bp, Artificial Sequence
  chemically synthesized
actccaccctccttcaaaagaa

SEQ ID NO: 10051 - DNA, 22 bp, Artificial Sequence
  chemically synthesized
caccctccttcaaaagaaacag

SEQ ID NO: 10052 - DNA, 22 bp, Artificial Sequence
  chemically synthesized
cttcaaaagaaacagcatttcc

SEQ ID NO: 10053 - DNA, 22 bp, Artificial Sequence
  chemically synthesized
caaaagaaacagcatttcctac

SEQ ID NO: 10054 - DNA, 22 bp, Artificial Sequence
  chemically synthesized
aaaagaaacagcatttcctact

SEQ ID NO: 10055 - DNA, 22 bp, Artificial Sequence
  chemically synthesized
cctacttttatactgtctatat

SEQ ID NO: 10056 - DNA, 22 bp, Artificial Sequence
  chemically synthesized
ctacttttatactgtctatatg

SEQ ID NO: 10057 - DNA, 22 bp, Artificial Sequence
  chemically synthesized
cttttatactgtctatatgatt

SEQ ID NO: 10058 - DNA, 22 bp, Artificial Sequence
  chemically synthesized
ttatactgtctatatgattgat

SEQ ID NO: 10059 - DNA, 22 bp, Artificial Sequence
  chemically synthesized
tatactgtctatatgattgatt

SEQ ID NO: 10060 - DNA, 22 bp, Artificial Sequence
  chemically synthesized
atactgtctatatgattgattt

SEQ ID NO: 10061 - DNA, 22 bp, Artificial Sequence
  chemically synthesized
tactgtctatatgattgatttg

SEQ ID NO: 10062 - DNA, 22 bp, Artificial Sequence
  chemically synthesized
tctatatgattgatttgcacag

SEQ ID NO: 10063 - DNA, 22 bp, Artificial Sequence
  chemically synthesized
tatgattgatttgcacagctca

SEQ ID NO: 10064 - DNA, 22 bp, Artificial Sequence
  chemically synthesized
atttgcacagctcatctggcca

SEQ ID NO: 10065 - DNA, 22 bp, Artificial Sequence
  chemically synthesized
gcacagctcatctggccagaag

SEQ ID NO: 10066 - DNA, 22 bp, Artificial Sequence
  chemically synthesized
cacagctcatctggccagaaga

SEQ ID NO: 10067 - DNA, 22 bp, Artificial Sequence
  chemically synthesized
atctggccagaagagctgagac

SEQ ID NO: 10068 - DNA, 22 bp, Artificial Sequence
  chemically synthesized
gccagaagagctgagacatccg

SEQ ID NO: 10069 - DNA, 22 bp, Artificial Sequence
  chemically synthesized
agacatccgttcccctacaaga

SEQ ID NO: 10070 - DNA, 22 bp, Artificial Sequence
  chemically synthesized
cttgtaggggaacggatgtctc

SEQ ID NO: 10071 - DNA, 22 bp, Artificial Sequence
  chemically synthesized
ttgtaggggaacggatgtctca

SEQ ID NO: 10072 - DNA, 22 bp, Artificial Sequence
  chemically synthesized
gtaggggaacggatgtctcagc

SEQ ID NO: 10073 - DNA, 22 bp, Artificial Sequence
  chemically synthesized
taggggaacggatgtctcagct

SEQ ID NO: 10074 - DNA, 22 bp, Artificial Sequence
  chemically synthesized
agctcttctggccagatgagct

SEQ ID NO: 10075 - DNA, 22 bp, Artificial Sequence
  chemically synthesized
ttctggccagatgagctgtgca

SEQ ID NO: 10076 - DNA, 22 bp, Artificial Sequence
  chemically synthesized
ctggccagatgagctgtgcaaa

SEQ ID NO: 10077 - DNA, 22 bp, Artificial Sequence
  chemically synthesized
tggccagatgagctgtgcaaat

SEQ ID NO: 10078 - DNA, 22 bp, Artificial Sequence
  chemically synthesized
gccagatgagctgtgcaaatca

SEQ ID NO: 10079 - DNA, 22 bp, Artificial Sequence
  chemically synthesized
tgcaaatcaatcatatagacag

SEQ ID NO: 10080 - DNA, 22 bp, Artificial Sequence
  chemically synthesized
tttcttttgaaggagggtggag

SEQ ID NO: 10081 - DNA, 22 bp, Artificial Sequence
  chemically synthesized
cttttgaaggagggtggagtta

SEQ ID NO: 10082 - DNA, 22 bp, Artificial Sequence
  chemically synthesized
ttttgaaggagggtggagttaa

SEQ ID NO: 10083 - DNA, 22 bp, Artificial Sequence
  chemically synthesized
ttgaaggagggtggagttaaat

SEQ ID NO: 10084 - DNA, 22 bp, Artificial Sequence
  chemically synthesized
tgaaggagggtggagttaaatc

SEQ ID NO: 10085 - DNA, 22 bp, Artificial Sequence
  chemically synthesized
gaaggagggtggagttaaatca

SEQ ID NO: 10086 - DNA, 22 bp, Artificial Sequence
  chemically synthesized
aaggagggtggagttaaatcat

SEQ ID NO: 10087 - DNA, 22 bp, Artificial Sequence
  chemically synthesized
aatcattaagtgtattgaaggc

SEQ ID NO: 10088 - DNA, 22 bp, Artificial Sequence
  chemically synthesized
agtgtattgaaggcgaaaagaa

SEQ ID NO: 10089 - DNA, 22 bp, Artificial Sequence
  chemically synthesized
aaggcgaaaagaatcagagaac

SEQ ID NO: 10090 - DNA, 22 bp, Artificial Sequence
  chemically synthesized
ttctttttaagttgagcttaaa

SEQ ID NO: 10091 - DNA, 22 bp, Artificial Sequence
  chemically synthesized
ctttttaagttgagcttaaaat

SEQ ID NO: 10092 - DNA, 22 bp, Artificial Sequence
  chemically synthesized
tttttaagttgagcttaaaata

SEQ ID NO: 10093 - DNA, 22 bp, Artificial Sequence
  chemically synthesized
tttaagttgagcttaaaataag

SEQ ID NO: 10094 - DNA, 22 bp, Artificial Sequence
  chemically synthesized
ttaagttgagcttaaaataagc

SEQ ID NO: 10095 - DNA, 22 bp, Artificial Sequence
  chemically synthesized
taagttgagcttaaaataagct

SEQ ID NO: 10096 - DNA, 22 bp, Artificial Sequence
  chemically synthesized
aagttgagcttaaaataagcta

SEQ ID NO: 10097 - DNA, 22 bp, Artificial Sequence
  chemically synthesized
agttgagcttaaaataagctag

SEQ ID NO: 10098 - DNA, 22 bp, Artificial Sequence
  chemically synthesized
agcttaaaataagctagagaat

SEQ ID NO: 10099 - DNA, 22 bp, Artificial Sequence
  chemically synthesized
aaaataagctagagaatagatc

SEQ ID NO: 10100 - DNA, 22 bp, Artificial Sequence
  chemically synthesized
aaataagctagagaatagatct

SEQ ID NO: 10101 - DNA, 22 bp, Artificial Sequence
  chemically synthesized
gagaatagatctctggtctgaa

SEQ ID NO: 10102 - DNA, 22 bp, Artificial Sequence
  chemically synthesized
tggtctgaaggtttatttacgg

SEQ ID NO: 10103 - DNA, 22 bp, Artificial Sequence
  chemically synthesized
gtctgaaggtttatttacgggc

SEQ ID NO: 10104 - DNA, 22 bp, Artificial Sequence
  chemically synthesized
aaggtttatttacgggcttttc

SEQ ID NO: 10105 - DNA, 22 bp, Artificial Sequence
  chemically synthesized
atttacgggcttttctcactgg

SEQ ID NO: 10106 - DNA, 22 bp, Artificial Sequence
  chemically synthesized
tttacgggcttttctcactgga

SEQ ID NO: 10107 - DNA, 22 bp, Artificial Sequence
  chemically synthesized
acgggcttttctcactggatta

SEQ ID NO: 10108 - DNA, 22 bp, Artificial Sequence
  chemically synthesized
cgggcttttctcactggattat

SEQ ID NO: 10109 - DNA, 22 bp, Artificial Sequence
  chemically synthesized
ttctcactggattattttgttt

SEQ ID NO: 10110 - DNA, 22 bp, Artificial Sequence
  chemically synthesized
tctcactggattattttgtttt

SEQ ID NO: 10111 - DNA, 22 bp, Artificial Sequence
  chemically synthesized
ctcactggattattttgttttt

SEQ ID NO: 10112 - DNA, 22 bp, Artificial Sequence
  chemically synthesized
tcactggattattttgtttttg

SEQ ID NO: 10113 - DNA, 22 bp, Artificial Sequence
  chemically synthesized
actggattattttgtttttgtt

SEQ ID NO: 10114 - DNA, 22 bp, Artificial Sequence
  chemically synthesized
gattattttgtttttgttctct

SEQ ID NO: 10115 - DNA, 22 bp, Artificial Sequence
  chemically synthesized
ttttgtttttgttctctgctca

SEQ ID NO: 10116 - DNA, 22 bp, Artificial Sequence
  chemically synthesized
tgtttttgttctctgctcatcc

SEQ ID NO: 10117 - DNA, 22 bp, Artificial Sequence
  chemically synthesized
gtttttgttctctgctcatccc

SEQ ID NO: 10118 - DNA, 22 bp, Artificial Sequence
  chemically synthesized
tttttgttctctgctcatccca

SEQ ID NO: 10119 - DNA, 22 bp, Artificial Sequence
  chemically synthesized
ttgttctctgctcatcccacta

SEQ ID NO: 10120 - DNA, 22 bp, Artificial Sequence
  chemically synthesized
tgttctctgctcatcccactac

SEQ ID NO: 10121 - DNA, 22 bp, Artificial Sequence
  chemically synthesized
gttctctgctcatcccactaca

SEQ ID NO: 10122 - DNA, 22 bp, Artificial Sequence
  chemically synthesized
ttctctgctcatcccactacac

SEQ ID NO: 10123 - DNA, 22 bp, Artificial Sequence
  chemically synthesized
tctgctcatcccactacacaga

SEQ ID NO: 10124 - DNA, 22 bp, Artificial Sequence
  chemically synthesized
tgctcatcccactacacagaat

SEQ ID NO: 10125 - DNA, 22 bp, Artificial Sequence
  chemically synthesized
ctcatcccactacacagaatct

SEQ ID NO: 10126 - DNA, 22 bp, Artificial Sequence
  chemically synthesized
atcccactacacagaatctgtt

SEQ ID NO: 10127 - DNA, 22 bp, Artificial Sequence
  chemically synthesized
cacagaatctgttagaaaatat

SEQ ID NO: 10128 - DNA, 22 bp, Artificial Sequence
  chemically synthesized
ttagaaaatataaagaataaag

SEQ ID NO: 10129 - DNA, 22 bp, Artificial Sequence
  chemically synthesized
gaaaatataaagaataaaggat

SEQ ID NO: 10130 - DNA, 22 bp, Artificial Sequence
  chemically synthesized
gaagaacatttacattcatcta

SEQ ID NO: 10131 - DNA, 22 bp, Artificial Sequence
  chemically synthesized
acattcatctagtcaaaagccc

SEQ ID NO: 10132 - DNA, 22 bp, Artificial Sequence
  chemically synthesized
cattcatctagtcaaaagccca

SEQ ID NO: 10133 - DNA, 22 bp, Artificial Sequence
  chemically synthesized
atctagtcaaaagcccacattt

SEQ ID NO: 10134 - DNA, 22 bp, Artificial Sequence
  chemically synthesized
gtcaaaagcccacattttagta

SEQ ID NO: 10135 - DNA, 22 bp, Artificial Sequence
  chemically synthesized
tagtaaaagaaattactatcca

SEQ ID NO: 10136 - DNA, 22 bp, Artificial Sequence
  chemically synthesized
agtaaaagaaattactatccaa

SEQ ID NO: 10137 - DNA, 22 bp, Artificial Sequence
  chemically synthesized
gtaaaagaaattactatccaag

SEQ ID NO: 10138 - DNA, 22 bp, Artificial Sequence
  chemically synthesized
ctatccaagaagcaaatgattt

SEQ ID NO: 10139 - DNA, 22 bp, Artificial Sequence
  chemically synthesized
tccaagaagcaaatgatttgta

SEQ ID NO: 10140 - DNA, 22 bp, Artificial Sequence
  chemically synthesized
gtacaagatcacagggcttttc

SEQ ID NO: 10141 - DNA, 22 bp, Artificial Sequence
  chemically synthesized
tacaagatcacagggcttttca

SEQ ID NO: 10142 - DNA, 22 bp, Artificial Sequence
  chemically synthesized
ttcaacagtaaggctaaaaggt

SEQ ID NO: 10143 - DNA, 22 bp, Artificial Sequence
  chemically synthesized
tcaacagtaaggctaaaaggtt

SEQ ID NO: 10144 - DNA, 22 bp, Artificial Sequence
  chemically synthesized
caacagtaaggctaaaaggtta

SEQ ID NO: 10145 - DNA, 22 bp, Artificial Sequence
  chemically synthesized
aacagtaaggctaaaaggttaa

SEQ ID NO: 10146 - DNA, 22 bp, Artificial Sequence
  chemically synthesized
aaaggttaagaaaattctgatt

SEQ ID NO: 10147 - DNA, 22 bp, Artificial Sequence
  chemically synthesized
agaaaattctgattatcttaag

SEQ ID NO: 10148 - DNA, 22 bp, Artificial Sequence
  chemically synthesized
tgattatcttaagagttgctat

SEQ ID NO: 10149 - DNA, 22 bp, Artificial Sequence
  chemically synthesized
attatcttaagagttgctatta

SEQ ID NO: 10150 - DNA, 22 bp, Artificial Sequence
  chemically synthesized
tcttaagagttgctattaatta

SEQ ID NO: 10151 - DNA, 22 bp, Artificial Sequence
  chemically synthesized
aagagttgctattaattaaagc

SEQ ID NO: 10152 - DNA, 22 bp, Artificial Sequence
  chemically synthesized
agagttgctattaattaaagcc

SEQ ID NO: 10153 - DNA, 22 bp, Artificial Sequence
  chemically synthesized
ctattaattaaagccaacttaa

SEQ ID NO: 10154 - DNA, 22 bp, Artificial Sequence
  chemically synthesized
ttaattaaagccaacttaaacc

SEQ ID NO: 10155 - DNA, 22 bp, Artificial Sequence
  chemically synthesized
attaaagccaacttaaaccaac

SEQ ID NO: 10156 - DNA, 22 bp, Artificial Sequence
  chemically synthesized
aagccaacttaaaccaacttta

SEQ ID NO: 10157 - DNA, 22 bp, Artificial Sequence
  chemically synthesized
aaaccaactttaaatgtagagg

SEQ ID NO: 10158 - DNA, 22 bp, Artificial Sequence
  chemically synthesized
aaccaactttaaatgtagaggg

SEQ ID NO: 10159 - DNA, 22 bp, Artificial Sequence
  chemically synthesized
taaatgtagagggggatcctgg

SEQ ID NO: 10160 - DNA, 22 bp, Artificial Sequence
  chemically synthesized
aaatgtagagggggatcctgga

SEQ ID NO: 10161 - DNA, 22 bp, Artificial Sequence
  chemically synthesized
aatgtagagggggatcctggac

SEQ ID NO: 10162 - DNA, 22 bp, Artificial Sequence
  chemically synthesized
gacttcacattaaccctgtgtc

SEQ ID NO: 10163 - DNA, 22 bp, Artificial Sequence
  chemically synthesized
cacattaaccctgtgtcccctt

SEQ ID NO: 10164 - DNA, 22 bp, Artificial Sequence
  chemically synthesized
acattaaccctgtgtccccttt

SEQ ID NO: 10165 - DNA, 22 bp, Artificial Sequence
  chemically synthesized
accctgtgtcccctttttctcc

SEQ ID NO: 10166 - DNA, 22 bp, Artificial Sequence
  chemically synthesized
tgtcccctttttctccactctc

SEQ ID NO: 10167 - DNA, 22 bp, Artificial Sequence
  chemically synthesized
tttctccactctccccgtatcc

SEQ ID NO: 10168 - DNA, 22 bp, Artificial Sequence
  chemically synthesized
ttctccactctccccgtatccc

SEQ ID NO: 10169 - DNA, 22 bp, Artificial Sequence
  chemically synthesized
tctccactctccccgtatcccc

SEQ ID NO: 10170 - DNA, 22 bp, Artificial Sequence
  chemically synthesized
ctccactctccccgtatcccct

SEQ ID NO: 10171 - DNA, 22 bp, Artificial Sequence
  chemically synthesized
tccactctccccgtatccccta

SEQ ID NO: 10172 - DNA, 22 bp, Artificial Sequence
  chemically synthesized
cactctccccgtatcccctatc

SEQ ID NO: 10173 - DNA, 22 bp, Artificial Sequence
  chemically synthesized
tccccgtatcccctatcccacc

SEQ ID NO: 10174 - DNA, 22 bp, Artificial Sequence
  chemically synthesized
cccgtatcccctatcccacccc

SEQ ID NO: 10175 - DNA, 22 bp, Artificial Sequence
  chemically synthesized
tcccaccccaacccccacacag

SEQ ID NO: 10176 - DNA, 22 bp, Artificial Sequence
  chemically synthesized
accacccaatattattgttctc

SEQ ID NO: 10177 - DNA, 22 bp, Artificial Sequence
  chemically synthesized
ttgttctctgtaaacggaaaca

SEQ ID NO: 10178 - DNA, 22 bp, Artificial Sequence
  chemically synthesized
ttctctgtaaacggaaacaacc

SEQ ID NO: 10179 - DNA, 22 bp, Artificial Sequence
  chemically synthesized
tctgtaaacggaaacaacctgt

SEQ ID NO: 10180 - DNA, 22 bp, Artificial Sequence
  chemically synthesized
tgtaaacggaaacaacctgttg

SEQ ID NO: 10181 - DNA, 22 bp, Artificial Sequence
  chemically synthesized
taaacggaaacaacctgttgtc

SEQ ID NO: 10182 - DNA, 22 bp, Artificial Sequence
  chemically synthesized
ttgtctaaagagttttaactat

SEQ ID NO: 10183 - DNA, 22 bp, Artificial Sequence
  chemically synthesized
tctaaagagttttaactatggg

SEQ ID NO: 10184 - DNA, 22 bp, Artificial Sequence
  chemically synthesized
aagagttttaactatgggctca

SEQ ID NO: 10185 - DNA, 22 bp, Artificial Sequence
  chemically synthesized
taactatgggctcacgggtgag

SEQ ID NO: 10186 - DNA, 22 bp, Artificial Sequence
  chemically synthesized
aactatgggctcacgggtgagc

SEQ ID NO: 10187 - DNA, 22 bp, Artificial Sequence
  chemically synthesized
actatgggctcacgggtgagct

SEQ ID NO: 10188 - DNA, 22 bp, Artificial Sequence
  chemically synthesized
tgggctcacgggtgagctaaac

SEQ ID NO: 10189 - DNA, 22 bp, Artificial Sequence
  chemically synthesized
acgggtgagctaaacaggtttc

SEQ ID NO: 10190 - DNA, 22 bp, Artificial Sequence
  chemically synthesized
aacaggtttcccatctttttct

SEQ ID NO: 10191 - DNA, 22 bp, Artificial Sequence
  chemically synthesized
cccatctttttctggacccagg

SEQ ID NO: 10192 - DNA, 22 bp, Artificial Sequence
  chemically synthesized
ccatctttttctggacccagga

SEQ ID NO: 10193 - DNA, 22 bp, Artificial Sequence
  chemically synthesized
tttctggacccaggatcttagt

SEQ ID NO: 10194 - DNA, 22 bp, Artificial Sequence
  chemically synthesized
ttctggacccaggatcttagtg

SEQ ID NO: 10195 - DNA, 22 bp, Artificial Sequence
  chemically synthesized
tctggacccaggatcttagtgg

SEQ ID NO: 10196 - DNA, 22 bp, Artificial Sequence
  chemically synthesized
ctggacccaggatcttagtggg

SEQ ID NO: 10197 - DNA, 22 bp, Artificial Sequence
  chemically synthesized
tggacccaggatcttagtgggg

SEQ ID NO: 10198 - DNA, 22 bp, Artificial Sequence
  chemically synthesized
gacccaggatcttagtggggat

SEQ ID NO: 10199 - DNA, 22 bp, Artificial Sequence
  chemically synthesized
agtggggattttcactctgttc

SEQ ID NO: 10200 - DNA, 22 bp, Artificial Sequence
  chemically synthesized
gtggggattttcactctgttca

SEQ ID NO: 10201 - DNA, 22 bp, Artificial Sequence
  chemically synthesized
tcactctgttcactattttgtt

SEQ ID NO: 10202 - DNA, 22 bp, Artificial Sequence
  chemically synthesized
cactctgttcactattttgttg

SEQ ID NO: 10203 - DNA, 22 bp, Artificial Sequence
  chemically synthesized
actctgttcactattttgttgc

SEQ ID NO: 10204 - DNA, 22 bp, Artificial Sequence
  chemically synthesized
tgttcactattttgttgccctt

SEQ ID NO: 10205 - DNA, 22 bp, Artificial Sequence
  chemically synthesized
ttcactattttgttgcccttca

SEQ ID NO: 10206 - DNA, 22 bp, Artificial Sequence
  chemically synthesized
actattttgttgcccttcaaac

SEQ ID NO: 10207 - DNA, 22 bp, Artificial Sequence
  chemically synthesized
ttttgttgcccttcaaaccagt

SEQ ID NO: 10208 - DNA, 22 bp, Artificial Sequence
  chemically synthesized
tgttgcccttcaaaccagtaag

SEQ ID NO: 10209 - DNA, 22 bp, Artificial Sequence
  chemically synthesized
gttgcccttcaaaccagtaagc

SEQ ID NO: 10210 - DNA, 22 bp, Artificial Sequence
  chemically synthesized
ttgcccttcaaaccagtaagca

SEQ ID NO: 10211 - DNA, 22 bp, Artificial Sequence
  chemically synthesized
cccttcaaaccagtaagcattt

SEQ ID NO: 10212 - DNA, 22 bp, Artificial Sequence
  chemically synthesized
caaaccagtaagcatttatgag

SEQ ID NO: 10213 - DNA, 22 bp, Artificial Sequence
  chemically synthesized
aaaccagtaagcatttatgagg

SEQ ID NO: 10214 - DNA, 22 bp, Artificial Sequence
  chemically synthesized
atgaggactcacactatgccag

SEQ ID NO: 10215 - DNA, 22 bp, Artificial Sequence
  chemically synthesized
tgaggactcacactatgccaga

SEQ ID NO: 10216 - DNA, 22 bp, Artificial Sequence
  chemically synthesized
acactatgccagatacataggt

SEQ ID NO: 10217 - DNA, 22 bp, Artificial Sequence
  chemically synthesized
tgccagatacataggtggcagg

SEQ ID NO: 10218 - DNA, 22 bp, Artificial Sequence
  chemically synthesized
ttcactccagatataatctatc

SEQ ID NO: 10219 - DNA, 22 bp, Artificial Sequence
  chemically synthesized
cactccagatataatctatctg

SEQ ID NO: 10220 - DNA, 22 bp, Artificial Sequence
  chemically synthesized
actccagatataatctatctga

SEQ ID NO: 10221 - DNA, 20 bp, Artificial Sequence
  chemically synthesized
actttcacaatctgctagca

SEQ ID NO: 10222 - DNA, 20 bp, Artificial Sequence
  chemically synthesized
ctttcacaatctgctagcaa

SEQ ID NO: 10223 - DNA, 20 bp, Artificial Sequence
  chemically synthesized
atctgctagcaaaggttatg

SEQ ID NO: 10224 - DNA, 20 bp, Artificial Sequence
  chemically synthesized
gcagcgcgtgaacatgatca

SEQ ID NO: 10225 - DNA, 20 bp, Artificial Sequence
  chemically synthesized
gcgcgtgaacatgatcatgg

SEQ ID NO: 10226 - DNA, 20 bp, Artificial Sequence
  chemically synthesized
catgatcatggcagaatcac

SEQ ID NO: 10227 - DNA, 20 bp, Artificial Sequence
  chemically synthesized
atgatcatggcagaatcacc

SEQ ID NO: 10228 - DNA, 20 bp, Artificial Sequence
  chemically synthesized
cctcatcaccatctgccttt

SEQ ID NO: 10229 - DNA, 20 bp, Artificial Sequence
  chemically synthesized
ctcatcaccatctgcctttt

SEQ ID NO: 10230 - DNA, 20 bp, Artificial Sequence
  chemically synthesized
tgccttttaggatatctact

SEQ ID NO: 10231 - DNA, 20 bp, Artificial Sequence
  chemically synthesized
tctactcagtgctgaatgta

SEQ ID NO: 10232 - DNA, 20 bp, Artificial Sequence
  chemically synthesized
ctactcagtgctgaatgtac

SEQ ID NO: 10233 - DNA, 20 bp, Artificial Sequence
  chemically synthesized
ttccttttttaaaatacatt

SEQ ID NO: 10234 - DNA, 20 bp, Artificial Sequence
  chemically synthesized
cattgagtatgcttgccttt

SEQ ID NO: 10235 - DNA, 20 bp, Artificial Sequence
  chemically synthesized
gtatgcttgccttttagata

SEQ ID NO: 10236 - DNA, 20 bp, Artificial Sequence
  chemically synthesized
attttgattacatgatttga

SEQ ID NO: 10237 - DNA, 20 bp, Artificial Sequence
  chemically synthesized
atgatttgacagcaatattg

SEQ ID NO: 10238 - DNA, 20 bp, Artificial Sequence
  chemically synthesized
gatttgacagcaatattgaa

SEQ ID NO: 10239 - DNA, 20 bp, Artificial Sequence
  chemically synthesized
agcaatattgaagagtctaa

SEQ ID NO: 10240 - DNA, 20 bp, Artificial Sequence
  chemically synthesized
atattgaagagtctaacagc

SEQ ID NO: 10241 - DNA, 20 bp, Artificial Sequence
  chemically synthesized
agagtctaacagccagcacg

SEQ ID NO: 10242 - DNA, 20 bp, Artificial Sequence
  chemically synthesized
gagtctaacagccagcacgc

SEQ ID NO: 10243 - DNA, 20 bp, Artificial Sequence
  chemically synthesized
ctaacagccagcacgcaggt

SEQ ID NO: 10244 - DNA, 20 bp, Artificial Sequence
  chemically synthesized
cagccagcacgcaggttggt

SEQ ID NO: 10245 - DNA, 20 bp, Artificial Sequence
  chemically synthesized
gcacgcaggttggtaagtac

SEQ ID NO: 10246 - DNA, 20 bp, Artificial Sequence
  chemically synthesized
ggtaagtactggttctttgt

SEQ ID NO: 10247 - DNA, 20 bp, Artificial Sequence
  chemically synthesized
agtactggttctttgttagc

SEQ ID NO: 10248 - DNA, 20 bp, Artificial Sequence
  chemically synthesized
gtactggttctttgttagct

SEQ ID NO: 10249 - DNA, 20 bp, Artificial Sequence
  chemically synthesized
tcttcatttttaaaactaaa

SEQ ID NO: 10250 - DNA, 20 bp, Artificial Sequence
  chemically synthesized
tatgtttaataaacactgtt

SEQ ID NO: 10251 - DNA, 20 bp, Artificial Sequence
  chemically synthesized
acactgttcagttcatgatt

SEQ ID NO: 10252 - DNA, 20 bp, Artificial Sequence
  chemically synthesized
tttggtcatgtaattcctgt

SEQ ID NO: 10253 - DNA, 20 bp, Artificial Sequence
  chemically synthesized
ttagaaaacattcatctcct

SEQ ID NO: 10254 - DNA, 20 bp, Artificial Sequence
  chemically synthesized
ccttggtttaaaaaaattaa

SEQ ID NO: 10255 - DNA, 20 bp, Artificial Sequence
  chemically synthesized
tggtttaaaaaaattaaaag

SEQ ID NO: 10256 - DNA, 20 bp, Artificial Sequence
  chemically synthesized
ggtttaaaaaaattaaaagt

SEQ ID NO: 10257 - DNA, 20 bp, Artificial Sequence
  chemically synthesized
aaattaaaagtgggaaaaca

SEQ ID NO: 10258 - DNA, 20 bp, Artificial Sequence
  chemically synthesized
aaagtgggaaaacaaagaaa

SEQ ID NO: 10259 - DNA, 20 bp, Artificial Sequence
  chemically synthesized
gtgggaaaacaaagaaatag

SEQ ID NO: 10260 - DNA, 20 bp, Artificial Sequence
  chemically synthesized
aacaaagaaatagcagaata

SEQ ID NO: 10261 - DNA, 20 bp, Artificial Sequence
  chemically synthesized
ataaccacattatttttgtt

SEQ ID NO: 10262 - DNA, 20 bp, Artificial Sequence
  chemically synthesized
ttaccactttgaaatcaaaa

SEQ ID NO: 10263 - DNA, 20 bp, Artificial Sequence
  chemically synthesized
taccactttgaaatcaaaat

SEQ ID NO: 10264 - DNA, 20 bp, Artificial Sequence
  chemically synthesized
gaaatcaaaatgggaaacaa

SEQ ID NO: 10265 - DNA, 20 bp, Artificial Sequence
  chemically synthesized
ggaaacaaaagcacaaacaa

SEQ ID NO: 10266 - DNA, 20 bp, Artificial Sequence
  chemically synthesized
aatggccttatttacacaaa

SEQ ID NO: 10267 - DNA, 20 bp, Artificial Sequence
  chemically synthesized
tacacaaaaagtctgatttt

SEQ ID NO: 10268 - DNA, 20 bp, Artificial Sequence
  chemically synthesized
tttaagatatatgacatttc

SEQ ID NO: 10269 - DNA, 20 bp, Artificial Sequence
  chemically synthesized
ttaagatatatgacatttca

SEQ ID NO: 10270 - DNA, 20 bp, Artificial Sequence
  chemically synthesized
tatatgacatttcaaggttt

SEQ ID NO: 10271 - DNA, 20 bp, Artificial Sequence
  chemically synthesized
atgacatttcaaggtttcag

SEQ ID NO: 10272 - DNA, 20 bp, Artificial Sequence
  chemically synthesized
aggtttcagaagtatgtaat

SEQ ID NO: 10273 - DNA, 20 bp, Artificial Sequence
  chemically synthesized
ggtttcagaagtatgtaatg

SEQ ID NO: 10274 - DNA, 20 bp, Artificial Sequence
  chemically synthesized
aattatatatcttcaattta

SEQ ID NO: 10275 - DNA, 20 bp, Artificial Sequence
  chemically synthesized
atatcttcaatttaaagttt

SEQ ID NO: 10276 - DNA, 20 bp, Artificial Sequence
  chemically synthesized
aaagttttagttaaaacata

SEQ ID NO: 10277 - DNA, 20 bp, Artificial Sequence
  chemically synthesized
cataaagattaacctttcat

SEQ ID NO: 10278 - DNA, 20 bp, Artificial Sequence
  chemically synthesized
aagattaacctttcattagc

SEQ ID NO: 10279 - DNA, 20 bp, Artificial Sequence
  chemically synthesized
acctttcattagcaagctgt

SEQ ID NO: 10280 - DNA, 20 bp, Artificial Sequence
  chemically synthesized
caagctgttagttatcacca

SEQ ID NO: 10281 - DNA, 20 bp, Artificial Sequence
  chemically synthesized
gttatcaccaaagcttttca

SEQ ID NO: 10282 - DNA, 20 bp, Artificial Sequence
  chemically synthesized
caccaaagcttttcatggat

SEQ ID NO: 10283 - DNA, 20 bp, Artificial Sequence
  chemically synthesized
accaaagcttttcatggatt

SEQ ID NO: 10284 - DNA, 20 bp, Artificial Sequence
  chemically synthesized
tgtctctatgtcaaacatct

SEQ ID NO: 10285 - DNA, 20 bp, Artificial Sequence
  chemically synthesized
tctctatgtcaaacatcttg

SEQ ID NO: 10286 - DNA, 20 bp, Artificial Sequence
  chemically synthesized
aacatcttggagttgatatt

SEQ ID NO: 10287 - DNA, 20 bp, Artificial Sequence
  chemically synthesized
acatcttggagttgatattt

SEQ ID NO: 10288 - DNA, 20 bp, Artificial Sequence
  chemically synthesized
catcttggagttgatatttg

SEQ ID NO: 10289 - DNA, 20 bp, Artificial Sequence
  chemically synthesized
atttggggaaacacaatact

SEQ ID NO: 10290 - DNA, 20 bp, Artificial Sequence
  chemically synthesized
gggaaacacaatactcagtt

SEQ ID NO: 10291 - DNA, 20 bp, Artificial Sequence
  chemically synthesized
caatactcagttgagttccc

SEQ ID NO: 10292 - DNA, 20 bp, Artificial Sequence
  chemically synthesized
aatactcagttgagttccct

SEQ ID NO: 10293 - DNA, 20 bp, Artificial Sequence
  chemically synthesized
atactcagttgagttcccta

SEQ ID NO: 10294 - DNA, 20 bp, Artificial Sequence
  chemically synthesized
tactcagttgagttccctag

SEQ ID NO: 10295 - DNA, 20 bp, Artificial Sequence
  chemically synthesized
ctcagttgagttccctaggg

SEQ ID NO: 10296 - DNA, 20 bp, Artificial Sequence
  chemically synthesized
ttgagttccctaggggagaa

SEQ ID NO: 10297 - DNA, 20 bp, Artificial Sequence
  chemically synthesized
gttccctaggggagaaaagc

SEQ ID NO: 10298 - DNA, 20 bp, Artificial Sequence
  chemically synthesized
taggggagaaaagcaagctt

SEQ ID NO: 10299 - DNA, 20 bp, Artificial Sequence
  chemically synthesized
caagcttaagaattgacata

SEQ ID NO: 10300 - DNA, 20 bp, Artificial Sequence
  chemically synthesized
agcttaagaattgacataaa

SEQ ID NO: 10301 - DNA, 20 bp, Artificial Sequence
  chemically synthesized
ttaagaattgacataaagag

SEQ ID NO: 10302 - DNA, 20 bp, Artificial Sequence
  chemically synthesized
taagaattgacataaagagt

SEQ ID NO: 10303 - DNA, 20 bp, Artificial Sequence
  chemically synthesized
gaattgacataaagagtagg

SEQ ID NO: 10304 - DNA, 20 bp, Artificial Sequence
  chemically synthesized
tgacataaagagtaggaagt

SEQ ID NO: 10305 - DNA, 20 bp, Artificial Sequence
  chemically synthesized
actttgttttttcacaacta

SEQ ID NO: 10306 - DNA, 20 bp, Artificial Sequence
  chemically synthesized
cagtgactttatgtatttcc

SEQ ID NO: 10307 - DNA, 20 bp, Artificial Sequence
  chemically synthesized
gtgactttatgtatttccca

SEQ ID NO: 10308 - DNA, 20 bp, Artificial Sequence
  chemically synthesized
tgactttatgtatttcccag

SEQ ID NO: 10309 - DNA, 20 bp, Artificial Sequence
  chemically synthesized
ctttatgtatttcccagagg

SEQ ID NO: 10310 - DNA, 20 bp, Artificial Sequence
  chemically synthesized
tttatgtatttcccagagga

SEQ ID NO: 10311 - DNA, 20 bp, Artificial Sequence
  chemically synthesized
atttcccagaggaaggcata

SEQ ID NO: 10312 - DNA, 20 bp, Artificial Sequence
  chemically synthesized
tttcccagaggaaggcatac

SEQ ID NO: 10313 - DNA, 20 bp, Artificial Sequence
  chemically synthesized
ttcccagaggaaggcataca

SEQ ID NO: 10314 - DNA, 20 bp, Artificial Sequence
  chemically synthesized
ccagaggaaggcatacaggg

SEQ ID NO: 10315 - DNA, 20 bp, Artificial Sequence
  chemically synthesized
agggaagaaattatcccatt

SEQ ID NO: 10316 - DNA, 20 bp, Artificial Sequence
  chemically synthesized
aattatcccatttggacaaa

SEQ ID NO: 10317 - DNA, 20 bp, Artificial Sequence
  chemically synthesized
ggacaaacagcatgttctca

SEQ ID NO: 10318 - DNA, 20 bp, Artificial Sequence
  chemically synthesized
gacaaacagcatgttctcac

SEQ ID NO: 10319 - DNA, 20 bp, Artificial Sequence
  chemically synthesized
aaacagcatgttctcacagg

SEQ ID NO: 10320 - DNA, 20 bp, Artificial Sequence
  chemically synthesized
acacttacttgtcaactttc

SEQ ID NO: 10321 - DNA, 20 bp, Artificial Sequence
  chemically synthesized
caactttctagaatcaaatc

SEQ ID NO: 10322 - DNA, 20 bp, Artificial Sequence
  chemically synthesized
ctttctagaatcaaatctag

SEQ ID NO: 10323 - DNA, 20 bp, Artificial Sequence
  chemically synthesized
gaatcaaatctagtagctga

SEQ ID NO: 10324 - DNA, 20 bp, Artificial Sequence
  chemically synthesized
aatctagtagctgacagtac

SEQ ID NO: 10325 - DNA, 20 bp, Artificial Sequence
  chemically synthesized
atctagtagctgacagtacc

SEQ ID NO: 10326 - DNA, 20 bp, Artificial Sequence
  chemically synthesized
gtagctgacagtaccaggat

SEQ ID NO: 10327 - DNA, 20 bp, Artificial Sequence
  chemically synthesized
tagctgacagtaccaggatc

SEQ ID NO: 10328 - DNA, 20 bp, Artificial Sequence
  chemically synthesized
agctgacagtaccaggatca

SEQ ID NO: 10329 - DNA, 20 bp, Artificial Sequence
  chemically synthesized
gctgacagtaccaggatcag

SEQ ID NO: 10330 - DNA, 20 bp, Artificial Sequence
  chemically synthesized
ggatcaggggtgccaaccct

SEQ ID NO: 10331 - DNA, 20 bp, Artificial Sequence
  chemically synthesized
gtgccaaccctaagcacccc

SEQ ID NO: 10332 - DNA, 20 bp, Artificial Sequence
  chemically synthesized
caaccctaagcacccccaga

SEQ ID NO: 10333 - DNA, 20 bp, Artificial Sequence
  chemically synthesized
agcacccccagaaagctgac

SEQ ID NO: 10334 - DNA, 20 bp, Artificial Sequence
  chemically synthesized
cagaaagctgactggccctg

SEQ ID NO: 10335 - DNA, 20 bp, Artificial Sequence
  chemically synthesized
tggccctgtggttcccactc

SEQ ID NO: 10336 - DNA, 20 bp, Artificial Sequence
  chemically synthesized
tcccactccagacatgatgt

SEQ ID NO: 10337 - DNA, 20 bp, Artificial Sequence
  chemically synthesized
catgatgtcagctgtgaaat

SEQ ID NO: 10338 - DNA, 20 bp, Artificial Sequence
  chemically synthesized
aataacgataaaaaaaaata

SEQ ID NO: 10339 - DNA, 20 bp, Artificial Sequence
  chemically synthesized
taacgataaaaaaaaataca

SEQ ID NO: 10340 - DNA, 20 bp, Artificial Sequence
  chemically synthesized
aacgataaaaaaaaatacag

SEQ ID NO: 10341 - DNA, 20 bp, Artificial Sequence
  chemically synthesized
aaaaaatacagaggttaaac

SEQ ID NO: 10342 - DNA, 20 bp, Artificial Sequence
  chemically synthesized
atacagaggttaaactagca

SEQ ID NO: 10343 - DNA, 20 bp, Artificial Sequence
  chemically synthesized
agaggttaaactagcaaagt

SEQ ID NO: 10344 - DNA, 20 bp, Artificial Sequence
  chemically synthesized
ttaaactagcaaagtgagta

SEQ ID NO: 10345 - DNA, 20 bp, Artificial Sequence
  chemically synthesized
ctagcaaagtgagtaaagtc

SEQ ID NO: 10346 - DNA, 20 bp, Artificial Sequence
  chemically synthesized
tagcaaagtgagtaaagtca

SEQ ID NO: 10347 - DNA, 20 bp, Artificial Sequence
  chemically synthesized
agcaaagtgagtaaagtcaa

SEQ ID NO: 10348 - DNA, 20 bp, Artificial Sequence
  chemically synthesized
gtgagtaaagtcaagggata

SEQ ID NO: 10349 - DNA, 20 bp, Artificial Sequence
  chemically synthesized
aagggataaagaaaatttgt

SEQ ID NO: 10350 - DNA, 20 bp, Artificial Sequence
  chemically synthesized
aatttgttggaaaactcaca

SEQ ID NO: 10351 - DNA, 20 bp, Artificial Sequence
  chemically synthesized
ttgttggaaaactcacaaag

SEQ ID NO: 10352 - DNA, 20 bp, Artificial Sequence
  chemically synthesized
tgttggaaaactcacaaagc

SEQ ID NO: 10353 - DNA, 20 bp, Artificial Sequence
  chemically synthesized
aactcacaaagcaggacata

SEQ ID NO: 10354 - DNA, 20 bp, Artificial Sequence
  chemically synthesized
cacaaagcaggacataaagc

SEQ ID NO: 10355 - DNA, 20 bp, Artificial Sequence
  chemically synthesized
acaaagcaggacataaagca

SEQ ID NO: 10356 - DNA, 20 bp, Artificial Sequence
  chemically synthesized
aggacataaagcaaggccat

SEQ ID NO: 10357 - DNA, 20 bp, Artificial Sequence
  chemically synthesized
ggccattagatatatctcat

SEQ ID NO: 10358 - DNA, 20 bp, Artificial Sequence
  chemically synthesized
tatctcattagtgtgacatc

SEQ ID NO: 10359 - DNA, 20 bp, Artificial Sequence
  chemically synthesized
atctcattagtgtgacatct

SEQ ID NO: 10360 - DNA, 20 bp, Artificial Sequence
  chemically synthesized
ctcattagtgtgacatctgg

SEQ ID NO: 10361 - DNA, 20 bp, Artificial Sequence
  chemically synthesized
tcattagtgtgacatctggg

SEQ ID NO: 10362 - DNA, 20 bp, Artificial Sequence
  chemically synthesized
gtgtgacatctgggaggaca

SEQ ID NO: 10363 - DNA, 20 bp, Artificial Sequence
  chemically synthesized
ccaaaccctttcttctatat

SEQ ID NO: 10364 - DNA, 20 bp, Artificial Sequence
  chemically synthesized
aaccctttcttctatataag

SEQ ID NO: 10365 - DNA, 20 bp, Artificial Sequence
  chemically synthesized
ctttcttctatataagtggt

SEQ ID NO: 10366 - DNA, 20 bp, Artificial Sequence
  chemically synthesized
atataagtggtgagatgatg

SEQ ID NO: 10367 - DNA, 20 bp, Artificial Sequence
  chemically synthesized
tataagtggtgagatgatga

SEQ ID NO: 10368 - DNA, 20 bp, Artificial Sequence
  chemically synthesized
ggtgagatgatgaaggttgt

SEQ ID NO: 10369 - DNA, 20 bp, Artificial Sequence
  chemically synthesized
tgagatgatgaaggttgtaa

SEQ ID NO: 10370 - DNA, 20 bp, Artificial Sequence
  chemically synthesized
gagatgatgaaggttgtaag

SEQ ID NO: 10371 - DNA, 20 bp, Artificial Sequence
  chemically synthesized
agatgatgaaggttgtaaga

SEQ ID NO: 10372 - DNA, 20 bp, Artificial Sequence
  chemically synthesized
agagggcttctgcccccttg

SEQ ID NO: 10373 - DNA, 20 bp, Artificial Sequence
  chemically synthesized
ttctgcccccttgaagactt

SEQ ID NO: 10374 - DNA, 20 bp, Artificial Sequence
  chemically synthesized
cccttgaagacttcagatgc

SEQ ID NO: 10375 - DNA, 20 bp, Artificial Sequence
  chemically synthesized
ccttgaagacttcagatgct

SEQ ID NO: 10376 - DNA, 20 bp, Artificial Sequence
  chemically synthesized
cttgaagacttcagatgctg

SEQ ID NO: 10377 - DNA, 20 bp, Artificial Sequence
  chemically synthesized
aagacttcagatgctgggga

SEQ ID NO: 10378 - DNA, 20 bp, Artificial Sequence
  chemically synthesized
agacttcagatgctggggaa

SEQ ID NO: 10379 - DNA, 20 bp, Artificial Sequence
  chemically synthesized
ttcagatgctggggaaagga

SEQ ID NO: 10380 - DNA, 20 bp, Artificial Sequence
  chemically synthesized
atgctggggaaaggatagat

SEQ ID NO: 10381 - DNA, 20 bp, Artificial Sequence
  chemically synthesized
gggaaaggatagataagaat

SEQ ID NO: 10382 - DNA, 20 bp, Artificial Sequence
  chemically synthesized
ggaaaggatagataagaata

SEQ ID NO: 10383 - DNA, 20 bp, Artificial Sequence
  chemically synthesized
agataagaataaggatgaac

SEQ ID NO: 10384 - DNA, 20 bp, Artificial Sequence
  chemically synthesized
gataagaataaggatgaacc

SEQ ID NO: 10385 - DNA, 20 bp, Artificial Sequence
  chemically synthesized
ataaggatgaaccaggcttt

SEQ ID NO: 10386 - DNA, 20 bp, Artificial Sequence
  chemically synthesized
aaggatgaaccaggcttttg

SEQ ID NO: 10387 - DNA, 20 bp, Artificial Sequence
  chemically synthesized
tgaaccaggcttttggagcc

SEQ ID NO: 10388 - DNA, 20 bp, Artificial Sequence
  chemically synthesized
gaaccaggcttttggagcct

SEQ ID NO: 10389 - DNA, 20 bp, Artificial Sequence
  chemically synthesized
ggagcctgggaaataatgac

SEQ ID NO: 10390 - DNA, 20 bp, Artificial Sequence
  chemically synthesized
aatgactagcgataaacctg

SEQ ID NO: 10391 - DNA, 20 bp, Artificial Sequence
  chemically synthesized
atgactagcgataaacctga

SEQ ID NO: 10392 - DNA, 20 bp, Artificial Sequence
  chemically synthesized
tgactagcgataaacctgaa

SEQ ID NO: 10393 - DNA, 20 bp, Artificial Sequence
  chemically synthesized
ctagcgataaacctgaaggg

SEQ ID NO: 10394 - DNA, 20 bp, Artificial Sequence
  chemically synthesized
gataaacctgaagggaagtt

SEQ ID NO: 10395 - DNA, 20 bp, Artificial Sequence
  chemically synthesized
gaagttaagtatacgatccc

SEQ ID NO: 10396 - DNA, 20 bp, Artificial Sequence
  chemically synthesized
tacgatccccagataatact

SEQ ID NO: 10397 - DNA, 20 bp, Artificial Sequence
  chemically synthesized
acgatccccagataatacta

SEQ ID NO: 10398 - DNA, 20 bp, Artificial Sequence
  chemically synthesized
gatccccagataatactaag

SEQ ID NO: 10399 - DNA, 20 bp, Artificial Sequence
  chemically synthesized
cccagataatactaaggaga

SEQ ID NO: 10400 - DNA, 20 bp, Artificial Sequence
  chemically synthesized
ccagataatactaaggagaa

SEQ ID NO: 10401 - DNA, 20 bp, Artificial Sequence
  chemically synthesized
agaaaggcaatgtgattctg

SEQ ID NO: 10402 - DNA, 20 bp, Artificial Sequence
  chemically synthesized
atgtgattctgcagccattg

SEQ ID NO: 10403 - DNA, 20 bp, Artificial Sequence
  chemically synthesized
gattctgcagccattgtagc

SEQ ID NO: 10404 - DNA, 20 bp, Artificial Sequence
  chemically synthesized
ttctgcagccattgtagcca

SEQ ID NO: 10405 - DNA, 20 bp, Artificial Sequence
  chemically synthesized
ccattgtagccagagataat

SEQ ID NO: 10406 - DNA, 20 bp, Artificial Sequence
  chemically synthesized
gccagagataataagccctt

SEQ ID NO: 10407 - DNA, 20 bp, Artificial Sequence
  chemically synthesized
ccagagataataagcccttg

SEQ ID NO: 10408 - DNA, 20 bp, Artificial Sequence
  chemically synthesized
gagataataagcccttgagg

SEQ ID NO: 10409 - DNA, 20 bp, Artificial Sequence
  chemically synthesized
agataataagcccttgagga

SEQ ID NO: 10410 - DNA, 20 bp, Artificial Sequence
  chemically synthesized
gataataagcccttgaggaa

SEQ ID NO: 10411 - DNA, 20 bp, Artificial Sequence
  chemically synthesized
ataataagcccttgaggaag

SEQ ID NO: 10412 - DNA, 20 bp, Artificial Sequence
  chemically synthesized
taagcccttgaggaaggggc

SEQ ID NO: 10413 - DNA, 20 bp, Artificial Sequence
  chemically synthesized
aagcccttgaggaaggggcc

SEQ ID NO: 10414 - DNA, 20 bp, Artificial Sequence
  chemically synthesized
agcccttgaggaaggggcca

SEQ ID NO: 10415 - DNA, 20 bp, Artificial Sequence
  chemically synthesized
gcccttgaggaaggggccag

SEQ ID NO: 10416 - DNA, 20 bp, Artificial Sequence
  chemically synthesized
ggggccaggggaatttttct

SEQ ID NO: 10417 - DNA, 20 bp, Artificial Sequence
  chemically synthesized
gggccaggggaatttttcta

SEQ ID NO: 10418 - DNA, 20 bp, Artificial Sequence
  chemically synthesized
caggggaatttttctaagga

SEQ ID NO: 10419 - DNA, 20 bp, Artificial Sequence
  chemically synthesized
ggaatttttctaaggataga

SEQ ID NO: 10420 - DNA, 20 bp, Artificial Sequence
  chemically synthesized
aaggatagacagtattaatg

SEQ ID NO: 10421 - DNA, 20 bp, Artificial Sequence
  chemically synthesized
ttctgctattaaactctcat

SEQ ID NO: 10422 - DNA, 20 bp, Artificial Sequence
  chemically synthesized
aaactctcattggcttctaa

SEQ ID NO: 10423 - DNA, 20 bp, Artificial Sequence
  chemically synthesized
aactctcattggcttctaaa

SEQ ID NO: 10424 - DNA, 20 bp, Artificial Sequence
  chemically synthesized
ctctcattggcttctaaaag

SEQ ID NO: 10425 - DNA, 20 bp, Artificial Sequence
  chemically synthesized
ttggcttctaaaaggagttt

SEQ ID NO: 10426 - DNA, 20 bp, Artificial Sequence
  chemically synthesized
cttctaaaaggagtttcggt

SEQ ID NO: 10427 - DNA, 20 bp, Artificial Sequence
  chemically synthesized
gtttcggtgagtgatttgct

SEQ ID NO: 10428 - DNA, 20 bp, Artificial Sequence
  chemically synthesized
gctgagatgttgcattttca

SEQ ID NO: 10429 - DNA, 20 bp, Artificial Sequence
  chemically synthesized
attttcatggctgctgcctt

SEQ ID NO: 10430 - DNA, 20 bp, Artificial Sequence
  chemically synthesized
ttttcatggctgctgccttt

SEQ ID NO: 10431 - DNA, 20 bp, Artificial Sequence
  chemically synthesized
gcctttaggtattattgcaa

SEQ ID NO: 10432 - DNA, 20 bp, Artificial Sequence
  chemically synthesized
taggtattattgcaacagtt

SEQ ID NO: 10433 - DNA, 20 bp, Artificial Sequence
  chemically synthesized
ttggaattttgaaattaaaa

SEQ ID NO: 10434 - DNA, 20 bp, Artificial Sequence
  chemically synthesized
ttaaaacagttctgtaaaac

SEQ ID NO: 10435 - DNA, 20 bp, Artificial Sequence
  chemically synthesized
acagttctgtaaaaccagtt

SEQ ID NO: 10436 - DNA, 20 bp, Artificial Sequence
  chemically synthesized
aaaaccagtttagttttgta

SEQ ID NO: 10437 - DNA, 20 bp, Artificial Sequence
  chemically synthesized
tttgtaaagtgtatgcatca

SEQ ID NO: 10438 - DNA, 20 bp, Artificial Sequence
  chemically synthesized
catcaaagatgtccttcatt

SEQ ID NO: 10439 - DNA, 20 bp, Artificial Sequence
  chemically synthesized
tccttcattcagacattact

SEQ ID NO: 10440 - DNA, 20 bp, Artificial Sequence
  chemically synthesized
acattactgagttacaacta

SEQ ID NO: 10441 - DNA, 20 bp, Artificial Sequence
  chemically synthesized
ctgagttacaactatggtgc

SEQ ID NO: 10442 - DNA, 20 bp, Artificial Sequence
  chemically synthesized
tgagttacaactatggtgcc

SEQ ID NO: 10443 - DNA, 20 bp, Artificial Sequence
  chemically synthesized
tatggtgccaggtactgtgt

SEQ ID NO: 10444 - DNA, 20 bp, Artificial Sequence
  chemically synthesized
atggtgccaggtactgtgtc

SEQ ID NO: 10445 - DNA, 20 bp, Artificial Sequence
  chemically synthesized
tggtgccaggtactgtgtca

SEQ ID NO: 10446 - DNA, 20 bp, Artificial Sequence
  chemically synthesized
caggtactgtgtcagggtac

SEQ ID NO: 10447 - DNA, 20 bp, Artificial Sequence
  chemically synthesized
aggtactgtgtcagggtact

SEQ ID NO: 10448 - DNA, 20 bp, Artificial Sequence
  chemically synthesized
ggtactgtgtcagggtacta

SEQ ID NO: 10449 - DNA, 20 bp, Artificial Sequence
  chemically synthesized
gtactgtgtcagggtactag

SEQ ID NO: 10450 - DNA, 20 bp, Artificial Sequence
  chemically synthesized
gtgtcagggtactaggggta

SEQ ID NO: 10451 - DNA, 20 bp, Artificial Sequence
  chemically synthesized
tgtcagggtactaggggtat

SEQ ID NO: 10452 - DNA, 20 bp, Artificial Sequence
  chemically synthesized
gtcagggtactaggggtatg

SEQ ID NO: 10453 - DNA, 20 bp, Artificial Sequence
  chemically synthesized
ctaggggtatggggataaac

SEQ ID NO: 10454 - DNA, 20 bp, Artificial Sequence
  chemically synthesized
cagactccctctttgatcta

SEQ ID NO: 10455 - DNA, 20 bp, Artificial Sequence
  chemically synthesized
actccctctttgatctaaag

SEQ ID NO: 10456 - DNA, 20 bp, Artificial Sequence
  chemically synthesized
tctttgatctaaagcagcat

SEQ ID NO: 10457 - DNA, 20 bp, Artificial Sequence
  chemically synthesized
ctttgatctaaagcagcatg

SEQ ID NO: 10458 - DNA, 20 bp, Artificial Sequence
  chemically synthesized
gatctaaagcagcatgaggc

SEQ ID NO: 10459 - DNA, 20 bp, Artificial Sequence
  chemically synthesized
atctaaagcagcatgaggcc

SEQ ID NO: 10460 - DNA, 20 bp, Artificial Sequence
  chemically synthesized
aaagcagcatgaggccaggt

SEQ ID NO: 10461 - DNA, 20 bp, Artificial Sequence
  chemically synthesized
agcagcatgaggccaggtga

SEQ ID NO: 10462 - DNA, 20 bp, Artificial Sequence
  chemically synthesized
gcagcatgaggccaggtgag

SEQ ID NO: 10463 - DNA, 20 bp, Artificial Sequence
  chemically synthesized
taatgtgataaaatgtgcac

SEQ ID NO: 10464 - DNA, 20 bp, Artificial Sequence
  chemically synthesized
aatgtgataaaatgtgcact

SEQ ID NO: 10465 - DNA, 20 bp, Artificial Sequence
  chemically synthesized
taaaatgtgcactaggtact

SEQ ID NO: 10466 - DNA, 20 bp, Artificial Sequence
  chemically synthesized
aaaatgtgcactaggtacta

SEQ ID NO: 10467 - DNA, 20 bp, Artificial Sequence
  chemically synthesized
aaatgtgcactaggtactaa

SEQ ID NO: 10468 - DNA, 20 bp, Artificial Sequence
  chemically synthesized
cactaggtactaagggatca

SEQ ID NO: 10469 - DNA, 20 bp, Artificial Sequence
  chemically synthesized
ctaggtactaagggatcata

SEQ ID NO: 10470 - DNA, 20 bp, Artificial Sequence
  chemically synthesized
gtactaagggatcatagaga

SEQ ID NO: 10471 - DNA, 20 bp, Artificial Sequence
  chemically synthesized
tactaagggatcatagagaa

SEQ ID NO: 10472 - DNA, 20 bp, Artificial Sequence
  chemically synthesized
agagaaaggaacacattaaa

SEQ ID NO: 10473 - DNA, 20 bp, Artificial Sequence
  chemically synthesized
gagaaaggaacacattaaat

SEQ ID NO: 10474 - DNA, 20 bp, Artificial Sequence
  chemically synthesized
agaaaggaacacattaaatg

SEQ ID NO: 10475 - DNA, 20 bp, Artificial Sequence
  chemically synthesized
ttaaatggggaaacaattga

SEQ ID NO: 10476 - DNA, 20 bp, Artificial Sequence
  chemically synthesized
aaatggggaaacaattgata

SEQ ID NO: 10477 - DNA, 20 bp, Artificial Sequence
  chemically synthesized
atggggaaacaattgataga

SEQ ID NO: 10478 - DNA, 20 bp, Artificial Sequence
  chemically synthesized
ggggaaacaattgatagaga

SEQ ID NO: 10479 - DNA, 20 bp, Artificial Sequence
  chemically synthesized
agagagagaatattttcatc

SEQ ID NO: 10480 - DNA, 20 bp, Artificial Sequence
  chemically synthesized
gagagagaatattttcatct

SEQ ID NO: 10481 - DNA, 20 bp, Artificial Sequence
  chemically synthesized
tattttcatctgggtcttaa

SEQ ID NO: 10482 - DNA, 20 bp, Artificial Sequence
  chemically synthesized
tcatctgggtcttaaaagat

SEQ ID NO: 10483 - DNA, 20 bp, Artificial Sequence
  chemically synthesized
tctgggtcttaaaagatgag

SEQ ID NO: 10484 - DNA, 20 bp, Artificial Sequence
  chemically synthesized
ctgggtcttaaaagatgagt

SEQ ID NO: 10485 - DNA, 20 bp, Artificial Sequence
  chemically synthesized
tctctttaaatgtctgatat

SEQ ID NO: 10486 - DNA, 20 bp, Artificial Sequence
  chemically synthesized
ctctttaaatgtctgatata

SEQ ID NO: 10487 - DNA, 20 bp, Artificial Sequence
  chemically synthesized
tctttaaatgtctgatataa

SEQ ID NO: 10488 - DNA, 20 bp, Artificial Sequence
  chemically synthesized
atataagggcattttatgca

SEQ ID NO: 10489 - DNA, 20 bp, Artificial Sequence
  chemically synthesized
ataagggcattttatgcaaa

SEQ ID NO: 10490 - DNA, 20 bp, Artificial Sequence
  chemically synthesized
taagggcattttatgcaaag

SEQ ID NO: 10491 - DNA, 20 bp, Artificial Sequence
  chemically synthesized
caaagaggatcactcgtgca

SEQ ID NO: 10492 - DNA, 20 bp, Artificial Sequence
  chemically synthesized
ggatcactcgtgcaaagact

SEQ ID NO: 10493 - DNA, 20 bp, Artificial Sequence
  chemically synthesized
gtgcaaagactcagatttgc

SEQ ID NO: 10494 - DNA, 20 bp, Artificial Sequence
  chemically synthesized
actcagatttgcaagaacgt

SEQ ID NO: 10495 - DNA, 20 bp, Artificial Sequence
  chemically synthesized
ctcagatttgcaagaacgtg

SEQ ID NO: 10496 - DNA, 20 bp, Artificial Sequence
  chemically synthesized
tgcaagaacgtgaggtattt

SEQ ID NO: 10497 - DNA, 20 bp, Artificial Sequence
  chemically synthesized
gcaagaacgtgaggtatttc

SEQ ID NO: 10498 - DNA, 20 bp, Artificial Sequence
  chemically synthesized
aagaacgtgaggtatttcag

SEQ ID NO: 10499 - DNA, 20 bp, Artificial Sequence
  chemically synthesized
ggtatttcaggagttttgta

SEQ ID NO: 10500 - DNA, 20 bp, Artificial Sequence
  chemically synthesized
gagttttgtatggttccata

SEQ ID NO: 10501 - DNA, 20 bp, Artificial Sequence
  chemically synthesized
ggttccatatggactatgac

SEQ ID NO: 10502 - DNA, 20 bp, Artificial Sequence
  chemically synthesized
ccatatggactatgacaagt

SEQ ID NO: 10503 - DNA, 20 bp, Artificial Sequence
  chemically synthesized
atggactatgacaagtgaga

SEQ ID NO: 10504 - DNA, 20 bp, Artificial Sequence
  chemically synthesized
tggactatgacaagtgagac

SEQ ID NO: 10505 - DNA, 20 bp, Artificial Sequence
  chemically synthesized
gacaagtgagacaggtaaac

SEQ ID NO: 10506 - DNA, 20 bp, Artificial Sequence
  chemically synthesized
acaagtgagacaggtaaact

SEQ ID NO: 10507 - DNA, 20 bp, Artificial Sequence
  chemically synthesized
agtgagacaggtaaactagg

SEQ ID NO: 10508 - DNA, 20 bp, Artificial Sequence
  chemically synthesized
tgagacaggtaaactaggca

SEQ ID NO: 10509 - DNA, 20 bp, Artificial Sequence
  chemically synthesized
acaggtaaactaggcagagc

SEQ ID NO: 10510 - DNA, 20 bp, Artificial Sequence
  chemically synthesized
aactaggcagagctggtcat

SEQ ID NO: 10511 - DNA, 20 bp, Artificial Sequence
  chemically synthesized
gagctggtcatcagataatg

SEQ ID NO: 10512 - DNA, 20 bp, Artificial Sequence
  chemically synthesized
gataatgaagtcattaacct

SEQ ID NO: 10513 - DNA, 20 bp, Artificial Sequence
  chemically synthesized
ataatgaagtcattaaccta

SEQ ID NO: 10514 - DNA, 20 bp, Artificial Sequence
  chemically synthesized
aatgaagtcattaacctaag

SEQ ID NO: 10515 - DNA, 20 bp, Artificial Sequence
  chemically synthesized
agtcattaacctaaggagat

SEQ ID NO: 10516 - DNA, 20 bp, Artificial Sequence
  chemically synthesized
ttggacaataaaatgcaata

SEQ ID NO: 10517 - DNA, 20 bp, Artificial Sequence
  chemically synthesized
ggacaataaaatgcaatatg

SEQ ID NO: 10518 - DNA, 20 bp, Artificial Sequence
  chemically synthesized
gacaataaaatgcaatatgg

SEQ ID NO: 10519 - DNA, 20 bp, Artificial Sequence
  chemically synthesized
aatgcaatatggaggtatcg

SEQ ID NO: 10520 - DNA, 20 bp, Artificial Sequence
  chemically synthesized
aggtatcgaagtataaacat

SEQ ID NO: 10521 - DNA, 20 bp, Artificial Sequence
  chemically synthesized
ggtatcgaagtataaacata

SEQ ID NO: 10522 - DNA, 20 bp, Artificial Sequence
  chemically synthesized
tatcgaagtataaacataag

SEQ ID NO: 10523 - DNA, 20 bp, Artificial Sequence
  chemically synthesized
aacataaggagtaccactga

SEQ ID NO: 10524 - DNA, 20 bp, Artificial Sequence
  chemically synthesized
agtaccactgatggctgatt

SEQ ID NO: 10525 - DNA, 20 bp, Artificial Sequence
  chemically synthesized
gtaccactgatggctgattt

SEQ ID NO: 10526 - DNA, 20 bp, Artificial Sequence
  chemically synthesized
gatggctgatttaggatgcc

SEQ ID NO: 10527 - DNA, 20 bp, Artificial Sequence
  chemically synthesized
ctgatttaggatgcccagtc

SEQ ID NO: 10528 - DNA, 20 bp, Artificial Sequence
  chemically synthesized
gcaacacgctaatgaaatga

SEQ ID NO: 10529 - DNA, 20 bp, Artificial Sequence
  chemically synthesized
acacgctaatgaaatgatag

SEQ ID NO: 10530 - DNA, 20 bp, Artificial Sequence
  chemically synthesized
cacgctaatgaaatgatagt

SEQ ID NO: 10531 - DNA, 20 bp, Artificial Sequence
  chemically synthesized
acgctaatgaaatgatagtg

SEQ ID NO: 10532 - DNA, 20 bp, Artificial Sequence
  chemically synthesized
cgctaatgaaatgatagtgg

SEQ ID NO: 10533 - DNA, 20 bp, Artificial Sequence
  chemically synthesized
ctaatgaaatgatagtgggg

SEQ ID NO: 10534 - DNA, 20 bp, Artificial Sequence
  chemically synthesized
taatgaaatgatagtggggg

SEQ ID NO: 10535 - DNA, 20 bp, Artificial Sequence
  chemically synthesized
aatgaaatgatagtggggga

SEQ ID NO: 10536 - DNA, 20 bp, Artificial Sequence
  chemically synthesized
atgaaatgatagtgggggag

SEQ ID NO: 10537 - DNA, 20 bp, Artificial Sequence
  chemically synthesized
tgaaatgatagtgggggagg

SEQ ID NO: 10538 - DNA, 20 bp, Artificial Sequence
  chemically synthesized
gtgggggagggggccgtacc

SEQ ID NO: 10539 - DNA, 20 bp, Artificial Sequence
  chemically synthesized
ggagggggccgtaccaagac

SEQ ID NO: 10540 - DNA, 20 bp, Artificial Sequence
  chemically synthesized
gagggggccgtaccaagact

SEQ ID NO: 10541 - DNA, 20 bp, Artificial Sequence
  chemically synthesized
gggggccgtaccaagactag

SEQ ID NO: 10542 - DNA, 20 bp, Artificial Sequence
  chemically synthesized
gggccgtaccaagactagga

SEQ ID NO: 10543 - DNA, 20 bp, Artificial Sequence
  chemically synthesized
gccgtaccaagactaggaga

SEQ ID NO: 10544 - DNA, 20 bp, Artificial Sequence
  chemically synthesized
gtaccaagactaggagagag

SEQ ID NO: 10545 - DNA, 20 bp, Artificial Sequence
  chemically synthesized
gactaggagagagcagtcct

SEQ ID NO: 10546 - DNA, 20 bp, Artificial Sequence
  chemically synthesized
gagactattgcaattatctg

SEQ ID NO: 10547 - DNA, 20 bp, Artificial Sequence
  chemically synthesized
agactattgcaattatctgc

SEQ ID NO: 10548 - DNA, 20 bp, Artificial Sequence
  chemically synthesized
actattgcaattatctgcgg

SEQ ID NO: 10549 - DNA, 20 bp, Artificial Sequence
  chemically synthesized
aattatctgcgggagacata

SEQ ID NO: 10550 - DNA, 20 bp, Artificial Sequence
  chemically synthesized
attatctgcgggagacataa

SEQ ID NO: 10551 - DNA, 20 bp, Artificial Sequence
  chemically synthesized
tctgcgggagacataaaggc

SEQ ID NO: 10552 - DNA, 20 bp, Artificial Sequence
  chemically synthesized
cataaaggctagaacctgaa

SEQ ID NO: 10553 - DNA, 20 bp, Artificial Sequence
  chemically synthesized
aaaggctagaacctgaacag

SEQ ID NO: 10554 - DNA, 20 bp, Artificial Sequence
  chemically synthesized
ggctagaacctgaacagtag

SEQ ID NO: 10555 - DNA, 20 bp, Artificial Sequence
  chemically synthesized
gaacagtagcagtacaaaaa

SEQ ID NO: 10556 - DNA, 20 bp, Artificial Sequence
  chemically synthesized
acagtagcagtacaaaaaaa

SEQ ID NO: 10557 - DNA, 20 bp, Artificial Sequence
  chemically synthesized
cagtagcagtacaaaaaaag

SEQ ID NO: 10558 - DNA, 20 bp, Artificial Sequence
  chemically synthesized
agtagcagtacaaaaaaaga

SEQ ID NO: 10559 - DNA, 20 bp, Artificial Sequence
  chemically synthesized
gtagcagtacaaaaaaagag

SEQ ID NO: 10560 - DNA, 20 bp, Artificial Sequence
  chemically synthesized
agcagtacaaaaaaagaggg

SEQ ID NO: 10561 - DNA, 20 bp, Artificial Sequence
  chemically synthesized
aggggagttcaaatgatatt

SEQ ID NO: 10562 - DNA, 20 bp, Artificial Sequence
  chemically synthesized
ggggagttcaaatgatatta

SEQ ID NO: 10563 - DNA, 20 bp, Artificial Sequence
  chemically synthesized
gagttcaaatgatattaagg

SEQ ID NO: 10564 - DNA, 20 bp, Artificial Sequence
  chemically synthesized
ttcaaatgatattaaggaag

SEQ ID NO: 10565 - DNA, 20 bp, Artificial Sequence
  chemically synthesized
aaatgatattaaggaagtag

SEQ ID NO: 10566 - DNA, 20 bp, Artificial Sequence
  chemically synthesized
tgatattaaggaagtagaag

SEQ ID NO: 10567 - DNA, 20 bp, Artificial Sequence
  chemically synthesized
agtggtatgacttaaccatc

SEQ ID NO: 10568 - DNA, 20 bp, Artificial Sequence
  chemically synthesized
gtggtatgacttaaccatct

SEQ ID NO: 10569 - DNA, 20 bp, Artificial Sequence
  chemically synthesized
atgacttaaccatctgggta

SEQ ID NO: 10570 - DNA, 20 bp, Artificial Sequence
  chemically synthesized
acttaaccatctgggtatgg

SEQ ID NO: 10571 - DNA, 20 bp, Artificial Sequence
  chemically synthesized
cttaaccatctgggtatgga

SEQ ID NO: 10572 - DNA, 20 bp, Artificial Sequence
  chemically synthesized
ttaaccatctgggtatggaa

SEQ ID NO: 10573 - DNA, 20 bp, Artificial Sequence
  chemically synthesized
taaccatctgggtatggaag

SEQ ID NO: 10574 - DNA, 20 bp, Artificial Sequence
  chemically synthesized
tctgggtatggaaggggaaa

SEQ ID NO: 10575 - DNA, 20 bp, Artificial Sequence
  chemically synthesized
ggtatggaaggggaaatggc

SEQ ID NO: 10576 - DNA, 20 bp, Artificial Sequence
  chemically synthesized
tatggaaggggaaatggcta

SEQ ID NO: 10577 - DNA, 20 bp, Artificial Sequence
  chemically synthesized
aggggaaatggctagagtct

SEQ ID NO: 10578 - DNA, 20 bp, Artificial Sequence
  chemically synthesized
ggggaaatggctagagtctt

SEQ ID NO: 10579 - DNA, 20 bp, Artificial Sequence
  chemically synthesized
gggaaatggctagagtcttg

SEQ ID NO: 10580 - DNA, 20 bp, Artificial Sequence
  chemically synthesized
ctttgtgtttgatgtgatta

SEQ ID NO: 10581 - DNA, 20 bp, Artificial Sequence
  chemically synthesized
tttgatgtgattatggacca

SEQ ID NO: 10582 - DNA, 20 bp, Artificial Sequence
  chemically synthesized
tggaccacagaataatgtct

SEQ ID NO: 10583 - DNA, 20 bp, Artificial Sequence
  chemically synthesized
gaccacagaataatgtctaa

SEQ ID NO: 10584 - DNA, 20 bp, Artificial Sequence
  chemically synthesized
agaataatgtctaagagaac

SEQ ID NO: 10585 - DNA, 20 bp, Artificial Sequence
  chemically synthesized
gtctaagagaactggctctt

SEQ ID NO: 10586 - DNA, 20 bp, Artificial Sequence
  chemically synthesized
tggctctttagtctgactgc

SEQ ID NO: 10587 - DNA, 20 bp, Artificial Sequence
  chemically synthesized
gctctttagtctgactgcca

SEQ ID NO: 10588 - DNA, 20 bp, Artificial Sequence
  chemically synthesized
agtctgaatcctgaatgttt

SEQ ID NO: 10589 - DNA, 20 bp, Artificial Sequence
  chemically synthesized
aatgttttagtatgttacct

SEQ ID NO: 10590 - DNA, 20 bp, Artificial Sequence
  chemically synthesized
atgttttagtatgttacctt

SEQ ID NO: 10591 - DNA, 20 bp, Artificial Sequence
  chemically synthesized
ttagtatgttaccttgggca

SEQ ID NO: 10592 - DNA, 20 bp, Artificial Sequence
  chemically synthesized
gttaccttgggcaaagccct

SEQ ID NO: 10593 - DNA, 20 bp, Artificial Sequence
  chemically synthesized
tcttcctcattcataaaaat

SEQ ID NO: 10594 - DNA, 20 bp, Artificial Sequence
  chemically synthesized
cattcataaaaataagatga

SEQ ID NO: 10595 - DNA, 20 bp, Artificial Sequence
  chemically synthesized
agatgacagtgcctatctcg

SEQ ID NO: 10596 - DNA, 20 bp, Artificial Sequence
  chemically synthesized
gatgacagtgcctatctcgt

SEQ ID NO: 10597 - DNA, 20 bp, Artificial Sequence
  chemically synthesized
ctatctcgtgggacttttgt

SEQ ID NO: 10598 - DNA, 20 bp, Artificial Sequence
  chemically synthesized
tatctcgtgggacttttgtg

SEQ ID NO: 10599 - DNA, 20 bp, Artificial Sequence
  chemically synthesized
gtgggacttttgtgaggatg

SEQ ID NO: 10600 - DNA, 20 bp, Artificial Sequence
  chemically synthesized
gacttttgtgaggatgaagt

SEQ ID NO: 10601 - DNA, 20 bp, Artificial Sequence
  chemically synthesized
gtgaggatgaagtgagataa

SEQ ID NO: 10602 - DNA, 20 bp, Artificial Sequence
  chemically synthesized
gaagtgagataatggatgca

SEQ ID NO: 10603 - DNA, 20 bp, Artificial Sequence
  chemically synthesized
ataatggatgcaaagttact

SEQ ID NO: 10604 - DNA, 20 bp, Artificial Sequence
  chemically synthesized
ggatgcaaagttactgagca

SEQ ID NO: 10605 - DNA, 20 bp, Artificial Sequence
  chemically synthesized
actgagcacagtgtccaaca

SEQ ID NO: 10606 - DNA, 20 bp, Artificial Sequence
  chemically synthesized
gagcacagtgtccaacacag

SEQ ID NO: 10607 - DNA, 20 bp, Artificial Sequence
  chemically synthesized
cacagtgtccaacacagcag

SEQ ID NO: 10608 - DNA, 20 bp, Artificial Sequence
  chemically synthesized
cagaagcattacatatacat

SEQ ID NO: 10609 - DNA, 20 bp, Artificial Sequence
  chemically synthesized
acatatacattagctattac

SEQ ID NO: 10610 - DNA, 20 bp, Artificial Sequence
  chemically synthesized
actggctacattatgatata

SEQ ID NO: 10611 - DNA, 20 bp, Artificial Sequence
  chemically synthesized
gctacattatgatatacagt

SEQ ID NO: 10612 - DNA, 20 bp, Artificial Sequence
  chemically synthesized
ctacattatgatatacagtt

SEQ ID NO: 10613 - DNA, 20 bp, Artificial Sequence
  chemically synthesized
tacattatgatatacagtta

SEQ ID NO: 10614 - DNA, 20 bp, Artificial Sequence
  chemically synthesized
cattatgatatacagttagg

SEQ ID NO: 10615 - DNA, 20 bp, Artificial Sequence
  chemically synthesized
atgatatacagttagggagt

SEQ ID NO: 10616 - DNA, 20 bp, Artificial Sequence
  chemically synthesized
tatacagttagggagttgga

SEQ ID NO: 10617 - DNA, 20 bp, Artificial Sequence
  chemically synthesized
tggaaagataatctgaaatt

SEQ ID NO: 10618 - DNA, 20 bp, Artificial Sequence
  chemically synthesized
ggaaagataatctgaaattc

SEQ ID NO: 10619 - DNA, 20 bp, Artificial Sequence
  chemically synthesized
aaagataatctgaaattcag

SEQ ID NO: 10620 - DNA, 20 bp, Artificial Sequence
  chemically synthesized
tcaggagacgtatctgacta

SEQ ID NO: 10621 - DNA, 20 bp, Artificial Sequence
  chemically synthesized
caggagacgtatctgactat

SEQ ID NO: 10622 - DNA, 20 bp, Artificial Sequence
  chemically synthesized
agacgtatctgactataggt

SEQ ID NO: 10623 - DNA, 20 bp, Artificial Sequence
  chemically synthesized
tctgactataggtgagtatt

SEQ ID NO: 10624 - DNA, 20 bp, Artificial Sequence
  chemically synthesized
ggaactcattgttctgtaaa

SEQ ID NO: 10625 - DNA, 20 bp, Artificial Sequence
  chemically synthesized
actcattgttctgtaaacag

SEQ ID NO: 10626 - DNA, 20 bp, Artificial Sequence
  chemically synthesized
tgttctgtaaacagtagtta

SEQ ID NO: 10627 - DNA, 20 bp, Artificial Sequence
  chemically synthesized
agtagttacagccacgtgtg

SEQ ID NO: 10628 - DNA, 20 bp, Artificial Sequence
  chemically synthesized
gtagttacagccacgtgtgt

SEQ ID NO: 10629 - DNA, 20 bp, Artificial Sequence
  chemically synthesized
cagccacgtgtgtgggcatc

SEQ ID NO: 10630 - DNA, 20 bp, Artificial Sequence
  chemically synthesized
gccacgtgtgtgggcatctg

SEQ ID NO: 10631 - DNA, 20 bp, Artificial Sequence
  chemically synthesized
cacgtgtgtgggcatctgga

SEQ ID NO: 10632 - DNA, 20 bp, Artificial Sequence
  chemically synthesized
tgtgtgggcatctggagagt

SEQ ID NO: 10633 - DNA, 20 bp, Artificial Sequence
  chemically synthesized
gggcatctggagagtgagca

SEQ ID NO: 10634 - DNA, 20 bp, Artificial Sequence
  chemically synthesized
agcatggatattgtgatacc

SEQ ID NO: 10635 - DNA, 20 bp, Artificial Sequence
  chemically synthesized
ggatattgtgatacctagta

SEQ ID NO: 10636 - DNA, 20 bp, Artificial Sequence
  chemically synthesized
gtgatacctagtacagtgcc

SEQ ID NO: 10637 - DNA, 20 bp, Artificial Sequence
  chemically synthesized
atacctagtacagtgcctgg

SEQ ID NO: 10638 - DNA, 20 bp, Artificial Sequence
  chemically synthesized
cctagtacagtgcctggcag

SEQ ID NO: 10639 - DNA, 20 bp, Artificial Sequence
  chemically synthesized
agtacagtgcctggcagtag

SEQ ID NO: 10640 - DNA, 20 bp, Artificial Sequence
  chemically synthesized
ggcagtagtggttgtatgct

SEQ ID NO: 10641 - DNA, 20 bp, Artificial Sequence
  chemically synthesized
tgctcagtaaattttgttga

SEQ ID NO: 10642 - DNA, 20 bp, Artificial Sequence
  chemically synthesized
gctcagtaaattttgttgac

SEQ ID NO: 10643 - DNA, 20 bp, Artificial Sequence
  chemically synthesized
ctcagtaaattttgttgaca

SEQ ID NO: 10644 - DNA, 20 bp, Artificial Sequence
  chemically synthesized
gtaaattttgttgacagggt

SEQ ID NO: 10645 - DNA, 20 bp, Artificial Sequence
  chemically synthesized
taaattttgttgacagggtc

SEQ ID NO: 10646 - DNA, 20 bp, Artificial Sequence
  chemically synthesized
aaattttgttgacagggtca

SEQ ID NO: 10647 - DNA, 20 bp, Artificial Sequence
  chemically synthesized
tttgttgacagggtcagggc

SEQ ID NO: 10648 - DNA, 20 bp, Artificial Sequence
  chemically synthesized
tgacagggtcagggccggac

SEQ ID NO: 10649 - DNA, 20 bp, Artificial Sequence
  chemically synthesized
gtcagggccggactagactg

SEQ ID NO: 10650 - DNA, 20 bp, Artificial Sequence
  chemically synthesized
gggccggactagactgtggt

SEQ ID NO: 10651 - DNA, 20 bp, Artificial Sequence
  chemically synthesized
cggactagactgtggtaagc

SEQ ID NO: 10652 - DNA, 20 bp, Artificial Sequence
  chemically synthesized
ggactagactgtggtaagca

SEQ ID NO: 10653 - DNA, 20 bp, Artificial Sequence
  chemically synthesized
actgtggtaagcaaggcctg

SEQ ID NO: 10654 - DNA, 20 bp, Artificial Sequence
  chemically synthesized
ctgtggtaagcaaggcctgt

SEQ ID NO: 10655 - DNA, 20 bp, Artificial Sequence
  chemically synthesized
tgtggtaagcaaggcctgta

SEQ ID NO: 10656 - DNA, 20 bp, Artificial Sequence
  chemically synthesized
taaatatacttgtatgcccc

SEQ ID NO: 10657 - DNA, 20 bp, Artificial Sequence
  chemically synthesized
atatacttgtatgccccgag

SEQ ID NO: 10658 - DNA, 20 bp, Artificial Sequence
  chemically synthesized
acttgtatgccccgagaagt

SEQ ID NO: 10659 - DNA, 20 bp, Artificial Sequence
  chemically synthesized
cttgtatgccccgagaagtg

SEQ ID NO: 10660 - DNA, 20 bp, Artificial Sequence
  chemically synthesized
tgtgccctacatgccttgtt

SEQ ID NO: 10661 - DNA, 20 bp, Artificial Sequence
  chemically synthesized
tgtttggttcactcttgtcc

SEQ ID NO: 10662 - DNA, 20 bp, Artificial Sequence
  chemically synthesized
gttcactcttgtcccagccc

SEQ ID NO: 10663 - DNA, 20 bp, Artificial Sequence
  chemically synthesized
actcttgtcccagccctagc

SEQ ID NO: 10664 - DNA, 20 bp, Artificial Sequence
  chemically synthesized
cagccctagcaagtatatat

SEQ ID NO: 10665 - DNA, 20 bp, Artificial Sequence
  chemically synthesized
agccctagcaagtatatata

SEQ ID NO: 10666 - DNA, 20 bp, Artificial Sequence
  chemically synthesized
caagtatatataaggtgaaa

SEQ ID NO: 10667 - DNA, 20 bp, Artificial Sequence
  chemically synthesized
aagtatatataaggtgaaaa

SEQ ID NO: 10668 - DNA, 20 bp, Artificial Sequence
  chemically synthesized
atataaggtgaaaaaggaaa

SEQ ID NO: 10669 - DNA, 20 bp, Artificial Sequence
  chemically synthesized
aggtgaaaaaggaaaaagct

SEQ ID NO: 10670 - DNA, 20 bp, Artificial Sequence
  chemically synthesized
ggtgaaaaaggaaaaagctg

SEQ ID NO: 10671 - DNA, 20 bp, Artificial Sequence
  chemically synthesized
aaaaaggaaaaagctgaggc

SEQ ID NO: 10672 - DNA, 20 bp, Artificial Sequence
  chemically synthesized
aaaggaaaaagctgaggctg

SEQ ID NO: 10673 - DNA, 20 bp, Artificial Sequence
  chemically synthesized
aaaaagctgaggctggagcc

SEQ ID NO: 10674 - DNA, 20 bp, Artificial Sequence
  chemically synthesized
aaaagctgaggctggagcct

SEQ ID NO: 10675 - DNA, 20 bp, Artificial Sequence
  chemically synthesized
aagctgaggctggagcctgg

SEQ ID NO: 10676 - DNA, 20 bp, Artificial Sequence
  chemically synthesized
gctggagcctgggagaaccc

SEQ ID NO: 10677 - DNA, 20 bp, Artificial Sequence
  chemically synthesized
tgggagaaccctggacattt

SEQ ID NO: 10678 - DNA, 20 bp, Artificial Sequence
  chemically synthesized
gggagaaccctggacattta

SEQ ID NO: 10679 - DNA, 20 bp, Artificial Sequence
  chemically synthesized
ggagaaccctggacatttaa

SEQ ID NO: 10680 - DNA, 20 bp, Artificial Sequence
  chemically synthesized
ccctggacatttaagggcca

SEQ ID NO: 10681 - DNA, 20 bp, Artificial Sequence
  chemically synthesized
ctggacatttaagggccatg

SEQ ID NO: 10682 - DNA, 20 bp, Artificial Sequence
  chemically synthesized
ggacatttaagggccatgga

SEQ ID NO: 10683 - DNA, 20 bp, Artificial Sequence
  chemically synthesized
gacatttaagggccatggag

SEQ ID NO: 10684 - DNA, 20 bp, Artificial Sequence
  chemically synthesized
ttaagggccatggagaggaa

SEQ ID NO: 10685 - DNA, 20 bp, Artificial Sequence
  chemically synthesized
taagggccatggagaggaac

SEQ ID NO: 10686 - DNA, 20 bp, Artificial Sequence
  chemically synthesized
agggccatggagaggaacag

SEQ ID NO: 10687 - DNA, 20 bp, Artificial Sequence
  chemically synthesized
gaacaggagttaatcaattc

SEQ ID NO: 10688 - DNA, 20 bp, Artificial Sequence
  chemically synthesized
gagttaatcaattcaagtgc

SEQ ID NO: 10689 - DNA, 20 bp, Artificial Sequence
  chemically synthesized
taatcaattcaagtgctgga

SEQ ID NO: 10690 - DNA, 20 bp, Artificial Sequence
  chemically synthesized
ttcaagtgctggatggataa

SEQ ID NO: 10691 - DNA, 20 bp, Artificial Sequence
  chemically synthesized
tcaagtgctggatggataac

SEQ ID NO: 10692 - DNA, 20 bp, Artificial Sequence
  chemically synthesized
aagtgctggatggataacag

SEQ ID NO: 10693 - DNA, 20 bp, Artificial Sequence
  chemically synthesized
gctggatggataacaggagt

SEQ ID NO: 10694 - DNA, 20 bp, Artificial Sequence
  chemically synthesized
tggatggataacaggagtta

SEQ ID NO: 10695 - DNA, 20 bp, Artificial Sequence
  chemically synthesized
ggataacaggagttagagca

SEQ ID NO: 10696 - DNA, 20 bp, Artificial Sequence
  chemically synthesized
taacaggagttagagcaaag

SEQ ID NO: 10697 - DNA, 20 bp, Artificial Sequence
  chemically synthesized
aacaggagttagagcaaagc

SEQ ID NO: 10698 - DNA, 20 bp, Artificial Sequence
  chemically synthesized
acaggagttagagcaaagcg

SEQ ID NO: 10699 - DNA, 20 bp, Artificial Sequence
  chemically synthesized
gttagagcaaagcggggaac

SEQ ID NO: 10700 - DNA, 20 bp, Artificial Sequence
  chemically synthesized
agcaaagcggggaaccagaa

SEQ ID NO: 10701 - DNA, 20 bp, Artificial Sequence
  chemically synthesized
caaagcggggaaccagaata

SEQ ID NO: 10702 - DNA, 20 bp, Artificial Sequence
  chemically synthesized
aatagagtgattattataaa

SEQ ID NO: 10703 - DNA, 20 bp, Artificial Sequence
  chemically synthesized
tagagtgattattataaaaa

SEQ ID NO: 10704 - DNA, 20 bp, Artificial Sequence
  chemically synthesized
tataaaaagagtttcctaaa

SEQ ID NO: 10705 - DNA, 20 bp, Artificial Sequence
  chemically synthesized
ataaaaagagtttcctaaaa

SEQ ID NO: 10706 - DNA, 20 bp, Artificial Sequence
  chemically synthesized
taaaaagagtttcctaaaaa

SEQ ID NO: 10707 - DNA, 20 bp, Artificial Sequence
  chemically synthesized
aaaagagtttcctaaaaagg

SEQ ID NO: 10708 - DNA, 20 bp, Artificial Sequence
  chemically synthesized
aagagtttcctaaaaaggga

SEQ ID NO: 10709 - DNA, 20 bp, Artificial Sequence
  chemically synthesized
aaaagggagagatcaacaat

SEQ ID NO: 10710 - DNA, 20 bp, Artificial Sequence
  chemically synthesized
atcaacaattagaaattatt

SEQ ID NO: 10711 - DNA, 20 bp, Artificial Sequence
  chemically synthesized
caacaattagaaattattta

SEQ ID NO: 10712 - DNA, 20 bp, Artificial Sequence
  chemically synthesized
caattagaaattatttagag

SEQ ID NO: 10713 - DNA, 20 bp, Artificial Sequence
  chemically synthesized
tagaaattatttagagcagc

SEQ ID NO: 10714 - DNA, 20 bp, Artificial Sequence
  chemically synthesized
ataaactcaaaattattctt

SEQ ID NO: 10715 - DNA, 20 bp, Artificial Sequence
  chemically synthesized
taaactcaaaattattcttt

SEQ ID NO: 10716 - DNA, 20 bp, Artificial Sequence
  chemically synthesized
gtcattcctgattgtgacaa

SEQ ID NO: 10717 - DNA, 20 bp, Artificial Sequence
  chemically synthesized
ttcattatataaatgtgatt

SEQ ID NO: 10718 - DNA, 20 bp, Artificial Sequence
  chemically synthesized
tcattatataaatgtgatta

SEQ ID NO: 10719 - DNA, 20 bp, Artificial Sequence
  chemically synthesized
ttatataaatgtgattaagg

SEQ ID NO: 10720 - DNA, 20 bp, Artificial Sequence
  chemically synthesized
tatataaatgtgattaagga

SEQ ID NO: 10721 - DNA, 20 bp, Artificial Sequence
  chemically synthesized
aaatgtgattaaggaaggaa

SEQ ID NO: 10722 - DNA, 20 bp, Artificial Sequence
  chemically synthesized
atgtgattaaggaaggaaaa

SEQ ID NO: 10723 - DNA, 20 bp, Artificial Sequence
  chemically synthesized
aaggaaggaaaagagctaca

SEQ ID NO: 10724 - DNA, 20 bp, Artificial Sequence
  chemically synthesized
gaaggaaaagagctacacag

SEQ ID NO: 10725 - DNA, 20 bp, Artificial Sequence
  chemically synthesized
gagctacacagaagttatta

SEQ ID NO: 10726 - DNA, 20 bp, Artificial Sequence
  chemically synthesized
gctacacagaagttattaaa

SEQ ID NO: 10727 - DNA, 20 bp, Artificial Sequence
  chemically synthesized
cagaagttattaaagagcta

SEQ ID NO: 10728 - DNA, 20 bp, Artificial Sequence
  chemically synthesized
gaagttattaaagagctaaa

SEQ ID NO: 10729 - DNA, 20 bp, Artificial Sequence
  chemically synthesized
ttaaagagctaaagagaatt

SEQ ID NO: 10730 - DNA, 20 bp, Artificial Sequence
  chemically synthesized
gagaattgagaaatttaaaa

SEQ ID NO: 10731 - DNA, 20 bp, Artificial Sequence
  chemically synthesized
aattgagaaatttaaaacag

SEQ ID NO: 10732 - DNA, 20 bp, Artificial Sequence
  chemically synthesized
gagaaatttaaaacagaaga

SEQ ID NO: 10733 - DNA, 20 bp, Artificial Sequence
  chemically synthesized
aaatttaaaacagaagaaag

SEQ ID NO: 10734 - DNA, 20 bp, Artificial Sequence
  chemically synthesized
aatttaaaacagaagaaagt

SEQ ID NO: 10735 - DNA, 20 bp, Artificial Sequence
  chemically synthesized
atttaaaacagaagaaagta

SEQ ID NO: 10736 - DNA, 20 bp, Artificial Sequence
  chemically synthesized
agaaagtagggccaacatga

SEQ ID NO: 10737 - DNA, 20 bp, Artificial Sequence
  chemically synthesized
gaaagtagggccaacatgaa

SEQ ID NO: 10738 - DNA, 20 bp, Artificial Sequence
  chemically synthesized
aagtagggccaacatgaaag

SEQ ID NO: 10739 - DNA, 20 bp, Artificial Sequence
  chemically synthesized
tagggccaacatgaaaggag

SEQ ID NO: 10740 - DNA, 20 bp, Artificial Sequence
  chemically synthesized
agggccaacatgaaaggagt

SEQ ID NO: 10741 - DNA, 20 bp, Artificial Sequence
  chemically synthesized
gggccaacatgaaaggagta

SEQ ID NO: 10742 - DNA, 20 bp, Artificial Sequence
  chemically synthesized
gccaacatgaaaggagtagg

SEQ ID NO: 10743 - DNA, 20 bp, Artificial Sequence
  chemically synthesized
atgaaaggagtagggagaaa

SEQ ID NO: 10744 - DNA, 20 bp, Artificial Sequence
  chemically synthesized
gaaaggagtagggagaaaaa

SEQ ID NO: 10745 - DNA, 20 bp, Artificial Sequence
  chemically synthesized
tagggagaaaaagagataac

SEQ ID NO: 10746 - DNA, 20 bp, Artificial Sequence
  chemically synthesized
ctgatcctgccaacacctgt

SEQ ID NO: 10747 - DNA, 20 bp, Artificial Sequence
  chemically synthesized
tcctgccaacacctgtgaga

SEQ ID NO: 10748 - DNA, 20 bp, Artificial Sequence
  chemically synthesized
aacctaatttacatttgaca

SEQ ID NO: 10749 - DNA, 20 bp, Artificial Sequence
  chemically synthesized
aatttacatttgacaaagtt

SEQ ID NO: 10750 - DNA, 20 bp, Artificial Sequence
  chemically synthesized
atttacatttgacaaagtta

SEQ ID NO: 10751 - DNA, 20 bp, Artificial Sequence
  chemically synthesized
catttgacaaagttaaggtt

SEQ ID NO: 10752 - DNA, 20 bp, Artificial Sequence
  chemically synthesized
tttgacaaagttaaggttca

SEQ ID NO: 10753 - DNA, 20 bp, Artificial Sequence
  chemically synthesized
agagcttgtgtgacttgtcc

SEQ ID NO: 10754 - DNA, 20 bp, Artificial Sequence
  chemically synthesized
gagcttgtgtgacttgtcca

SEQ ID NO: 10755 - DNA, 20 bp, Artificial Sequence
  chemically synthesized
gtgtgacttgtccaaggtca

SEQ ID NO: 10756 - DNA, 20 bp, Artificial Sequence
  chemically synthesized
tgtgacttgtccaaggtcac

SEQ ID NO: 10757 - DNA, 20 bp, Artificial Sequence
  chemically synthesized
cttgtccaaggtcacaggtc

SEQ ID NO: 10758 - DNA, 20 bp, Artificial Sequence
  chemically synthesized
tgtccaaggtcacaggtcta

SEQ ID NO: 10759 - DNA, 20 bp, Artificial Sequence
  chemically synthesized
gtccaaggtcacaggtctag

SEQ ID NO: 10760 - DNA, 20 bp, Artificial Sequence
  chemically synthesized
ccaaggtcacaggtctagag

SEQ ID NO: 10761 - DNA, 20 bp, Artificial Sequence
  chemically synthesized
caaggtcacaggtctagagg

SEQ ID NO: 10762 - DNA, 20 bp, Artificial Sequence
  chemically synthesized
ggtcacaggtctagaggagg

SEQ ID NO: 10763 - DNA, 20 bp, Artificial Sequence
  chemically synthesized
ttctgtctgatctgattcta

SEQ ID NO: 10764 - DNA, 20 bp, Artificial Sequence
  chemically synthesized
tttcactcaaccacactgta

SEQ ID NO: 10765 - DNA, 20 bp, Artificial Sequence
  chemically synthesized
actcaaccacactgtacagt

SEQ ID NO: 10766 - DNA, 20 bp, Artificial Sequence
  chemically synthesized
gtacagtcagctctccttgt

SEQ ID NO: 10767 - DNA, 20 bp, Artificial Sequence
  chemically synthesized
agctctccttgtgagttcca

SEQ ID NO: 10768 - DNA, 20 bp, Artificial Sequence
  chemically synthesized
ccttgtgagttccacagcca

SEQ ID NO: 10769 - DNA, 20 bp, Artificial Sequence
  chemically synthesized
gccacagattcaattaactg

SEQ ID NO: 10770 - DNA, 20 bp, Artificial Sequence
  chemically synthesized
actgcagatcaaaaatattc

SEQ ID NO: 10771 - DNA, 20 bp, Artificial Sequence
  chemically synthesized
aaaaatattcaagaaaaaaa

SEQ ID NO: 10772 - DNA, 20 bp, Artificial Sequence
  chemically synthesized
atattcaagaaaaaaatgga

SEQ ID NO: 10773 - DNA, 20 bp, Artificial Sequence
  chemically synthesized
gcatctctactgaacatgta

SEQ ID NO: 10774 - DNA, 20 bp, Artificial Sequence
  chemically synthesized
tcattattccctaaacaata

SEQ ID NO: 10775 - DNA, 20 bp, Artificial Sequence
  chemically synthesized
cagcataacaactatttaca

SEQ ID NO: 10776 - DNA, 20 bp, Artificial Sequence
  chemically synthesized
acatagcatttacattgtat

SEQ ID NO: 10777 - DNA, 20 bp, Artificial Sequence
  chemically synthesized
tttacattgtattagctatt

SEQ ID NO: 10778 - DNA, 20 bp, Artificial Sequence
  chemically synthesized
tacattgtattagctattaa

SEQ ID NO: 10779 - DNA, 20 bp, Artificial Sequence
  chemically synthesized
attagctattaagagaaacc

SEQ ID NO: 10780 - DNA, 20 bp, Artificial Sequence
  chemically synthesized
tagctattaagagaaaccta

SEQ ID NO: 10781 - DNA, 20 bp, Artificial Sequence
  chemically synthesized
agaaacctagagatgattta

SEQ ID NO: 10782 - DNA, 20 bp, Artificial Sequence
  chemically synthesized
tagagatgatttaaagtaca

SEQ ID NO: 10783 - DNA, 20 bp, Artificial Sequence
  chemically synthesized
agagatgatttaaagtacaa

SEQ ID NO: 10784 - DNA, 20 bp, Artificial Sequence
  chemically synthesized
agatgatttaaagtacaaag

SEQ ID NO: 10785 - DNA, 20 bp, Artificial Sequence
  chemically synthesized
gatgatttaaagtacaaagg

SEQ ID NO: 10786 - DNA, 20 bp, Artificial Sequence
  chemically synthesized
agtacaaaggaggatgtgtt

SEQ ID NO: 10787 - DNA, 20 bp, Artificial Sequence
  chemically synthesized
gtacaaaggaggatgtgttt

SEQ ID NO: 10788 - DNA, 20 bp, Artificial Sequence
  chemically synthesized
gtgtttaggttatatgcaaa

SEQ ID NO: 10789 - DNA, 20 bp, Artificial Sequence
  chemically synthesized
ttaggttatatgcaaatagt

SEQ ID NO: 10790 - DNA, 20 bp, Artificial Sequence
  chemically synthesized
atagtaagccatttttatat

SEQ ID NO: 10791 - DNA, 20 bp, Artificial Sequence
  chemically synthesized
agtaagccatttttatatcg

SEQ ID NO: 10792 - DNA, 20 bp, Artificial Sequence
  chemically synthesized
catttttatatcggagactt

SEQ ID NO: 10793 - DNA, 20 bp, Artificial Sequence
  chemically synthesized
atcggagacttgagcatcca

SEQ ID NO: 10794 - DNA, 20 bp, Artificial Sequence
  chemically synthesized
tccacagatcttgatatttg

SEQ ID NO: 10795 - DNA, 20 bp, Artificial Sequence
  chemically synthesized
ccacagatcttgatatttgc

SEQ ID NO: 10796 - DNA, 20 bp, Artificial Sequence
  chemically synthesized
cacagatcttgatatttgca

SEQ ID NO: 10797 - DNA, 20 bp, Artificial Sequence
  chemically synthesized
acagatcttgatatttgcag

SEQ ID NO: 10798 - DNA, 20 bp, Artificial Sequence
  chemically synthesized
cagatcttgatatttgcagg

SEQ ID NO: 10799 - DNA, 20 bp, Artificial Sequence
  chemically synthesized
gtcttgccaccaattttcca

SEQ ID NO: 10800 - DNA, 20 bp, Artificial Sequence
  chemically synthesized
accaattttccatggatact

SEQ ID NO: 10801 - DNA, 20 bp, Artificial Sequence
  chemically synthesized
ccaattttccatggatactg

SEQ ID NO: 10802 - DNA, 20 bp, Artificial Sequence
  chemically synthesized
tactgaggaacgactgtaaa

SEQ ID NO: 10803 - DNA, 20 bp, Artificial Sequence
  chemically synthesized
ggaacgactgtaaatggatg

SEQ ID NO: 10804 - DNA, 20 bp, Artificial Sequence
  chemically synthesized
gaacgactgtaaatggatgc

SEQ ID NO: 10805 - DNA, 20 bp, Artificial Sequence
  chemically synthesized
actgtaaatggatgcaggca

SEQ ID NO: 10806 - DNA, 20 bp, Artificial Sequence
  chemically synthesized
atgcaggcatggatgctatt

SEQ ID NO: 10807 - DNA, 20 bp, Artificial Sequence
  chemically synthesized
tgcaggcatggatgctattt

SEQ ID NO: 10808 - DNA, 20 bp, Artificial Sequence
  chemically synthesized
caggcatggatgctatttag

SEQ ID NO: 10809 - DNA, 20 bp, Artificial Sequence
  chemically synthesized
ggatgctatttaggagtgtc

SEQ ID NO: 10810 - DNA, 20 bp, Artificial Sequence
  chemically synthesized
gatgctatttaggagtgtcc

SEQ ID NO: 10811 - DNA, 20 bp, Artificial Sequence
  chemically synthesized
atgctatttaggagtgtcca

SEQ ID NO: 10812 - DNA, 20 bp, Artificial Sequence
  chemically synthesized
atttaggagtgtccagggcc

SEQ ID NO: 10813 - DNA, 20 bp, Artificial Sequence
  chemically synthesized
gtgtccagggccaagtaaat

SEQ ID NO: 10814 - DNA, 20 bp, Artificial Sequence
  chemically synthesized
ggccaagtaaatgagttgct

SEQ ID NO: 10815 - DNA, 20 bp, Artificial Sequence
  chemically synthesized
caagtaaatgagttgctgag

SEQ ID NO: 10816 - DNA, 20 bp, Artificial Sequence
  chemically synthesized
agtaaatgagttgctgagca

SEQ ID NO: 10817 - DNA, 20 bp, Artificial Sequence
  chemically synthesized
taaatgagttgctgagcaga

SEQ ID NO: 10818 - DNA, 20 bp, Artificial Sequence
  chemically synthesized
aaatgagttgctgagcagag

SEQ ID NO: 10819 - DNA, 20 bp, Artificial Sequence
  chemically synthesized
tgagttgctgagcagagagg

SEQ ID NO: 10820 - DNA, 20 bp, Artificial Sequence
  chemically synthesized
gagttgctgagcagagaggt

SEQ ID NO: 10821 - DNA, 20 bp, Artificial Sequence
  chemically synthesized
ttgctgagcagagaggtggg

SEQ ID NO: 10822 - DNA, 20 bp, Artificial Sequence
  chemically synthesized
gctgagcagagaggtgggtg

SEQ ID NO: 10823 - DNA, 20 bp, Artificial Sequence
  chemically synthesized
ctgagcagagaggtgggtgg

SEQ ID NO: 10824 - DNA, 20 bp, Artificial Sequence
  chemically synthesized
gagaggtgggtggaggctgt

SEQ ID NO: 10825 - DNA, 20 bp, Artificial Sequence
  chemically synthesized
agaggtgggtggaggctgtg

SEQ ID NO: 10826 - DNA, 20 bp, Artificial Sequence
  chemically synthesized
ggctgtgaggcatcaatatg

SEQ ID NO: 10827 - DNA, 20 bp, Artificial Sequence
  chemically synthesized
tgtgaggcatcaatatgtgg

SEQ ID NO: 10828 - DNA, 20 bp, Artificial Sequence
  chemically synthesized
ggtggcatccatctgcattt

SEQ ID NO: 10829 - DNA, 20 bp, Artificial Sequence
  chemically synthesized
ttggtgatttttttccttca

SEQ ID NO: 10830 - DNA, 20 bp, Artificial Sequence
  chemically synthesized
tttttttccttcacagtcct

SEQ ID NO: 10831 - DNA, 20 bp, Artificial Sequence
  chemically synthesized
cttcacagtcctcggctgtc

SEQ ID NO: 10832 - DNA, 20 bp, Artificial Sequence
  chemically synthesized
ttcacagtcctcggctgtct

SEQ ID NO: 10833 - DNA, 20 bp, Artificial Sequence
  chemically synthesized
acagtcctcggctgtctggg

SEQ ID NO: 10834 - DNA, 20 bp, Artificial Sequence
  chemically synthesized
agtcctcggctgtctgggaa

SEQ ID NO: 10835 - DNA, 20 bp, Artificial Sequence
  chemically synthesized
cctcggctgtctgggaagag

SEQ ID NO: 10836 - DNA, 20 bp, Artificial Sequence
  chemically synthesized
ctcggctgtctgggaagaga

SEQ ID NO: 10837 - DNA, 20 bp, Artificial Sequence
  chemically synthesized
tgtctgggaagagaaggatg

SEQ ID NO: 10838 - DNA, 20 bp, Artificial Sequence
  chemically synthesized
gtctgggaagagaaggatga

SEQ ID NO: 10839 - DNA, 20 bp, Artificial Sequence
  chemically synthesized
tgggaagagaaggatgaagg

SEQ ID NO: 10840 - DNA, 20 bp, Artificial Sequence
  chemically synthesized
aagagaaggatgaaggcaga

SEQ ID NO: 10841 - DNA, 20 bp, Artificial Sequence
  chemically synthesized
ggcagatggctgctccaatt

SEQ ID NO: 10842 - DNA, 20 bp, Artificial Sequence
  chemically synthesized
gcagatggctgctccaattt

SEQ ID NO: 10843 - DNA, 20 bp, Artificial Sequence
  chemically synthesized
cagatggctgctccaattta

SEQ ID NO: 10844 - DNA, 20 bp, Artificial Sequence
  chemically synthesized
agatggctgctccaatttag

SEQ ID NO: 10845 - DNA, 20 bp, Artificial Sequence
  chemically synthesized
ggctgctccaatttaggggc

SEQ ID NO: 10846 - DNA, 20 bp, Artificial Sequence
  chemically synthesized
gctgctccaatttaggggct

SEQ ID NO: 10847 - DNA, 20 bp, Artificial Sequence
  chemically synthesized
caatttaggggctaggattg

SEQ ID NO: 10848 - DNA, 20 bp, Artificial Sequence
  chemically synthesized
aatttaggggctaggattgc

SEQ ID NO: 10849 - DNA, 20 bp, Artificial Sequence
  chemically synthesized
atttaggggctaggattgca

SEQ ID NO: 10850 - DNA, 20 bp, Artificial Sequence
  chemically synthesized
taggggctaggattgcaggg

SEQ ID NO: 10851 - DNA, 20 bp, Artificial Sequence
  chemically synthesized
aggggctaggattgcagggt

SEQ ID NO: 10852 - DNA, 20 bp, Artificial Sequence
  chemically synthesized
ctaggattgcagggtgggca

SEQ ID NO: 10853 - DNA, 20 bp, Artificial Sequence
  chemically synthesized
gtgggcacagcattgcaaac

SEQ ID NO: 10854 - DNA, 20 bp, Artificial Sequence
  chemically synthesized
cacagcattgcaaacgagtg

SEQ ID NO: 10855 - DNA, 20 bp, Artificial Sequence
  chemically synthesized
acagcattgcaaacgagtga

SEQ ID NO: 10856 - DNA, 20 bp, Artificial Sequence
  chemically synthesized
gcaaacgagtgaaggaaatt

SEQ ID NO: 10857 - DNA, 20 bp, Artificial Sequence
  chemically synthesized
gtgaaggaaattgagaaata

SEQ ID NO: 10858 - DNA, 20 bp, Artificial Sequence
  chemically synthesized
attgagaaatatggccaatg

SEQ ID NO: 10859 - DNA, 20 bp, Artificial Sequence
  chemically synthesized
tgagaaatatggccaatgaa

SEQ ID NO: 10860 - DNA, 20 bp, Artificial Sequence
  chemically synthesized
atatggccaatgaagagttg

SEQ ID NO: 10861 - DNA, 20 bp, Artificial Sequence
  chemically synthesized
atggccaatgaagagttgaa

SEQ ID NO: 10862 - DNA, 20 bp, Artificial Sequence
  chemically synthesized
ggccaatgaagagttgaaga

SEQ ID NO: 10863 - DNA, 20 bp, Artificial Sequence
  chemically synthesized
gccaatgaagagttgaagag

SEQ ID NO: 10864 - DNA, 20 bp, Artificial Sequence
  chemically synthesized
tgaagagttgaagagaggcc

SEQ ID NO: 10865 - DNA, 20 bp, Artificial Sequence
  chemically synthesized
agttgaagagaggcctggca

SEQ ID NO: 10866 - DNA, 20 bp, Artificial Sequence
  chemically synthesized
tgaagagaggcctggcatgg

SEQ ID NO: 10867 - DNA, 20 bp, Artificial Sequence
  chemically synthesized
gtggctcacacctataatcc

SEQ ID NO: 10868 - DNA, 20 bp, Artificial Sequence
  chemically synthesized
acctataatcccagcacttt

SEQ ID NO: 10869 - DNA, 20 bp, Artificial Sequence
  chemically synthesized
ctataatcccagcactttca

SEQ ID NO: 10870 - DNA, 20 bp, Artificial Sequence
  chemically synthesized
tataatcccagcactttcag

SEQ ID NO: 10871 - DNA, 20 bp, Artificial Sequence
  chemically synthesized
tcccagcactttcagaggcc

SEQ ID NO: 10872 - DNA, 20 bp, Artificial Sequence
  chemically synthesized
cccagcactttcagaggccc

SEQ ID NO: 10873 - DNA, 20 bp, Artificial Sequence
  chemically synthesized
agcactttcagaggcccagg

SEQ ID NO: 10874 - DNA, 20 bp, Artificial Sequence
  chemically synthesized
gcactttcagaggcccaggc

SEQ ID NO: 10875 - DNA, 20 bp, Artificial Sequence
  chemically synthesized
ctttcagaggcccaggcagg

SEQ ID NO: 10876 - DNA, 20 bp, Artificial Sequence
  chemically synthesized
cccaggcaggcagatcactt

SEQ ID NO: 10877 - DNA, 20 bp, Artificial Sequence
  chemically synthesized
ccaggcaggcagatcacttg

SEQ ID NO: 10878 - DNA, 20 bp, Artificial Sequence
  chemically synthesized
gcaggcagatcacttgaggt

SEQ ID NO: 10879 - DNA, 20 bp, Artificial Sequence
  chemically synthesized
caggcagatcacttgaggtc

SEQ ID NO: 10880 - DNA, 20 bp, Artificial Sequence
  chemically synthesized
ggcagatcacttgaggtcag

SEQ ID NO: 10881 - DNA, 20 bp, Artificial Sequence
  chemically synthesized
tgaggtcaggagttcgacac

SEQ ID NO: 10882 - DNA, 20 bp, Artificial Sequence
  chemically synthesized
tcaggagttcgacaccagcc

SEQ ID NO: 10883 - DNA, 20 bp, Artificial Sequence
  chemically synthesized
tcgacaccagcctggccaac

SEQ ID NO: 10884 - DNA, 20 bp, Artificial Sequence
  chemically synthesized
cgacaccagcctggccaaca

SEQ ID NO: 10885 - DNA, 20 bp, Artificial Sequence
  chemically synthesized
gcctggccaacaaggtgaaa

SEQ ID NO: 10886 - DNA, 20 bp, Artificial Sequence
  chemically synthesized
aaggtgaaatggtgaaaccc

SEQ ID NO: 10887 - DNA, 20 bp, Artificial Sequence
  chemically synthesized
tttactaaaaatacaaaaat

SEQ ID NO: 10888 - DNA, 20 bp, Artificial Sequence
  chemically synthesized
ctaaaaatacaaaaattagc

SEQ ID NO: 10889 - DNA, 20 bp, Artificial Sequence
  chemically synthesized
taaaaatacaaaaattagct

SEQ ID NO: 10890 - DNA, 20 bp, Artificial Sequence
  chemically synthesized
atacaaaaattagctgggca

SEQ ID NO: 10891 - DNA, 20 bp, Artificial Sequence
  chemically synthesized
caaaaattagctgggcatgg

SEQ ID NO: 10892 - DNA, 20 bp, Artificial Sequence
  chemically synthesized
aaattagctgggcatggtgg

SEQ ID NO: 10893 - DNA, 20 bp, Artificial Sequence
  chemically synthesized
aattagctgggcatggtggc

SEQ ID NO: 10894 - DNA, 20 bp, Artificial Sequence
  chemically synthesized
gtggcgggtgcctgtaatcc

SEQ ID NO: 10895 - DNA, 20 bp, Artificial Sequence
  chemically synthesized
tgcctgtaatcccagctact

SEQ ID NO: 10896 - DNA, 20 bp, Artificial Sequence
  chemically synthesized
gcctgtaatcccagctactt

SEQ ID NO: 10897 - DNA, 20 bp, Artificial Sequence
  chemically synthesized
ctgtaatcccagctacttgg

SEQ ID NO: 10898 - DNA, 20 bp, Artificial Sequence
  chemically synthesized
tgtaatcccagctacttggg

SEQ ID NO: 10899 - DNA, 20 bp, Artificial Sequence
  chemically synthesized
tcccagctacttgggaggct

SEQ ID NO: 10900 - DNA, 20 bp, Artificial Sequence
  chemically synthesized
cccagctacttgggaggctg

SEQ ID NO: 10901 - DNA, 20 bp, Artificial Sequence
  chemically synthesized
agctacttgggaggctgagg

SEQ ID NO: 10902 - DNA, 20 bp, Artificial Sequence
  chemically synthesized
gctacttgggaggctgaggc

SEQ ID NO: 10903 - DNA, 20 bp, Artificial Sequence
  chemically synthesized
tacttgggaggctgaggcag

SEQ ID NO: 10904 - DNA, 20 bp, Artificial Sequence
  chemically synthesized
gggaggctgaggcaggagaa

SEQ ID NO: 10905 - DNA, 20 bp, Artificial Sequence
  chemically synthesized
gcaggagaatagcttgaacc

SEQ ID NO: 10906 - DNA, 20 bp, Artificial Sequence
  chemically synthesized
caggagaatagcttgaacct

SEQ ID NO: 10907 - DNA, 20 bp, Artificial Sequence
  chemically synthesized
ggagaatagcttgaacctgg

SEQ ID NO: 10908 - DNA, 20 bp, Artificial Sequence
  chemically synthesized
aatagcttgaacctgggaga

SEQ ID NO: 10909 - DNA, 20 bp, Artificial Sequence
  chemically synthesized
tagcttgaacctgggagatg

SEQ ID NO: 10910 - DNA, 20 bp, Artificial Sequence
  chemically synthesized
agcttgaacctgggagatgg

SEQ ID NO: 10911 - DNA, 20 bp, Artificial Sequence
  chemically synthesized
aacctgggagatggaggttg

SEQ ID NO: 10912 - DNA, 20 bp, Artificial Sequence
  chemically synthesized
tgggagatggaggttgcagt

SEQ ID NO: 10913 - DNA, 20 bp, Artificial Sequence
  chemically synthesized
gatggaggttgcagtgagct

SEQ ID NO: 10914 - DNA, 20 bp, Artificial Sequence
  chemically synthesized
gagatcgcaccactgcactc

SEQ ID NO: 10915 - DNA, 20 bp, Artificial Sequence
  chemically synthesized
cgcaccactgcactccagcc

SEQ ID NO: 10916 - DNA, 20 bp, Artificial Sequence
  chemically synthesized
gcaccactgcactccagcct

SEQ ID NO: 10917 - DNA, 20 bp, Artificial Sequence
  chemically synthesized
ctgcactccagcctgggcga

SEQ ID NO: 10918 - DNA, 20 bp, Artificial Sequence
  chemically synthesized
gcactccagcctgggcgaca

SEQ ID NO: 10919 - DNA, 20 bp, Artificial Sequence
  chemically synthesized
tccagcctgggcgacagagc

SEQ ID NO: 10920 - DNA, 20 bp, Artificial Sequence
  chemically synthesized
caagactctgtcaaaaaaaa

SEQ ID NO: 10921 - DNA, 20 bp, Artificial Sequence
  chemically synthesized
agactctgtcaaaaaaaaaa

SEQ ID NO: 10922 - DNA, 20 bp, Artificial Sequence
  chemically synthesized
tgtcaaaaaaaaaagagttg

SEQ ID NO: 10923 - DNA, 20 bp, Artificial Sequence
  chemically synthesized
tcaaaaaaaaaagagttgaa

SEQ ID NO: 10924 - DNA, 20 bp, Artificial Sequence
  chemically synthesized
aaaaaagagttgaagagaaa

SEQ ID NO: 10925 - DNA, 20 bp, Artificial Sequence
  chemically synthesized
agagttgaagagaaaaagtc

SEQ ID NO: 10926 - DNA, 20 bp, Artificial Sequence
  chemically synthesized
gagttgaagagaaaaagtct

SEQ ID NO: 10927 - DNA, 20 bp, Artificial Sequence
  chemically synthesized
aaaagtctaggctaaattca

SEQ ID NO: 10928 - DNA, 20 bp, Artificial Sequence
  chemically synthesized
aggctaaattcaaagaaaaa

SEQ ID NO: 10929 - DNA, 20 bp, Artificial Sequence
  chemically synthesized
taaattcaaagaaaaaaagt

SEQ ID NO: 10930 - DNA, 20 bp, Artificial Sequence
  chemically synthesized
aagaaaaaaagtgagcccaa

SEQ ID NO: 10931 - DNA, 20 bp, Artificial Sequence
  chemically synthesized
agaaaaaaagtgagcccaaa

SEQ ID NO: 10932 - DNA, 20 bp, Artificial Sequence
  chemically synthesized
gtgagcccaaaaggaacttg

SEQ ID NO: 10933 - DNA, 20 bp, Artificial Sequence
  chemically synthesized
gagcccaaaaggaacttgca

SEQ ID NO: 10934 - DNA, 20 bp, Artificial Sequence
  chemically synthesized
ccaaaaggaacttgcagagc

SEQ ID NO: 10935 - DNA, 20 bp, Artificial Sequence
  chemically synthesized
caaaaggaacttgcagagca

SEQ ID NO: 10936 - DNA, 20 bp, Artificial Sequence
  chemically synthesized
aaaaggaacttgcagagcaa

SEQ ID NO: 10937 - DNA, 20 bp, Artificial Sequence
  chemically synthesized
gaacttgcagagcaagggaa

SEQ ID NO: 10938 - DNA, 20 bp, Artificial Sequence
  chemically synthesized
cttgcagagcaagggaaaag

SEQ ID NO: 10939 - DNA, 20 bp, Artificial Sequence
  chemically synthesized
ttgcagagcaagggaaaagc

SEQ ID NO: 10940 - DNA, 20 bp, Artificial Sequence
  chemically synthesized
tgcagagcaagggaaaagca

SEQ ID NO: 10941 - DNA, 20 bp, Artificial Sequence
  chemically synthesized
aagggaaaagcagggatgtc

SEQ ID NO: 10942 - DNA, 20 bp, Artificial Sequence
  chemically synthesized
agggaaaagcagggatgtca

SEQ ID NO: 10943 - DNA, 20 bp, Artificial Sequence
  chemically synthesized
gggaaaagcagggatgtcaa

SEQ ID NO: 10944 - DNA, 20 bp, Artificial Sequence
  chemically synthesized
aagcagggatgtcaagggac

SEQ ID NO: 10945 - DNA, 20 bp, Artificial Sequence
  chemically synthesized
agggactagaacactccata

SEQ ID NO: 10946 - DNA, 20 bp, Artificial Sequence
  chemically synthesized
agaacactccataaagtgaa

SEQ ID NO: 10947 - DNA, 20 bp, Artificial Sequence
  chemically synthesized
tgaacagctgcaatgaaaat

SEQ ID NO: 10948 - DNA, 20 bp, Artificial Sequence
  chemically synthesized
gaacagctgcaatgaaaata

SEQ ID NO: 10949 - DNA, 20 bp, Artificial Sequence
  chemically synthesized
aacagctgcaatgaaaataa

SEQ ID NO: 10950 - DNA, 20 bp, Artificial Sequence
  chemically synthesized
agctgcaatgaaaataaggg

SEQ ID NO: 10951 - DNA, 20 bp, Artificial Sequence
  chemically synthesized
gcaatgaaaataagggaaga

SEQ ID NO: 10952 - DNA, 20 bp, Artificial Sequence
  chemically synthesized
gaaaataagggaagaaagtt

SEQ ID NO: 10953 - DNA, 20 bp, Artificial Sequence
  chemically synthesized
ctttcctttctcttcctttt

SEQ ID NO: 10954 - DNA, 20 bp, Artificial Sequence
  chemically synthesized
ttcctttctcttcctttttg

SEQ ID NO: 10955 - DNA, 20 bp, Artificial Sequence
  chemically synthesized
tcttcctttttggagttaat

SEQ ID NO: 10956 - DNA, 20 bp, Artificial Sequence
  chemically synthesized
cttcctttttggagttaatc

SEQ ID NO: 10957 - DNA, 20 bp, Artificial Sequence
  chemically synthesized
cctttttggagttaatcagg

SEQ ID NO: 10958 - DNA, 20 bp, Artificial Sequence
  chemically synthesized
ttttggagttaatcaggaag

SEQ ID NO: 10959 - DNA, 20 bp, Artificial Sequence
  chemically synthesized
ggaagtagtcccaaataccc

SEQ ID NO: 10960 - DNA, 20 bp, Artificial Sequence
  chemically synthesized
gtagtcccaaataccccaga

SEQ ID NO: 10961 - DNA, 20 bp, Artificial Sequence
  chemically synthesized
ccccagaaagttcatcttat

SEQ ID NO: 10962 - DNA, 20 bp, Artificial Sequence
  chemically synthesized
aagttcatcttataagccct

SEQ ID NO: 10963 - DNA, 20 bp, Artificial Sequence
  chemically synthesized
tataagcccttggtcctctt

SEQ ID NO: 10964 - DNA, 20 bp, Artificial Sequence
  chemically synthesized
agcccttggtcctcttgaga

SEQ ID NO: 10965 - DNA, 20 bp, Artificial Sequence
  chemically synthesized
tggtcctcttgagatggtat

SEQ ID NO: 10966 - DNA, 20 bp, Artificial Sequence
  chemically synthesized
gatggtatcagatatattgc

SEQ ID NO: 10967 - DNA, 20 bp, Artificial Sequence
  chemically synthesized
gatatattgctagacccttg

SEQ ID NO: 10968 - DNA, 20 bp, Artificial Sequence
  chemically synthesized
tattgctagacccttgaaga

SEQ ID NO: 10969 - DNA, 20 bp, Artificial Sequence
  chemically synthesized
attgctagacccttgaagaa

SEQ ID NO: 10970 - DNA, 20 bp, Artificial Sequence
  chemically synthesized
cttgaagaaaggaacaactc

SEQ ID NO: 10971 - DNA, 20 bp, Artificial Sequence
  chemically synthesized
ttgaagaaaggaacaactcc

SEQ ID NO: 10972 - DNA, 20 bp, Artificial Sequence
  chemically synthesized
acaactccaggcaacttctt

SEQ ID NO: 10973 - DNA, 20 bp, Artificial Sequence
  chemically synthesized
caaacacatgtgtgtgtata

SEQ ID NO: 10974 - DNA, 20 bp, Artificial Sequence
  chemically synthesized
agccatgcattccttaacaa

SEQ ID NO: 10975 - DNA, 20 bp, Artificial Sequence
  chemically synthesized
gccatgcattccttaacaat

SEQ ID NO: 10976 - DNA, 20 bp, Artificial Sequence
  chemically synthesized
ccatgcattccttaacaatg

SEQ ID NO: 10977 - DNA, 20 bp, Artificial Sequence
  chemically synthesized
taacaatggggatatattct

SEQ ID NO: 10978 - DNA, 20 bp, Artificial Sequence
  chemically synthesized
attctgagaaatgtgtcatt

SEQ ID NO: 10979 - DNA, 20 bp, Artificial Sequence
  chemically synthesized
tcatcattgtgcgaacataa

SEQ ID NO: 10980 - DNA, 20 bp, Artificial Sequence
  chemically synthesized
atcattgtgcgaacataata

SEQ ID NO: 10981 - DNA, 20 bp, Artificial Sequence
  chemically synthesized
tgtacttacctaaacctaaa

SEQ ID NO: 10982 - DNA, 20 bp, Artificial Sequence
  chemically synthesized
ttacctaaacctaaatggta

SEQ ID NO: 10983 - DNA, 20 bp, Artificial Sequence
  chemically synthesized
ggtatagcttactacatacc

SEQ ID NO: 10984 - DNA, 20 bp, Artificial Sequence
  chemically synthesized
gtatagcttactacatacct

SEQ ID NO: 10985 - DNA, 20 bp, Artificial Sequence
  chemically synthesized
atacctaggttgtattgatg

SEQ ID NO: 10986 - DNA, 20 bp, Artificial Sequence
  chemically synthesized
ttgatgtggcctattgctcc

SEQ ID NO: 10987 - DNA, 20 bp, Artificial Sequence
  chemically synthesized
tgatgtggcctattgctcct

SEQ ID NO: 10988 - DNA, 20 bp, Artificial Sequence
  chemically synthesized
gcctattgctcctaggctcc

SEQ ID NO: 10989 - DNA, 20 bp, Artificial Sequence
  chemically synthesized
cctattgctcctaggctcct

SEQ ID NO: 10990 - DNA, 20 bp, Artificial Sequence
  chemically synthesized
tcctgggctgcaaacctgta

SEQ ID NO: 10991 - DNA, 20 bp, Artificial Sequence
  chemically synthesized
tgtgactgtactgaacactg

SEQ ID NO: 10992 - DNA, 20 bp, Artificial Sequence
  chemically synthesized
gtgactgtactgaacactgt

SEQ ID NO: 10993 - DNA, 20 bp, Artificial Sequence
  chemically synthesized
gtactgaacactgtaggcaa

SEQ ID NO: 10994 - DNA, 20 bp, Artificial Sequence
  chemically synthesized
aacactgtaggcaatggtaa

SEQ ID NO: 10995 - DNA, 20 bp, Artificial Sequence
  chemically synthesized
actgtaggcaatggtaacag

SEQ ID NO: 10996 - DNA, 20 bp, Artificial Sequence
  chemically synthesized
ggtatttgtgtatctaaaca

SEQ ID NO: 10997 - DNA, 20 bp, Artificial Sequence
  chemically synthesized
ttgtgtatctaaacatagaa

SEQ ID NO: 10998 - DNA, 20 bp, Artificial Sequence
  chemically synthesized
tgtgtatctaaacatagaaa

SEQ ID NO: 10999 - DNA, 20 bp, Artificial Sequence
  chemically synthesized
atctaaacatagaaaaggta

SEQ ID NO: 11000 - DNA, 20 bp, Artificial Sequence
  chemically synthesized
gaaaaggtacagtgaaaata

SEQ ID NO: 11001 - DNA, 20 bp, Artificial Sequence
  chemically synthesized
aatacagtattataacctta

SEQ ID NO: 11002 - DNA, 20 bp, Artificial Sequence
  chemically synthesized
atacagtattataaccttat

SEQ ID NO: 11003 - DNA, 20 bp, Artificial Sequence
  chemically synthesized
gggaccactgtcgtataatg

SEQ ID NO: 11004 - DNA, 20 bp, Artificial Sequence
  chemically synthesized
ttgaccaaaatgtcattgtg

SEQ ID NO: 11005 - DNA, 20 bp, Artificial Sequence
  chemically synthesized
tatatgtacacacacacaca

SEQ ID NO: 11006 - DNA, 20 bp, Artificial Sequence
  chemically synthesized
tatgtacacacacacacata

SEQ ID NO: 11007 - DNA, 20 bp, Artificial Sequence
  chemically synthesized
tgtacacacacacacataga

SEQ ID NO: 11008 - DNA, 20 bp, Artificial Sequence
  chemically synthesized
tacacacacacacatagaga

SEQ ID NO: 11009 - DNA, 20 bp, Artificial Sequence
  chemically synthesized
cacacacacacatagagaga

SEQ ID NO: 11010 - DNA, 20 bp, Artificial Sequence
  chemically synthesized
cacacacacatagagagaga

SEQ ID NO: 11011 - DNA, 20 bp, Artificial Sequence
  chemically synthesized
cacacacatagagagagaga

SEQ ID NO: 11012 - DNA, 20 bp, Artificial Sequence
  chemically synthesized
cacacatagagagagagaga

SEQ ID NO: 11013 - DNA, 20 bp, Artificial Sequence
  chemically synthesized
acacatagagagagagagag

SEQ ID NO: 11014 - DNA, 20 bp, Artificial Sequence
  chemically synthesized
acatagagagagagagagag

SEQ ID NO: 11015 - DNA, 20 bp, Artificial Sequence
  chemically synthesized
atagagagagagagagagga

SEQ ID NO: 11016 - DNA, 20 bp, Artificial Sequence
  chemically synthesized
tagagagagagagagaggag

SEQ ID NO: 11017 - DNA, 20 bp, Artificial Sequence
  chemically synthesized
gagagagagagagaggagag

SEQ ID NO: 11018 - DNA, 20 bp, Artificial Sequence
  chemically synthesized
gagagagagagaggagagga

SEQ ID NO: 11019 - DNA, 20 bp, Artificial Sequence
  chemically synthesized
agagagagagaggagaggag

SEQ ID NO: 11020 - DNA, 20 bp, Artificial Sequence
  chemically synthesized
gagagagaggagaggagagg

SEQ ID NO: 11021 - DNA, 20 bp, Artificial Sequence
  chemically synthesized
agagagaggagaggagagga

SEQ ID NO: 11022 - DNA, 20 bp, Artificial Sequence
  chemically synthesized
agagaggagaggagaggaag

SEQ ID NO: 11023 - DNA, 20 bp, Artificial Sequence
  chemically synthesized
gagaggagaggagaggaagg

SEQ ID NO: 11024 - DNA, 20 bp, Artificial Sequence
  chemically synthesized
agaggagaggagaggaagga

SEQ ID NO: 11025 - DNA, 20 bp, Artificial Sequence
  chemically synthesized
aggagaggagaggaaggagg

SEQ ID NO: 11026 - DNA, 20 bp, Artificial Sequence
  chemically synthesized
ggagaggagaggaaggaggg

SEQ ID NO: 11027 - DNA, 20 bp, Artificial Sequence
  chemically synthesized
gagaggagaggaaggaggga

SEQ ID NO: 11028 - DNA, 20 bp, Artificial Sequence
  chemically synthesized
aggagaggaaggagggaggg

SEQ ID NO: 11029 - DNA, 20 bp, Artificial Sequence
  chemically synthesized
ggagaggaaggagggaggga

SEQ ID NO: 11030 - DNA, 20 bp, Artificial Sequence
  chemically synthesized
agaggaaggagggagggaag

SEQ ID NO: 11031 - DNA, 20 bp, Artificial Sequence
  chemically synthesized
agggaaggagaaatatgatt

SEQ ID NO: 11032 - DNA, 20 bp, Artificial Sequence
  chemically synthesized
aaggagaaatatgattcaga

SEQ ID NO: 11033 - DNA, 20 bp, Artificial Sequence
  chemically synthesized
ggagaaatatgattcagata

SEQ ID NO: 11034 - DNA, 20 bp, Artificial Sequence
  chemically synthesized
agatagagacatctatcctc

SEQ ID NO: 11035 - DNA, 20 bp, Artificial Sequence
  chemically synthesized
atagagacatctatcctcca

SEQ ID NO: 11036 - DNA, 20 bp, Artificial Sequence
  chemically synthesized
gacatctatcctccagagtt

SEQ ID NO: 11037 - DNA, 20 bp, Artificial Sequence
  chemically synthesized
acatctatcctccagagttc

SEQ ID NO: 11038 - DNA, 20 bp, Artificial Sequence
  chemically synthesized
atctatcctccagagttcag

SEQ ID NO: 11039 - DNA, 20 bp, Artificial Sequence
  chemically synthesized
agagttcaggagtgtctctt

SEQ ID NO: 11040 - DNA, 20 bp, Artificial Sequence
  chemically synthesized
tcaggagtgtctcttcagac

SEQ ID NO: 11041 - DNA, 20 bp, Artificial Sequence
  chemically synthesized
caggagtgtctcttcagact

SEQ ID NO: 11042 - DNA, 20 bp, Artificial Sequence
  chemically synthesized
gagtgtctcttcagactagg

SEQ ID NO: 11043 - DNA, 20 bp, Artificial Sequence
  chemically synthesized
ctcttcagactaggtagatg

SEQ ID NO: 11044 - DNA, 20 bp, Artificial Sequence
  chemically synthesized
aaaaaacatatcctgaattc

SEQ ID NO: 11045 - DNA, 20 bp, Artificial Sequence
  chemically synthesized
aaaacatatcctgaattcta

SEQ ID NO: 11046 - DNA, 20 bp, Artificial Sequence
  chemically synthesized
aacatatcctgaattctaga

SEQ ID NO: 11047 - DNA, 20 bp, Artificial Sequence
  chemically synthesized
cctataacacttgccaacca

SEQ ID NO: 11048 - DNA, 20 bp, Artificial Sequence
  chemically synthesized
ctataacacttgccaaccaa

SEQ ID NO: 11049 - DNA, 20 bp, Artificial Sequence
  chemically synthesized
attgcttttttaaattaatg

SEQ ID NO: 11050 - DNA, 20 bp, Artificial Sequence
  chemically synthesized
agtgatttttctttaacatc

SEQ ID NO: 11051 - DNA, 20 bp, Artificial Sequence
  chemically synthesized
ttttctttaacatctagtga

SEQ ID NO: 11052 - DNA, 20 bp, Artificial Sequence
  chemically synthesized
taacatctagtgacagacac

SEQ ID NO: 11053 - DNA, 20 bp, Artificial Sequence
  chemically synthesized
aacatctagtgacagacact

SEQ ID NO: 11054 - DNA, 20 bp, Artificial Sequence
  chemically synthesized
acatctagtgacagacactg

SEQ ID NO: 11055 - DNA, 20 bp, Artificial Sequence
  chemically synthesized
agacactggggtcacatttg

SEQ ID NO: 11056 - DNA, 20 bp, Artificial Sequence
  chemically synthesized
actggggtcacatttgcagc

SEQ ID NO: 11057 - DNA, 20 bp, Artificial Sequence
  chemically synthesized
atttgcagctggaccataat

SEQ ID NO: 11058 - DNA, 20 bp, Artificial Sequence
  chemically synthesized
tttgcagctggaccataatt

SEQ ID NO: 11059 - DNA, 20 bp, Artificial Sequence
  chemically synthesized
ataattaggcttctgttctt

SEQ ID NO: 11060 - DNA, 20 bp, Artificial Sequence
  chemically synthesized
taattaggcttctgttcttc

SEQ ID NO: 11061 - DNA, 20 bp, Artificial Sequence
  chemically synthesized
attaggcttctgttcttcag

SEQ ID NO: 11062 - DNA, 20 bp, Artificial Sequence
  chemically synthesized
cttcaggagacatttgttca

SEQ ID NO: 11063 - DNA, 20 bp, Artificial Sequence
  chemically synthesized
gacatttgttcaaagtcatt

SEQ ID NO: 11064 - DNA, 20 bp, Artificial Sequence
  chemically synthesized
acatttgttcaaagtcattt

SEQ ID NO: 11065 - DNA, 20 bp, Artificial Sequence
  chemically synthesized
gggcaaccatattctgaaaa

SEQ ID NO: 11066 - DNA, 20 bp, Artificial Sequence
  chemically synthesized
accatattctgaaaacagcc

SEQ ID NO: 11067 - DNA, 20 bp, Artificial Sequence
  chemically synthesized
tattctgaaaacagcccagc

SEQ ID NO: 11068 - DNA, 20 bp, Artificial Sequence
  chemically synthesized
attctgaaaacagcccagcc

SEQ ID NO: 11069 - DNA, 20 bp, Artificial Sequence
  chemically synthesized
ttctgaaaacagcccagcca

SEQ ID NO: 11070 - DNA, 20 bp, Artificial Sequence
  chemically synthesized
aaacagcccagccagggtga

SEQ ID NO: 11071 - DNA, 20 bp, Artificial Sequence
  chemically synthesized
gggtgatggatcactttgca

SEQ ID NO: 11072 - DNA, 20 bp, Artificial Sequence
  chemically synthesized
actttgcaaagatcctcaat

SEQ ID NO: 11073 - DNA, 20 bp, Artificial Sequence
  chemically synthesized
atcctcaatgagctattttc

SEQ ID NO: 11074 - DNA, 20 bp, Artificial Sequence
  chemically synthesized
gctattttcaagtgatgaca

SEQ ID NO: 11075 - DNA, 20 bp, Artificial Sequence
  chemically synthesized
tcaagtgatgacaaagtgtg

SEQ ID NO: 11076 - DNA, 20 bp, Artificial Sequence
  chemically synthesized
gtgaagttaaccgctcattt

SEQ ID NO: 11077 - DNA, 20 bp, Artificial Sequence
  chemically synthesized
agaactttctttttcatcca

SEQ ID NO: 11078 - DNA, 20 bp, Artificial Sequence
  chemically synthesized
aaagtaaattcaaatatgat

SEQ ID NO: 11079 - DNA, 20 bp, Artificial Sequence
  chemically synthesized
gaaatctgaccttttattac

SEQ ID NO: 11080 - DNA, 20 bp, Artificial Sequence
  chemically synthesized
actggaattctcttgactaa

SEQ ID NO: 11081 - DNA, 20 bp, Artificial Sequence
  chemically synthesized
cctaaatctccatgtgtata

SEQ ID NO: 11082 - DNA, 20 bp, Artificial Sequence
  chemically synthesized
tccatgtgtatacagtactg

SEQ ID NO: 11083 - DNA, 20 bp, Artificial Sequence
  chemically synthesized
ccatgtgtatacagtactgt

SEQ ID NO: 11084 - DNA, 20 bp, Artificial Sequence
  chemically synthesized
acagtactgtgggaacatca

SEQ ID NO: 11085 - DNA, 20 bp, Artificial Sequence
  chemically synthesized
tgtgggaacatcacagattt

SEQ ID NO: 11086 - DNA, 20 bp, Artificial Sequence
  chemically synthesized
gattttggctccatgcccta

SEQ ID NO: 11087 - DNA, 20 bp, Artificial Sequence
  chemically synthesized
ttttggctccatgccctaaa

SEQ ID NO: 11088 - DNA, 20 bp, Artificial Sequence
  chemically synthesized
tccatgccctaaagagaaat

SEQ ID NO: 11089 - DNA, 20 bp, Artificial Sequence
  chemically synthesized
cctaaagagaaattggcttt

SEQ ID NO: 11090 - DNA, 20 bp, Artificial Sequence
  chemically synthesized
aaattggctttcagattatt

SEQ ID NO: 11091 - DNA, 20 bp, Artificial Sequence
  chemically synthesized
gattatttggattaaaaaca

SEQ ID NO: 11092 - DNA, 20 bp, Artificial Sequence
  chemically synthesized
ttaaaaacaaagactttctt

SEQ ID NO: 11093 - DNA, 20 bp, Artificial Sequence
  chemically synthesized
aaaaacaaagactttcttaa

SEQ ID NO: 11094 - DNA, 20 bp, Artificial Sequence
  chemically synthesized
tttcttttttgctaaaacta

SEQ ID NO: 11095 - DNA, 20 bp, Artificial Sequence
  chemically synthesized
agaattattcttttacattt

SEQ ID NO: 11096 - DNA, 20 bp, Artificial Sequence
  chemically synthesized
acgccaacaaaattctgaat

SEQ ID NO: 11097 - DNA, 20 bp, Artificial Sequence
  chemically synthesized
acaaaattctgaatcggcca

SEQ ID NO: 11098 - DNA, 20 bp, Artificial Sequence
  chemically synthesized
aaaattctgaatcggccaaa

SEQ ID NO: 11099 - DNA, 20 bp, Artificial Sequence
  chemically synthesized
aaattctgaatcggccaaag

SEQ ID NO: 11100 - DNA, 20 bp, Artificial Sequence
  chemically synthesized
tcggccaaagaggtataatt

SEQ ID NO: 11101 - DNA, 20 bp, Artificial Sequence
  chemically synthesized
cggccaaagaggtataattc

SEQ ID NO: 11102 - DNA, 20 bp, Artificial Sequence
  chemically synthesized
gaggtataattcaggtaaat

SEQ ID NO: 11103 - DNA, 20 bp, Artificial Sequence
  chemically synthesized
gtataattcaggtaaattgg

SEQ ID NO: 11104 - DNA, 20 bp, Artificial Sequence
  chemically synthesized
ataattcaggtaaattggaa

SEQ ID NO: 11105 - DNA, 20 bp, Artificial Sequence
  chemically synthesized
taaattggaagagtttgttc

SEQ ID NO: 11106 - DNA, 20 bp, Artificial Sequence
  chemically synthesized
aaattggaagagtttgttca

SEQ ID NO: 11107 - DNA, 20 bp, Artificial Sequence
  chemically synthesized
aattggaagagtttgttcaa

SEQ ID NO: 11108 - DNA, 20 bp, Artificial Sequence
  chemically synthesized
agtttgttcaagggaacctt

SEQ ID NO: 11109 - DNA, 20 bp, Artificial Sequence
  chemically synthesized
tttgttcaagggaaccttga

SEQ ID NO: 11110 - DNA, 20 bp, Artificial Sequence
  chemically synthesized
tgttcaagggaaccttgaga

SEQ ID NO: 11111 - DNA, 20 bp, Artificial Sequence
  chemically synthesized
gaaccttgagagagaatgta

SEQ ID NO: 11112 - DNA, 20 bp, Artificial Sequence
  chemically synthesized
ccttgagagagaatgtatgg

SEQ ID NO: 11113 - DNA, 20 bp, Artificial Sequence
  chemically synthesized
agagagaatgtatggaagaa

SEQ ID NO: 11114 - DNA, 20 bp, Artificial Sequence
  chemically synthesized
gaatgtatggaagaaaagtg

SEQ ID NO: 11115 - DNA, 20 bp, Artificial Sequence
  chemically synthesized
ggaagaaaagtgtagttttg

SEQ ID NO: 11116 - DNA, 20 bp, Artificial Sequence
  chemically synthesized
agaaaagtgtagttttgaag

SEQ ID NO: 11117 - DNA, 20 bp, Artificial Sequence
  chemically synthesized
gtgtagttttgaagaagcac

SEQ ID NO: 11118 - DNA, 20 bp, Artificial Sequence
  chemically synthesized
tagttttgaagaagcacgag

SEQ ID NO: 11119 - DNA, 20 bp, Artificial Sequence
  chemically synthesized
gaagtttttgaaaacactga

SEQ ID NO: 11120 - DNA, 20 bp, Artificial Sequence
  chemically synthesized
tcttccatacattctctctc

SEQ ID NO: 11121 - DNA, 20 bp, Artificial Sequence
  chemically synthesized
cttccatacattctctctca

SEQ ID NO: 11122 - DNA, 20 bp, Artificial Sequence
  chemically synthesized
ttacctgaattatacctctt

SEQ ID NO: 11123 - DNA, 20 bp, Artificial Sequence
  chemically synthesized
ttatacctctttggccgatt

SEQ ID NO: 11124 - DNA, 20 bp, Artificial Sequence
  chemically synthesized
tggccgattcagaattttgt

SEQ ID NO: 11125 - DNA, 20 bp, Artificial Sequence
  chemically synthesized
ttgttggcgttttcatgatc

SEQ ID NO: 11126 - DNA, 20 bp, Artificial Sequence
  chemically synthesized
caagaaaaactgaaatgtaa

SEQ ID NO: 11127 - DNA, 20 bp, Artificial Sequence
  chemically synthesized
aatgtaaaagaataattctt

SEQ ID NO: 11128 - DNA, 20 bp, Artificial Sequence
  chemically synthesized
aaagaataattctttagttt

SEQ ID NO: 11129 - DNA, 20 bp, Artificial Sequence
  chemically synthesized
attctttagttttagcaaaa

SEQ ID NO: 11130 - DNA, 20 bp, Artificial Sequence
  chemically synthesized
atgaaaattttacatctctt

SEQ ID NO: 11131 - DNA, 20 bp, Artificial Sequence
  chemically synthesized
aaattttacatctcttaaga

SEQ ID NO: 11132 - DNA, 20 bp, Artificial Sequence
  chemically synthesized
ttttaatccaaataatctga

SEQ ID NO: 11133 - DNA, 20 bp, Artificial Sequence
  chemically synthesized
tctgaaagccaatttctctt

SEQ ID NO: 11134 - DNA, 20 bp, Artificial Sequence
  chemically synthesized
ctgaaagccaatttctcttt

SEQ ID NO: 11135 - DNA, 20 bp, Artificial Sequence
  chemically synthesized
tgaaagccaatttctcttta

SEQ ID NO: 11136 - DNA, 20 bp, Artificial Sequence
  chemically synthesized
gccaatttctctttagggca

SEQ ID NO: 11137 - DNA, 20 bp, Artificial Sequence
  chemically synthesized
caatttctctttagggcatg

SEQ ID NO: 11138 - DNA, 20 bp, Artificial Sequence
  chemically synthesized
caaaatctgtgatgttccca

SEQ ID NO: 11139 - DNA, 20 bp, Artificial Sequence
  chemically synthesized
cccacagtactgtatacaca

SEQ ID NO: 11140 - DNA, 20 bp, Artificial Sequence
  chemically synthesized
cacagtactgtatacacatg

SEQ ID NO: 11141 - DNA, 20 bp, Artificial Sequence
  chemically synthesized
actgtatacacatggagatt

SEQ ID NO: 11142 - DNA, 20 bp, Artificial Sequence
  chemically synthesized
ctgtatacacatggagattt

SEQ ID NO: 11143 - DNA, 20 bp, Artificial Sequence
  chemically synthesized
ttaaaattcaattttacttt

SEQ ID NO: 11144 - DNA, 20 bp, Artificial Sequence
  chemically synthesized
attcaattttacttttagtc

SEQ ID NO: 11145 - DNA, 20 bp, Artificial Sequence
  chemically synthesized
tcaattttacttttagtcaa

SEQ ID NO: 11146 - DNA, 20 bp, Artificial Sequence
  chemically synthesized
acttttagtcaagagaattc

SEQ ID NO: 11147 - DNA, 20 bp, Artificial Sequence
  chemically synthesized
caagagaattccagtaataa

SEQ ID NO: 11148 - DNA, 20 bp, Artificial Sequence
  chemically synthesized
aagagaattccagtaataaa

SEQ ID NO: 11149 - DNA, 20 bp, Artificial Sequence
  chemically synthesized
gaattccagtaataaaaggt

SEQ ID NO: 11150 - DNA, 20 bp, Artificial Sequence
  chemically synthesized
aatcatatttgaatttactt

SEQ ID NO: 11151 - DNA, 20 bp, Artificial Sequence
  chemically synthesized
tgaatttactttggatgaaa

SEQ ID NO: 11152 - DNA, 20 bp, Artificial Sequence
  chemically synthesized
tttactttggatgaaaaaga

SEQ ID NO: 11153 - DNA, 20 bp, Artificial Sequence
  chemically synthesized
gaaaaagaaagttctcaaat

SEQ ID NO: 11154 - DNA, 20 bp, Artificial Sequence
  chemically synthesized
aaagaaagttctcaaatgag

SEQ ID NO: 11155 - DNA, 20 bp, Artificial Sequence
  chemically synthesized
actttgtcatcacttgaaaa

SEQ ID NO: 11156 - DNA, 20 bp, Artificial Sequence
  chemically synthesized
tcacttgaaaatagctcatt

SEQ ID NO: 11157 - DNA, 20 bp, Artificial Sequence
  chemically synthesized
cacttgaaaatagctcattg

SEQ ID NO: 11158 - DNA, 20 bp, Artificial Sequence
  chemically synthesized
gctcattgaggatctttgca

SEQ ID NO: 11159 - DNA, 20 bp, Artificial Sequence
  chemically synthesized
tgcaaagtgatccatcaccc

SEQ ID NO: 11160 - DNA, 20 bp, Artificial Sequence
  chemically synthesized
aagtgatccatcaccctggc

SEQ ID NO: 11161 - DNA, 20 bp, Artificial Sequence
  chemically synthesized
agtgatccatcaccctggct

SEQ ID NO: 11162 - DNA, 20 bp, Artificial Sequence
  chemically synthesized
caccctggctgggctgtttt

SEQ ID NO: 11163 - DNA, 20 bp, Artificial Sequence
  chemically synthesized
gctgggctgttttcagaata

SEQ ID NO: 11164 - DNA, 20 bp, Artificial Sequence
  chemically synthesized
ctttgaacaaatgtctcctg

SEQ ID NO: 11165 - DNA, 20 bp, Artificial Sequence
  chemically synthesized
aacaaatgtctcctgaagaa

SEQ ID NO: 11166 - DNA, 20 bp, Artificial Sequence
  chemically synthesized
aaatgtctcctgaagaacag

SEQ ID NO: 11167 - DNA, 20 bp, Artificial Sequence
  chemically synthesized
gaagaacagaagcctaatta

SEQ ID NO: 11168 - DNA, 20 bp, Artificial Sequence
  chemically synthesized
acagaagcctaattatggtc

SEQ ID NO: 11169 - DNA, 20 bp, Artificial Sequence
  chemically synthesized
tccagctgcaaatgtgaccc

SEQ ID NO: 11170 - DNA, 20 bp, Artificial Sequence
  chemically synthesized
gtgaccccagtgtctgtcac

SEQ ID NO: 11171 - DNA, 20 bp, Artificial Sequence
  chemically synthesized
gtgtctgtcactagatgtta

SEQ ID NO: 11172 - DNA, 20 bp, Artificial Sequence
  chemically synthesized
atcactgcattaatttaaaa

SEQ ID NO: 11173 - DNA, 20 bp, Artificial Sequence
  chemically synthesized
ttaatttaaaaaagcaattt

SEQ ID NO: 11174 - DNA, 20 bp, Artificial Sequence
  chemically synthesized
aaaaagcaatttcagatcaa

SEQ ID NO: 11175 - DNA, 20 bp, Artificial Sequence
  chemically synthesized
tttcagatcaacagcacctt

SEQ ID NO: 11176 - DNA, 20 bp, Artificial Sequence
  chemically synthesized
agatcaacagcacctttggt

SEQ ID NO: 11177 - DNA, 20 bp, Artificial Sequence
  chemically synthesized
caacagcacctttggttggc

SEQ ID NO: 11178 - DNA, 20 bp, Artificial Sequence
  chemically synthesized
cctttggttggcaagtgtta

SEQ ID NO: 11179 - DNA, 20 bp, Artificial Sequence
  chemically synthesized
ctttggttggcaagtgttat

SEQ ID NO: 11180 - DNA, 20 bp, Artificial Sequence
  chemically synthesized
ggcaagtgttataggaattg

SEQ ID NO: 11181 - DNA, 20 bp, Artificial Sequence
  chemically synthesized
tataggaattgcagtgattt

SEQ ID NO: 11182 - DNA, 20 bp, Artificial Sequence
  chemically synthesized
cagtgatttaagcatctctc

SEQ ID NO: 11183 - DNA, 20 bp, Artificial Sequence
  chemically synthesized
ttaagcatctctctagaatt

SEQ ID NO: 11184 - DNA, 20 bp, Artificial Sequence
  chemically synthesized
taagcatctctctagaattc

SEQ ID NO: 11185 - DNA, 20 bp, Artificial Sequence
  chemically synthesized
attcaggatatgtttttttt

SEQ ID NO: 11186 - DNA, 20 bp, Artificial Sequence
  chemically synthesized
ttttttaagctacatctacc

SEQ ID NO: 11187 - DNA, 20 bp, Artificial Sequence
  chemically synthesized
agctacatctacctagtctg

SEQ ID NO: 11188 - DNA, 20 bp, Artificial Sequence
  chemically synthesized
ctacatctacctagtctgaa

SEQ ID NO: 11189 - DNA, 20 bp, Artificial Sequence
  chemically synthesized
gaagagacactcctgaactc

SEQ ID NO: 11190 - DNA, 20 bp, Artificial Sequence
  chemically synthesized
agagacactcctgaactctg

SEQ ID NO: 11191 - DNA, 20 bp, Artificial Sequence
  chemically synthesized
gagacactcctgaactctgg

SEQ ID NO: 11192 - DNA, 20 bp, Artificial Sequence
  chemically synthesized
cactcctgaactctggagga

SEQ ID NO: 11193 - DNA, 20 bp, Artificial Sequence
  chemically synthesized
tatcatatatatatatatat

SEQ ID NO: 11194 - DNA, 20 bp, Artificial Sequence
  chemically synthesized
tttgctgcacaatgacattt

SEQ ID NO: 11195 - DNA, 20 bp, Artificial Sequence
  chemically synthesized
aatgacattttggtcaatga

SEQ ID NO: 11196 - DNA, 20 bp, Artificial Sequence
  chemically synthesized
tgatggaccacattatacga

SEQ ID NO: 11197 - DNA, 20 bp, Artificial Sequence
  chemically synthesized
tggaccacattatacgacag

SEQ ID NO: 11198 - DNA, 20 bp, Artificial Sequence
  chemically synthesized
ttatacgacagtggtcccat

SEQ ID NO: 11199 - DNA, 20 bp, Artificial Sequence
  chemically synthesized
tatacgacagtggtcccata

SEQ ID NO: 11200 - DNA, 20 bp, Artificial Sequence
  chemically synthesized
cactgtaccttttctatgtt

SEQ ID NO: 11201 - DNA, 20 bp, Artificial Sequence
  chemically synthesized
accactgttaccattgccta

SEQ ID NO: 11202 - DNA, 20 bp, Artificial Sequence
  chemically synthesized
ttaccattgcctacagtgtt

SEQ ID NO: 11203 - DNA, 20 bp, Artificial Sequence
  chemically synthesized
attgcctacagtgttcagta

SEQ ID NO: 11204 - DNA, 20 bp, Artificial Sequence
  chemically synthesized
cagtacagtcacatgctgta

SEQ ID NO: 11205 - DNA, 20 bp, Artificial Sequence
  chemically synthesized
agtacagtcacatgctgtac

SEQ ID NO: 11206 - DNA, 20 bp, Artificial Sequence
  chemically synthesized
tcacatgctgtacaggtttg

SEQ ID NO: 11207 - DNA, 20 bp, Artificial Sequence
  chemically synthesized
tgctgtacaggtttgcagcc

SEQ ID NO: 11208 - DNA, 20 bp, Artificial Sequence
  chemically synthesized
gctgtacaggtttgcagccc

SEQ ID NO: 11209 - DNA, 20 bp, Artificial Sequence
  chemically synthesized
tgtacaggtttgcagcccag

SEQ ID NO: 11210 - DNA, 20 bp, Artificial Sequence
  chemically synthesized
aggtttgcagcccaggagcc

SEQ ID NO: 11211 - DNA, 20 bp, Artificial Sequence
  chemically synthesized
ggtttgcagcccaggagcct

SEQ ID NO: 11212 - DNA, 20 bp, Artificial Sequence
  chemically synthesized
tttgcagcccaggagcctag

SEQ ID NO: 11213 - DNA, 20 bp, Artificial Sequence
  chemically synthesized
gcccaggagcctaggagcaa

SEQ ID NO: 11214 - DNA, 20 bp, Artificial Sequence
  chemically synthesized
cccaggagcctaggagcaat

SEQ ID NO: 11215 - DNA, 20 bp, Artificial Sequence
  chemically synthesized
taggccacatcaatacaacc

SEQ ID NO: 11216 - DNA, 20 bp, Artificial Sequence
  chemically synthesized
aggccacatcaatacaacct

SEQ ID NO: 11217 - DNA, 20 bp, Artificial Sequence
  chemically synthesized
atcaatacaacctaggtatg

SEQ ID NO: 11218 - DNA, 20 bp, Artificial Sequence
  chemically synthesized
atacaacctaggtatgtagt

SEQ ID NO: 11219 - DNA, 20 bp, Artificial Sequence
  chemically synthesized
atgtagtaagctataccatt

SEQ ID NO: 11220 - DNA, 20 bp, Artificial Sequence
  chemically synthesized
tgtagtaagctataccattt

SEQ ID NO: 11221 - DNA, 20 bp, Artificial Sequence
  chemically synthesized
taagctataccatttaggtt

SEQ ID NO: 11222 - DNA, 20 bp, Artificial Sequence
  chemically synthesized
aagctataccatttaggttt

SEQ ID NO: 11223 - DNA, 20 bp, Artificial Sequence
  chemically synthesized
tataccatttaggtttaggt

SEQ ID NO: 11224 - DNA, 20 bp, Artificial Sequence
  chemically synthesized
ttgcttaatgacacatttct

SEQ ID NO: 11225 - DNA, 20 bp, Artificial Sequence
  chemically synthesized
cagaatatatccccattgtt

SEQ ID NO: 11226 - DNA, 20 bp, Artificial Sequence
  chemically synthesized
agaatatatccccattgtta

SEQ ID NO: 11227 - DNA, 20 bp, Artificial Sequence
  chemically synthesized
ccccattgttaaggaatgca

SEQ ID NO: 11228 - DNA, 20 bp, Artificial Sequence
  chemically synthesized
tgtatgtataaaattaataa

SEQ ID NO: 11229 - DNA, 20 bp, Artificial Sequence
  chemically synthesized
gtatgtataaaattaataac

SEQ ID NO: 11230 - DNA, 20 bp, Artificial Sequence
  chemically synthesized
tatgtataaaattaataaca

SEQ ID NO: 11231 - DNA, 20 bp, Artificial Sequence
  chemically synthesized
aaaattaataacagggactc

SEQ ID NO: 11232 - DNA, 20 bp, Artificial Sequence
  chemically synthesized
attaataacagggactcaag

SEQ ID NO: 11233 - DNA, 20 bp, Artificial Sequence
  chemically synthesized
cagggactcaagaagttgcc

SEQ ID NO: 11234 - DNA, 20 bp, Artificial Sequence
  chemically synthesized
gggactcaagaagttgcctg

SEQ ID NO: 11235 - DNA, 20 bp, Artificial Sequence
  chemically synthesized
ctggagttgttcctttcttc

SEQ ID NO: 11236 - DNA, 20 bp, Artificial Sequence
  chemically synthesized
tggagttgttcctttcttca

SEQ ID NO: 11237 - DNA, 20 bp, Artificial Sequence
  chemically synthesized
ggagttgttcctttcttcaa

SEQ ID NO: 11238 - DNA, 20 bp, Artificial Sequence
  chemically synthesized
tgttcctttcttcaagggtc

SEQ ID NO: 11239 - DNA, 20 bp, Artificial Sequence
  chemically synthesized
aatatatctgataccatctc

SEQ ID NO: 11240 - DNA, 20 bp, Artificial Sequence
  chemically synthesized
tatatctgataccatctcaa

SEQ ID NO: 11241 - DNA, 20 bp, Artificial Sequence
  chemically synthesized
atatctgataccatctcaag

SEQ ID NO: 11242 - DNA, 20 bp, Artificial Sequence
  chemically synthesized
gataccatctcaagaggacc

SEQ ID NO: 11243 - DNA, 20 bp, Artificial Sequence
  chemically synthesized
ataccatctcaagaggacca

SEQ ID NO: 11244 - DNA, 20 bp, Artificial Sequence
  chemically synthesized
taccatctcaagaggaccaa

SEQ ID NO: 11245 - DNA, 20 bp, Artificial Sequence
  chemically synthesized
caagaggaccaagggcttat

SEQ ID NO: 11246 - DNA, 20 bp, Artificial Sequence
  chemically synthesized
ggcttataagatgaactttc

SEQ ID NO: 11247 - DNA, 20 bp, Artificial Sequence
  chemically synthesized
gcttataagatgaactttct

SEQ ID NO: 11248 - DNA, 20 bp, Artificial Sequence
  chemically synthesized
cttataagatgaactttctg

SEQ ID NO: 11249 - DNA, 20 bp, Artificial Sequence
  chemically synthesized
gatgaactttctggggtatt

SEQ ID NO: 11250 - DNA, 20 bp, Artificial Sequence
  chemically synthesized
atgaactttctggggtattt

SEQ ID NO: 11251 - DNA, 20 bp, Artificial Sequence
  chemically synthesized
acttcctgattaactccaaa

SEQ ID NO: 11252 - DNA, 20 bp, Artificial Sequence
  chemically synthesized
cttcctgattaactccaaaa

SEQ ID NO: 11253 - DNA, 20 bp, Artificial Sequence
  chemically synthesized
cctgattaactccaaaaagg

SEQ ID NO: 11254 - DNA, 20 bp, Artificial Sequence
  chemically synthesized
tgattaactccaaaaaggaa

SEQ ID NO: 11255 - DNA, 20 bp, Artificial Sequence
  chemically synthesized
taactccaaaaaggaagaga

SEQ ID NO: 11256 - DNA, 20 bp, Artificial Sequence
  chemically synthesized
aactccaaaaaggaagagaa

SEQ ID NO: 11257 - DNA, 20 bp, Artificial Sequence
  chemically synthesized
ccaaaaaggaagagaaagga

SEQ ID NO: 11258 - DNA, 20 bp, Artificial Sequence
  chemically synthesized
ggaagagaaaggaaagtaaa

SEQ ID NO: 11259 - DNA, 20 bp, Artificial Sequence
  chemically synthesized
gaagagaaaggaaagtaaaa

SEQ ID NO: 11260 - DNA, 20 bp, Artificial Sequence
  chemically synthesized
agaaaggaaagtaaaaagga

SEQ ID NO: 11261 - DNA, 20 bp, Artificial Sequence
  chemically synthesized
gaaaggaaagtaaaaaggaa

SEQ ID NO: 11262 - DNA, 20 bp, Artificial Sequence
  chemically synthesized
ggaaagtaaaaaggaaagga

SEQ ID NO: 11263 - DNA, 20 bp, Artificial Sequence
  chemically synthesized
taaaaaggaaaggaaagaaa

SEQ ID NO: 11264 - DNA, 20 bp, Artificial Sequence
  chemically synthesized
aaaaggaaaggaaagaaacg

SEQ ID NO: 11265 - DNA, 20 bp, Artificial Sequence
  chemically synthesized
ttcttcccttattttcattg

SEQ ID NO: 11266 - DNA, 20 bp, Artificial Sequence
  chemically synthesized
cattgcagctgttcacttta

SEQ ID NO: 11267 - DNA, 20 bp, Artificial Sequence
  chemically synthesized
ttgcagctgttcactttatg

SEQ ID NO: 11268 - DNA, 20 bp, Artificial Sequence
  chemically synthesized
gttcactttatggagtgttc

SEQ ID NO: 11269 - DNA, 20 bp, Artificial Sequence
  chemically synthesized
ctgcttttcccttgctctgc

SEQ ID NO: 11270 - DNA, 20 bp, Artificial Sequence
  chemically synthesized
cttgctctgcaagttccttt

SEQ ID NO: 11271 - DNA, 20 bp, Artificial Sequence
  chemically synthesized
ttgctctgcaagttcctttt

SEQ ID NO: 11272 - DNA, 20 bp, Artificial Sequence
  chemically synthesized
tcactttttttctttgaatt

SEQ ID NO: 11273 - DNA, 20 bp, Artificial Sequence
  chemically synthesized
ttttttctttgaatttagcc

SEQ ID NO: 11274 - DNA, 20 bp, Artificial Sequence
  chemically synthesized
ttcaactcttttttttttga

SEQ ID NO: 11275 - DNA, 20 bp, Artificial Sequence
  chemically synthesized
caactcttttttttttgaca

SEQ ID NO: 11276 - DNA, 20 bp, Artificial Sequence
  chemically synthesized
cagagtcttgctctgtcgcc

SEQ ID NO: 11277 - DNA, 20 bp, Artificial Sequence
  chemically synthesized
agagtcttgctctgtcgccc

SEQ ID NO: 11278 - DNA, 20 bp, Artificial Sequence
  chemically synthesized
tcttgctctgtcgcccaggc

SEQ ID NO: 11279 - DNA, 20 bp, Artificial Sequence
  chemically synthesized
ttgctctgtcgcccaggctg

SEQ ID NO: 11280 - DNA, 20 bp, Artificial Sequence
  chemically synthesized
ctgtcgcccaggctggagtg

SEQ ID NO: 11281 - DNA, 20 bp, Artificial Sequence
  chemically synthesized
tcgcccaggctggagtgcag

SEQ ID NO: 11282 - DNA, 20 bp, Artificial Sequence
  chemically synthesized
ggagtgcagtggtgcgatct

SEQ ID NO: 11283 - DNA, 20 bp, Artificial Sequence
  chemically synthesized
tcactgcaacctccatctcc

SEQ ID NO: 11284 - DNA, 20 bp, Artificial Sequence
  chemically synthesized
cactgcaacctccatctccc

SEQ ID NO: 11285 - DNA, 20 bp, Artificial Sequence
  chemically synthesized
aacctccatctcccaggttc

SEQ ID NO: 11286 - DNA, 20 bp, Artificial Sequence
  chemically synthesized
ttcaagctattctcctgcct

SEQ ID NO: 11287 - DNA, 20 bp, Artificial Sequence
  chemically synthesized
ttctcctgcctcagcctccc

SEQ ID NO: 11288 - DNA, 20 bp, Artificial Sequence
  chemically synthesized
tcctgcctcagcctcccaag

SEQ ID NO: 11289 - DNA, 20 bp, Artificial Sequence
  chemically synthesized
gcctcagcctcccaagtagc

SEQ ID NO: 11290 - DNA, 20 bp, Artificial Sequence
  chemically synthesized
cctcagcctcccaagtagct

SEQ ID NO: 11291 - DNA, 20 bp, Artificial Sequence
  chemically synthesized
ctcccaagtagctgggatta

SEQ ID NO: 11292 - DNA, 20 bp, Artificial Sequence
  chemically synthesized
tcccaagtagctgggattac

SEQ ID NO: 11293 - DNA, 20 bp, Artificial Sequence
  chemically synthesized
caggcacccgccaccatgcc

SEQ ID NO: 11294 - DNA, 20 bp, Artificial Sequence
  chemically synthesized
ccagctaatttttgtatttt

SEQ ID NO: 11295 - DNA, 20 bp, Artificial Sequence
  chemically synthesized
taatttttgtatttttagta

SEQ ID NO: 11296 - DNA, 20 bp, Artificial Sequence
  chemically synthesized
ttttgtatttttagtaaagc

SEQ ID NO: 11297 - DNA, 20 bp, Artificial Sequence
  chemically synthesized
tttgtatttttagtaaagcc

SEQ ID NO: 11298 - DNA, 20 bp, Artificial Sequence
  chemically synthesized
ttgtatttttagtaaagccg

SEQ ID NO: 11299 - DNA, 20 bp, Artificial Sequence
  chemically synthesized
gtttcaccatttcaccttgt

SEQ ID NO: 11300 - DNA, 20 bp, Artificial Sequence
  chemically synthesized
caccatttcaccttgttggc

SEQ ID NO: 11301 - DNA, 20 bp, Artificial Sequence
  chemically synthesized
accatttcaccttgttggcc

SEQ ID NO: 11302 - DNA, 20 bp, Artificial Sequence
  chemically synthesized
tttcaccttgttggccaggc

SEQ ID NO: 11303 - DNA, 20 bp, Artificial Sequence
  chemically synthesized
ggtgtcgaactcctgacctc

SEQ ID NO: 11304 - DNA, 20 bp, Artificial Sequence
  chemically synthesized
cctcaagtgatctgcctgcc

SEQ ID NO: 11305 - DNA, 20 bp, Artificial Sequence
  chemically synthesized
ctcaagtgatctgcctgcct

SEQ ID NO: 11306 - DNA, 20 bp, Artificial Sequence
  chemically synthesized
ctgcctgcctgggcctctga

SEQ ID NO: 11307 - DNA, 20 bp, Artificial Sequence
  chemically synthesized
gcctgggcctctgaaagtgc

SEQ ID NO: 11308 - DNA, 20 bp, Artificial Sequence
  chemically synthesized
cctgggcctctgaaagtgct

SEQ ID NO: 11309 - DNA, 20 bp, Artificial Sequence
  chemically synthesized
ctctgaaagtgctgggatta

SEQ ID NO: 11310 - DNA, 20 bp, Artificial Sequence
  chemically synthesized
tctgaaagtgctgggattat

SEQ ID NO: 11311 - DNA, 20 bp, Artificial Sequence
  chemically synthesized
agtgctgggattataggtgt

SEQ ID NO: 11312 - DNA, 20 bp, Artificial Sequence
  chemically synthesized
ataggtgtgagccaccatgc

SEQ ID NO: 11313 - DNA, 20 bp, Artificial Sequence
  chemically synthesized
taggtgtgagccaccatgcc

SEQ ID NO: 11314 - DNA, 20 bp, Artificial Sequence
  chemically synthesized
gcctctcttcaactcttcat

SEQ ID NO: 11315 - DNA, 20 bp, Artificial Sequence
  chemically synthesized
ctgtgcccaccctgcaatcc

SEQ ID NO: 11316 - DNA, 20 bp, Artificial Sequence
  chemically synthesized
tgcaatcctagcccctaaat

SEQ ID NO: 11317 - DNA, 20 bp, Artificial Sequence
  chemically synthesized
caatcctagcccctaaattg

SEQ ID NO: 11318 - DNA, 20 bp, Artificial Sequence
  chemically synthesized
tcctagcccctaaattggag

SEQ ID NO: 11319 - DNA, 20 bp, Artificial Sequence
  chemically synthesized
tgccttcatccttctcttcc

SEQ ID NO: 11320 - DNA, 20 bp, Artificial Sequence
  chemically synthesized
ttcatccttctcttcccaga

SEQ ID NO: 11321 - DNA, 20 bp, Artificial Sequence
  chemically synthesized
ccttctcttcccagacagcc

SEQ ID NO: 11322 - DNA, 20 bp, Artificial Sequence
  chemically synthesized
cttctcttcccagacagccg

SEQ ID NO: 11323 - DNA, 20 bp, Artificial Sequence
  chemically synthesized
ccagacagccgaggactgtg

SEQ ID NO: 11324 - DNA, 20 bp, Artificial Sequence
  chemically synthesized
cagacagccgaggactgtga

SEQ ID NO: 11325 - DNA, 20 bp, Artificial Sequence
  chemically synthesized
ggaaaaaaatcaccaaaatg

SEQ ID NO: 11326 - DNA, 20 bp, Artificial Sequence
  chemically synthesized
aaaaatcaccaaaatgcaga

SEQ ID NO: 11327 - DNA, 20 bp, Artificial Sequence
  chemically synthesized
caccacatattgatgcctca

SEQ ID NO: 11328 - DNA, 20 bp, Artificial Sequence
  chemically synthesized
cctccacccacctctctgct

SEQ ID NO: 11329 - DNA, 20 bp, Artificial Sequence
  chemically synthesized
tgctcagcaactcatttact

SEQ ID NO: 11330 - DNA, 20 bp, Artificial Sequence
  chemically synthesized
gcaactcatttacttggccc

SEQ ID NO: 11331 - DNA, 20 bp, Artificial Sequence
  chemically synthesized
tggccctggacactcctaaa

SEQ ID NO: 11332 - DNA, 20 bp, Artificial Sequence
  chemically synthesized
tccatgcctgcatccattta

SEQ ID NO: 11333 - DNA, 20 bp, Artificial Sequence
  chemically synthesized
atccatttacagtcgttcct

SEQ ID NO: 11334 - DNA, 20 bp, Artificial Sequence
  chemically synthesized
cagtcgttcctcagtatcca

SEQ ID NO: 11335 - DNA, 20 bp, Artificial Sequence
  chemically synthesized
cctcagtatccatggaaaat

SEQ ID NO: 11336 - DNA, 20 bp, Artificial Sequence
  chemically synthesized
cagtatccatggaaaattgg

SEQ ID NO: 11337 - DNA, 20 bp, Artificial Sequence
  chemically synthesized
atccatggaaaattggtggc

SEQ ID NO: 11338 - DNA, 20 bp, Artificial Sequence
  chemically synthesized
caagaccccctgcaaatatc

SEQ ID NO: 11339 - DNA, 20 bp, Artificial Sequence
  chemically synthesized
cctgcaaatatcaagatctg

SEQ ID NO: 11340 - DNA, 20 bp, Artificial Sequence
  chemically synthesized
atcaagatctgtggatgctc

SEQ ID NO: 11341 - DNA, 20 bp, Artificial Sequence
  chemically synthesized
tcaagtctccgatataaaaa

SEQ ID NO: 11342 - DNA, 20 bp, Artificial Sequence
  chemically synthesized
tttgtactttaaatcatctc

SEQ ID NO: 11343 - DNA, 20 bp, Artificial Sequence
  chemically synthesized
ttgtactttaaatcatctct

SEQ ID NO: 11344 - DNA, 20 bp, Artificial Sequence
  chemically synthesized
catctctaggtttctcttaa

SEQ ID NO: 11345 - DNA, 20 bp, Artificial Sequence
  chemically synthesized
caatgtaaatgctatgtaaa

SEQ ID NO: 11346 - DNA, 20 bp, Artificial Sequence
  chemically synthesized
agttgttatgctgtattgtt

SEQ ID NO: 11347 - DNA, 20 bp, Artificial Sequence
  chemically synthesized
gttgttatgctgtattgttt

SEQ ID NO: 11348 - DNA, 20 bp, Artificial Sequence
  chemically synthesized
ttgttatgctgtattgttta

SEQ ID NO: 11349 - DNA, 20 bp, Artificial Sequence
  chemically synthesized
tattgtttagggaataatga

SEQ ID NO: 11350 - DNA, 20 bp, Artificial Sequence
  chemically synthesized
tagggaataatgaaagataa

SEQ ID NO: 11351 - DNA, 20 bp, Artificial Sequence
  chemically synthesized
gggaataatgaaagataaaa

SEQ ID NO: 11352 - DNA, 20 bp, Artificial Sequence
  chemically synthesized
taaaagagtctgtacatgtt

SEQ ID NO: 11353 - DNA, 20 bp, Artificial Sequence
  chemically synthesized
aagagtctgtacatgttcag

SEQ ID NO: 11354 - DNA, 20 bp, Artificial Sequence
  chemically synthesized
gagtctgtacatgttcagta

SEQ ID NO: 11355 - DNA, 20 bp, Artificial Sequence
  chemically synthesized
tcttgaatatttttgatctg

SEQ ID NO: 11356 - DNA, 20 bp, Artificial Sequence
  chemically synthesized
tctgcagttaattgaatctg

SEQ ID NO: 11357 - DNA, 20 bp, Artificial Sequence
  chemically synthesized
gttaattgaatctgtggctg

SEQ ID NO: 11358 - DNA, 20 bp, Artificial Sequence
  chemically synthesized
tctgtggctgtggaactcac

SEQ ID NO: 11359 - DNA, 20 bp, Artificial Sequence
  chemically synthesized
ctgtggctgtggaactcaca

SEQ ID NO: 11360 - DNA, 20 bp, Artificial Sequence
  chemically synthesized
gtggctgtggaactcacaag

SEQ ID NO: 11361 - DNA, 20 bp, Artificial Sequence
  chemically synthesized
ggctgtggaactcacaagga

SEQ ID NO: 11362 - DNA, 20 bp, Artificial Sequence
  chemically synthesized
cacaaggagagctgactgta

SEQ ID NO: 11363 - DNA, 20 bp, Artificial Sequence
  chemically synthesized
ggagagctgactgtacagtg

SEQ ID NO: 11364 - DNA, 20 bp, Artificial Sequence
  chemically synthesized
gctgactgtacagtgtggtt

SEQ ID NO: 11365 - DNA, 20 bp, Artificial Sequence
  chemically synthesized
agtgtggttgagtgaaaaaa

SEQ ID NO: 11366 - DNA, 20 bp, Artificial Sequence
  chemically synthesized
ttgagtgaaaaaacagactt

SEQ ID NO: 11367 - DNA, 20 bp, Artificial Sequence
  chemically synthesized
gaaaaaacagactttagaat

SEQ ID NO: 11368 - DNA, 20 bp, Artificial Sequence
  chemically synthesized
aacagactttagaatcagat

SEQ ID NO: 11369 - DNA, 20 bp, Artificial Sequence
  chemically synthesized
gactttagaatcagatcaga

SEQ ID NO: 11370 - DNA, 20 bp, Artificial Sequence
  chemically synthesized
agaatcagatcagacagaaa

SEQ ID NO: 11371 - DNA, 20 bp, Artificial Sequence
  chemically synthesized
gaatcagatcagacagaaat

SEQ ID NO: 11372 - DNA, 20 bp, Artificial Sequence
  chemically synthesized
gacagaaataggtttgaatc

SEQ ID NO: 11373 - DNA, 20 bp, Artificial Sequence
  chemically synthesized
aatcaagtatctgcctcctc

SEQ ID NO: 11374 - DNA, 20 bp, Artificial Sequence
  chemically synthesized
ctcctctagacctgtgacct

SEQ ID NO: 11375 - DNA, 20 bp, Artificial Sequence
  chemically synthesized
ctagacctgtgaccttggac

SEQ ID NO: 11376 - DNA, 20 bp, Artificial Sequence
  chemically synthesized
tgaccttggacaagtcacac

SEQ ID NO: 11377 - DNA, 20 bp, Artificial Sequence
  chemically synthesized
taactttgtcaaatgtaaat

SEQ ID NO: 11378 - DNA, 20 bp, Artificial Sequence
  chemically synthesized
aactttgtcaaatgtaaatt

SEQ ID NO: 11379 - DNA, 20 bp, Artificial Sequence
  chemically synthesized
caaatgtaaattaggtttaa

SEQ ID NO: 11380 - DNA, 20 bp, Artificial Sequence
  chemically synthesized
atgtaaattaggtttaacag

SEQ ID NO: 11381 - DNA, 20 bp, Artificial Sequence
  chemically synthesized
aggtttaacagtagtataat

SEQ ID NO: 11382 - DNA, 20 bp, Artificial Sequence
  chemically synthesized
taataagaatatctatctca

SEQ ID NO: 11383 - DNA, 20 bp, Artificial Sequence
  chemically synthesized
aataagaatatctatctcac

SEQ ID NO: 11384 - DNA, 20 bp, Artificial Sequence
  chemically synthesized
aatatctatctcacaggtgt

SEQ ID NO: 11385 - DNA, 20 bp, Artificial Sequence
  chemically synthesized
atctatctcacaggtgttgg

SEQ ID NO: 11386 - DNA, 20 bp, Artificial Sequence
  chemically synthesized
tctatctcacaggtgttggc

SEQ ID NO: 11387 - DNA, 20 bp, Artificial Sequence
  chemically synthesized
ctcacaggtgttggcaggat

SEQ ID NO: 11388 - DNA, 20 bp, Artificial Sequence
  chemically synthesized
caggtgttggcaggatcagt

SEQ ID NO: 11389 - DNA, 20 bp, Artificial Sequence
  chemically synthesized
ggatcagtgagacaatatgc

SEQ ID NO: 11390 - DNA, 20 bp, Artificial Sequence
  chemically synthesized
tctccctactcctttcatgt

SEQ ID NO: 11391 - DNA, 20 bp, Artificial Sequence
  chemically synthesized
ttaaatttctcaattctctt

SEQ ID NO: 11392 - DNA, 20 bp, Artificial Sequence
  chemically synthesized
gctctttaataacttctgtg

SEQ ID NO: 11393 - DNA, 20 bp, Artificial Sequence
  chemically synthesized
gaaatgactattgtcacaat

SEQ ID NO: 11394 - DNA, 20 bp, Artificial Sequence
  chemically synthesized
aaatgactattgtcacaatc

SEQ ID NO: 11395 - DNA, 20 bp, Artificial Sequence
  chemically synthesized
tcacaatcaggaatgaccta

SEQ ID NO: 11396 - DNA, 20 bp, Artificial Sequence
  chemically synthesized
atgacctaaagaataatttt

SEQ ID NO: 11397 - DNA, 20 bp, Artificial Sequence
  chemically synthesized
ttttgagtttatgtatttac

SEQ ID NO: 11398 - DNA, 20 bp, Artificial Sequence
  chemically synthesized
attgttgatctctccctttt

SEQ ID NO: 11399 - DNA, 20 bp, Artificial Sequence
  chemically synthesized
ttgttgatctctcccttttt

SEQ ID NO: 11400 - DNA, 20 bp, Artificial Sequence
  chemically synthesized
ttataataatcactctattc

SEQ ID NO: 11401 - DNA, 20 bp, Artificial Sequence
  chemically synthesized
tctaactcctgttatccatc

SEQ ID NO: 11402 - DNA, 20 bp, Artificial Sequence
  chemically synthesized
ttaactcctgttcctctcca

SEQ ID NO: 11403 - DNA, 20 bp, Artificial Sequence
  chemically synthesized
ctccatggcccttaaatgtc

SEQ ID NO: 11404 - DNA, 20 bp, Artificial Sequence
  chemically synthesized
tccatggcccttaaatgtcc

SEQ ID NO: 11405 - DNA, 20 bp, Artificial Sequence
  chemically synthesized
ccatggcccttaaatgtcca

SEQ ID NO: 11406 - DNA, 20 bp, Artificial Sequence
  chemically synthesized
ttaaatgtccagggttctcc

SEQ ID NO: 11407 - DNA, 20 bp, Artificial Sequence
  chemically synthesized
taaatgtccagggttctccc

SEQ ID NO: 11408 - DNA, 20 bp, Artificial Sequence
  chemically synthesized
tccagggttctcccaggctc

SEQ ID NO: 11409 - DNA, 20 bp, Artificial Sequence
  chemically synthesized
gttctcccaggctccagcct

SEQ ID NO: 11410 - DNA, 20 bp, Artificial Sequence
  chemically synthesized
ttcaccttatatatacttgc

SEQ ID NO: 11411 - DNA, 20 bp, Artificial Sequence
  chemically synthesized
tcaccttatatatacttgct

SEQ ID NO: 11412 - DNA, 20 bp, Artificial Sequence
  chemically synthesized
caccttatatatacttgcta

SEQ ID NO: 11413 - DNA, 20 bp, Artificial Sequence
  chemically synthesized
ttatatatacttgctagggc

SEQ ID NO: 11414 - DNA, 20 bp, Artificial Sequence
  chemically synthesized
tatatatacttgctagggct

SEQ ID NO: 11415 - DNA, 20 bp, Artificial Sequence
  chemically synthesized
atacttgctagggctgggac

SEQ ID NO: 11416 - DNA, 20 bp, Artificial Sequence
  chemically synthesized
acttgctagggctgggacaa

SEQ ID NO: 11417 - DNA, 20 bp, Artificial Sequence
  chemically synthesized
gggacaagagtgaaccaaac

SEQ ID NO: 11418 - DNA, 20 bp, Artificial Sequence
  chemically synthesized
ggacaagagtgaaccaaaca

SEQ ID NO: 11419 - DNA, 20 bp, Artificial Sequence
  chemically synthesized
agtgaaccaaacaaggcatg

SEQ ID NO: 11420 - DNA, 20 bp, Artificial Sequence
  chemically synthesized
gtgaaccaaacaaggcatgt

SEQ ID NO: 11421 - DNA, 20 bp, Artificial Sequence
  chemically synthesized
tgaaccaaacaaggcatgta

SEQ ID NO: 11422 - DNA, 20 bp, Artificial Sequence
  chemically synthesized
gcatgtagggcacaatattt

SEQ ID NO: 11423 - DNA, 20 bp, Artificial Sequence
  chemically synthesized
atgtagggcacaatatttaa

SEQ ID NO: 11424 - DNA, 20 bp, Artificial Sequence
  chemically synthesized
tgtagggcacaatatttaag

SEQ ID NO: 11425 - DNA, 20 bp, Artificial Sequence
  chemically synthesized
tttaagaggtcctcacttct

SEQ ID NO: 11426 - DNA, 20 bp, Artificial Sequence
  chemically synthesized
ttaagaggtcctcacttctc

SEQ ID NO: 11427 - DNA, 20 bp, Artificial Sequence
  chemically synthesized
taagaggtcctcacttctcg

SEQ ID NO: 11428 - DNA, 20 bp, Artificial Sequence
  chemically synthesized
cctcacttctcggggcatac

SEQ ID NO: 11429 - DNA, 20 bp, Artificial Sequence
  chemically synthesized
acaagtatatttatgcccta

SEQ ID NO: 11430 - DNA, 20 bp, Artificial Sequence
  chemically synthesized
caagtatatttatgccctac

SEQ ID NO: 11431 - DNA, 20 bp, Artificial Sequence
  chemically synthesized
cctacaggccttgcttacca

SEQ ID NO: 11432 - DNA, 20 bp, Artificial Sequence
  chemically synthesized
aggccttgcttaccacagtc

SEQ ID NO: 11433 - DNA, 20 bp, Artificial Sequence
  chemically synthesized
ttgcttaccacagtctagtc

SEQ ID NO: 11434 - DNA, 20 bp, Artificial Sequence
  chemically synthesized
ccctgtcaacaaaatttact

SEQ ID NO: 11435 - DNA, 20 bp, Artificial Sequence
  chemically synthesized
gagcatacaaccactactgc

SEQ ID NO: 11436 - DNA, 20 bp, Artificial Sequence
  chemically synthesized
agcatacaaccactactgcc

SEQ ID NO: 11437 - DNA, 20 bp, Artificial Sequence
  chemically synthesized
actactgccaggcactgtac

SEQ ID NO: 11438 - DNA, 20 bp, Artificial Sequence
  chemically synthesized
ctactgccaggcactgtact

SEQ ID NO: 11439 - DNA, 20 bp, Artificial Sequence
  chemically synthesized
caatatccatgctcactctc

SEQ ID NO: 11440 - DNA, 20 bp, Artificial Sequence
  chemically synthesized
tctccagatgcccacacacg

SEQ ID NO: 11441 - DNA, 20 bp, Artificial Sequence
  chemically synthesized
gtggctgtaactactgttta

SEQ ID NO: 11442 - DNA, 20 bp, Artificial Sequence
  chemically synthesized
actactgtttacagaacaat

SEQ ID NO: 11443 - DNA, 20 bp, Artificial Sequence
  chemically synthesized
gagttccaaatactcaccta

SEQ ID NO: 11444 - DNA, 20 bp, Artificial Sequence
  chemically synthesized
tccaaatactcacctatagt

SEQ ID NO: 11445 - DNA, 20 bp, Artificial Sequence
  chemically synthesized
cagatacgtctcctgaattt

SEQ ID NO: 11446 - DNA, 20 bp, Artificial Sequence
  chemically synthesized
cctaactgtatatcataatg

SEQ ID NO: 11447 - DNA, 20 bp, Artificial Sequence
  chemically synthesized
actgtatatcataatgtagc

SEQ ID NO: 11448 - DNA, 20 bp, Artificial Sequence
  chemically synthesized
tatcataatgtagccagtaa

SEQ ID NO: 11449 - DNA, 20 bp, Artificial Sequence
  chemically synthesized
atgtaatgcttctgctgtgt

SEQ ID NO: 11450 - DNA, 20 bp, Artificial Sequence
  chemically synthesized
gctgtgttggacactgtgct

SEQ ID NO: 11451 - DNA, 20 bp, Artificial Sequence
  chemically synthesized
atctcacttcatcctcacaa

SEQ ID NO: 11452 - DNA, 20 bp, Artificial Sequence
  chemically synthesized
catcctcacaaaagtcccac

SEQ ID NO: 11453 - DNA, 20 bp, Artificial Sequence
  chemically synthesized
ctcacaaaagtcccacgaga

SEQ ID NO: 11454 - DNA, 20 bp, Artificial Sequence
  chemically synthesized
tcacaaaagtcccacgagat

SEQ ID NO: 11455 - DNA, 20 bp, Artificial Sequence
  chemically synthesized
gtcatcttatttttatgaat

SEQ ID NO: 11456 - DNA, 20 bp, Artificial Sequence
  chemically synthesized
tcatcttatttttatgaatg

SEQ ID NO: 11457 - DNA, 20 bp, Artificial Sequence
  chemically synthesized
tcttatttttatgaatgagg

SEQ ID NO: 11458 - DNA, 20 bp, Artificial Sequence
  chemically synthesized
atttttatgaatgaggaaga

SEQ ID NO: 11459 - DNA, 20 bp, Artificial Sequence
  chemically synthesized
gaatgaggaagatagattca

SEQ ID NO: 11460 - DNA, 20 bp, Artificial Sequence
  chemically synthesized
atgaggaagatagattcata

SEQ ID NO: 11461 - DNA, 20 bp, Artificial Sequence
  chemically synthesized
tgaggaagatagattcatag

SEQ ID NO: 11462 - DNA, 20 bp, Artificial Sequence
  chemically synthesized
aagatagattcatagaggct

SEQ ID NO: 11463 - DNA, 20 bp, Artificial Sequence
  chemically synthesized
agatagattcatagaggcta

SEQ ID NO: 11464 - DNA, 20 bp, Artificial Sequence
  chemically synthesized
gatagattcatagaggctaa

SEQ ID NO: 11465 - DNA, 20 bp, Artificial Sequence
  chemically synthesized
agaggctaagggctttgccc

SEQ ID NO: 11466 - DNA, 20 bp, Artificial Sequence
  chemically synthesized
gaggctaagggctttgccca

SEQ ID NO: 11467 - DNA, 20 bp, Artificial Sequence
  chemically synthesized
aggtaacatactaaaacatt

SEQ ID NO: 11468 - DNA, 20 bp, Artificial Sequence
  chemically synthesized
ggtaacatactaaaacattc

SEQ ID NO: 11469 - DNA, 20 bp, Artificial Sequence
  chemically synthesized
atactaaaacattcaggatt

SEQ ID NO: 11470 - DNA, 20 bp, Artificial Sequence
  chemically synthesized
aacattcaggattcagactc

SEQ ID NO: 11471 - DNA, 20 bp, Artificial Sequence
  chemically synthesized
attcaggattcagactctgg

SEQ ID NO: 11472 - DNA, 20 bp, Artificial Sequence
  chemically synthesized
aggattcagactctggcagt

SEQ ID NO: 11473 - DNA, 20 bp, Artificial Sequence
  chemically synthesized
agactctggcagtcagacta

SEQ ID NO: 11474 - DNA, 20 bp, Artificial Sequence
  chemically synthesized
actctggcagtcagactaaa

SEQ ID NO: 11475 - DNA, 20 bp, Artificial Sequence
  chemically synthesized
tggcagtcagactaaagagc

SEQ ID NO: 11476 - DNA, 20 bp, Artificial Sequence
  chemically synthesized
gactaaagagccagttctct

SEQ ID NO: 11477 - DNA, 20 bp, Artificial Sequence
  chemically synthesized
ttctcttagacattattctg

SEQ ID NO: 11478 - DNA, 20 bp, Artificial Sequence
  chemically synthesized
ccataatcacatcaaacaca

SEQ ID NO: 11479 - DNA, 20 bp, Artificial Sequence
  chemically synthesized
acatcaaacacaaagtcccc

SEQ ID NO: 11480 - DNA, 20 bp, Artificial Sequence
  chemically synthesized
acacaaagtccccaagactc

SEQ ID NO: 11481 - DNA, 20 bp, Artificial Sequence
  chemically synthesized
gccatttccccttccatacc

SEQ ID NO: 11482 - DNA, 20 bp, Artificial Sequence
  chemically synthesized
tttccccttccatacccaga

SEQ ID NO: 11483 - DNA, 20 bp, Artificial Sequence
  chemically synthesized
ccttccatacccagatggtt

SEQ ID NO: 11484 - DNA, 20 bp, Artificial Sequence
  chemically synthesized
ttttttgtactgctactgtt

SEQ ID NO: 11485 - DNA, 20 bp, Artificial Sequence
  chemically synthesized
tttttgtactgctactgttc

SEQ ID NO: 11486 - DNA, 20 bp, Artificial Sequence
  chemically synthesized
tactgctactgttcaggttc

SEQ ID NO: 11487 - DNA, 20 bp, Artificial Sequence
  chemically synthesized
tctagcctttatgtctcccg

SEQ ID NO: 11488 - DNA, 20 bp, Artificial Sequence
  chemically synthesized
tctcccgcagataattgcaa

SEQ ID NO: 11489 - DNA, 20 bp, Artificial Sequence
  chemically synthesized
gcagataattgcaatagtct

SEQ ID NO: 11490 - DNA, 20 bp, Artificial Sequence
  chemically synthesized
cagataattgcaatagtctc

SEQ ID NO: 11491 - DNA, 20 bp, Artificial Sequence
  chemically synthesized
gtctcaggactgctctctcc

SEQ ID NO: 11492 - DNA, 20 bp, Artificial Sequence
  chemically synthesized
ggactgctctctcctagtct

SEQ ID NO: 11493 - DNA, 20 bp, Artificial Sequence
  chemically synthesized
gctctctcctagtcttggta

SEQ ID NO: 11494 - DNA, 20 bp, Artificial Sequence
  chemically synthesized
ctcccccactatcatttcat

SEQ ID NO: 11495 - DNA, 20 bp, Artificial Sequence
  chemically synthesized
tcatttcattagcgtgttgc

SEQ ID NO: 11496 - DNA, 20 bp, Artificial Sequence
  chemically synthesized
tcattagcgtgttgccagac

SEQ ID NO: 11497 - DNA, 20 bp, Artificial Sequence
  chemically synthesized
cattagcgtgttgccagact

SEQ ID NO: 11498 - DNA, 20 bp, Artificial Sequence
  chemically synthesized
ccagactgggcatcctaaat

SEQ ID NO: 11499 - DNA, 20 bp, Artificial Sequence
  chemically synthesized
gggcatcctaaatcagccat

SEQ ID NO: 11500 - DNA, 20 bp, Artificial Sequence
  chemically synthesized
catcctaaatcagccatcag

SEQ ID NO: 11501 - DNA, 20 bp, Artificial Sequence
  chemically synthesized
attttattgtccaatctcct

SEQ ID NO: 11502 - DNA, 20 bp, Artificial Sequence
  chemically synthesized
ttttattgtccaatctcctt

SEQ ID NO: 11503 - DNA, 20 bp, Artificial Sequence
  chemically synthesized
tgacttcattatctgatgac

SEQ ID NO: 11504 - DNA, 20 bp, Artificial Sequence
  chemically synthesized
atctgatgaccagctctgcc

SEQ ID NO: 11505 - DNA, 20 bp, Artificial Sequence
  chemically synthesized
tttacctgtctcacttgtca

SEQ ID NO: 11506 - DNA, 20 bp, Artificial Sequence
  chemically synthesized
ctcacttgtcatagtccata

SEQ ID NO: 11507 - DNA, 20 bp, Artificial Sequence
  chemically synthesized
cctcacgttcttgcaaatct

SEQ ID NO: 11508 - DNA, 20 bp, Artificial Sequence
  chemically synthesized
gcaaatctgagtctttgcac

SEQ ID NO: 11509 - DNA, 20 bp, Artificial Sequence
  chemically synthesized
tgcataaaatgcccttatat

SEQ ID NO: 11510 - DNA, 20 bp, Artificial Sequence
  chemically synthesized
gcccttatatcagacattta

SEQ ID NO: 11511 - DNA, 20 bp, Artificial Sequence
  chemically synthesized
ccttatatcagacatttaaa

SEQ ID NO: 11512 - DNA, 20 bp, Artificial Sequence
  chemically synthesized
ttatatcagacatttaaaga

SEQ ID NO: 11513 - DNA, 20 bp, Artificial Sequence
  chemically synthesized
atatcagacatttaaagaga

SEQ ID NO: 11514 - DNA, 20 bp, Artificial Sequence
  chemically synthesized
agaacgcctactcatctttt

SEQ ID NO: 11515 - DNA, 20 bp, Artificial Sequence
  chemically synthesized
cctactcatcttttaagacc

SEQ ID NO: 11516 - DNA, 20 bp, Artificial Sequence
  chemically synthesized
ttcctttctctatgatccct

SEQ ID NO: 11517 - DNA, 20 bp, Artificial Sequence
  chemically synthesized
ctctatgatcccttagtacc

SEQ ID NO: 11518 - DNA, 20 bp, Artificial Sequence
  chemically synthesized
ttatattgaaacctctcacc

SEQ ID NO: 11519 - DNA, 20 bp, Artificial Sequence
  chemically synthesized
cacctggcctcatgctgctt

SEQ ID NO: 11520 - DNA, 20 bp, Artificial Sequence
  chemically synthesized
cctcatgctgctttagatca

SEQ ID NO: 11521 - DNA, 20 bp, Artificial Sequence
  chemically synthesized
tcatgctgctttagatcaaa

SEQ ID NO: 11522 - DNA, 20 bp, Artificial Sequence
  chemically synthesized
catgctgctttagatcaaag

SEQ ID NO: 11523 - DNA, 20 bp, Artificial Sequence
  chemically synthesized
atgctgctttagatcaaaga

SEQ ID NO: 11524 - DNA, 20 bp, Artificial Sequence
  chemically synthesized
gctgctttagatcaaagagg

SEQ ID NO: 11525 - DNA, 20 bp, Artificial Sequence
  chemically synthesized
tttagatcaaagagggagtc

SEQ ID NO: 11526 - DNA, 20 bp, Artificial Sequence
  chemically synthesized
ctggtttatccccatacccc

SEQ ID NO: 11527 - DNA, 20 bp, Artificial Sequence
  chemically synthesized
atacccctagtaccctgaca

SEQ ID NO: 11528 - DNA, 20 bp, Artificial Sequence
  chemically synthesized
tagtaccctgacacagtacc

SEQ ID NO: 11529 - DNA, 20 bp, Artificial Sequence
  chemically synthesized
tgacacagtacctggcacca

SEQ ID NO: 11530 - DNA, 20 bp, Artificial Sequence
  chemically synthesized
ctggcaccatagttgtaact

SEQ ID NO: 11531 - DNA, 20 bp, Artificial Sequence
  chemically synthesized
aactcagtaatgtctgaatg

SEQ ID NO: 11532 - DNA, 20 bp, Artificial Sequence
  chemically synthesized
actcagtaatgtctgaatga

SEQ ID NO: 11533 - DNA, 20 bp, Artificial Sequence
  chemically synthesized
tacactttacaaaactaaac

SEQ ID NO: 11534 - DNA, 20 bp, Artificial Sequence
  chemically synthesized
acaaaactaaactggtttta

SEQ ID NO: 11535 - DNA, 20 bp, Artificial Sequence
  chemically synthesized
aactgttgcaataataccta

SEQ ID NO: 11536 - DNA, 20 bp, Artificial Sequence
  chemically synthesized
actgttgcaataatacctaa

SEQ ID NO: 11537 - DNA, 20 bp, Artificial Sequence
  chemically synthesized
gttgcaataatacctaaagg

SEQ ID NO: 11538 - DNA, 20 bp, Artificial Sequence
  chemically synthesized
gcaataatacctaaaggcag

SEQ ID NO: 11539 - DNA, 20 bp, Artificial Sequence
  chemically synthesized
gccatgaaaatgcaacatct

SEQ ID NO: 11540 - DNA, 20 bp, Artificial Sequence
  chemically synthesized
tcactcaccgaaactccttt

SEQ ID NO: 11541 - DNA, 20 bp, Artificial Sequence
  chemically synthesized
ctcaccgaaactccttttag

SEQ ID NO: 11542 - DNA, 20 bp, Artificial Sequence
  chemically synthesized
aactccttttagaagccaat

SEQ ID NO: 11543 - DNA, 20 bp, Artificial Sequence
  chemically synthesized
ctccttttagaagccaatga

SEQ ID NO: 11544 - DNA, 20 bp, Artificial Sequence
  chemically synthesized
agaagccaatgagagtttaa

SEQ ID NO: 11545 - DNA, 20 bp, Artificial Sequence
  chemically synthesized
agccaatgagagtttaatag

SEQ ID NO: 11546 - DNA, 20 bp, Artificial Sequence
  chemically synthesized
caatgagagtttaatagcag

SEQ ID NO: 11547 - DNA, 20 bp, Artificial Sequence
  chemically synthesized
atgagagtttaatagcagaa

SEQ ID NO: 11548 - DNA, 20 bp, Artificial Sequence
  chemically synthesized
gagagtttaatagcagaaga

SEQ ID NO: 11549 - DNA, 20 bp, Artificial Sequence
  chemically synthesized
gcattaatactgtctatcct

SEQ ID NO: 11550 - DNA, 20 bp, Artificial Sequence
  chemically synthesized
tatccttagaaaaattcccc

SEQ ID NO: 11551 - DNA, 20 bp, Artificial Sequence
  chemically synthesized
attcccctggccccttcctc

SEQ ID NO: 11552 - DNA, 20 bp, Artificial Sequence
  chemically synthesized
ttcccctggccccttcctca

SEQ ID NO: 11553 - DNA, 20 bp, Artificial Sequence
  chemically synthesized
tcccctggccccttcctcaa

SEQ ID NO: 11554 - DNA, 20 bp, Artificial Sequence
  chemically synthesized
cctcaagggcttattatctc

SEQ ID NO: 11555 - DNA, 20 bp, Artificial Sequence
  chemically synthesized
cttattatctctggctacaa

SEQ ID NO: 11556 - DNA, 20 bp, Artificial Sequence
  chemically synthesized
atctctggctacaatggctg

SEQ ID NO: 11557 - DNA, 20 bp, Artificial Sequence
  chemically synthesized
aatcacattgcctttctcct

SEQ ID NO: 11558 - DNA, 20 bp, Artificial Sequence
  chemically synthesized
cctttctccttagtattatc

SEQ ID NO: 11559 - DNA, 20 bp, Artificial Sequence
  chemically synthesized
ctttctccttagtattatct

SEQ ID NO: 11560 - DNA, 20 bp, Artificial Sequence
  chemically synthesized
tttctccttagtattatctg

SEQ ID NO: 11561 - DNA, 20 bp, Artificial Sequence
  chemically synthesized
tcgtatacttaacttccctt

SEQ ID NO: 11562 - DNA, 20 bp, Artificial Sequence
  chemically synthesized
cgtatacttaacttcccttc

SEQ ID NO: 11563 - DNA, 20 bp, Artificial Sequence
  chemically synthesized
cttcccttcaggtttatcgc

SEQ ID NO: 11564 - DNA, 20 bp, Artificial Sequence
  chemically synthesized
tatcgctagtcattatttcc

SEQ ID NO: 11565 - DNA, 20 bp, Artificial Sequence
  chemically synthesized
atcgctagtcattatttccc

SEQ ID NO: 11566 - DNA, 20 bp, Artificial Sequence
  chemically synthesized
cattatttcccaggctccaa

SEQ ID NO: 11567 - DNA, 20 bp, Artificial Sequence
  chemically synthesized
tttcccaggctccaaaagcc

SEQ ID NO: 11568 - DNA, 20 bp, Artificial Sequence
  chemically synthesized
attcttatctatcctttccc

SEQ ID NO: 11569 - DNA, 20 bp, Artificial Sequence
  chemically synthesized
tatcctttccccagcatctg

SEQ ID NO: 11570 - DNA, 20 bp, Artificial Sequence
  chemically synthesized
ccccagcatctgaagtcttc

SEQ ID NO: 11571 - DNA, 20 bp, Artificial Sequence
  chemically synthesized
cccagcatctgaagtcttca

SEQ ID NO: 11572 - DNA, 20 bp, Artificial Sequence
  chemically synthesized
ccagcatctgaagtcttcaa

SEQ ID NO: 11573 - DNA, 20 bp, Artificial Sequence
  chemically synthesized
cagcatctgaagtcttcaag

SEQ ID NO: 11574 - DNA, 20 bp, Artificial Sequence
  chemically synthesized
agcatctgaagtcttcaagg

SEQ ID NO: 11575 - DNA, 20 bp, Artificial Sequence
  chemically synthesized
atctgaagtcttcaaggggg

SEQ ID NO: 11576 - DNA, 20 bp, Artificial Sequence
  chemically synthesized
tgaagtcttcaagggggcag

SEQ ID NO: 11577 - DNA, 20 bp, Artificial Sequence
  chemically synthesized
tcatcatctcaccacttata

SEQ ID NO: 11578 - DNA, 20 bp, Artificial Sequence
  chemically synthesized
tcatctcaccacttatatag

SEQ ID NO: 11579 - DNA, 20 bp, Artificial Sequence
  chemically synthesized
ctcaccacttatatagaaga

SEQ ID NO: 11580 - DNA, 20 bp, Artificial Sequence
  chemically synthesized
tcaccacttatatagaagaa

SEQ ID NO: 11581 - DNA, 20 bp, Artificial Sequence
  chemically synthesized
caccacttatatagaagaaa

SEQ ID NO: 11582 - DNA, 20 bp, Artificial Sequence
  chemically synthesized
cttatatagaagaaagggtt

SEQ ID NO: 11583 - DNA, 20 bp, Artificial Sequence
  chemically synthesized
gtttggatgctttgtcctcc

SEQ ID NO: 11584 - DNA, 20 bp, Artificial Sequence
  chemically synthesized
ctcccagatgtcacactaat

SEQ ID NO: 11585 - DNA, 20 bp, Artificial Sequence
  chemically synthesized
cactaatgagatatatctaa

SEQ ID NO: 11586 - DNA, 20 bp, Artificial Sequence
  chemically synthesized
tgctttatgtcctgctttgt

SEQ ID NO: 11587 - DNA, 20 bp, Artificial Sequence
  chemically synthesized
cttgactttactcactttgc

SEQ ID NO: 11588 - DNA, 20 bp, Artificial Sequence
  chemically synthesized
atttttttttatcgttattt

SEQ ID NO: 11589 - DNA, 20 bp, Artificial Sequence
  chemically synthesized
ttatcgttatttcagcattt

SEQ ID NO: 11590 - DNA, 20 bp, Artificial Sequence
  chemically synthesized
agcatttcagtctgatttca

SEQ ID NO: 11591 - DNA, 20 bp, Artificial Sequence
  chemically synthesized
ttcacagctgacatcatgtc

SEQ ID NO: 11592 - DNA, 20 bp, Artificial Sequence
  chemically synthesized
cacagctgacatcatgtctg

SEQ ID NO: 11593 - DNA, 20 bp, Artificial Sequence
  chemically synthesized
agctgacatcatgtctggag

SEQ ID NO: 11594 - DNA, 20 bp, Artificial Sequence
  chemically synthesized
gctgacatcatgtctggagt

SEQ ID NO: 11595 - DNA, 20 bp, Artificial Sequence
  chemically synthesized
catgtctggagtgggaacca

SEQ ID NO: 11596 - DNA, 20 bp, Artificial Sequence
  chemically synthesized
atgtctggagtgggaaccac

SEQ ID NO: 11597 - DNA, 20 bp, Artificial Sequence
  chemically synthesized
tgtctggagtgggaaccaca

SEQ ID NO: 11598 - DNA, 20 bp, Artificial Sequence
  chemically synthesized
tggagtgggaaccacagggc

SEQ ID NO: 11599 - DNA, 20 bp, Artificial Sequence
  chemically synthesized
gtgggaaccacagggccagt

SEQ ID NO: 11600 - DNA, 20 bp, Artificial Sequence
  chemically synthesized
cacagggccagtcagctttc

SEQ ID NO: 11601 - DNA, 20 bp, Artificial Sequence
  chemically synthesized
acagggccagtcagctttct

SEQ ID NO: 11602 - DNA, 20 bp, Artificial Sequence
  chemically synthesized
cagggccagtcagctttctg

SEQ ID NO: 11603 - DNA, 20 bp, Artificial Sequence
  chemically synthesized
agggccagtcagctttctgg

SEQ ID NO: 11604 - DNA, 20 bp, Artificial Sequence
  chemically synthesized
gtcagctttctgggggtgct

SEQ ID NO: 11605 - DNA, 20 bp, Artificial Sequence
  chemically synthesized
tcagctttctgggggtgctt

SEQ ID NO: 11606 - DNA, 20 bp, Artificial Sequence
  chemically synthesized
cagctttctgggggtgctta

SEQ ID NO: 11607 - DNA, 20 bp, Artificial Sequence
  chemically synthesized
tttctgggggtgcttagggt

SEQ ID NO: 11608 - DNA, 20 bp, Artificial Sequence
  chemically synthesized
agggttggcacccctgatcc

SEQ ID NO: 11609 - DNA, 20 bp, Artificial Sequence
  chemically synthesized
acccctgatcctggtactgt

SEQ ID NO: 11610 - DNA, 20 bp, Artificial Sequence
  chemically synthesized
atcctggtactgtcagctac

SEQ ID NO: 11611 - DNA, 20 bp, Artificial Sequence
  chemically synthesized
tcagctactagatttgattc

SEQ ID NO: 11612 - DNA, 20 bp, Artificial Sequence
  chemically synthesized
ctactagatttgattctaga

SEQ ID NO: 11613 - DNA, 20 bp, Artificial Sequence
  chemically synthesized
tttgattctagaaagttgac

SEQ ID NO: 11614 - DNA, 20 bp, Artificial Sequence
  chemically synthesized
attctagaaagttgacaagt

SEQ ID NO: 11615 - DNA, 20 bp, Artificial Sequence
  chemically synthesized
gtgtgataaatgcttcctgt

SEQ ID NO: 11616 - DNA, 20 bp, Artificial Sequence
  chemically synthesized
gaacatgctgtttgtccaaa

SEQ ID NO: 11617 - DNA, 20 bp, Artificial Sequence
  chemically synthesized
aacatgctgtttgtccaaat

SEQ ID NO: 11618 - DNA, 20 bp, Artificial Sequence
  chemically synthesized
cttccctgtatgccttcctc

SEQ ID NO: 11619 - DNA, 20 bp, Artificial Sequence
  chemically synthesized
ttccctgtatgccttcctct

SEQ ID NO: 11620 - DNA, 20 bp, Artificial Sequence
  chemically synthesized
cttcctctgggaaatacata

SEQ ID NO: 11621 - DNA, 20 bp, Artificial Sequence
  chemically synthesized
ggaaatacataaagtcactg

SEQ ID NO: 11622 - DNA, 20 bp, Artificial Sequence
  chemically synthesized
actgtagttgtgaaaaaaca

SEQ ID NO: 11623 - DNA, 20 bp, Artificial Sequence
  chemically synthesized
caaagtgatatatgttgcat

SEQ ID NO: 11624 - DNA, 20 bp, Artificial Sequence
  chemically synthesized
tactctttatgtcaattctt

SEQ ID NO: 11625 - DNA, 20 bp, Artificial Sequence
  chemically synthesized
ttaagcttgcttttctcccc

SEQ ID NO: 11626 - DNA, 20 bp, Artificial Sequence
  chemically synthesized
taagcttgcttttctcccct

SEQ ID NO: 11627 - DNA, 20 bp, Artificial Sequence
  chemically synthesized
aagcttgcttttctccccta

SEQ ID NO: 11628 - DNA, 20 bp, Artificial Sequence
  chemically synthesized
ctcccctagggaactcaact

SEQ ID NO: 11629 - DNA, 20 bp, Artificial Sequence
  chemically synthesized
tttccccaaatatcaactcc

SEQ ID NO: 11630 - DNA, 20 bp, Artificial Sequence
  chemically synthesized
caactccaagatgtttgaca

SEQ ID NO: 11631 - DNA, 20 bp, Artificial Sequence
  chemically synthesized
actccaagatgtttgacata

SEQ ID NO: 11632 - DNA, 20 bp, Artificial Sequence
  chemically synthesized
attttttcctaatccatgaa

SEQ ID NO: 11633 - DNA, 20 bp, Artificial Sequence
  chemically synthesized
tcctaatccatgaaaagctt

SEQ ID NO: 11634 - DNA, 20 bp, Artificial Sequence
  chemically synthesized
aaagctttggtgataactaa

SEQ ID NO: 11635 - DNA, 20 bp, Artificial Sequence
  chemically synthesized
aactaacagcttgctaatga

SEQ ID NO: 11636 - DNA, 20 bp, Artificial Sequence
  chemically synthesized
actaacagcttgctaatgaa

SEQ ID NO: 11637 - DNA, 20 bp, Artificial Sequence
  chemically synthesized
ttaactaaaactttaaattg

SEQ ID NO: 11638 - DNA, 20 bp, Artificial Sequence
  chemically synthesized
agatatataatttaaaaaat

SEQ ID NO: 11639 - DNA, 20 bp, Artificial Sequence
  chemically synthesized
atatataatttaaaaaatta

SEQ ID NO: 11640 - DNA, 20 bp, Artificial Sequence
  chemically synthesized
aatgtcatatatcttaaaat

SEQ ID NO: 11641 - DNA, 20 bp, Artificial Sequence
  chemically synthesized
atcagactttttgtgtaaat

SEQ ID NO: 11642 - DNA, 20 bp, Artificial Sequence
  chemically synthesized
tcagactttttgtgtaaata

SEQ ID NO: 11643 - DNA, 20 bp, Artificial Sequence
  chemically synthesized
tgtttcccattttgatttca

SEQ ID NO: 11644 - DNA, 20 bp, Artificial Sequence
  chemically synthesized
ttcccattttgatttcaaag

SEQ ID NO: 11645 - DNA, 20 bp, Artificial Sequence
  chemically synthesized
cattttgatttcaaagtggt

SEQ ID NO: 11646 - DNA, 20 bp, Artificial Sequence
  chemically synthesized
aagtccaaacaaaaataatg

SEQ ID NO: 11647 - DNA, 20 bp, Artificial Sequence
  chemically synthesized
acttttaatttttttaaacc

SEQ ID NO: 11648 - DNA, 20 bp, Artificial Sequence
  chemically synthesized
cttttaatttttttaaacca

SEQ ID NO: 11649 - DNA, 20 bp, Artificial Sequence
  chemically synthesized
tttaatttttttaaaccaag

SEQ ID NO: 11650 - DNA, 20 bp, Artificial Sequence
  chemically synthesized
aggagatgaatgttttctaa

SEQ ID NO: 11651 - DNA, 20 bp, Artificial Sequence
  chemically synthesized
ggagatgaatgttttctaac

SEQ ID NO: 11652 - DNA, 20 bp, Artificial Sequence
  chemically synthesized
tgaccaaatcatgaactgaa

SEQ ID NO: 11653 - DNA, 20 bp, Artificial Sequence
  chemically synthesized
attaaacataaatgcatcat

SEQ ID NO: 11654 - DNA, 20 bp, Artificial Sequence
  chemically synthesized
ataagcattgtcgatctatt

SEQ ID NO: 11655 - DNA, 20 bp, Artificial Sequence
  chemically synthesized
tctatttagttttaaaaatg

SEQ ID NO: 11656 - DNA, 20 bp, Artificial Sequence
  chemically synthesized
atttagttttaaaaatgaag

SEQ ID NO: 11657 - DNA, 20 bp, Artificial Sequence
  chemically synthesized
tagttttaaaaatgaagaag

SEQ ID NO: 11658 - DNA, 20 bp, Artificial Sequence
  chemically synthesized
aaatgaagaagaagaaaacc

SEQ ID NO: 11659 - DNA, 20 bp, Artificial Sequence
  chemically synthesized
agaagaaaacctagctaaca

SEQ ID NO: 11660 - DNA, 20 bp, Artificial Sequence
  chemically synthesized
aaacctagctaacaaagaac

SEQ ID NO: 11661 - DNA, 20 bp, Artificial Sequence
  chemically synthesized
gtacttaccaacctgcgtgc

SEQ ID NO: 11662 - DNA, 20 bp, Artificial Sequence
  chemically synthesized
ccaacctgcgtgctggctgt

SEQ ID NO: 11663 - DNA, 20 bp, Artificial Sequence
  chemically synthesized
caaatcatgtaatcaaaatt

SEQ ID NO: 11664 - DNA, 20 bp, Artificial Sequence
  chemically synthesized
catgtaatcaaaatttagtg

SEQ ID NO: 11665 - DNA, 20 bp, Artificial Sequence
  chemically synthesized
gtaatcaaaatttagtgaag

SEQ ID NO: 11666 - DNA, 20 bp, Artificial Sequence
  chemically synthesized
tcaaaatttagtgaagaaga

SEQ ID NO: 11667 - DNA, 20 bp, Artificial Sequence
  chemically synthesized
tttagtgaagaagacagcat

SEQ ID NO: 11668 - DNA, 20 bp, Artificial Sequence
  chemically synthesized
tcagatatttctatatctaa

SEQ ID NO: 11669 - DNA, 20 bp, Artificial Sequence
  chemically synthesized
cagatatttctatatctaaa

SEQ ID NO: 11670 - DNA, 20 bp, Artificial Sequence
  chemically synthesized
tatttctatatctaaaaggc

SEQ ID NO: 11671 - DNA, 20 bp, Artificial Sequence
  chemically synthesized
atactcaatgtattttaaaa

SEQ ID NO: 11672 - DNA, 20 bp, Artificial Sequence
  chemically synthesized
tactcaatgtattttaaaaa

SEQ ID NO: 11673 - DNA, 20 bp, Artificial Sequence
  chemically synthesized
aggaaacaaacctgtacatt

SEQ ID NO: 11674 - DNA, 20 bp, Artificial Sequence
  chemically synthesized
aaacctgtacattcagcact

SEQ ID NO: 11675 - DNA, 20 bp, Artificial Sequence
  chemically synthesized
cctgtacattcagcactgag

SEQ ID NO: 11676 - DNA, 20 bp, Artificial Sequence
  chemically synthesized
gcactgagtagatatcctaa

SEQ ID NO: 11677 - DNA, 20 bp, Artificial Sequence
  chemically synthesized
cactgagtagatatcctaaa

SEQ ID NO: 11678 - DNA, 20 bp, Artificial Sequence
  chemically synthesized
tgagtagatatcctaaaagg

SEQ ID NO: 11679 - DNA, 20 bp, Artificial Sequence
  chemically synthesized
tagatatcctaaaaggcaga

SEQ ID NO: 11680 - DNA, 20 bp, Artificial Sequence
  chemically synthesized
cctaaaaggcagatggtgat

SEQ ID NO: 11681 - DNA, 20 bp, Artificial Sequence
  chemically synthesized
ctaaaaggcagatggtgatg

SEQ ID NO: 11682 - DNA, 20 bp, Artificial Sequence
  chemically synthesized
aggcagatggtgatgaggcc

SEQ ID NO: 11683 - DNA, 20 bp, Artificial Sequence
  chemically synthesized
acgcgctgcataacctttgc

SEQ ID NO: 11684 - DNA, 20 bp, Artificial Sequence
  chemically synthesized
cgctgcataacctttgctag

SEQ ID NO: 11685 - DNA, 20 bp, Artificial Sequence
  chemically synthesized
cctttgctagcagattgtga

SEQ ID NO: 11686 - DNA, 20 bp, Artificial Sequence
  chemically synthesized
ttgctagcagattgtgaaag

SEQ ID NO: 11687 - DNA, 20 bp, Artificial Sequence
  chemically synthesized
gcgcgtgaacatgatcatgg

SEQ ID NO: 11688 - DNA, 20 bp, Artificial Sequence
  chemically synthesized
cctcatcaccatctgccttt

SEQ ID NO: 11689 - DNA, 20 bp, Artificial Sequence
  chemically synthesized
tttaggatatctactcagtg

SEQ ID NO: 11690 - DNA, 20 bp, Artificial Sequence
  chemically synthesized
gtttccttttttaaaataca

SEQ ID NO: 11691 - DNA, 20 bp, Artificial Sequence
  chemically synthesized
atgatttgacagcaatattg

SEQ ID NO: 11692 - DNA, 20 bp, Artificial Sequence
  chemically synthesized
gtgggaaaacaaagaaatag

SEQ ID NO: 11693 - DNA, 20 bp, Artificial Sequence
  chemically synthesized
agttatcaccaaagcttttc

SEQ ID NO: 11694 - DNA, 20 bp, Artificial Sequence
  chemically synthesized
tgtctctatgtcaaacatct

SEQ ID NO: 11695 - DNA, 20 bp, Artificial Sequence
  chemically synthesized
tggggaaacacaatactcag

SEQ ID NO: 11696 - DNA, 20 bp, Artificial Sequence
  chemically synthesized
taggggagaaaagcaagctt

SEQ ID NO: 11697 - DNA, 20 bp, Artificial Sequence
  chemically synthesized
caagcttaagaattgacata

SEQ ID NO: 11698 - DNA, 20 bp, Artificial Sequence
  chemically synthesized
acacttacttgtcaactttc

SEQ ID NO: 11699 - DNA, 20 bp, Artificial Sequence
  chemically synthesized
aatctagtagctgacagtac

SEQ ID NO: 11700 - DNA, 20 bp, Artificial Sequence
  chemically synthesized
tagctgacagtaccaggatc

SEQ ID NO: 11701 - DNA, 20 bp, Artificial Sequence
  chemically synthesized
acagaggttaaactagcaaa

SEQ ID NO: 11702 - DNA, 20 bp, Artificial Sequence
  chemically synthesized
tagcaaagtgagtaaagtca

SEQ ID NO: 11703 - DNA, 20 bp, Artificial Sequence
  chemically synthesized
aagacttcagatgctgggga

SEQ ID NO: 11704 - DNA, 20 bp, Artificial Sequence
  chemically synthesized
atgctggggaaaggatagat

SEQ ID NO: 11705 - DNA, 20 bp, Artificial Sequence
  chemically synthesized
gggaaaggatagataagaat

SEQ ID NO: 11706 - DNA, 20 bp, Artificial Sequence
  chemically synthesized
gcccttgaggaaggggccag

SEQ ID NO: 11707 - DNA, 20 bp, Artificial Sequence
  chemically synthesized
ggggccaggggaatttttct

SEQ ID NO: 11708 - DNA, 20 bp, Artificial Sequence
  chemically synthesized
aactctcattggcttctaaa

SEQ ID NO: 11709 - DNA, 20 bp, Artificial Sequence
  chemically synthesized
ggcttctaaaaggagtttcg

SEQ ID NO: 11710 - DNA, 20 bp, Artificial Sequence
  chemically synthesized
taggtattattgcaacagtt

SEQ ID NO: 11711 - DNA, 20 bp, Artificial Sequence
  chemically synthesized
tgtccttcattcagacatta

SEQ ID NO: 11712 - DNA, 20 bp, Artificial Sequence
  chemically synthesized
tatggtgccaggtactgtgt

SEQ ID NO: 11713 - DNA, 20 bp, Artificial Sequence
  chemically synthesized
aggtactgtgtcagggtact

SEQ ID NO: 11714 - DNA, 20 bp, Artificial Sequence
  chemically synthesized
tgtcagggtactaggggtat

SEQ ID NO: 11715 - DNA, 20 bp, Artificial Sequence
  chemically synthesized
aaaatgtgcactaggtacta

SEQ ID NO: 11716 - DNA, 20 bp, Artificial Sequence
  chemically synthesized
ggggaaacaattgatagaga

SEQ ID NO: 11717 - DNA, 20 bp, Artificial Sequence
  chemically synthesized
tagagagagaatattttcat

SEQ ID NO: 11718 - DNA, 20 bp, Artificial Sequence
  chemically synthesized
tttcatctgggtcttaaaag

SEQ ID NO: 11719 - DNA, 20 bp, Artificial Sequence
  chemically synthesized
ataagggcattttatgcaaa

SEQ ID NO: 11720 - DNA, 20 bp, Artificial Sequence
  chemically synthesized
gcaagaacgtgaggtatttc

SEQ ID NO: 11721 - DNA, 20 bp, Artificial Sequence
  chemically synthesized
ggtatcgaagtataaacata

SEQ ID NO: 11722 - DNA, 20 bp, Artificial Sequence
  chemically synthesized
agtaccactgatggctgatt

SEQ ID NO: 11723 - DNA, 20 bp, Artificial Sequence
  chemically synthesized
gtagcagtacaaaaaaagag

SEQ ID NO: 11724 - DNA, 20 bp, Artificial Sequence
  chemically synthesized
aagtggtatgacttaaccat

SEQ ID NO: 11725 - DNA, 20 bp, Artificial Sequence
  chemically synthesized
ggtatggaaggggaaatggc

SEQ ID NO: 11726 - DNA, 20 bp, Artificial Sequence
  chemically synthesized
tttgatgtgattatggacca

SEQ ID NO: 11727 - DNA, 20 bp, Artificial Sequence
  chemically synthesized
tggctctttagtctgactgc

SEQ ID NO: 11728 - DNA, 20 bp, Artificial Sequence
  chemically synthesized
tttagtctgactgccagagt

SEQ ID NO: 11729 - DNA, 20 bp, Artificial Sequence
  chemically synthesized
tgactgccagagtctgaatc

SEQ ID NO: 11730 - DNA, 20 bp, Artificial Sequence
  chemically synthesized
gggcaaagcccttagcctct

SEQ ID NO: 11731 - DNA, 20 bp, Artificial Sequence
  chemically synthesized
ctatctcgtgggacttttgt

SEQ ID NO: 11732 - DNA, 20 bp, Artificial Sequence
  chemically synthesized
tgtgaggatgaagtgagata

SEQ ID NO: 11733 - DNA, 20 bp, Artificial Sequence
  chemically synthesized
tacattatgatatacagtta

SEQ ID NO: 11734 - DNA, 20 bp, Artificial Sequence
  chemically synthesized
ggagacgtatctgactatag

SEQ ID NO: 11735 - DNA, 20 bp, Artificial Sequence
  chemically synthesized
gccacgtgtgtgggcatctg

SEQ ID NO: 11736 - DNA, 20 bp, Artificial Sequence
  chemically synthesized
tgggcatctggagagtgagc

SEQ ID NO: 11737 - DNA, 20 bp, Artificial Sequence
  chemically synthesized
tgctcagtaaattttgttga

SEQ ID NO: 11738 - DNA, 20 bp, Artificial Sequence
  chemically synthesized
taagggccatggagaggaac

SEQ ID NO: 11739 - DNA, 20 bp, Artificial Sequence
  chemically synthesized
ggagttaatcaattcaagtg

SEQ ID NO: 11740 - DNA, 20 bp, Artificial Sequence
  chemically synthesized
ttaatcaattcaagtgctgg

SEQ ID NO: 11741 - DNA, 20 bp, Artificial Sequence
  chemically synthesized
tcaagtgctggatggataac

SEQ ID NO: 11742 - DNA, 20 bp, Artificial Sequence
  chemically synthesized
gttagagcaaagcggggaac

SEQ ID NO: 11743 - DNA, 20 bp, Artificial Sequence
  chemically synthesized
agcaaagcggggaaccagaa

SEQ ID NO: 11744 - DNA, 20 bp, Artificial Sequence
  chemically synthesized
aatagagtgattattataaa

SEQ ID NO: 11745 - DNA, 20 bp, Artificial Sequence
  chemically synthesized
gaagttattaaagagctaaa

SEQ ID NO: 11746 - DNA, 20 bp, Artificial Sequence
  chemically synthesized
gaaagtagggccaacatgaa

SEQ ID NO: 11747 - DNA, 20 bp, Artificial Sequence
  chemically synthesized
ctgtacagtcagctctcctt

SEQ ID NO: 11748 - DNA, 20 bp, Artificial Sequence
  chemically synthesized
caaaaatattcaagaaaaaa

SEQ ID NO: 11749 - DNA, 20 bp, Artificial Sequence
  chemically synthesized
agatgatttaaagtacaaag

SEQ ID NO: 11750 - DNA, 20 bp, Artificial Sequence
  chemically synthesized
cacagatcttgatatttgca

SEQ ID NO: 11751 - DNA, 20 bp, Artificial Sequence
  chemically synthesized
ggtcttgccaccaattttcc

SEQ ID NO: 11752 - DNA, 20 bp, Artificial Sequence
  chemically synthesized
atactgaggaacgactgtaa

SEQ ID NO: 11753 - DNA, 20 bp, Artificial Sequence
  chemically synthesized
gactgtaaatggatgcaggc

SEQ ID NO: 11754 - DNA, 20 bp, Artificial Sequence
  chemically synthesized
tgcaggcatggatgctattt

SEQ ID NO: 11755 - DNA, 20 bp, Artificial Sequence
  chemically synthesized
gagtgtccagggccaagtaa

SEQ ID NO: 11756 - DNA, 20 bp, Artificial Sequence
  chemically synthesized
atgagttgctgagcagagag

SEQ ID NO: 11757 - DNA, 20 bp, Artificial Sequence
  chemically synthesized
cctcggctgtctgggaagag

SEQ ID NO: 11758 - DNA, 20 bp, Artificial Sequence
  chemically synthesized
ggctgctccaatttaggggc

SEQ ID NO: 11759 - DNA, 20 bp, Artificial Sequence
  chemically synthesized
caatttaggggctaggattg

SEQ ID NO: 11760 - DNA, 20 bp, Artificial Sequence
  chemically synthesized
gggtgggcacagcattgcaa

SEQ ID NO: 11761 - DNA, 20 bp, Artificial Sequence
  chemically synthesized
attgagaaatatggccaatg

SEQ ID NO: 11762 - DNA, 20 bp, Artificial Sequence
  chemically synthesized
caggcagatcacttgaggtc

SEQ ID NO: 11763 - DNA, 20 bp, Artificial Sequence
  chemically synthesized
aaaattagctgggcatggtg

SEQ ID NO: 11764 - DNA, 20 bp, Artificial Sequence
  chemically synthesized
tacttgggaggctgaggcag

SEQ ID NO: 11765 - DNA, 20 bp, Artificial Sequence
  chemically synthesized
caagactctgtcaaaaaaaa

SEQ ID NO: 11766 - DNA, 20 bp, Artificial Sequence
  chemically synthesized
ttgcagagcaagggaaaagc

SEQ ID NO: 11767 - DNA, 20 bp, Artificial Sequence
  chemically synthesized
ctttcctttctcttcctttt

SEQ ID NO: 11768 - DNA, 20 bp, Artificial Sequence
  chemically synthesized
gaacaactccaggcaacttc

SEQ ID NO: 11769 - DNA, 20 bp, Artificial Sequence
  chemically synthesized
gccatgcattccttaacaat

SEQ ID NO: 11770 - DNA, 20 bp, Artificial Sequence
  chemically synthesized
tcatcattgtgcgaacataa

SEQ ID NO: 11771 - DNA, 20 bp, Artificial Sequence
  chemically synthesized
agatagagacatctatcctc

SEQ ID NO: 11772 - DNA, 20 bp, Artificial Sequence
  chemically synthesized
acatctatcctccagagttc

SEQ ID NO: 11773 - DNA, 20 bp, Artificial Sequence
  chemically synthesized
tagcttaaaaaaaacatatc

SEQ ID NO: 11774 - DNA, 20 bp, Artificial Sequence
  chemically synthesized
taacatctagtgacagacac

SEQ ID NO: 11775 - DNA, 20 bp, Artificial Sequence
  chemically synthesized
tattctgaaaacagcccagc

SEQ ID NO: 11776 - DNA, 20 bp, Artificial Sequence
  chemically synthesized
aaaacagcccagccagggtg

SEQ ID NO: 11777 - DNA, 20 bp, Artificial Sequence
  chemically synthesized
gaaatctgaccttttattac

SEQ ID NO: 11778 - DNA, 20 bp, Artificial Sequence
  chemically synthesized
tctcttgactaaaagtaaaa

SEQ ID NO: 11779 - DNA, 20 bp, Artificial Sequence
  chemically synthesized
gaaattggctttcagattat

SEQ ID NO: 11780 - DNA, 20 bp, Artificial Sequence
  chemically synthesized
tttcttttttgctaaaacta

SEQ ID NO: 11781 - DNA, 20 bp, Artificial Sequence
  chemically synthesized
atgaaaacgccaacaaaatt

SEQ ID NO: 11782 - DNA, 20 bp, Artificial Sequence
  chemically synthesized
gtataattcaggtaaattgg

SEQ ID NO: 11783 - DNA, 20 bp, Artificial Sequence
  chemically synthesized
tgttcaagggaaccttgaga

SEQ ID NO: 11784 - DNA, 20 bp, Artificial Sequence
  chemically synthesized
aacaaactcttccaatttac

SEQ ID NO: 11785 - DNA, 20 bp, Artificial Sequence
  chemically synthesized
ttatacctctttggccgatt

SEQ ID NO: 11786 - DNA, 20 bp, Artificial Sequence
  chemically synthesized
caagaaaaactgaaatgtaa

SEQ ID NO: 11787 - DNA, 20 bp, Artificial Sequence
  chemically synthesized
ctgtatacacatggagattt

SEQ ID NO: 11788 - DNA, 20 bp, Artificial Sequence
  chemically synthesized
tcaattttacttttagtcaa

SEQ ID NO: 11789 - DNA, 20 bp, Artificial Sequence
  chemically synthesized
ggtcagatttctaatcatat

SEQ ID NO: 11790 - DNA, 20 bp, Artificial Sequence
  chemically synthesized
taatcatatttgaatttact

SEQ ID NO: 11791 - DNA, 20 bp, Artificial Sequence
  chemically synthesized
tcacttgaaaatagctcatt

SEQ ID NO: 11792 - DNA, 20 bp, Artificial Sequence
  chemically synthesized
caccctggctgggctgtttt

SEQ ID NO: 11793 - DNA, 20 bp, Artificial Sequence
  chemically synthesized
ctttggttggcaagtgttat

SEQ ID NO: 11794 - DNA, 20 bp, Artificial Sequence
  chemically synthesized
cagtgatttaagcatctctc

SEQ ID NO: 11795 - DNA, 20 bp, Artificial Sequence
  chemically synthesized
ttaagcatctctctagaatt

SEQ ID NO: 11796 - DNA, 20 bp, Artificial Sequence
  chemically synthesized
agagacactcctgaactctg

SEQ ID NO: 11797 - DNA, 20 bp, Artificial Sequence
  chemically synthesized
tggaggatagatgtctctat

SEQ ID NO: 11798 - DNA, 20 bp, Artificial Sequence
  chemically synthesized
ttgcttaatgacacatttct

SEQ ID NO: 11799 - DNA, 20 bp, Artificial Sequence
  chemically synthesized
agaatatatccccattgtta

SEQ ID NO: 11800 - DNA, 20 bp, Artificial Sequence
  chemically synthesized
cagggactcaagaagttgcc

SEQ ID NO: 11801 - DNA, 20 bp, Artificial Sequence
  chemically synthesized
ctggagttgttcctttcttc

SEQ ID NO: 11802 - DNA, 20 bp, Artificial Sequence
  chemically synthesized
ggcttataagatgaactttc

SEQ ID NO: 11803 - DNA, 20 bp, Artificial Sequence
  chemically synthesized
cattgcagctgttcacttta

SEQ ID NO: 11804 - DNA, 20 bp, Artificial Sequence
  chemically synthesized
tttgggctcactttttttct

SEQ ID NO: 11805 - DNA, 20 bp, Artificial Sequence
  chemically synthesized
ttcaactcttttttttttga

SEQ ID NO: 11806 - DNA, 20 bp, Artificial Sequence
  chemically synthesized
tcttgctctgtcgcccaggc

SEQ ID NO: 11807 - DNA, 20 bp, Artificial Sequence
  chemically synthesized
gcctcagcctcccaagtagc

SEQ ID NO: 11808 - DNA, 20 bp, Artificial Sequence
  chemically synthesized
ttttgtatttttagtaaagc

SEQ ID NO: 11809 - DNA, 20 bp, Artificial Sequence
  chemically synthesized
gcctgggcctctgaaagtgc

SEQ ID NO: 11810 - DNA, 20 bp, Artificial Sequence
  chemically synthesized
aaaaaatcaccaaaatgcag

SEQ ID NO: 11811 - DNA, 20 bp, Artificial Sequence
  chemically synthesized
ccctgcaaatatcaagatct

SEQ ID NO: 11812 - DNA, 20 bp, Artificial Sequence
  chemically synthesized
ttgttatgctgtattgttta

SEQ ID NO: 11813 - DNA, 20 bp, Artificial Sequence
  chemically synthesized
tagggaataatgaaagataa

SEQ ID NO: 11814 - DNA, 20 bp, Artificial Sequence
  chemically synthesized
tgcaaccatccatttttttc

SEQ ID NO: 11815 - DNA, 20 bp, Artificial Sequence
  chemically synthesized
tatttttgatctgcagttaa

SEQ ID NO: 11816 - DNA, 20 bp, Artificial Sequence
  chemically synthesized
gagctgactgtacagtgtgg

SEQ ID NO: 11817 - DNA, 20 bp, Artificial Sequence
  chemically synthesized
ttgagtgaaaaaacagactt

SEQ ID NO: 11818 - DNA, 20 bp, Artificial Sequence
  chemically synthesized
cagatcagacagaaataggt

SEQ ID NO: 11819 - DNA, 20 bp, Artificial Sequence
  chemically synthesized
aggtttaacagtagtataat

SEQ ID NO: 11820 - DNA, 20 bp, Artificial Sequence
  chemically synthesized
atctatctcacaggtgttgg

SEQ ID NO: 11821 - DNA, 20 bp, Artificial Sequence
  chemically synthesized
aaatgactattgtcacaatc

SEQ ID NO: 11822 - DNA, 20 bp, Artificial Sequence
  chemically synthesized
tcacaatcaggaatgaccta

SEQ ID NO: 11823 - DNA, 20 bp, Artificial Sequence
  chemically synthesized
gaatgacctaaagaataatt

SEQ ID NO: 11824 - DNA, 20 bp, Artificial Sequence
  chemically synthesized
tcctgttatccatccagcac

SEQ ID NO: 11825 - DNA, 20 bp, Artificial Sequence
  chemically synthesized
ctccatggcccttaaatgtc

SEQ ID NO: 11826 - DNA, 20 bp, Artificial Sequence
  chemically synthesized
atacttgctagggctgggac

SEQ ID NO: 11827 - DNA, 20 bp, Artificial Sequence
  chemically synthesized
taactactgtttacagaaca

SEQ ID NO: 11828 - DNA, 20 bp, Artificial Sequence
  chemically synthesized
cctatagtcagatacgtctc

SEQ ID NO: 11829 - DNA, 20 bp, Artificial Sequence
  chemically synthesized
ggcactgtcatcttattttt

SEQ ID NO: 11830 - DNA, 20 bp, Artificial Sequence
  chemically synthesized
aggtaacatactaaaacatt

SEQ ID NO: 11831 - DNA, 20 bp, Artificial Sequence
  chemically synthesized
tacctcacgttcttgcaaat

SEQ ID NO: 11832 - DNA, 20 bp, Artificial Sequence
  chemically synthesized
ttgcaaatctgagtctttgc

SEQ ID NO: 11833 - DNA, 20 bp, Artificial Sequence
  chemically synthesized
atgctgctttagatcaaaga

SEQ ID NO: 11834 - DNA, 20 bp, Artificial Sequence
  chemically synthesized
tagttgtaactcagtaatgt

SEQ ID NO: 11835 - DNA, 20 bp, Artificial Sequence
  chemically synthesized
aactccttttagaagccaat

SEQ ID NO: 11836 - DNA, 20 bp, Artificial Sequence
  chemically synthesized
atgagagtttaatagcagaa

SEQ ID NO: 11837 - DNA, 20 bp, Artificial Sequence
  chemically synthesized
atctctggctacaatggctg

SEQ ID NO: 11838 - DNA, 20 bp, Artificial Sequence
  chemically synthesized
ctttctccttagtattatct

SEQ ID NO: 11839 - DNA, 20 bp, Artificial Sequence
  chemically synthesized
ctcaccacttatatagaaga

SEQ ID NO: 11840 - DNA, 20 bp, Artificial Sequence
  chemically synthesized
acttatatagaagaaagggt

SEQ ID NO: 11841 - DNA, 20 bp, Artificial Sequence
  chemically synthesized
cttgctttatgtcctgcttt

SEQ ID NO: 11842 - DNA, 20 bp, Artificial Sequence
  chemically synthesized
ttcacagctgacatcatgtc

SEQ ID NO: 11843 - DNA, 20 bp, Artificial Sequence
  chemically synthesized
acagggccagtcagctttct

SEQ ID NO: 11844 - DNA, 20 bp, Artificial Sequence
  chemically synthesized
gtcagctttctgggggtgct

SEQ ID NO: 11845 - DNA, 20 bp, Artificial Sequence
  chemically synthesized
gaacatgctgtttgtccaaa

SEQ ID NO: 11846 - DNA, 20 bp, Artificial Sequence
  chemically synthesized
ttctcccctagggaactcaa

SEQ ID NO: 11847 - DNA, 20 bp, Artificial Sequence
  chemically synthesized
aatttttttaaaccaaggag

SEQ ID NO: 11848 - DNA, 20 bp, Artificial Sequence
  chemically synthesized
ggagatgaatgttttctaac

SEQ ID NO: 11849 - DNA, 20 bp, Artificial Sequence
  chemically synthesized
acaaacctgtacattcagca

SEQ ID NO: 11850 - DNA, 20 bp, Artificial Sequence
  chemically synthesized
agcgcgtgaacatgatcatg

SEQ ID NO: 11851 - DNA, 20 bp, Artificial Sequence
  chemically synthesized
agtatgcttgccttttagat

SEQ ID NO: 11852 - DNA, 20 bp, Artificial Sequence
  chemically synthesized
atttggtcatgtaattcctg

SEQ ID NO: 11853 - DNA, 20 bp, Artificial Sequence
  chemically synthesized
aaaattaaaagtgggaaaac

SEQ ID NO: 11854 - DNA, 20 bp, Artificial Sequence
  chemically synthesized
agtgggaaaacaaagaaata

SEQ ID NO: 11855 - DNA, 20 bp, Artificial Sequence
  chemically synthesized
actcagttgagttccctagg

SEQ ID NO: 11856 - DNA, 20 bp, Artificial Sequence
  chemically synthesized
ctaggggagaaaagcaagct

SEQ ID NO: 11857 - DNA, 20 bp, Artificial Sequence
  chemically synthesized
cccagaggaaggcatacagg

SEQ ID NO: 11858 - DNA, 20 bp, Artificial Sequence
  chemically synthesized
cacacttacttgtcaacttt

SEQ ID NO: 11859 - DNA, 20 bp, Artificial Sequence
  chemically synthesized
ggtgccaaccctaagcaccc

SEQ ID NO: 11860 - DNA, 20 bp, Artificial Sequence
  chemically synthesized
agtgagtaaagtcaagggat

SEQ ID NO: 11861 - DNA, 20 bp, Artificial Sequence
  chemically synthesized
gatgctggggaaaggataga

SEQ ID NO: 11862 - DNA, 20 bp, Artificial Sequence
  chemically synthesized
cgatccccagataatactaa

SEQ ID NO: 11863 - DNA, 20 bp, Artificial Sequence
  chemically synthesized
actaggtactaagggatcat

SEQ ID NO: 11864 - DNA, 20 bp, Artificial Sequence
  chemically synthesized
tggggaaacaattgatagag

SEQ ID NO: 11865 - DNA, 20 bp, Artificial Sequence
  chemically synthesized
gtttgatgtgattatggacc

SEQ ID NO: 11866 - DNA, 20 bp, Artificial Sequence
  chemically synthesized
agttagagcaaagcggggaa

SEQ ID NO: 11867 - DNA, 20 bp, Artificial Sequence
  chemically synthesized
aaaaagggagagatcaacaa

SEQ ID NO: 11868 - DNA, 20 bp, Artificial Sequence
  chemically synthesized
agaagttattaaagagctaa

SEQ ID NO: 11869 - DNA, 20 bp, Artificial Sequence
  chemically synthesized
attaaagagctaaagagaat

SEQ ID NO: 11870 - DNA, 20 bp, Artificial Sequence
  chemically synthesized
gaattgagaaatttaaaaca

SEQ ID NO: 11871 - DNA, 20 bp, Artificial Sequence
  chemically synthesized
ggccaacatgaaaggagtag

SEQ ID NO: 11872 - DNA, 20 bp, Artificial Sequence
  chemically synthesized
aactgcagatcaaaaatatt

SEQ ID NO: 11873 - DNA, 20 bp, Artificial Sequence
  chemically synthesized
ttacattgtattagctatta

SEQ ID NO: 11874 - DNA, 20 bp, Artificial Sequence
  chemically synthesized
tgcaaacgagtgaaggaaat

SEQ ID NO: 11875 - DNA, 20 bp, Artificial Sequence
  chemically synthesized
ctacttgggaggctgaggca

SEQ ID NO: 11876 - DNA, 20 bp, Artificial Sequence
  chemically synthesized
gtcaaaaaaaaaagagttga

SEQ ID NO: 11877 - DNA, 20 bp, Artificial Sequence
  chemically synthesized
aaaaagtctaggctaaattc

SEQ ID NO: 11878 - DNA, 20 bp, Artificial Sequence
  chemically synthesized
cagctgcaatgaaaataagg

SEQ ID NO: 11879 - DNA, 20 bp, Artificial Sequence
  chemically synthesized
aggaagtagtcccaaatacc

SEQ ID NO: 11880 - DNA, 20 bp, Artificial Sequence
  chemically synthesized
agatatattgctagaccctt

SEQ ID NO: 11881 - DNA, 20 bp, Artificial Sequence
  chemically synthesized
ttaacaatggggatatattc

SEQ ID NO: 11882 - DNA, 20 bp, Artificial Sequence
  chemically synthesized
tggtatttgtgtatctaaac

SEQ ID NO: 11883 - DNA, 20 bp, Artificial Sequence
  chemically synthesized
gagaggaaggagggagggaa

SEQ ID NO: 11884 - DNA, 20 bp, Artificial Sequence
  chemically synthesized
caaagtaaattcaaatatga

SEQ ID NO: 11885 - DNA, 20 bp, Artificial Sequence
  chemically synthesized
attttggctccatgccctaa

SEQ ID NO: 11886 - DNA, 20 bp, Artificial Sequence
  chemically synthesized
ttttcttttttgctaaaact

SEQ ID NO: 11887 - DNA, 20 bp, Artificial Sequence
  chemically synthesized
ttgttcaagggaaccttgag

SEQ ID NO: 11888 - DNA, 20 bp, Artificial Sequence
  chemically synthesized
accttgagagagaatgtatg

SEQ ID NO: 11889 - DNA, 20 bp, Artificial Sequence
  chemically synthesized
attatacctctttggccgat

SEQ ID NO: 11890 - DNA, 20 bp, Artificial Sequence
  chemically synthesized
tttgttggcgttttcatgat

SEQ ID NO: 11891 - DNA, 20 bp, Artificial Sequence
  chemically synthesized
tcaagaaaaactgaaatgta

SEQ ID NO: 11892 - DNA, 20 bp, Artificial Sequence
  chemically synthesized
aattctttagttttagcaaa

SEQ ID NO: 11893 - DNA, 20 bp, Artificial Sequence
  chemically synthesized
catgaaaattttacatctct

SEQ ID NO: 11894 - DNA, 20 bp, Artificial Sequence
  chemically synthesized
ttcaattttacttttagtca

SEQ ID NO: 11895 - DNA, 20 bp, Artificial Sequence
  chemically synthesized
ttgaatttactttggatgaa

SEQ ID NO: 11896 - DNA, 20 bp, Artificial Sequence
  chemically synthesized
tcaccctggctgggctgttt

SEQ ID NO: 11897 - DNA, 20 bp, Artificial Sequence
  chemically synthesized
agtgtctgtcactagatgtt

SEQ ID NO: 11898 - DNA, 20 bp, Artificial Sequence
  chemically synthesized
gcagtgatttaagcatctct

SEQ ID NO: 11899 - DNA, 20 bp, Artificial Sequence
  chemically synthesized
attgcttaatgacacatttc

SEQ ID NO: 11900 - DNA, 20 bp, Artificial Sequence
  chemically synthesized
ctgattaactccaaaaagga

SEQ ID NO: 11901 - DNA, 20 bp, Artificial Sequence
  chemically synthesized
aggaaagtaaaaaggaaagg

SEQ ID NO: 11902 - DNA, 20 bp, Artificial Sequence
  chemically synthesized
gttgagtgaaaaaacagact

SEQ ID NO: 11903 - DNA, 20 bp, Artificial Sequence
  chemically synthesized
agactttagaatcagatcag

SEQ ID NO: 11904 - DNA, 20 bp, Artificial Sequence
  chemically synthesized
taggtttaacagtagtataa

SEQ ID NO: 11905 - DNA, 20 bp, Artificial Sequence
  chemically synthesized
gtcacaatcaggaatgacct

SEQ ID NO: 11906 - DNA, 20 bp, Artificial Sequence
  chemically synthesized
tgcattaatactgtctatcc

SEQ ID NO: 11907 - DNA, 20 bp, Artificial Sequence
  chemically synthesized
tatctctggctacaatggct

SEQ ID NO: 11908 - DNA, 20 bp, Artificial Sequence
  chemically synthesized
atcatctcaccacttatata

SEQ ID NO: 11909 - DNA, 20 bp, Artificial Sequence
  chemically synthesized
gtcagctactagatttgatt

SEQ ID NO: 11910 - DNA, 20 bp, Artificial Sequence
  chemically synthesized
ttagttttaaaaatgaagaa

SEQ ID NO: 11911 - DNA, 20 bp, Artificial Sequence
  chemically synthesized
gttttcttcttcttcatttt

SEQ ID NO: 11912 - DNA, 20 bp, Artificial Sequence
  chemically synthesized
tggtcatgtaattcctgtta

SEQ ID NO: 11913 - DNA, 20 bp, Artificial Sequence
  chemically synthesized
tttaaaaaaattaaaagtgg

SEQ ID NO: 11914 - DNA, 20 bp, Artificial Sequence
  chemically synthesized
cttcaatttaaagttttagt

SEQ ID NO: 11915 - DNA, 20 bp, Artificial Sequence
  chemically synthesized
gggataaagaaaatttgttg

SEQ ID NO: 11916 - DNA, 20 bp, Artificial Sequence
  chemically synthesized
acagtttggaattttgaaat

SEQ ID NO: 11917 - DNA, 20 bp, Artificial Sequence
  chemically synthesized
ttgaaattaaaacagttctg

SEQ ID NO: 11918 - DNA, 20 bp, Artificial Sequence
  chemically synthesized
ctaaagagaattgagaaatt

SEQ ID NO: 11919 - DNA, 20 bp, Artificial Sequence
  chemically synthesized
acacatatatgtatatacat

SEQ ID NO: 11920 - DNA, 20 bp, Artificial Sequence
  chemically synthesized
ctaggtagatgtagcttaaa

SEQ ID NO: 11921 - DNA, 20 bp, Artificial Sequence
  chemically synthesized
catttgggcaaccatattct

SEQ ID NO: 11922 - DNA, 20 bp, Artificial Sequence
  chemically synthesized
gctttcagattatttggatt

SEQ ID NO: 11923 - DNA, 20 bp, Artificial Sequence
  chemically synthesized
catgatgttttcttttttgc

SEQ ID NO: 11924 - DNA, 20 bp, Artificial Sequence
  chemically synthesized
tttcagtttttcttgatcat

SEQ ID NO: 11925 - DNA, 20 bp, Artificial Sequence
  chemically synthesized
aagaagcacgagaagttttt

SEQ ID NO: 11926 - DNA, 20 bp, Artificial Sequence
  chemically synthesized
aaaaacttctcgtgcttctt

SEQ ID NO: 11927 - DNA, 20 bp, Artificial Sequence
  chemically synthesized
ttggcgttttcatgatcaag

SEQ ID NO: 11928 - DNA, 20 bp, Artificial Sequence
  chemically synthesized
tctttagttttagcaaaaaa

SEQ ID NO: 11929 - DNA, 20 bp, Artificial Sequence
  chemically synthesized
tgtacagtgtggttgagtga

SEQ ID NO: 11930 - DNA, 20 bp, Artificial Sequence
  chemically synthesized
ctttgcccaaggtaacatac

SEQ ID NO: 11931 - DNA, 20 bp, Artificial Sequence
  chemically synthesized
atagtccatatggaaccata

SEQ ID NO: 11932 - DNA, 20 bp, Artificial Sequence
  chemically synthesized
tctttgatgcatacacttta

SEQ ID NO: 11933 - DNA, 20 bp, Artificial Sequence
  chemically synthesized
taaagtcactgtagttgtga

SEQ ID NO: 11934 - DNA, 20 bp, Artificial Sequence
  chemically synthesized
gttaatctttatgttttaac

SEQ ID NO: 11935 - DNA, 20 bp, Artificial Sequence
  chemically synthesized
gttttaaaaatgaagaagaa

SEQ ID NO: 11936 - DNA, 20 bp, Artificial Sequence
  chemically synthesized
atctactcagtgctgaatgt

SEQ ID NO: 11937 - DNA, 20 bp, Artificial Sequence
  chemically synthesized
actcagtgctgaatgtacag

SEQ ID NO: 11938 - DNA, 20 bp, Artificial Sequence
  chemically synthesized
ccttttttaaaatacattga

SEQ ID NO: 11939 - DNA, 20 bp, Artificial Sequence
  chemically synthesized
atgctgtcttcttcactaaa

SEQ ID NO: 11940 - DNA, 20 bp, Artificial Sequence
  chemically synthesized
ttcttcactaaattttgatt

SEQ ID NO: 11941 - DNA, 20 bp, Artificial Sequence
  chemically synthesized
aagtactggttctttgttag

SEQ ID NO: 11942 - DNA, 20 bp, Artificial Sequence
  chemically synthesized
tttaaaactaaatagatcga

SEQ ID NO: 11943 - DNA, 20 bp, Artificial Sequence
  chemically synthesized
cgacaatgcttatgatgcat

SEQ ID NO: 11944 - DNA, 20 bp, Artificial Sequence
  chemically synthesized
tttaataaacactgttcagt

SEQ ID NO: 11945 - DNA, 20 bp, Artificial Sequence
  chemically synthesized
tgttagaaaacattcatctc

SEQ ID NO: 11946 - DNA, 20 bp, Artificial Sequence
  chemically synthesized
aaaaaaaataaccacattat

SEQ ID NO: 11947 - DNA, 20 bp, Artificial Sequence
  chemically synthesized
tggccttatttacacaaaaa

SEQ ID NO: 11948 - DNA, 20 bp, Artificial Sequence
  chemically synthesized
ttttaagatatatgacattt

SEQ ID NO: 11949 - DNA, 20 bp, Artificial Sequence
  chemically synthesized
taaattatatatcttcaatt

SEQ ID NO: 11950 - DNA, 20 bp, Artificial Sequence
  chemically synthesized
ttaaagttttagttaaaaca

SEQ ID NO: 11951 - DNA, 20 bp, Artificial Sequence
  chemically synthesized
agcaagctgttagttatcac

SEQ ID NO: 11952 - DNA, 20 bp, Artificial Sequence
  chemically synthesized
tagttatcaccaaagctttt

SEQ ID NO: 11953 - DNA, 20 bp, Artificial Sequence
  chemically synthesized
gagttccctaggggagaaaa

SEQ ID NO: 11954 - DNA, 20 bp, Artificial Sequence
  chemically synthesized
agctaatgcaacatatatca

SEQ ID NO: 11955 - DNA, 20 bp, Artificial Sequence
  chemically synthesized
tgagatgatgaaggttgtaa

SEQ ID NO: 11956 - DNA, 20 bp, Artificial Sequence
  chemically synthesized
tagataagaataaggatgaa

SEQ ID NO: 11957 - DNA, 20 bp, Artificial Sequence
  chemically synthesized
taatactaaggagaaaggca

SEQ ID NO: 11958 - DNA, 20 bp, Artificial Sequence
  chemically synthesized
tcttctgctattaaactctc

SEQ ID NO: 11959 - DNA, 20 bp, Artificial Sequence
  chemically synthesized
aactctcattggcttctaaa

SEQ ID NO: 11960 - DNA, 20 bp, Artificial Sequence
  chemically synthesized
cttctaaaaggagtttcggt

SEQ ID NO: 11961 - DNA, 20 bp, Artificial Sequence
  chemically synthesized
ctgcctttaggtattattgc

SEQ ID NO: 11962 - DNA, 20 bp, Artificial Sequence
  chemically synthesized
aattaaaacagttctgtaaa

SEQ ID NO: 11963 - DNA, 20 bp, Artificial Sequence
  chemically synthesized
aaacagttctgtaaaaccag

SEQ ID NO: 11964 - DNA, 20 bp, Artificial Sequence
  chemically synthesized
aagcagcatgaggccaggtg

SEQ ID NO: 11965 - DNA, 20 bp, Artificial Sequence
  chemically synthesized
gaggatcactcgtgcaaaga

SEQ ID NO: 11966 - DNA, 20 bp, Artificial Sequence
  chemically synthesized
gcaagaacgtgaggtatttc

SEQ ID NO: 11967 - DNA, 20 bp, Artificial Sequence
  chemically synthesized
ataatgaagtcattaaccta

SEQ ID NO: 11968 - DNA, 20 bp, Artificial Sequence
  chemically synthesized
acataaggagtaccactgat

SEQ ID NO: 11969 - DNA, 20 bp, Artificial Sequence
  chemically synthesized
tggctagagtcttggggact

SEQ ID NO: 11970 - DNA, 20 bp, Artificial Sequence
  chemically synthesized
tcttggggactttgtgtttg

SEQ ID NO: 11971 - DNA, 20 bp, Artificial Sequence
  chemically synthesized
actgccagagtctgaatcct

SEQ ID NO: 11972 - DNA, 20 bp, Artificial Sequence
  chemically synthesized
taaatattgtgccctacatg

SEQ ID NO: 11973 - DNA, 20 bp, Artificial Sequence
  chemically synthesized
caaagcggggaaccagaata

SEQ ID NO: 11974 - DNA, 20 bp, Artificial Sequence
  chemically synthesized
aatagagtgattattataaa

SEQ ID NO: 11975 - DNA, 20 bp, Artificial Sequence
  chemically synthesized
aaaattattctttaggtcat

SEQ ID NO: 11976 - DNA, 20 bp, Artificial Sequence
  chemically synthesized
atagtcatttcattatataa

SEQ ID NO: 11977 - DNA, 20 bp, Artificial Sequence
  chemically synthesized
catttgacaaagttaaggtt

SEQ ID NO: 11978 - DNA, 20 bp, Artificial Sequence
  chemically synthesized
caggtctagaggaggcagat

SEQ ID NO: 11979 - DNA, 20 bp, Artificial Sequence
  chemically synthesized
ttcaaacctatttctgtctg

SEQ ID NO: 11980 - DNA, 20 bp, Artificial Sequence
  chemically synthesized
ctgtctgatctgattctaaa

SEQ ID NO: 11981 - DNA, 20 bp, Artificial Sequence
  chemically synthesized
ctccttgtgagttccacagc

SEQ ID NO: 11982 - DNA, 20 bp, Artificial Sequence
  chemically synthesized
agctattaagagaaacctag

SEQ ID NO: 11983 - DNA, 20 bp, Artificial Sequence
  chemically synthesized
gatttaaagtacaaaggagg

SEQ ID NO: 11984 - DNA, 20 bp, Artificial Sequence
  chemically synthesized
ggtggcatccatctgcattt

SEQ ID NO: 11985 - DNA, 20 bp, Artificial Sequence
  chemically synthesized
tggctgctccaatttagggg

SEQ ID NO: 11986 - DNA, 20 bp, Artificial Sequence
  chemically synthesized
acaaggtgaaatggtgaaac

SEQ ID NO: 11987 - DNA, 20 bp, Artificial Sequence
  chemically synthesized
ttgggaggctgaggcaggag

SEQ ID NO: 11988 - DNA, 20 bp, Artificial Sequence
  chemically synthesized
ctgcaatgaaaataagggaa

SEQ ID NO: 11989 - DNA, 20 bp, Artificial Sequence
  chemically synthesized
gggaagaaagtttagttcat

SEQ ID NO: 11990 - DNA, 20 bp, Artificial Sequence
  chemically synthesized
acttacctaaacctaaatgg

SEQ ID NO: 11991 - DNA, 20 bp, Artificial Sequence
  chemically synthesized
ccaaaatgtcattgtgcagc

SEQ ID NO: 11992 - DNA, 20 bp, Artificial Sequence
  chemically synthesized
aaggagggagggaaggagaa

SEQ ID NO: 11993 - DNA, 20 bp, Artificial Sequence
  chemically synthesized
gtctcttcagactaggtaga

SEQ ID NO: 11994 - DNA, 20 bp, Artificial Sequence
  chemically synthesized
acatatcctgaattctagag

SEQ ID NO: 11995 - DNA, 20 bp, Artificial Sequence
  chemically synthesized
caaaggtgctgttgatctga

SEQ ID NO: 11996 - DNA, 20 bp, Artificial Sequence
  chemically synthesized
attgcttttttaaattaatg

SEQ ID NO: 11997 - DNA, 20 bp, Artificial Sequence
  chemically synthesized
catttgcagctggaccataa

SEQ ID NO: 11998 - DNA, 20 bp, Artificial Sequence
  chemically synthesized
ttcatccaaagtaaattcaa

SEQ ID NO: 11999 - DNA, 20 bp, Artificial Sequence
  chemically synthesized
atacagtactgtgggaacat

SEQ ID NO: 12000 - DNA, 20 bp, Artificial Sequence
  chemically synthesized
gctccatgccctaaagagaa

SEQ ID NO: 12001 - DNA, 20 bp, Artificial Sequence
  chemically synthesized
gccctaaagagaaattggct

SEQ ID NO: 12002 - DNA, 20 bp, Artificial Sequence
  chemically synthesized
agaaattggctttcagatta

SEQ ID NO: 12003 - DNA, 20 bp, Artificial Sequence
  chemically synthesized
taagagatgtaaaattttca

SEQ ID NO: 12004 - DNA, 20 bp, Artificial Sequence
  chemically synthesized
aaagaattattcttttacat

SEQ ID NO: 12005 - DNA, 20 bp, Artificial Sequence
  chemically synthesized
gtataattcaggtaaattgg

SEQ ID NO: 12006 - DNA, 20 bp, Artificial Sequence
  chemically synthesized
gagaatgtatggaagaaaag

SEQ ID NO: 12007 - DNA, 20 bp, Artificial Sequence
  chemically synthesized
tgtagttttgaagaagcacg

SEQ ID NO: 12008 - DNA, 20 bp, Artificial Sequence
  chemically synthesized
tcagtgttttcaaaaacttc

SEQ ID NO: 12009 - DNA, 20 bp, Artificial Sequence
  chemically synthesized
tacctgaattatacctcttt

SEQ ID NO: 12010 - DNA, 20 bp, Artificial Sequence
  chemically synthesized
tggccgattcagaattttgt

SEQ ID NO: 12011 - DNA, 20 bp, Artificial Sequence
  chemically synthesized
gaaatgtaaaagaataattc

SEQ ID NO: 12012 - DNA, 20 bp, Artificial Sequence
  chemically synthesized
tttacatctcttaagaaagt

SEQ ID NO: 12013 - DNA, 20 bp, Artificial Sequence
  chemically synthesized
cccacagtactgtatacaca

SEQ ID NO: 12014 - DNA, 20 bp, Artificial Sequence
  chemically synthesized
gagaattccagtaataaaag

SEQ ID NO: 12015 - DNA, 20 bp, Artificial Sequence
  chemically synthesized
gtgatccatcaccctggctg

SEQ ID NO: 12016 - DNA, 20 bp, Artificial Sequence
  chemically synthesized
ggcaagtgttataggaattg

SEQ ID NO: 12017 - DNA, 20 bp, Artificial Sequence
  chemically synthesized
gcatctctctagaattcagg

SEQ ID NO: 12018 - DNA, 20 bp, Artificial Sequence
  chemically synthesized
gtattttcactgtacctttt

SEQ ID NO: 12019 - DNA, 20 bp, Artificial Sequence
  chemically synthesized
tcagtacagtcacatgctgt

SEQ ID NO: 12020 - DNA, 20 bp, Artificial Sequence
  chemically synthesized
tatgtagtaagctataccat

SEQ ID NO: 12021 - DNA, 20 bp, Artificial Sequence
  chemically synthesized
ttatgttcgcacaatgatga

SEQ ID NO: 12022 - DNA, 20 bp, Artificial Sequence
  chemically synthesized
gcatggctgtatacacacac

SEQ ID NO: 12023 - DNA, 20 bp, Artificial Sequence
  chemically synthesized
gtatacacacacatgtgttt

SEQ ID NO: 12024 - DNA, 20 bp, Artificial Sequence
  chemically synthesized
gataccatctcaagaggacc

SEQ ID NO: 12025 - DNA, 20 bp, Artificial Sequence
  chemically synthesized
ctggggtatttgggactact

SEQ ID NO: 12026 - DNA, 20 bp, Artificial Sequence
  chemically synthesized
gtgttctagtcccttgacat

SEQ ID NO: 12027 - DNA, 20 bp, Artificial Sequence
  chemically synthesized
tgcctcagcctcccaagtag

SEQ ID NO: 12028 - DNA, 20 bp, Artificial Sequence
  chemically synthesized
ttttgtatttttagtaaagc

SEQ ID NO: 12029 - DNA, 20 bp, Artificial Sequence
  chemically synthesized
tgcctgggcctctgaaagtg

SEQ ID NO: 12030 - DNA, 20 bp, Artificial Sequence
  chemically synthesized
catatttctcaatttccttc

SEQ ID NO: 12031 - DNA, 20 bp, Artificial Sequence
  chemically synthesized
gctcaagtctccgatataaa

SEQ ID NO: 12032 - DNA, 20 bp, Artificial Sequence
  chemically synthesized
ctttgtactttaaatcatct

SEQ ID NO: 12033 - DNA, 20 bp, Artificial Sequence
  chemically synthesized
tgtaaatagttgttatgctg

SEQ ID NO: 12034 - DNA, 20 bp, Artificial Sequence
  chemically synthesized
tagaatcagatcagacagaa

SEQ ID NO: 12035 - DNA, 20 bp, Artificial Sequence
  chemically synthesized
ttaactttgtcaaatgtaaa

SEQ ID NO: 12036 - DNA, 20 bp, Artificial Sequence
  chemically synthesized
ttcatgttggccctactttc

SEQ ID NO: 12037 - DNA, 20 bp, Artificial Sequence
  chemically synthesized
gaatgacctaaagaataatt

SEQ ID NO: 12038 - DNA, 20 bp, Artificial Sequence
  chemically synthesized
ataatcactctattctggtt

SEQ ID NO: 12039 - DNA, 20 bp, Artificial Sequence
  chemically synthesized
tgttatccatccagcacttg

SEQ ID NO: 12040 - DNA, 20 bp, Artificial Sequence
  chemically synthesized
gggttctcccaggctccagc

SEQ ID NO: 12041 - DNA, 20 bp, Artificial Sequence
  chemically synthesized
gtatatttatgccctacagg

SEQ ID NO: 12042 - DNA, 20 bp, Artificial Sequence
  chemically synthesized
cccacacacgtggctgtaac

SEQ ID NO: 12043 - DNA, 20 bp, Artificial Sequence
  chemically synthesized
gtcagatacgtctcctgaat

SEQ ID NO: 12044 - DNA, 20 bp, Artificial Sequence
  chemically synthesized
agtaatagctaatgtatatg

SEQ ID NO: 12045 - DNA, 20 bp, Artificial Sequence
  chemically synthesized
ttatttttatgaatgaggaa

SEQ ID NO: 12046 - DNA, 20 bp, Artificial Sequence
  chemically synthesized
aagatagattcatagaggct

SEQ ID NO: 12047 - DNA, 20 bp, Artificial Sequence
  chemically synthesized
aaggtaacatactaaaacat

SEQ ID NO: 12048 - DNA, 20 bp, Artificial Sequence
  chemically synthesized
tcagccatcagtggtactcc

SEQ ID NO: 12049 - DNA, 20 bp, Artificial Sequence
  chemically synthesized
ttatctgatgaccagctctg

SEQ ID NO: 12050 - DNA, 20 bp, Artificial Sequence
  chemically synthesized
gaaaatattctctctctatc

SEQ ID NO: 12051 - DNA, 20 bp, Artificial Sequence
  chemically synthesized
aaacctctcacctggcctca

SEQ ID NO: 12052 - DNA, 20 bp, Artificial Sequence
  chemically synthesized
gctttagatcaaagagggag

SEQ ID NO: 12053 - DNA, 20 bp, Artificial Sequence
  chemically synthesized
catacactttacaaaactaa

SEQ ID NO: 12054 - DNA, 20 bp, Artificial Sequence
  chemically synthesized
aaactaaactggttttacag

SEQ ID NO: 12055 - DNA, 20 bp, Artificial Sequence
  chemically synthesized
aactccttttagaagccaat

SEQ ID NO: 12056 - DNA, 20 bp, Artificial Sequence
  chemically synthesized
attcccctggccccttcctc

SEQ ID NO: 12057 - DNA, 20 bp, Artificial Sequence
  chemically synthesized
atcgtatacttaacttccct

SEQ ID NO: 12058 - DNA, 20 bp, Artificial Sequence
  chemically synthesized
ctcaccacttatatagaaga

SEQ ID NO: 12059 - DNA, 20 bp, Artificial Sequence
  chemically synthesized
ttatatagaagaaagggttt

SEQ ID NO: 12060 - DNA, 20 bp, Artificial Sequence
  chemically synthesized
taatgagatatatctaatgg

SEQ ID NO: 12061 - DNA, 20 bp, Artificial Sequence
  chemically synthesized
tctaatggccttgctttatg

SEQ ID NO: 12062 - DNA, 20 bp, Artificial Sequence
  chemically synthesized
cttgctttatgtcctgcttt

SEQ ID NO: 12063 - DNA, 20 bp, Artificial Sequence
  chemically synthesized
cccttgactttactcacttt

SEQ ID NO: 12064 - DNA, 20 bp, Artificial Sequence
  chemically synthesized
atcgttatttcagcatttca

SEQ ID NO: 12065 - DNA, 20 bp, Artificial Sequence
  chemically synthesized
gagtgggaaccacagggcca

SEQ ID NO: 12066 - DNA, 20 bp, Artificial Sequence
  chemically synthesized
agggccagtcagctttctgg

SEQ ID NO: 12067 - DNA, 20 bp, Artificial Sequence
  chemically synthesized
tgatcctggtactgtcagct

SEQ ID NO: 12068 - DNA, 20 bp, Artificial Sequence
  chemically synthesized
ctggtactgtcagctactag

SEQ ID NO: 12069 - DNA, 20 bp, Artificial Sequence
  chemically synthesized
agttgacaagtaagtgtgat

SEQ ID NO: 12070 - DNA, 20 bp, Artificial Sequence
  chemically synthesized
aaatgcttcctgtgagaaca

SEQ ID NO: 12071 - DNA, 20 bp, Artificial Sequence
  chemically synthesized
cctactctttatgtcaattc

SEQ ID NO: 12072 - DNA, 20 bp, Artificial Sequence
  chemically synthesized
ctctttatgtcaattcttaa

SEQ ID NO: 12073 - DNA, 20 bp, Artificial Sequence
  chemically synthesized
ctagggaactcaactgagta

SEQ ID NO: 12074 - DNA, 20 bp, Artificial Sequence
  chemically synthesized
ttccccaaatatcaactcca

SEQ ID NO: 12075 - DNA, 20 bp, Artificial Sequence
  chemically synthesized
agatgtttgacatagagaca

SEQ ID NO: 12076 - DNA, 20 bp, Artificial Sequence
  chemically synthesized
tgattttttcctaatccatg

SEQ ID NO: 12077 - DNA, 20 bp, Artificial Sequence
  chemically synthesized
gaaaagctttggtgataact

SEQ ID NO: 12078 - DNA, 20 bp, Artificial Sequence
  chemically synthesized
tgctaatgaaaggttaatct

SEQ ID NO: 12079 - DNA, 20 bp, Artificial Sequence
  chemically synthesized
actttttgtgtaaataaggc

SEQ ID NO: 12080 - DNA, 20 bp, Artificial Sequence
  chemically synthesized
tgtgtaaataaggccattgt

SEQ ID NO: 12081 - DNA, 20 bp, Artificial Sequence
  chemically synthesized
aataaggccattgtttgtgc

SEQ ID NO: 12082 - DNA, 20 bp, Artificial Sequence
  chemically synthesized
gtttgtgcttttgtttccca

SEQ ID NO: 12083 - DNA, 20 bp, Artificial Sequence
  chemically synthesized
ttcactatattctgctattt

SEQ ID NO: 12084 - DNA, 20 bp, Artificial Sequence
  chemically synthesized
tttttttaaaccaaggagat

SEQ ID NO: 12085 - DNA, 20 bp, Artificial Sequence
  chemically synthesized
tgaccaaatcatgaactgaa

SEQ ID NO: 12086 - DNA, 20 bp, Artificial Sequence
  chemically synthesized
tcataagcattgtcgatcta

SEQ ID NO: 12087 - DNA, 20 bp, Artificial Sequence
  chemically synthesized
aggcagatggtgatgaggcc

SEQ ID NO: 12088 - DNA, 20 bp, Artificial Sequence
  chemically synthesized
cgcgctgcataacctttgct

SEQ ID NO: 12089 - DNA, 22 bp, Artificial Sequence
  chemically synthesized
tcacaatctgctagcaaaggtt

SEQ ID NO: 12090 - DNA, 22 bp, Artificial Sequence
  chemically synthesized
cacaatctgctagcaaaggtta

SEQ ID NO: 12091 - DNA, 22 bp, Artificial Sequence
  chemically synthesized
acaatctgctagcaaaggttat

SEQ ID NO: 12092 - DNA, 22 bp, Artificial Sequence
  chemically synthesized
ctagcaaaggttatgcagcgcg

SEQ ID NO: 12093 - DNA, 22 bp, Artificial Sequence
  chemically synthesized
gcaaaggttatgcagcgcgtga

SEQ ID NO: 12094 - DNA, 22 bp, Artificial Sequence
  chemically synthesized
tgcagcgcgtgaacatgatcat

SEQ ID NO: 12095 - DNA, 22 bp, Artificial Sequence
  chemically synthesized
atcaccatctgccttttaggat

SEQ ID NO: 12096 - DNA, 22 bp, Artificial Sequence
  chemically synthesized
ccttttaggatatctactcagt

SEQ ID NO: 12097 - DNA, 22 bp, Artificial Sequence
  chemically synthesized
ttaggatatctactcagtgctg

SEQ ID NO: 12098 - DNA, 22 bp, Artificial Sequence
  chemically synthesized
taggatatctactcagtgctga

SEQ ID NO: 12099 - DNA, 22 bp, Artificial Sequence
  chemically synthesized
aggatatctactcagtgctgaa

SEQ ID NO: 12100 - DNA, 22 bp, Artificial Sequence
  chemically synthesized
ggatatctactcagtgctgaat

SEQ ID NO: 12101 - DNA, 22 bp, Artificial Sequence
  chemically synthesized
ctcagtgctgaatgtacaggtt

SEQ ID NO: 12102 - DNA, 22 bp, Artificial Sequence
  chemically synthesized
agtgctgaatgtacaggtttgt

SEQ ID NO: 12103 - DNA, 22 bp, Artificial Sequence
  chemically synthesized
aatgtacaggtttgtttccttt

SEQ ID NO: 12104 - DNA, 22 bp, Artificial Sequence
  chemically synthesized
gtttccttttttaaaatacatt

SEQ ID NO: 12105 - DNA, 22 bp, Artificial Sequence
  chemically synthesized
tttccttttttaaaatacattg

SEQ ID NO: 12106 - DNA, 22 bp, Artificial Sequence
  chemically synthesized
ccttttttaaaatacattgagt

SEQ ID NO: 12107 - DNA, 22 bp, Artificial Sequence
  chemically synthesized
cttttttaaaatacattgagta

SEQ ID NO: 12108 - DNA, 22 bp, Artificial Sequence
  chemically synthesized
ttttaaaatacattgagtatgc

SEQ ID NO: 12109 - DNA, 22 bp, Artificial Sequence
  chemically synthesized
tttaaaatacattgagtatgct

SEQ ID NO: 12110 - DNA, 22 bp, Artificial Sequence
  chemically synthesized
ttaaaatacattgagtatgctt

SEQ ID NO: 12111 - DNA, 22 bp, Artificial Sequence
  chemically synthesized
taaaatacattgagtatgcttg

SEQ ID NO: 12112 - DNA, 22 bp, Artificial Sequence
  chemically synthesized
aaaatacattgagtatgcttgc

SEQ ID NO: 12113 - DNA, 22 bp, Artificial Sequence
  chemically synthesized
aaatacattgagtatgcttgcc

SEQ ID NO: 12114 - DNA, 22 bp, Artificial Sequence
  chemically synthesized
agtatgcttgccttttagatat

SEQ ID NO: 12115 - DNA, 22 bp, Artificial Sequence
  chemically synthesized
gccttttagatatagaaatatc

SEQ ID NO: 12116 - DNA, 22 bp, Artificial Sequence
  chemically synthesized
ccttttagatatagaaatatct

SEQ ID NO: 12117 - DNA, 22 bp, Artificial Sequence
  chemically synthesized
ttagatatagaaatatctgatg

SEQ ID NO: 12118 - DNA, 22 bp, Artificial Sequence
  chemically synthesized
tagatatagaaatatctgatgc

SEQ ID NO: 12119 - DNA, 22 bp, Artificial Sequence
  chemically synthesized
agatatagaaatatctgatgct

SEQ ID NO: 12120 - DNA, 22 bp, Artificial Sequence
  chemically synthesized
gatatagaaatatctgatgctg

SEQ ID NO: 12121 - DNA, 22 bp, Artificial Sequence
  chemically synthesized
atgctgtcttcttcactaaatt

SEQ ID NO: 12122 - DNA, 22 bp, Artificial Sequence
  chemically synthesized
tcttcttcactaaattttgatt

SEQ ID NO: 12123 - DNA, 22 bp, Artificial Sequence
  chemically synthesized
cttcactaaattttgattacat

SEQ ID NO: 12124 - DNA, 22 bp, Artificial Sequence
  chemically synthesized
ttcactaaattttgattacatg

SEQ ID NO: 12125 - DNA, 22 bp, Artificial Sequence
  chemically synthesized
cactaaattttgattacatgat

SEQ ID NO: 12126 - DNA, 22 bp, Artificial Sequence
  chemically synthesized
actaaattttgattacatgatt

SEQ ID NO: 12127 - DNA, 22 bp, Artificial Sequence
  chemically synthesized
aattttgattacatgatttgac

SEQ ID NO: 12128 - DNA, 22 bp, Artificial Sequence
  chemically synthesized
tgattacatgatttgacagcaa

SEQ ID NO: 12129 - DNA, 22 bp, Artificial Sequence
  chemically synthesized
gattacatgatttgacagcaat

SEQ ID NO: 12130 - DNA, 22 bp, Artificial Sequence
  chemically synthesized
attacatgatttgacagcaata

SEQ ID NO: 12131 - DNA, 22 bp, Artificial Sequence
  chemically synthesized
catgatttgacagcaatattga

SEQ ID NO: 12132 - DNA, 22 bp, Artificial Sequence
  chemically synthesized
gacagcaatattgaagagtcta

SEQ ID NO: 12133 - DNA, 22 bp, Artificial Sequence
  chemically synthesized
acagcaatattgaagagtctaa

SEQ ID NO: 12134 - DNA, 22 bp, Artificial Sequence
  chemically synthesized
aagagtctaacagccagcacgc

SEQ ID NO: 12135 - DNA, 22 bp, Artificial Sequence
  chemically synthesized
acagccagcacgcaggttggta

SEQ ID NO: 12136 - DNA, 22 bp, Artificial Sequence
  chemically synthesized
gtaagtactggttctttgttag

SEQ ID NO: 12137 - DNA, 22 bp, Artificial Sequence
  chemically synthesized
gttctttgttagctaggttttc

SEQ ID NO: 12138 - DNA, 22 bp, Artificial Sequence
  chemically synthesized
tttgttagctaggttttcttct

SEQ ID NO: 12139 - DNA, 22 bp, Artificial Sequence
  chemically synthesized
tgttagctaggttttcttcttc

SEQ ID NO: 12140 - DNA, 22 bp, Artificial Sequence
  chemically synthesized
gttagctaggttttcttcttct

SEQ ID NO: 12141 - DNA, 22 bp, Artificial Sequence
  chemically synthesized
ttagctaggttttcttcttctt

SEQ ID NO: 12142 - DNA, 22 bp, Artificial Sequence
  chemically synthesized
gctaggttttcttcttcttcat

SEQ ID NO: 12143 - DNA, 22 bp, Artificial Sequence
  chemically synthesized
ggttttcttcttcttcattttt

SEQ ID NO: 12144 - DNA, 22 bp, Artificial Sequence
  chemically synthesized
tcttcttcttcatttttaaaac

SEQ ID NO: 12145 - DNA, 22 bp, Artificial Sequence
  chemically synthesized
cttcttcttcatttttaaaact

SEQ ID NO: 12146 - DNA, 22 bp, Artificial Sequence
  chemically synthesized
ttcttcttcatttttaaaacta

SEQ ID NO: 12147 - DNA, 22 bp, Artificial Sequence
  chemically synthesized
cttcttcatttttaaaactaaa

SEQ ID NO: 12148 - DNA, 22 bp, Artificial Sequence
  chemically synthesized
ttcttcatttttaaaactaaat

SEQ ID NO: 12149 - DNA, 22 bp, Artificial Sequence
  chemically synthesized
cttcatttttaaaactaaatag

SEQ ID NO: 12150 - DNA, 22 bp, Artificial Sequence
  chemically synthesized
ttcatttttaaaactaaataga

SEQ ID NO: 12151 - DNA, 22 bp, Artificial Sequence
  chemically synthesized
catttttaaaactaaatagatc

SEQ ID NO: 12152 - DNA, 22 bp, Artificial Sequence
  chemically synthesized
atttttaaaactaaatagatcg

SEQ ID NO: 12153 - DNA, 22 bp, Artificial Sequence
  chemically synthesized
ttaaaactaaatagatcgacaa

SEQ ID NO: 12154 - DNA, 22 bp, Artificial Sequence
  chemically synthesized
taaaactaaatagatcgacaat

SEQ ID NO: 12155 - DNA, 22 bp, Artificial Sequence
  chemically synthesized
aaaactaaatagatcgacaatg

SEQ ID NO: 12156 - DNA, 22 bp, Artificial Sequence
  chemically synthesized
aaactaaatagatcgacaatgc

SEQ ID NO: 12157 - DNA, 22 bp, Artificial Sequence
  chemically synthesized
aatagatcgacaatgcttatga

SEQ ID NO: 12158 - DNA, 22 bp, Artificial Sequence
  chemically synthesized
atgatgcatttatgtttaataa

SEQ ID NO: 12159 - DNA, 22 bp, Artificial Sequence
  chemically synthesized
tgatgcatttatgtttaataaa

SEQ ID NO: 12160 - DNA, 22 bp, Artificial Sequence
  chemically synthesized
atgtttaataaacactgttcag

SEQ ID NO: 12161 - DNA, 22 bp, Artificial Sequence
  chemically synthesized
tgtttaataaacactgttcagt

SEQ ID NO: 12162 - DNA, 22 bp, Artificial Sequence
  chemically synthesized
aataaacactgttcagttcatg

SEQ ID NO: 12163 - DNA, 22 bp, Artificial Sequence
  chemically synthesized
ataaacactgttcagttcatga

SEQ ID NO: 12164 - DNA, 22 bp, Artificial Sequence
  chemically synthesized
ttcagttcatgatttggtcatg

SEQ ID NO: 12165 - DNA, 22 bp, Artificial Sequence
  chemically synthesized
agttcatgatttggtcatgtaa

SEQ ID NO: 12166 - DNA, 22 bp, Artificial Sequence
  chemically synthesized
atgatttggtcatgtaattcct

SEQ ID NO: 12167 - DNA, 22 bp, Artificial Sequence
  chemically synthesized
ggtcatgtaattcctgttagaa

SEQ ID NO: 12168 - DNA, 22 bp, Artificial Sequence
  chemically synthesized
gtcatgtaattcctgttagaaa

SEQ ID NO: 12169 - DNA, 22 bp, Artificial Sequence
  chemically synthesized
ctgttagaaaacattcatctcc

SEQ ID NO: 12170 - DNA, 22 bp, Artificial Sequence
  chemically synthesized
ttagaaaacattcatctccttg

SEQ ID NO: 12171 - DNA, 22 bp, Artificial Sequence
  chemically synthesized
gaaaacattcatctccttggtt

SEQ ID NO: 12172 - DNA, 22 bp, Artificial Sequence
  chemically synthesized
atctccttggtttaaaaaaatt

SEQ ID NO: 12173 - DNA, 22 bp, Artificial Sequence
  chemically synthesized
cttggtttaaaaaaattaaaag

SEQ ID NO: 12174 - DNA, 22 bp, Artificial Sequence
  chemically synthesized
ggtttaaaaaaattaaaagtgg

SEQ ID NO: 12175 - DNA, 22 bp, Artificial Sequence
  chemically synthesized
gtttaaaaaaattaaaagtggg

SEQ ID NO: 12176 - DNA, 22 bp, Artificial Sequence
  chemically synthesized
aaaaaaattaaaagtgggaaaa

SEQ ID NO: 12177 - DNA, 22 bp, Artificial Sequence
  chemically synthesized
aaaaaattaaaagtgggaaaac

SEQ ID NO: 12178 - DNA, 22 bp, Artificial Sequence
  chemically synthesized
aaagtgggaaaacaaagaaata

SEQ ID NO: 12179 - DNA, 22 bp, Artificial Sequence
  chemically synthesized
tttttgtttggacttaccactt

SEQ ID NO: 12180 - DNA, 22 bp, Artificial Sequence
  chemically synthesized
ttgtttggacttaccactttga

SEQ ID NO: 12181 - DNA, 22 bp, Artificial Sequence
  chemically synthesized
tgtttggacttaccactttgaa

SEQ ID NO: 12182 - DNA, 22 bp, Artificial Sequence
  chemically synthesized
gtttggacttaccactttgaaa

SEQ ID NO: 12183 - DNA, 22 bp, Artificial Sequence
  chemically synthesized
tttggacttaccactttgaaat

SEQ ID NO: 12184 - DNA, 22 bp, Artificial Sequence
  chemically synthesized
ggacttaccactttgaaatcaa

SEQ ID NO: 12185 - DNA, 22 bp, Artificial Sequence
  chemically synthesized
gacttaccactttgaaatcaaa

SEQ ID NO: 12186 - DNA, 22 bp, Artificial Sequence
  chemically synthesized
accactttgaaatcaaaatggg

SEQ ID NO: 12187 - DNA, 22 bp, Artificial Sequence
  chemically synthesized
ccactttgaaatcaaaatggga

SEQ ID NO: 12188 - DNA, 22 bp, Artificial Sequence
  chemically synthesized
tgaaatcaaaatgggaaacaaa

SEQ ID NO: 12189 - DNA, 22 bp, Artificial Sequence
  chemically synthesized
gaaatcaaaatgggaaacaaaa

SEQ ID NO: 12190 - DNA, 22 bp, Artificial Sequence
  chemically synthesized
aaatcaaaatgggaaacaaaag

SEQ ID NO: 12191 - DNA, 22 bp, Artificial Sequence
  chemically synthesized
atttacacaaaaagtctgattt

SEQ ID NO: 12192 - DNA, 22 bp, Artificial Sequence
  chemically synthesized
tttacacaaaaagtctgatttt

SEQ ID NO: 12193 - DNA, 22 bp, Artificial Sequence
  chemically synthesized
acacaaaaagtctgattttaag

SEQ ID NO: 12194 - DNA, 22 bp, Artificial Sequence
  chemically synthesized
cacaaaaagtctgattttaaga

SEQ ID NO: 12195 - DNA, 22 bp, Artificial Sequence
  chemically synthesized
attttaagatatatgacatttc

SEQ ID NO: 12196 - DNA, 22 bp, Artificial Sequence
  chemically synthesized
taagatatatgacatttcaagg

SEQ ID NO: 12197 - DNA, 22 bp, Artificial Sequence
  chemically synthesized
aagatatatgacatttcaaggt

SEQ ID NO: 12198 - DNA, 22 bp, Artificial Sequence
  chemically synthesized
agatatatgacatttcaaggtt

SEQ ID NO: 12199 - DNA, 22 bp, Artificial Sequence
  chemically synthesized
caaggtttcagaagtatgtaat

SEQ ID NO: 12200 - DNA, 22 bp, Artificial Sequence
  chemically synthesized
aaggtttcagaagtatgtaatg

SEQ ID NO: 12201 - DNA, 22 bp, Artificial Sequence
  chemically synthesized
cagaagtatgtaatgaggtgtg

SEQ ID NO: 12202 - DNA, 22 bp, Artificial Sequence
  chemically synthesized
agaagtatgtaatgaggtgtgt

SEQ ID NO: 12203 - DNA, 22 bp, Artificial Sequence
  chemically synthesized
taattttttaaattatatatct

SEQ ID NO: 12204 - DNA, 22 bp, Artificial Sequence
  chemically synthesized
attttttaaattatatatcttc

SEQ ID NO: 12205 - DNA, 22 bp, Artificial Sequence
  chemically synthesized
tttaaattatatatcttcaatt

SEQ ID NO: 12206 - DNA, 22 bp, Artificial Sequence
  chemically synthesized
ttaaattatatatcttcaattt

SEQ ID NO: 12207 - DNA, 22 bp, Artificial Sequence
  chemically synthesized
taaattatatatcttcaattta

SEQ ID NO: 12208 - DNA, 22 bp, Artificial Sequence
  chemically synthesized
aaattatatatcttcaatttaa

SEQ ID NO: 12209 - DNA, 22 bp, Artificial Sequence
  chemically synthesized
aattatatatcttcaatttaaa

SEQ ID NO: 12210 - DNA, 22 bp, Artificial Sequence
  chemically synthesized
tatatcttcaatttaaagtttt

SEQ ID NO: 12211 - DNA, 22 bp, Artificial Sequence
  chemically synthesized
caatttaaagttttagttaaaa

SEQ ID NO: 12212 - DNA, 22 bp, Artificial Sequence
  chemically synthesized
aatttaaagttttagttaaaac

SEQ ID NO: 12213 - DNA, 22 bp, Artificial Sequence
  chemically synthesized
aaagttttagttaaaacataaa

SEQ ID NO: 12214 - DNA, 22 bp, Artificial Sequence
  chemically synthesized
aagttttagttaaaacataaag

SEQ ID NO: 12215 - DNA, 22 bp, Artificial Sequence
  chemically synthesized
tagttaaaacataaagattaac

SEQ ID NO: 12216 - DNA, 22 bp, Artificial Sequence
  chemically synthesized
agttaaaacataaagattaacc

SEQ ID NO: 12217 - DNA, 22 bp, Artificial Sequence
  chemically synthesized
gttaaaacataaagattaacct

SEQ ID NO: 12218 - DNA, 22 bp, Artificial Sequence
  chemically synthesized
aaacataaagattaacctttca

SEQ ID NO: 12219 - DNA, 22 bp, Artificial Sequence
  chemically synthesized
acctttcattagcaagctgtta

SEQ ID NO: 12220 - DNA, 22 bp, Artificial Sequence
  chemically synthesized
tcattagcaagctgttagttat

SEQ ID NO: 12221 - DNA, 22 bp, Artificial Sequence
  chemically synthesized
cattagcaagctgttagttatc

SEQ ID NO: 12222 - DNA, 22 bp, Artificial Sequence
  chemically synthesized
attagcaagctgttagttatca

SEQ ID NO: 12223 - DNA, 22 bp, Artificial Sequence
  chemically synthesized
gcaagctgttagttatcaccaa

SEQ ID NO: 12224 - DNA, 22 bp, Artificial Sequence
  chemically synthesized
ttagttatcaccaaagcttttc

SEQ ID NO: 12225 - DNA, 22 bp, Artificial Sequence
  chemically synthesized
gttatcaccaaagcttttcatg

SEQ ID NO: 12226 - DNA, 22 bp, Artificial Sequence
  chemically synthesized
tcaccaaagcttttcatggatt

SEQ ID NO: 12227 - DNA, 22 bp, Artificial Sequence
  chemically synthesized
ttcatggattaggaaaaaatca

SEQ ID NO: 12228 - DNA, 22 bp, Artificial Sequence
  chemically synthesized
tcatggattaggaaaaaatcat

SEQ ID NO: 12229 - DNA, 22 bp, Artificial Sequence
  chemically synthesized
catggattaggaaaaaatcatt

SEQ ID NO: 12230 - DNA, 22 bp, Artificial Sequence
  chemically synthesized
atggattaggaaaaaatcattt

SEQ ID NO: 12231 - DNA, 22 bp, Artificial Sequence
  chemically synthesized
ggaaaaaatcattttgtctcta

SEQ ID NO: 12232 - DNA, 22 bp, Artificial Sequence
  chemically synthesized
tgtctctatgtcaaacatcttg

SEQ ID NO: 12233 - DNA, 22 bp, Artificial Sequence
  chemically synthesized
gtctctatgtcaaacatcttgg

SEQ ID NO: 12234 - DNA, 22 bp, Artificial Sequence
  chemically synthesized
tctctatgtcaaacatcttgga

SEQ ID NO: 12235 - DNA, 22 bp, Artificial Sequence
  chemically synthesized
tatgtcaaacatcttggagttg

SEQ ID NO: 12236 - DNA, 22 bp, Artificial Sequence
  chemically synthesized
tgtcaaacatcttggagttgat

SEQ ID NO: 12237 - DNA, 22 bp, Artificial Sequence
  chemically synthesized
ggagttgatatttggggaaaca

SEQ ID NO: 12238 - DNA, 22 bp, Artificial Sequence
  chemically synthesized
gagttgatatttggggaaacac

SEQ ID NO: 12239 - DNA, 22 bp, Artificial Sequence
  chemically synthesized
atatttggggaaacacaatact

SEQ ID NO: 12240 - DNA, 22 bp, Artificial Sequence
  chemically synthesized
ggggaaacacaatactcagttg

SEQ ID NO: 12241 - DNA, 22 bp, Artificial Sequence
  chemically synthesized
gggaaacacaatactcagttga

SEQ ID NO: 12242 - DNA, 22 bp, Artificial Sequence
  chemically synthesized
agttgagttccctaggggagaa

SEQ ID NO: 12243 - DNA, 22 bp, Artificial Sequence
  chemically synthesized
agttccctaggggagaaaagca

SEQ ID NO: 12244 - DNA, 22 bp, Artificial Sequence
  chemically synthesized
cctaggggagaaaagcaagctt

SEQ ID NO: 12245 - DNA, 22 bp, Artificial Sequence
  chemically synthesized
ggggagaaaagcaagcttaaga

SEQ ID NO: 12246 - DNA, 22 bp, Artificial Sequence
  chemically synthesized
aagaattgacataaagagtagg

SEQ ID NO: 12247 - DNA, 22 bp, Artificial Sequence
  chemically synthesized
agaattgacataaagagtagga

SEQ ID NO: 12248 - DNA, 22 bp, Artificial Sequence
  chemically synthesized
acataaagagtaggaagttagc

SEQ ID NO: 12249 - DNA, 22 bp, Artificial Sequence
  chemically synthesized
gctaatgcaacatatatcactt

SEQ ID NO: 12250 - DNA, 22 bp, Artificial Sequence
  chemically synthesized
atgcaacatatatcactttgtt

SEQ ID NO: 12251 - DNA, 22 bp, Artificial Sequence
  chemically synthesized
tgttttttcacaactacagtga

SEQ ID NO: 12252 - DNA, 22 bp, Artificial Sequence
  chemically synthesized
gttttttcacaactacagtgac

SEQ ID NO: 12253 - DNA, 22 bp, Artificial Sequence
  chemically synthesized
ttttttcacaactacagtgact

SEQ ID NO: 12254 - DNA, 22 bp, Artificial Sequence
  chemically synthesized
tttcacaactacagtgacttta

SEQ ID NO: 12255 - DNA, 22 bp, Artificial Sequence
  chemically synthesized
ttcacaactacagtgactttat

SEQ ID NO: 12256 - DNA, 22 bp, Artificial Sequence
  chemically synthesized
tcacaactacagtgactttatg

SEQ ID NO: 12257 - DNA, 22 bp, Artificial Sequence
  chemically synthesized
cacaactacagtgactttatgt

SEQ ID NO: 12258 - DNA, 22 bp, Artificial Sequence
  chemically synthesized
acaactacagtgactttatgta

SEQ ID NO: 12259 - DNA, 22 bp, Artificial Sequence
  chemically synthesized
cagtgactttatgtatttccca

SEQ ID NO: 12260 - DNA, 22 bp, Artificial Sequence
  chemically synthesized
tatgtatttcccagaggaaggc

SEQ ID NO: 12261 - DNA, 22 bp, Artificial Sequence
  chemically synthesized
atgtatttcccagaggaaggca

SEQ ID NO: 12262 - DNA, 22 bp, Artificial Sequence
  chemically synthesized
tgtatttcccagaggaaggcat

SEQ ID NO: 12263 - DNA, 22 bp, Artificial Sequence
  chemically synthesized
cccagaggaaggcatacaggga

SEQ ID NO: 12264 - DNA, 22 bp, Artificial Sequence
  chemically synthesized
ccagaggaaggcatacagggaa

SEQ ID NO: 12265 - DNA, 22 bp, Artificial Sequence
  chemically synthesized
tcccatttggacaaacagcatg

SEQ ID NO: 12266 - DNA, 22 bp, Artificial Sequence
  chemically synthesized
ggacaaacagcatgttctcaca

SEQ ID NO: 12267 - DNA, 22 bp, Artificial Sequence
  chemically synthesized
gacaaacagcatgttctcacag

SEQ ID NO: 12268 - DNA, 22 bp, Artificial Sequence
  chemically synthesized
tcacaggaagcatttatcacac

SEQ ID NO: 12269 - DNA, 22 bp, Artificial Sequence
  chemically synthesized
acaggaagcatttatcacactt

SEQ ID NO: 12270 - DNA, 22 bp, Artificial Sequence
  chemically synthesized
atcacacttacttgtcaacttt

SEQ ID NO: 12271 - DNA, 22 bp, Artificial Sequence
  chemically synthesized
tcacacttacttgtcaactttc

SEQ ID NO: 12272 - DNA, 22 bp, Artificial Sequence
  chemically synthesized
acttgtcaactttctagaatca

SEQ ID NO: 12273 - DNA, 22 bp, Artificial Sequence
  chemically synthesized
cttgtcaactttctagaatcaa

SEQ ID NO: 12274 - DNA, 22 bp, Artificial Sequence
  chemically synthesized
gtcaactttctagaatcaaatc

SEQ ID NO: 12275 - DNA, 22 bp, Artificial Sequence
  chemically synthesized
tcaactttctagaatcaaatct

SEQ ID NO: 12276 - DNA, 22 bp, Artificial Sequence
  chemically synthesized
tctagaatcaaatctagtagct

SEQ ID NO: 12277 - DNA, 22 bp, Artificial Sequence
  chemically synthesized
ctagaatcaaatctagtagctg

SEQ ID NO: 12278 - DNA, 22 bp, Artificial Sequence
  chemically synthesized
tagaatcaaatctagtagctga

SEQ ID NO: 12279 - DNA, 22 bp, Artificial Sequence
  chemically synthesized
gaatcaaatctagtagctgaca

SEQ ID NO: 12280 - DNA, 22 bp, Artificial Sequence
  chemically synthesized
gtagctgacagtaccaggatca

SEQ ID NO: 12281 - DNA, 22 bp, Artificial Sequence
  chemically synthesized
acagtaccaggatcaggggtgc

SEQ ID NO: 12282 - DNA, 22 bp, Artificial Sequence
  chemically synthesized
agcacccccagaaagctgactg

SEQ ID NO: 12283 - DNA, 22 bp, Artificial Sequence
  chemically synthesized
actggccctgtggttcccactc

SEQ ID NO: 12284 - DNA, 22 bp, Artificial Sequence
  chemically synthesized
gccctgtggttcccactccaga

SEQ ID NO: 12285 - DNA, 22 bp, Artificial Sequence
  chemically synthesized
tggttcccactccagacatgat

SEQ ID NO: 12286 - DNA, 22 bp, Artificial Sequence
  chemically synthesized
ccactccagacatgatgtcagc

SEQ ID NO: 12287 - DNA, 22 bp, Artificial Sequence
  chemically synthesized
cagacatgatgtcagctgtgaa

SEQ ID NO: 12288 - DNA, 22 bp, Artificial Sequence
  chemically synthesized
tgaaatcagactgaaatgctga

SEQ ID NO: 12289 - DNA, 22 bp, Artificial Sequence
  chemically synthesized
aaatgctgaaataacgataaaa

SEQ ID NO: 12290 - DNA, 22 bp, Artificial Sequence
  chemically synthesized
aaataacgataaaaaaaaatac

SEQ ID NO: 12291 - DNA, 22 bp, Artificial Sequence
  chemically synthesized
aactagcaaagtgagtaaagtc

SEQ ID NO: 12292 - DNA, 22 bp, Artificial Sequence
  chemically synthesized
gcaaagtgagtaaagtcaaggg

SEQ ID NO: 12293 - DNA, 22 bp, Artificial Sequence
  chemically synthesized
gttggaaaactcacaaagcagg

SEQ ID NO: 12294 - DNA, 22 bp, Artificial Sequence
  chemically synthesized
ttggaaaactcacaaagcagga

SEQ ID NO: 12295 - DNA, 22 bp, Artificial Sequence
  chemically synthesized
gaaaactcacaaagcaggacat

SEQ ID NO: 12296 - DNA, 22 bp, Artificial Sequence
  chemically synthesized
acaaagcaggacataaagcaag

SEQ ID NO: 12297 - DNA, 22 bp, Artificial Sequence
  chemically synthesized
gatatatctcattagtgtgaca

SEQ ID NO: 12298 - DNA, 22 bp, Artificial Sequence
  chemically synthesized
attagtgtgacatctgggagga

SEQ ID NO: 12299 - DNA, 22 bp, Artificial Sequence
  chemically synthesized
gtgtgacatctgggaggacaaa

SEQ ID NO: 12300 - DNA, 22 bp, Artificial Sequence
  chemically synthesized
ggaggacaaagcatccaaaccc

SEQ ID NO: 12301 - DNA, 22 bp, Artificial Sequence
  chemically synthesized
tcttctatataagtggtgagat

SEQ ID NO: 12302 - DNA, 22 bp, Artificial Sequence
  chemically synthesized
cttctatataagtggtgagatg

SEQ ID NO: 12303 - DNA, 22 bp, Artificial Sequence
  chemically synthesized
ttctatataagtggtgagatga

SEQ ID NO: 12304 - DNA, 22 bp, Artificial Sequence
  chemically synthesized
ctatataagtggtgagatgatg

SEQ ID NO: 12305 - DNA, 22 bp, Artificial Sequence
  chemically synthesized
tatataagtggtgagatgatga

SEQ ID NO: 12306 - DNA, 22 bp, Artificial Sequence
  chemically synthesized
tataagtggtgagatgatgaag

SEQ ID NO: 12307 - DNA, 22 bp, Artificial Sequence
  chemically synthesized
taagagggcttctgcccccttg

SEQ ID NO: 12308 - DNA, 22 bp, Artificial Sequence
  chemically synthesized
ctgcccccttgaagacttcaga

SEQ ID NO: 12309 - DNA, 22 bp, Artificial Sequence
  chemically synthesized
tgcccccttgaagacttcagat

SEQ ID NO: 12310 - DNA, 22 bp, Artificial Sequence
  chemically synthesized
cccccttgaagacttcagatgc

SEQ ID NO: 12311 - DNA, 22 bp, Artificial Sequence
  chemically synthesized
gaagacttcagatgctggggaa

SEQ ID NO: 12312 - DNA, 22 bp, Artificial Sequence
  chemically synthesized
aagacttcagatgctggggaaa

SEQ ID NO: 12313 - DNA, 22 bp, Artificial Sequence
  chemically synthesized
cagatgctggggaaaggataga

SEQ ID NO: 12314 - DNA, 22 bp, Artificial Sequence
  chemically synthesized
agatgctggggaaaggatagat

SEQ ID NO: 12315 - DNA, 22 bp, Artificial Sequence
  chemically synthesized
gggaaaggatagataagaataa

SEQ ID NO: 12316 - DNA, 22 bp, Artificial Sequence
  chemically synthesized
ttggagcctgggaaataatgac

SEQ ID NO: 12317 - DNA, 22 bp, Artificial Sequence
  chemically synthesized
tggagcctgggaaataatgact

SEQ ID NO: 12318 - DNA, 22 bp, Artificial Sequence
  chemically synthesized
ggagcctgggaaataatgacta

SEQ ID NO: 12319 - DNA, 22 bp, Artificial Sequence
  chemically synthesized
gagcctgggaaataatgactag

SEQ ID NO: 12320 - DNA, 22 bp, Artificial Sequence
  chemically synthesized
ggaaataatgactagcgataaa

SEQ ID NO: 12321 - DNA, 22 bp, Artificial Sequence
  chemically synthesized
gcgataaacctgaagggaagtt

SEQ ID NO: 12322 - DNA, 22 bp, Artificial Sequence
  chemically synthesized
aagggaagttaagtatacgatc

SEQ ID NO: 12323 - DNA, 22 bp, Artificial Sequence
  chemically synthesized
agtatacgatccccagataata

SEQ ID NO: 12324 - DNA, 22 bp, Artificial Sequence
  chemically synthesized
aggagaaaggcaatgtgattct

SEQ ID NO: 12325 - DNA, 22 bp, Artificial Sequence
  chemically synthesized
tgcagccattgtagccagagat

SEQ ID NO: 12326 - DNA, 22 bp, Artificial Sequence
  chemically synthesized
cagccattgtagccagagataa

SEQ ID NO: 12327 - DNA, 22 bp, Artificial Sequence
  chemically synthesized
tagccagagataataagccctt

SEQ ID NO: 12328 - DNA, 22 bp, Artificial Sequence
  chemically synthesized
gaggaaggggccaggggaattt

SEQ ID NO: 12329 - DNA, 22 bp, Artificial Sequence
  chemically synthesized
aggaaggggccaggggaatttt

SEQ ID NO: 12330 - DNA, 22 bp, Artificial Sequence
  chemically synthesized
ttctaaggatagacagtattaa

SEQ ID NO: 12331 - DNA, 22 bp, Artificial Sequence
  chemically synthesized
tctaaggatagacagtattaat

SEQ ID NO: 12332 - DNA, 22 bp, Artificial Sequence
  chemically synthesized
ctaaggatagacagtattaatg

SEQ ID NO: 12333 - DNA, 22 bp, Artificial Sequence
  chemically synthesized
taaggatagacagtattaatgc

SEQ ID NO: 12334 - DNA, 22 bp, Artificial Sequence
  chemically synthesized
aggatagacagtattaatgcag

SEQ ID NO: 12335 - DNA, 22 bp, Artificial Sequence
  chemically synthesized
atgcagcactctcttctgctat

SEQ ID NO: 12336 - DNA, 22 bp, Artificial Sequence
  chemically synthesized
tcttctgctattaaactctcat

SEQ ID NO: 12337 - DNA, 22 bp, Artificial Sequence
  chemically synthesized
ttctgctattaaactctcattg

SEQ ID NO: 12338 - DNA, 22 bp, Artificial Sequence
  chemically synthesized
ctgctattaaactctcattggc

SEQ ID NO: 12339 - DNA, 22 bp, Artificial Sequence
  chemically synthesized
tgctattaaactctcattggct

SEQ ID NO: 12340 - DNA, 22 bp, Artificial Sequence
  chemically synthesized
ctattaaactctcattggcttc

SEQ ID NO: 12341 - DNA, 22 bp, Artificial Sequence
  chemically synthesized
ttaaactctcattggcttctaa

SEQ ID NO: 12342 - DNA, 22 bp, Artificial Sequence
  chemically synthesized
aactctcattggcttctaaaag

SEQ ID NO: 12343 - DNA, 22 bp, Artificial Sequence
  chemically synthesized
tcattggcttctaaaaggagtt

SEQ ID NO: 12344 - DNA, 22 bp, Artificial Sequence
  chemically synthesized
attggcttctaaaaggagtttc

SEQ ID NO: 12345 - DNA, 22 bp, Artificial Sequence
  chemically synthesized
gcttctaaaaggagtttcggtg

SEQ ID NO: 12346 - DNA, 22 bp, Artificial Sequence
  chemically synthesized
ctaaaaggagtttcggtgagtg

SEQ ID NO: 12347 - DNA, 22 bp, Artificial Sequence
  chemically synthesized
taaaaggagtttcggtgagtga

SEQ ID NO: 12348 - DNA, 22 bp, Artificial Sequence
  chemically synthesized
aaaggagtttcggtgagtgatt

SEQ ID NO: 12349 - DNA, 22 bp, Artificial Sequence
  chemically synthesized
cggtgagtgatttgctgagatg

SEQ ID NO: 12350 - DNA, 22 bp, Artificial Sequence
  chemically synthesized
ggtgagtgatttgctgagatgt

SEQ ID NO: 12351 - DNA, 22 bp, Artificial Sequence
  chemically synthesized
gctgagatgttgcattttcatg

SEQ ID NO: 12352 - DNA, 22 bp, Artificial Sequence
  chemically synthesized
ctgagatgttgcattttcatgg

SEQ ID NO: 12353 - DNA, 22 bp, Artificial Sequence
  chemically synthesized
agatgttgcattttcatggctg

SEQ ID NO: 12354 - DNA, 22 bp, Artificial Sequence
  chemically synthesized
cattttcatggctgctgccttt

SEQ ID NO: 12355 - DNA, 22 bp, Artificial Sequence
  chemically synthesized
tcatggctgctgcctttaggta

SEQ ID NO: 12356 - DNA, 22 bp, Artificial Sequence
  chemically synthesized
catggctgctgcctttaggtat

SEQ ID NO: 12357 - DNA, 22 bp, Artificial Sequence
  chemically synthesized
atggctgctgcctttaggtatt

SEQ ID NO: 12358 - DNA, 22 bp, Artificial Sequence
  chemically synthesized
ctgcctttaggtattattgcaa

SEQ ID NO: 12359 - DNA, 22 bp, Artificial Sequence
  chemically synthesized
cctttaggtattattgcaacag

SEQ ID NO: 12360 - DNA, 22 bp, Artificial Sequence
  chemically synthesized
taggtattattgcaacagtttg

SEQ ID NO: 12361 - DNA, 22 bp, Artificial Sequence
  chemically synthesized
aggtattattgcaacagtttgg

SEQ ID NO: 12362 - DNA, 22 bp, Artificial Sequence
  chemically synthesized
ggtattattgcaacagtttgga

SEQ ID NO: 12363 - DNA, 22 bp, Artificial Sequence
  chemically synthesized
ttgcaacagtttggaattttga

SEQ ID NO: 12364 - DNA, 22 bp, Artificial Sequence
  chemically synthesized
caacagtttggaattttgaaat

SEQ ID NO: 12365 - DNA, 22 bp, Artificial Sequence
  chemically synthesized
ggaattttgaaattaaaacagt

SEQ ID NO: 12366 - DNA, 22 bp, Artificial Sequence
  chemically synthesized
gaattttgaaattaaaacagtt

SEQ ID NO: 12367 - DNA, 22 bp, Artificial Sequence
  chemically synthesized
tgaaattaaaacagttctgtaa

SEQ ID NO: 12368 - DNA, 22 bp, Artificial Sequence
  chemically synthesized
gaaattaaaacagttctgtaaa

SEQ ID NO: 12369 - DNA, 22 bp, Artificial Sequence
  chemically synthesized
aaattaaaacagttctgtaaaa

SEQ ID NO: 12370 - DNA, 22 bp, Artificial Sequence
  chemically synthesized
aaacagttctgtaaaaccagtt

SEQ ID NO: 12371 - DNA, 22 bp, Artificial Sequence
  chemically synthesized
tgtaaaaccagtttagttttgt

SEQ ID NO: 12372 - DNA, 22 bp, Artificial Sequence
  chemically synthesized
taaaaccagtttagttttgtaa

SEQ ID NO: 12373 - DNA, 22 bp, Artificial Sequence
  chemically synthesized
agttttgtaaagtgtatgcatc

SEQ ID NO: 12374 - DNA, 22 bp, Artificial Sequence
  chemically synthesized
gttttgtaaagtgtatgcatca

SEQ ID NO: 12375 - DNA, 22 bp, Artificial Sequence
  chemically synthesized
tgtaaagtgtatgcatcaaaga

SEQ ID NO: 12376 - DNA, 22 bp, Artificial Sequence
  chemically synthesized
gtaaagtgtatgcatcaaagat

SEQ ID NO: 12377 - DNA, 22 bp, Artificial Sequence
  chemically synthesized
taaagtgtatgcatcaaagatg

SEQ ID NO: 12378 - DNA, 22 bp, Artificial Sequence
  chemically synthesized
cattcagacattactgagttac

SEQ ID NO: 12379 - DNA, 22 bp, Artificial Sequence
  chemically synthesized
attcagacattactgagttaca

SEQ ID NO: 12380 - DNA, 22 bp, Artificial Sequence
  chemically synthesized
agacattactgagttacaacta

SEQ ID NO: 12381 - DNA, 22 bp, Artificial Sequence
  chemically synthesized
ctgagttacaactatggtgcca

SEQ ID NO: 12382 - DNA, 22 bp, Artificial Sequence
  chemically synthesized
agttacaactatggtgccaggt

SEQ ID NO: 12383 - DNA, 22 bp, Artificial Sequence
  chemically synthesized
caactatggtgccaggtactgt

SEQ ID NO: 12384 - DNA, 22 bp, Artificial Sequence
  chemically synthesized
tggtgccaggtactgtgtcagg

SEQ ID NO: 12385 - DNA, 22 bp, Artificial Sequence
  chemically synthesized
tgtcagggtactaggggtatgg

SEQ ID NO: 12386 - DNA, 22 bp, Artificial Sequence
  chemically synthesized
ggggtatggggataaaccagac

SEQ ID NO: 12387 - DNA, 22 bp, Artificial Sequence
  chemically synthesized
cctctttgatctaaagcagcat

SEQ ID NO: 12388 - DNA, 22 bp, Artificial Sequence
  chemically synthesized
tttgatctaaagcagcatgagg

SEQ ID NO: 12389 - DNA, 22 bp, Artificial Sequence
  chemically synthesized
tgatctaaagcagcatgaggcc

SEQ ID NO: 12390 - DNA, 22 bp, Artificial Sequence
  chemically synthesized
gatctaaagcagcatgaggcca

SEQ ID NO: 12391 - DNA, 22 bp, Artificial Sequence
  chemically synthesized
atctaaagcagcatgaggccag

SEQ ID NO: 12392 - DNA, 22 bp, Artificial Sequence
  chemically synthesized
aagcagcatgaggccaggtgag

SEQ ID NO: 12393 - DNA, 22 bp, Artificial Sequence
  chemically synthesized
caatataatgtgataaaatgtg

SEQ ID NO: 12394 - DNA, 22 bp, Artificial Sequence
  chemically synthesized
aatataatgtgataaaatgtgc

SEQ ID NO: 12395 - DNA, 22 bp, Artificial Sequence
  chemically synthesized
ggtactaagggatcatagagaa

SEQ ID NO: 12396 - DNA, 22 bp, Artificial Sequence
  chemically synthesized
agggatcatagagaaaggaaca

SEQ ID NO: 12397 - DNA, 22 bp, Artificial Sequence
  chemically synthesized
aatggggaaacaattgatagag

SEQ ID NO: 12398 - DNA, 22 bp, Artificial Sequence
  chemically synthesized
atagagagagaatattttcatc

SEQ ID NO: 12399 - DNA, 22 bp, Artificial Sequence
  chemically synthesized
tcatctgggtcttaaaagatga

SEQ ID NO: 12400 - DNA, 22 bp, Artificial Sequence
  chemically synthesized
catctgggtcttaaaagatgag

SEQ ID NO: 12401 - DNA, 22 bp, Artificial Sequence
  chemically synthesized
atctgggtcttaaaagatgagt

SEQ ID NO: 12402 - DNA, 22 bp, Artificial Sequence
  chemically synthesized
ggtcttaaaagatgagtaggcg

SEQ ID NO: 12403 - DNA, 22 bp, Artificial Sequence
  chemically synthesized
aaaagatgagtaggcgttctct

SEQ ID NO: 12404 - DNA, 22 bp, Artificial Sequence
  chemically synthesized
aaagatgagtaggcgttctctc

SEQ ID NO: 12405 - DNA, 22 bp, Artificial Sequence
  chemically synthesized
tctctctttaaatgtctgatat

SEQ ID NO: 12406 - DNA, 22 bp, Artificial Sequence
  chemically synthesized
tctctttaaatgtctgatataa

SEQ ID NO: 12407 - DNA, 22 bp, Artificial Sequence
  chemically synthesized
tctttaaatgtctgatataagg

SEQ ID NO: 12408 - DNA, 22 bp, Artificial Sequence
  chemically synthesized
tttaaatgtctgatataagggc

SEQ ID NO: 12409 - DNA, 22 bp, Artificial Sequence
  chemically synthesized
taaatgtctgatataagggcat

SEQ ID NO: 12410 - DNA, 22 bp, Artificial Sequence
  chemically synthesized
aaatgtctgatataagggcatt

SEQ ID NO: 12411 - DNA, 22 bp, Artificial Sequence
  chemically synthesized
aatgtctgatataagggcattt

SEQ ID NO: 12412 - DNA, 22 bp, Artificial Sequence
  chemically synthesized
atataagggcattttatgcaaa

SEQ ID NO: 12413 - DNA, 22 bp, Artificial Sequence
  chemically synthesized
tatgcaaagaggatcactcgtg

SEQ ID NO: 12414 - DNA, 22 bp, Artificial Sequence
  chemically synthesized
atgcaaagaggatcactcgtgc

SEQ ID NO: 12415 - DNA, 22 bp, Artificial Sequence
  chemically synthesized
tgcaaagaggatcactcgtgca

SEQ ID NO: 12416 - DNA, 22 bp, Artificial Sequence
  chemically synthesized
gtgcaaagactcagatttgcaa

SEQ ID NO: 12417 - DNA, 22 bp, Artificial Sequence
  chemically synthesized
agatttgcaagaacgtgaggta

SEQ ID NO: 12418 - DNA, 22 bp, Artificial Sequence
  chemically synthesized
gcaagaacgtgaggtatttcag

SEQ ID NO: 12419 - DNA, 22 bp, Artificial Sequence
  chemically synthesized
caagaacgtgaggtatttcagg

SEQ ID NO: 12420 - DNA, 22 bp, Artificial Sequence
  chemically synthesized
caggagttttgtatggttccat

SEQ ID NO: 12421 - DNA, 22 bp, Artificial Sequence
  chemically synthesized
aggagttttgtatggttccata

SEQ ID NO: 12422 - DNA, 22 bp, Artificial Sequence
  chemically synthesized
tgtatggttccatatggactat

SEQ ID NO: 12423 - DNA, 22 bp, Artificial Sequence
  chemically synthesized
gtatggttccatatggactatg

SEQ ID NO: 12424 - DNA, 22 bp, Artificial Sequence
  chemically synthesized
tatggttccatatggactatga

SEQ ID NO: 12425 - DNA, 22 bp, Artificial Sequence
  chemically synthesized
catatggactatgacaagtgag

SEQ ID NO: 12426 - DNA, 22 bp, Artificial Sequence
  chemically synthesized
tgacaagtgagacaggtaaact

SEQ ID NO: 12427 - DNA, 22 bp, Artificial Sequence
  chemically synthesized
ggcagagctggtcatcagataa

SEQ ID NO: 12428 - DNA, 22 bp, Artificial Sequence
  chemically synthesized
gtcatcagataatgaagtcatt

SEQ ID NO: 12429 - DNA, 22 bp, Artificial Sequence
  chemically synthesized
acctaaggagattggacaataa

SEQ ID NO: 12430 - DNA, 22 bp, Artificial Sequence
  chemically synthesized
aggagattggacaataaaatgc

SEQ ID NO: 12431 - DNA, 22 bp, Artificial Sequence
  chemically synthesized
gacaataaaatgcaatatggag

SEQ ID NO: 12432 - DNA, 22 bp, Artificial Sequence
  chemically synthesized
atggctgatttaggatgcccag

SEQ ID NO: 12433 - DNA, 22 bp, Artificial Sequence
  chemically synthesized
atttaggatgcccagtctggca

SEQ ID NO: 12434 - DNA, 22 bp, Artificial Sequence
  chemically synthesized
aggatgcccagtctggcaacac

SEQ ID NO: 12435 - DNA, 22 bp, Artificial Sequence
  chemically synthesized
ggatgcccagtctggcaacacg

SEQ ID NO: 12436 - DNA, 22 bp, Artificial Sequence
  chemically synthesized
gcaacacgctaatgaaatgata

SEQ ID NO: 12437 - DNA, 22 bp, Artificial Sequence
  chemically synthesized
atgaaatgatagtgggggaggg

SEQ ID NO: 12438 - DNA, 22 bp, Artificial Sequence
  chemically synthesized
ggagagagcagtcctgagacta

SEQ ID NO: 12439 - DNA, 22 bp, Artificial Sequence
  chemically synthesized
agactattgcaattatctgcgg

SEQ ID NO: 12440 - DNA, 22 bp, Artificial Sequence
  chemically synthesized
ttgcaattatctgcgggagaca

SEQ ID NO: 12441 - DNA, 22 bp, Artificial Sequence
  chemically synthesized
caattatctgcgggagacataa

SEQ ID NO: 12442 - DNA, 22 bp, Artificial Sequence
  chemically synthesized
tctgcgggagacataaaggcta

SEQ ID NO: 12443 - DNA, 22 bp, Artificial Sequence
  chemically synthesized
cgggagacataaaggctagaac

SEQ ID NO: 12444 - DNA, 22 bp, Artificial Sequence
  chemically synthesized
gaacctgaacagtagcagtaca

SEQ ID NO: 12445 - DNA, 22 bp, Artificial Sequence
  chemically synthesized
aacagtagcagtacaaaaaaag

SEQ ID NO: 12446 - DNA, 22 bp, Artificial Sequence
  chemically synthesized
aaatgatattaaggaagtagaa

SEQ ID NO: 12447 - DNA, 22 bp, Artificial Sequence
  chemically synthesized
aggaagtagaagtggtatgact

SEQ ID NO: 12448 - DNA, 22 bp, Artificial Sequence
  chemically synthesized
aaccatctgggtatggaagggg

SEQ ID NO: 12449 - DNA, 22 bp, Artificial Sequence
  chemically synthesized
accatctgggtatggaagggga

SEQ ID NO: 12450 - DNA, 22 bp, Artificial Sequence
  chemically synthesized
ggtatggaaggggaaatggcta

SEQ ID NO: 12451 - DNA, 22 bp, Artificial Sequence
  chemically synthesized
gagtcttggggactttgtgttt

SEQ ID NO: 12452 - DNA, 22 bp, Artificial Sequence
  chemically synthesized
ggggactttgtgtttgatgtga

SEQ ID NO: 12453 - DNA, 22 bp, Artificial Sequence
  chemically synthesized
gggactttgtgtttgatgtgat

SEQ ID NO: 12454 - DNA, 22 bp, Artificial Sequence
  chemically synthesized
tgtgtttgatgtgattatggac

SEQ ID NO: 12455 - DNA, 22 bp, Artificial Sequence
  chemically synthesized
gtgtttgatgtgattatggacc

SEQ ID NO: 12456 - DNA, 22 bp, Artificial Sequence
  chemically synthesized
tgtttgatgtgattatggacca

SEQ ID NO: 12457 - DNA, 22 bp, Artificial Sequence
  chemically synthesized
gatgtgattatggaccacagaa

SEQ ID NO: 12458 - DNA, 22 bp, Artificial Sequence
  chemically synthesized
atgtgattatggaccacagaat

SEQ ID NO: 12459 - DNA, 22 bp, Artificial Sequence
  chemically synthesized
tggaccacagaataatgtctaa

SEQ ID NO: 12460 - DNA, 22 bp, Artificial Sequence
  chemically synthesized
agagaactggctctttagtctg

SEQ ID NO: 12461 - DNA, 22 bp, Artificial Sequence
  chemically synthesized
gctctttagtctgactgccaga

SEQ ID NO: 12462 - DNA, 22 bp, Artificial Sequence
  chemically synthesized
tttagtctgactgccagagtct

SEQ ID NO: 12463 - DNA, 22 bp, Artificial Sequence
  chemically synthesized
tagtctgactgccagagtctga

SEQ ID NO: 12464 - DNA, 22 bp, Artificial Sequence
  chemically synthesized
agtctgactgccagagtctgaa

SEQ ID NO: 12465 - DNA, 22 bp, Artificial Sequence
  chemically synthesized
gtctgactgccagagtctgaat

SEQ ID NO: 12466 - DNA, 22 bp, Artificial Sequence
  chemically synthesized
actgccagagtctgaatcctga

SEQ ID NO: 12467 - DNA, 22 bp, Artificial Sequence
  chemically synthesized
ccagagtctgaatcctgaatgt

SEQ ID NO: 12468 - DNA, 22 bp, Artificial Sequence
  chemically synthesized
aatcctgaatgttttagtatgt

SEQ ID NO: 12469 - DNA, 22 bp, Artificial Sequence
  chemically synthesized
aatgttttagtatgttaccttg

SEQ ID NO: 12470 - DNA, 22 bp, Artificial Sequence
  chemically synthesized
tagtatgttaccttgggcaaag

SEQ ID NO: 12471 - DNA, 22 bp, Artificial Sequence
  chemically synthesized
agtatgttaccttgggcaaagc

SEQ ID NO: 12472 - DNA, 22 bp, Artificial Sequence
  chemically synthesized
gtatgttaccttgggcaaagcc

SEQ ID NO: 12473 - DNA, 22 bp, Artificial Sequence
  chemically synthesized
ccttgggcaaagcccttagcct

SEQ ID NO: 12474 - DNA, 22 bp, Artificial Sequence
  chemically synthesized
gggcaaagcccttagcctctat

SEQ ID NO: 12475 - DNA, 22 bp, Artificial Sequence
  chemically synthesized
ggcaaagcccttagcctctatg

SEQ ID NO: 12476 - DNA, 22 bp, Artificial Sequence
  chemically synthesized
agcctctatgaatctatcttcc

SEQ ID NO: 12477 - DNA, 22 bp, Artificial Sequence
  chemically synthesized
gcctctatgaatctatcttcct

SEQ ID NO: 12478 - DNA, 22 bp, Artificial Sequence
  chemically synthesized
tatgaatctatcttcctcattc

SEQ ID NO: 12479 - DNA, 22 bp, Artificial Sequence
  chemically synthesized
tgaatctatcttcctcattcat

SEQ ID NO: 12480 - DNA, 22 bp, Artificial Sequence
  chemically synthesized
tcttcctcattcataaaaataa

SEQ ID NO: 12481 - DNA, 22 bp, Artificial Sequence
  chemically synthesized
cctcattcataaaaataagatg

SEQ ID NO: 12482 - DNA, 22 bp, Artificial Sequence
  chemically synthesized
ctcattcataaaaataagatga

SEQ ID NO: 12483 - DNA, 22 bp, Artificial Sequence
  chemically synthesized
attcataaaaataagatgacag

SEQ ID NO: 12484 - DNA, 22 bp, Artificial Sequence
  chemically synthesized
ataaaaataagatgacagtgcc

SEQ ID NO: 12485 - DNA, 22 bp, Artificial Sequence
  chemically synthesized
tctcgtgggacttttgtgagga

SEQ ID NO: 12486 - DNA, 22 bp, Artificial Sequence
  chemically synthesized
gtgggacttttgtgaggatgaa

SEQ ID NO: 12487 - DNA, 22 bp, Artificial Sequence
  chemically synthesized
ttgtgaggatgaagtgagataa

SEQ ID NO: 12488 - DNA, 22 bp, Artificial Sequence
  chemically synthesized
tgtgaggatgaagtgagataat

SEQ ID NO: 12489 - DNA, 22 bp, Artificial Sequence
  chemically synthesized
gtgaggatgaagtgagataatg

SEQ ID NO: 12490 - DNA, 22 bp, Artificial Sequence
  chemically synthesized
tgaggatgaagtgagataatgg

SEQ ID NO: 12491 - DNA, 22 bp, Artificial Sequence
  chemically synthesized
ctgagcacagtgtccaacacag

SEQ ID NO: 12492 - DNA, 22 bp, Artificial Sequence
  chemically synthesized
agcacagtgtccaacacagcag

SEQ ID NO: 12493 - DNA, 22 bp, Artificial Sequence
  chemically synthesized
catatacattagctattactgg

SEQ ID NO: 12494 - DNA, 22 bp, Artificial Sequence
  chemically synthesized
gctattactggctacattatga

SEQ ID NO: 12495 - DNA, 22 bp, Artificial Sequence
  chemically synthesized
ttactggctacattatgatata

SEQ ID NO: 12496 - DNA, 22 bp, Artificial Sequence
  chemically synthesized
ctggctacattatgatatacag

SEQ ID NO: 12497 - DNA, 22 bp, Artificial Sequence
  chemically synthesized
gctacattatgatatacagtta

SEQ ID NO: 12498 - DNA, 22 bp, Artificial Sequence
  chemically synthesized
cattatgatatacagttaggga

SEQ ID NO: 12499 - DNA, 22 bp, Artificial Sequence
  chemically synthesized
tgatatacagttagggagttgg

SEQ ID NO: 12500 - DNA, 22 bp, Artificial Sequence
  chemically synthesized
gggagttggaaagataatctga

SEQ ID NO: 12501 - DNA, 22 bp, Artificial Sequence
  chemically synthesized
gaaagataatctgaaattcagg

SEQ ID NO: 12502 - DNA, 22 bp, Artificial Sequence
  chemically synthesized
aaattcaggagacgtatctgac

SEQ ID NO: 12503 - DNA, 22 bp, Artificial Sequence
  chemically synthesized
aggagacgtatctgactatagg

SEQ ID NO: 12504 - DNA, 22 bp, Artificial Sequence
  chemically synthesized
actataggtgagtatttggaac

SEQ ID NO: 12505 - DNA, 22 bp, Artificial Sequence
  chemically synthesized
taggtgagtatttggaactcat

SEQ ID NO: 12506 - DNA, 22 bp, Artificial Sequence
  chemically synthesized
ggaactcattgttctgtaaaca

SEQ ID NO: 12507 - DNA, 22 bp, Artificial Sequence
  chemically synthesized
gaactcattgttctgtaaacag

SEQ ID NO: 12508 - DNA, 22 bp, Artificial Sequence
  chemically synthesized
attgttctgtaaacagtagtta

SEQ ID NO: 12509 - DNA, 22 bp, Artificial Sequence
  chemically synthesized
ttctgtaaacagtagttacagc

SEQ ID NO: 12510 - DNA, 22 bp, Artificial Sequence
  chemically synthesized
tgtaaacagtagttacagccac

SEQ ID NO: 12511 - DNA, 22 bp, Artificial Sequence
  chemically synthesized
taaacagtagttacagccacgt

SEQ ID NO: 12512 - DNA, 22 bp, Artificial Sequence
  chemically synthesized
cagccacgtgtgtgggcatctg

SEQ ID NO: 12513 - DNA, 22 bp, Artificial Sequence
  chemically synthesized
gagagtgagcatggatattgtg

SEQ ID NO: 12514 - DNA, 22 bp, Artificial Sequence
  chemically synthesized
tgatacctagtacagtgcctgg

SEQ ID NO: 12515 - DNA, 22 bp, Artificial Sequence
  chemically synthesized
gtacagtgcctggcagtagtgg

SEQ ID NO: 12516 - DNA, 22 bp, Artificial Sequence
  chemically synthesized
gcagtagtggttgtatgctcag

SEQ ID NO: 12517 - DNA, 22 bp, Artificial Sequence
  chemically synthesized
tatgctcagtaaattttgttga

SEQ ID NO: 12518 - DNA, 22 bp, Artificial Sequence
  chemically synthesized
agtaaattttgttgacagggtc

SEQ ID NO: 12519 - DNA, 22 bp, Artificial Sequence
  chemically synthesized
tgttgacagggtcagggccgga

SEQ ID NO: 12520 - DNA, 22 bp, Artificial Sequence
  chemically synthesized
gttgacagggtcagggccggac

SEQ ID NO: 12521 - DNA, 22 bp, Artificial Sequence
  chemically synthesized
ttgacagggtcagggccggact

SEQ ID NO: 12522 - DNA, 22 bp, Artificial Sequence
  chemically synthesized
acagggtcagggccggactaga

SEQ ID NO: 12523 - DNA, 22 bp, Artificial Sequence
  chemically synthesized
gactgtggtaagcaaggcctgt

SEQ ID NO: 12524 - DNA, 22 bp, Artificial Sequence
  chemically synthesized
tggtaagcaaggcctgtagggc

SEQ ID NO: 12525 - DNA, 22 bp, Artificial Sequence
  chemically synthesized
tagggcataaatatacttgtat

SEQ ID NO: 12526 - DNA, 22 bp, Artificial Sequence
  chemically synthesized
gtatgccccgagaagtgaggac

SEQ ID NO: 12527 - DNA, 22 bp, Artificial Sequence
  chemically synthesized
tatgccccgagaagtgaggacc

SEQ ID NO: 12528 - DNA, 22 bp, Artificial Sequence
  chemically synthesized
ttaaatattgtgccctacatgc

SEQ ID NO: 12529 - DNA, 22 bp, Artificial Sequence
  chemically synthesized
aaatattgtgccctacatgcct

SEQ ID NO: 12530 - DNA, 22 bp, Artificial Sequence
  chemically synthesized
aatattgtgccctacatgcctt

SEQ ID NO: 12531 - DNA, 22 bp, Artificial Sequence
  chemically synthesized
tgccctacatgccttgtttggt

SEQ ID NO: 12532 - DNA, 22 bp, Artificial Sequence
  chemically synthesized
catgccttgtttggttcactct

SEQ ID NO: 12533 - DNA, 22 bp, Artificial Sequence
  chemically synthesized
gtttggttcactcttgtcccag

SEQ ID NO: 12534 - DNA, 22 bp, Artificial Sequence
  chemically synthesized
tttggttcactcttgtcccagc

SEQ ID NO: 12535 - DNA, 22 bp, Artificial Sequence
  chemically synthesized
ggttcactcttgtcccagccct

SEQ ID NO: 12536 - DNA, 22 bp, Artificial Sequence
  chemically synthesized
gttcactcttgtcccagcccta

SEQ ID NO: 12537 - DNA, 22 bp, Artificial Sequence
  chemically synthesized
actcttgtcccagccctagcaa

SEQ ID NO: 12538 - DNA, 22 bp, Artificial Sequence
  chemically synthesized
ttgtcccagccctagcaagtat

SEQ ID NO: 12539 - DNA, 22 bp, Artificial Sequence
  chemically synthesized
gtcccagccctagcaagtatat

SEQ ID NO: 12540 - DNA, 22 bp, Artificial Sequence
  chemically synthesized
tcccagccctagcaagtatata

SEQ ID NO: 12541 - DNA, 22 bp, Artificial Sequence
  chemically synthesized
gcaagtatatataaggtgaaaa

SEQ ID NO: 12542 - DNA, 22 bp, Artificial Sequence
  chemically synthesized
aggctggagcctgggagaaccc

SEQ ID NO: 12543 - DNA, 22 bp, Artificial Sequence
  chemically synthesized
gagcctgggagaaccctggaca

SEQ ID NO: 12544 - DNA, 22 bp, Artificial Sequence
  chemically synthesized
ggagaaccctggacatttaagg

SEQ ID NO: 12545 - DNA, 22 bp, Artificial Sequence
  chemically synthesized
gacatttaagggccatggagag

SEQ ID NO: 12546 - DNA, 22 bp, Artificial Sequence
  chemically synthesized
aagggccatggagaggaacagg

SEQ ID NO: 12547 - DNA, 22 bp, Artificial Sequence
  chemically synthesized
agggccatggagaggaacagga

SEQ ID NO: 12548 - DNA, 22 bp, Artificial Sequence
  chemically synthesized
atcaattcaagtgctggatgga

SEQ ID NO: 12549 - DNA, 22 bp, Artificial Sequence
  chemically synthesized
aagtgctggatggataacagga

SEQ ID NO: 12550 - DNA, 22 bp, Artificial Sequence
  chemically synthesized
gatggataacaggagttagagc

SEQ ID NO: 12551 - DNA, 22 bp, Artificial Sequence
  chemically synthesized
gagcaaagcggggaaccagaat

SEQ ID NO: 12552 - DNA, 22 bp, Artificial Sequence
  chemically synthesized
ttataaaaagagtttcctaaaa

SEQ ID NO: 12553 - DNA, 22 bp, Artificial Sequence
  chemically synthesized
taaaaagagtttcctaaaaagg

SEQ ID NO: 12554 - DNA, 22 bp, Artificial Sequence
  chemically synthesized
cctaaaaagggagagatcaaca

SEQ ID NO: 12555 - DNA, 22 bp, Artificial Sequence
  chemically synthesized
ctaaaaagggagagatcaacaa

SEQ ID NO: 12556 - DNA, 22 bp, Artificial Sequence
  chemically synthesized
aaaagggagagatcaacaatta

SEQ ID NO: 12557 - DNA, 22 bp, Artificial Sequence
  chemically synthesized
gaaattatttagagcagccagt

SEQ ID NO: 12558 - DNA, 22 bp, Artificial Sequence
  chemically synthesized
tttagagcagccagtaaataca

SEQ ID NO: 12559 - DNA, 22 bp, Artificial Sequence
  chemically synthesized
agagcagccagtaaatacataa

SEQ ID NO: 12560 - DNA, 22 bp, Artificial Sequence
  chemically synthesized
gagcagccagtaaatacataaa

SEQ ID NO: 12561 - DNA, 22 bp, Artificial Sequence
  chemically synthesized
aaaattattctttaggtcattc

SEQ ID NO: 12562 - DNA, 22 bp, Artificial Sequence
  chemically synthesized
ttctttaggtcattcctgattg

SEQ ID NO: 12563 - DNA, 22 bp, Artificial Sequence
  chemically synthesized
tttaggtcattcctgattgtga

SEQ ID NO: 12564 - DNA, 22 bp, Artificial Sequence
  chemically synthesized
taggtcattcctgattgtgaca

SEQ ID NO: 12565 - DNA, 22 bp, Artificial Sequence
  chemically synthesized
aggtcattcctgattgtgacaa

SEQ ID NO: 12566 - DNA, 22 bp, Artificial Sequence
  chemically synthesized
ggtcattcctgattgtgacaat

SEQ ID NO: 12567 - DNA, 22 bp, Artificial Sequence
  chemically synthesized
ctgattgtgacaatagtcattt

SEQ ID NO: 12568 - DNA, 22 bp, Artificial Sequence
  chemically synthesized
attgtgacaatagtcatttcat

SEQ ID NO: 12569 - DNA, 22 bp, Artificial Sequence
  chemically synthesized
tgacaatagtcatttcattata

SEQ ID NO: 12570 - DNA, 22 bp, Artificial Sequence
  chemically synthesized
cattatataaatgtgattaagg

SEQ ID NO: 12571 - DNA, 22 bp, Artificial Sequence
  chemically synthesized
attatataaatgtgattaagga

SEQ ID NO: 12572 - DNA, 22 bp, Artificial Sequence
  chemically synthesized
tataaatgtgattaaggaagga

SEQ ID NO: 12573 - DNA, 22 bp, Artificial Sequence
  chemically synthesized
aggaaggaaaagagctacacag

SEQ ID NO: 12574 - DNA, 22 bp, Artificial Sequence
  chemically synthesized
cacagaagttattaaagagcta

SEQ ID NO: 12575 - DNA, 22 bp, Artificial Sequence
  chemically synthesized
ttaaagagctaaagagaattga

SEQ ID NO: 12576 - DNA, 22 bp, Artificial Sequence
  chemically synthesized
aagagctaaagagaattgagaa

SEQ ID NO: 12577 - DNA, 22 bp, Artificial Sequence
  chemically synthesized
aagagaattgagaaatttaaaa

SEQ ID NO: 12578 - DNA, 22 bp, Artificial Sequence
  chemically synthesized
agaaatttaaaacagaagaaag

SEQ ID NO: 12579 - DNA, 22 bp, Artificial Sequence
  chemically synthesized
aaaacagaagaaagtagggcca

SEQ ID NO: 12580 - DNA, 22 bp, Artificial Sequence
  chemically synthesized
aaacagaagaaagtagggccaa

SEQ ID NO: 12581 - DNA, 22 bp, Artificial Sequence
  chemically synthesized
tctcactgatcctgccaacacc

SEQ ID NO: 12582 - DNA, 22 bp, Artificial Sequence
  chemically synthesized
actgatcctgccaacacctgtg

SEQ ID NO: 12583 - DNA, 22 bp, Artificial Sequence
  chemically synthesized
atcctgccaacacctgtgagat

SEQ ID NO: 12584 - DNA, 22 bp, Artificial Sequence
  chemically synthesized
ccaacacctgtgagatagatat

SEQ ID NO: 12585 - DNA, 22 bp, Artificial Sequence
  chemically synthesized
tgagatagatattcttattata

SEQ ID NO: 12586 - DNA, 22 bp, Artificial Sequence
  chemically synthesized
ttattatactactgttaaacct

SEQ ID NO: 12587 - DNA, 22 bp, Artificial Sequence
  chemically synthesized
attatactactgttaaacctaa

SEQ ID NO: 12588 - DNA, 22 bp, Artificial Sequence
  chemically synthesized
ttatactactgttaaacctaat

SEQ ID NO: 12589 - DNA, 22 bp, Artificial Sequence
  chemically synthesized
tactactgttaaacctaattta

SEQ ID NO: 12590 - DNA, 22 bp, Artificial Sequence
  chemically synthesized
ctgttaaacctaatttacattt

SEQ ID NO: 12591 - DNA, 22 bp, Artificial Sequence
  chemically synthesized
ttaaacctaatttacatttgac

SEQ ID NO: 12592 - DNA, 22 bp, Artificial Sequence
  chemically synthesized
aacctaatttacatttgacaaa

SEQ ID NO: 12593 - DNA, 22 bp, Artificial Sequence
  chemically synthesized
atttacatttgacaaagttaag

SEQ ID NO: 12594 - DNA, 22 bp, Artificial Sequence
  chemically synthesized
acatttgacaaagttaaggttc

SEQ ID NO: 12595 - DNA, 22 bp, Artificial Sequence
  chemically synthesized
catttgacaaagttaaggttca

SEQ ID NO: 12596 - DNA, 22 bp, Artificial Sequence
  chemically synthesized
gacaaagttaaggttcagagct

SEQ ID NO: 12597 - DNA, 22 bp, Artificial Sequence
  chemically synthesized
acaaagttaaggttcagagctt

SEQ ID NO: 12598 - DNA, 22 bp, Artificial Sequence
  chemically synthesized
aggttcagagcttgtgtgactt

SEQ ID NO: 12599 - DNA, 22 bp, Artificial Sequence
  chemically synthesized
agagcttgtgtgacttgtccaa

SEQ ID NO: 12600 - DNA, 22 bp, Artificial Sequence
  chemically synthesized
gtgtgacttgtccaaggtcaca

SEQ ID NO: 12601 - DNA, 22 bp, Artificial Sequence
  chemically synthesized
tgtgacttgtccaaggtcacag

SEQ ID NO: 12602 - DNA, 22 bp, Artificial Sequence
  chemically synthesized
gtccaaggtcacaggtctagag

SEQ ID NO: 12603 - DNA, 22 bp, Artificial Sequence
  chemically synthesized
tccaaggtcacaggtctagagg

SEQ ID NO: 12604 - DNA, 22 bp, Artificial Sequence
  chemically synthesized
gaggaggcagatacttgattca

SEQ ID NO: 12605 - DNA, 22 bp, Artificial Sequence
  chemically synthesized
gattcaaacctatttctgtctg

SEQ ID NO: 12606 - DNA, 22 bp, Artificial Sequence
  chemically synthesized
attcaaacctatttctgtctga

SEQ ID NO: 12607 - DNA, 22 bp, Artificial Sequence
  chemically synthesized
aaacctatttctgtctgatctg

SEQ ID NO: 12608 - DNA, 22 bp, Artificial Sequence
  chemically synthesized
tttctgtctgatctgattctaa

SEQ ID NO: 12609 - DNA, 22 bp, Artificial Sequence
  chemically synthesized
ctgtctgatctgattctaaagt

SEQ ID NO: 12610 - DNA, 22 bp, Artificial Sequence
  chemically synthesized
tgtctgatctgattctaaagtc

SEQ ID NO: 12611 - DNA, 22 bp, Artificial Sequence
  chemically synthesized
tctgatctgattctaaagtctg

SEQ ID NO: 12612 - DNA, 22 bp, Artificial Sequence
  chemically synthesized
atctgattctaaagtctgtttt

SEQ ID NO: 12613 - DNA, 22 bp, Artificial Sequence
  chemically synthesized
attctaaagtctgttttttcac

SEQ ID NO: 12614 - DNA, 22 bp, Artificial Sequence
  chemically synthesized
taaagtctgttttttcactcaa

SEQ ID NO: 12615 - DNA, 22 bp, Artificial Sequence
  chemically synthesized
aagtctgttttttcactcaacc

SEQ ID NO: 12616 - DNA, 22 bp, Artificial Sequence
  chemically synthesized
ttttttcactcaaccacactgt

SEQ ID NO: 12617 - DNA, 22 bp, Artificial Sequence
  chemically synthesized
tttcactcaaccacactgtaca

SEQ ID NO: 12618 - DNA, 22 bp, Artificial Sequence
  chemically synthesized
ttcactcaaccacactgtacag

SEQ ID NO: 12619 - DNA, 22 bp, Artificial Sequence
  chemically synthesized
tcactcaaccacactgtacagt

SEQ ID NO: 12620 - DNA, 22 bp, Artificial Sequence
  chemically synthesized
cactcaaccacactgtacagtc

SEQ ID NO: 12621 - DNA, 22 bp, Artificial Sequence
  chemically synthesized
actcaaccacactgtacagtca

SEQ ID NO: 12622 - DNA, 22 bp, Artificial Sequence
  chemically synthesized
aaccacactgtacagtcagctc

SEQ ID NO: 12623 - DNA, 22 bp, Artificial Sequence
  chemically synthesized
tacagtcagctctccttgtgag

SEQ ID NO: 12624 - DNA, 22 bp, Artificial Sequence
  chemically synthesized
tccttgtgagttccacagccac

SEQ ID NO: 12625 - DNA, 22 bp, Artificial Sequence
  chemically synthesized
cttgtgagttccacagccacag

SEQ ID NO: 12626 - DNA, 22 bp, Artificial Sequence
  chemically synthesized
gtgagttccacagccacagatt

SEQ ID NO: 12627 - DNA, 22 bp, Artificial Sequence
  chemically synthesized
tgagttccacagccacagattc

SEQ ID NO: 12628 - DNA, 22 bp, Artificial Sequence
  chemically synthesized
cacagccacagattcaattaac

SEQ ID NO: 12629 - DNA, 22 bp, Artificial Sequence
  chemically synthesized
aattaactgcagatcaaaaata

SEQ ID NO: 12630 - DNA, 22 bp, Artificial Sequence
  chemically synthesized
actgcagatcaaaaatattcaa

SEQ ID NO: 12631 - DNA, 22 bp, Artificial Sequence
  chemically synthesized
cagatcaaaaatattcaagaaa

SEQ ID NO: 12632 - DNA, 22 bp, Artificial Sequence
  chemically synthesized
aagaaaaaaatggatggttgca

SEQ ID NO: 12633 - DNA, 22 bp, Artificial Sequence
  chemically synthesized
catctctactgaacatgtacag

SEQ ID NO: 12634 - DNA, 22 bp, Artificial Sequence
  chemically synthesized
tactgaacatgtacagactctt

SEQ ID NO: 12635 - DNA, 22 bp, Artificial Sequence
  chemically synthesized
ctgaacatgtacagactctttt

SEQ ID NO: 12636 - DNA, 22 bp, Artificial Sequence
  chemically synthesized
aacatgtacagactcttttatc

SEQ ID NO: 12637 - DNA, 22 bp, Artificial Sequence
  chemically synthesized
ttttatctttcattattcccta

SEQ ID NO: 12638 - DNA, 22 bp, Artificial Sequence
  chemically synthesized
ttatctttcattattccctaaa

SEQ ID NO: 12639 - DNA, 22 bp, Artificial Sequence
  chemically synthesized
tatctttcattattccctaaac

SEQ ID NO: 12640 - DNA, 22 bp, Artificial Sequence
  chemically synthesized
atctttcattattccctaaaca

SEQ ID NO: 12641 - DNA, 22 bp, Artificial Sequence
  chemically synthesized
tctttcattattccctaaacaa

SEQ ID NO: 12642 - DNA, 22 bp, Artificial Sequence
  chemically synthesized
tcattattccctaaacaataca

SEQ ID NO: 12643 - DNA, 22 bp, Artificial Sequence
  chemically synthesized
cattattccctaaacaatacag

SEQ ID NO: 12644 - DNA, 22 bp, Artificial Sequence
  chemically synthesized
attattccctaaacaatacagc

SEQ ID NO: 12645 - DNA, 22 bp, Artificial Sequence
  chemically synthesized
ttccctaaacaatacagcataa

SEQ ID NO: 12646 - DNA, 22 bp, Artificial Sequence
  chemically synthesized
cctaaacaatacagcataacaa

SEQ ID NO: 12647 - DNA, 22 bp, Artificial Sequence
  chemically synthesized
aacaatacagcataacaactat

SEQ ID NO: 12648 - DNA, 22 bp, Artificial Sequence
  chemically synthesized
tttacatagcatttacattgta

SEQ ID NO: 12649 - DNA, 22 bp, Artificial Sequence
  chemically synthesized
acatagcatttacattgtatta

SEQ ID NO: 12650 - DNA, 22 bp, Artificial Sequence
  chemically synthesized
catagcatttacattgtattag

SEQ ID NO: 12651 - DNA, 22 bp, Artificial Sequence
  chemically synthesized
acattgtattagctattaagag

SEQ ID NO: 12652 - DNA, 22 bp, Artificial Sequence
  chemically synthesized
cattgtattagctattaagaga

SEQ ID NO: 12653 - DNA, 22 bp, Artificial Sequence
  chemically synthesized
tattagctattaagagaaacct

SEQ ID NO: 12654 - DNA, 22 bp, Artificial Sequence
  chemically synthesized
gctattaagagaaacctagaga

SEQ ID NO: 12655 - DNA, 22 bp, Artificial Sequence
  chemically synthesized
ttaagagaaacctagagatgat

SEQ ID NO: 12656 - DNA, 22 bp, Artificial Sequence
  chemically synthesized
agagaaacctagagatgattta

SEQ ID NO: 12657 - DNA, 22 bp, Artificial Sequence
  chemically synthesized
gagatgatttaaagtacaaagg

SEQ ID NO: 12658 - DNA, 22 bp, Artificial Sequence
  chemically synthesized
aaagtacaaaggaggatgtgtt

SEQ ID NO: 12659 - DNA, 22 bp, Artificial Sequence
  chemically synthesized
aagtacaaaggaggatgtgttt

SEQ ID NO: 12660 - DNA, 22 bp, Artificial Sequence
  chemically synthesized
aggttatatgcaaatagtaagc

SEQ ID NO: 12661 - DNA, 22 bp, Artificial Sequence
  chemically synthesized
ggttatatgcaaatagtaagcc

SEQ ID NO: 12662 - DNA, 22 bp, Artificial Sequence
  chemically synthesized
tatgcaaatagtaagccatttt

SEQ ID NO: 12663 - DNA, 22 bp, Artificial Sequence
  chemically synthesized
ttatatcggagacttgagcatc

SEQ ID NO: 12664 - DNA, 22 bp, Artificial Sequence
  chemically synthesized
tatatcggagacttgagcatcc

SEQ ID NO: 12665 - DNA, 22 bp, Artificial Sequence
  chemically synthesized
atatcggagacttgagcatcca

SEQ ID NO: 12666 - DNA, 22 bp, Artificial Sequence
  chemically synthesized
tatcggagacttgagcatccac

SEQ ID NO: 12667 - DNA, 22 bp, Artificial Sequence
  chemically synthesized
gagcatccacagatcttgatat

SEQ ID NO: 12668 - DNA, 22 bp, Artificial Sequence
  chemically synthesized
agcatccacagatcttgatatt

SEQ ID NO: 12669 - DNA, 22 bp, Artificial Sequence
  chemically synthesized
gatatttgcagggggtcttgcc

SEQ ID NO: 12670 - DNA, 22 bp, Artificial Sequence
  chemically synthesized
atatttgcagggggtcttgcca

SEQ ID NO: 12671 - DNA, 22 bp, Artificial Sequence
  chemically synthesized
gcagggggtcttgccaccaatt

SEQ ID NO: 12672 - DNA, 22 bp, Artificial Sequence
  chemically synthesized
cagggggtcttgccaccaattt

SEQ ID NO: 12673 - DNA, 22 bp, Artificial Sequence
  chemically synthesized
gccaccaattttccatggatac

SEQ ID NO: 12674 - DNA, 22 bp, Artificial Sequence
  chemically synthesized
ccaccaattttccatggatact

SEQ ID NO: 12675 - DNA, 22 bp, Artificial Sequence
  chemically synthesized
tccatggatactgaggaacgac

SEQ ID NO: 12676 - DNA, 22 bp, Artificial Sequence
  chemically synthesized
ccatggatactgaggaacgact

SEQ ID NO: 12677 - DNA, 22 bp, Artificial Sequence
  chemically synthesized
catggatactgaggaacgactg

SEQ ID NO: 12678 - DNA, 22 bp, Artificial Sequence
  chemically synthesized
aggaacgactgtaaatggatgc

SEQ ID NO: 12679 - DNA, 22 bp, Artificial Sequence
  chemically synthesized
taaatggatgcaggcatggatg

SEQ ID NO: 12680 - DNA, 22 bp, Artificial Sequence
  chemically synthesized
tttaggagtgtccagggccaag

SEQ ID NO: 12681 - DNA, 22 bp, Artificial Sequence
  chemically synthesized
aggagtgtccagggccaagtaa

SEQ ID NO: 12682 - DNA, 22 bp, Artificial Sequence
  chemically synthesized
ggagtgtccagggccaagtaaa

SEQ ID NO: 12683 - DNA, 22 bp, Artificial Sequence
  chemically synthesized
ctgagcagagaggtgggtggag

SEQ ID NO: 12684 - DNA, 22 bp, Artificial Sequence
  chemically synthesized
agcagagaggtgggtggaggct

SEQ ID NO: 12685 - DNA, 22 bp, Artificial Sequence
  chemically synthesized
tgaggcatcaatatgtggtggc

SEQ ID NO: 12686 - DNA, 22 bp, Artificial Sequence
  chemically synthesized
cattttggtgatttttttcctt

SEQ ID NO: 12687 - DNA, 22 bp, Artificial Sequence
  chemically synthesized
tggtgatttttttccttcacag

SEQ ID NO: 12688 - DNA, 22 bp, Artificial Sequence
  chemically synthesized
ggtgatttttttccttcacagt

SEQ ID NO: 12689 - DNA, 22 bp, Artificial Sequence
  chemically synthesized
gtgatttttttccttcacagtc

SEQ ID NO: 12690 - DNA, 22 bp, Artificial Sequence
  chemically synthesized
ttttccttcacagtcctcggct

SEQ ID NO: 12691 - DNA, 22 bp, Artificial Sequence
  chemically synthesized
tttccttcacagtcctcggctg

SEQ ID NO: 12692 - DNA, 22 bp, Artificial Sequence
  chemically synthesized
ttccttcacagtcctcggctgt

SEQ ID NO: 12693 - DNA, 22 bp, Artificial Sequence
  chemically synthesized
tccttcacagtcctcggctgtc

SEQ ID NO: 12694 - DNA, 22 bp, Artificial Sequence
  chemically synthesized
ccttcacagtcctcggctgtct

SEQ ID NO: 12695 - DNA, 22 bp, Artificial Sequence
  chemically synthesized
cttcacagtcctcggctgtctg

SEQ ID NO: 12696 - DNA, 22 bp, Artificial Sequence
  chemically synthesized
cacagtcctcggctgtctggga

SEQ ID NO: 12697 - DNA, 22 bp, Artificial Sequence
  chemically synthesized
acagtcctcggctgtctgggaa

SEQ ID NO: 12698 - DNA, 22 bp, Artificial Sequence
  chemically synthesized
ggctgtctgggaagagaaggat

SEQ ID NO: 12699 - DNA, 22 bp, Artificial Sequence
  chemically synthesized
tctgggaagagaaggatgaagg

SEQ ID NO: 12700 - DNA, 22 bp, Artificial Sequence
  chemically synthesized
ggaagagaaggatgaaggcaga

SEQ ID NO: 12701 - DNA, 22 bp, Artificial Sequence
  chemically synthesized
ctccaatttaggggctaggatt

SEQ ID NO: 12702 - DNA, 22 bp, Artificial Sequence
  chemically synthesized
caatttaggggctaggattgca

SEQ ID NO: 12703 - DNA, 22 bp, Artificial Sequence
  chemically synthesized
aggggctaggattgcagggtgg

SEQ ID NO: 12704 - DNA, 22 bp, Artificial Sequence
  chemically synthesized
ggggctaggattgcagggtggg

SEQ ID NO: 12705 - DNA, 22 bp, Artificial Sequence
  chemically synthesized
ggattgcagggtgggcacagca

SEQ ID NO: 12706 - DNA, 22 bp, Artificial Sequence
  chemically synthesized
cagggtgggcacagcattgcaa

SEQ ID NO: 12707 - DNA, 22 bp, Artificial Sequence
  chemically synthesized
caaacgagtgaaggaaattgag

SEQ ID NO: 12708 - DNA, 22 bp, Artificial Sequence
  chemically synthesized
agaaatatggccaatgaagagt

SEQ ID NO: 12709 - DNA, 22 bp, Artificial Sequence
  chemically synthesized
aagagaggcctggcatggtggc

SEQ ID NO: 12710 - DNA, 22 bp, Artificial Sequence
  chemically synthesized
gcatggtggctcacacctataa

SEQ ID NO: 12711 - DNA, 22 bp, Artificial Sequence
  chemically synthesized
acacctataatcccagcacttt

SEQ ID NO: 12712 - DNA, 22 bp, Artificial Sequence
  chemically synthesized
taatcccagcactttcagaggc

SEQ ID NO: 12713 - DNA, 22 bp, Artificial Sequence
  chemically synthesized
tcagaggcccaggcaggcagat

SEQ ID NO: 12714 - DNA, 22 bp, Artificial Sequence
  chemically synthesized
cagaggcccaggcaggcagatc

SEQ ID NO: 12715 - DNA, 22 bp, Artificial Sequence
  chemically synthesized
agaggcccaggcaggcagatca

SEQ ID NO: 12716 - DNA, 22 bp, Artificial Sequence
  chemically synthesized
gaggtcaggagttcgacaccag

SEQ ID NO: 12717 - DNA, 22 bp, Artificial Sequence
  chemically synthesized
aggtcaggagttcgacaccagc

SEQ ID NO: 12718 - DNA, 22 bp, Artificial Sequence
  chemically synthesized
gacaccagcctggccaacaagg

SEQ ID NO: 12719 - DNA, 22 bp, Artificial Sequence
  chemically synthesized
gccaacaaggtgaaatggtgaa

SEQ ID NO: 12720 - DNA, 22 bp, Artificial Sequence
  chemically synthesized
tactaaaaatacaaaaattagc

SEQ ID NO: 12721 - DNA, 22 bp, Artificial Sequence
  chemically synthesized
actaaaaatacaaaaattagct

SEQ ID NO: 12722 - DNA, 22 bp, Artificial Sequence
  chemically synthesized
ctaaaaatacaaaaattagctg

SEQ ID NO: 12723 - DNA, 22 bp, Artificial Sequence
  chemically synthesized
aaaatacaaaaattagctgggc

SEQ ID NO: 12724 - DNA, 22 bp, Artificial Sequence
  chemically synthesized
gctgggcatggtggcgggtgcc

SEQ ID NO: 12725 - DNA, 22 bp, Artificial Sequence
  chemically synthesized
ggcatggtggcgggtgcctgta

SEQ ID NO: 12726 - DNA, 22 bp, Artificial Sequence
  chemically synthesized
taatcccagctacttgggaggc

SEQ ID NO: 12727 - DNA, 22 bp, Artificial Sequence
  chemically synthesized
cttgggaggctgaggcaggaga

SEQ ID NO: 12728 - DNA, 22 bp, Artificial Sequence
  chemically synthesized
gggaggctgaggcaggagaata

SEQ ID NO: 12729 - DNA, 22 bp, Artificial Sequence
  chemically synthesized
ggaggctgaggcaggagaatag

SEQ ID NO: 12730 - DNA, 22 bp, Artificial Sequence
  chemically synthesized
aggcaggagaatagcttgaacc

SEQ ID NO: 12731 - DNA, 22 bp, Artificial Sequence
  chemically synthesized
gaacctgggagatggaggttgc

SEQ ID NO: 12732 - DNA, 22 bp, Artificial Sequence
  chemically synthesized
aacctgggagatggaggttgca

SEQ ID NO: 12733 - DNA, 22 bp, Artificial Sequence
  chemically synthesized
ggagatggaggttgcagtgagc

SEQ ID NO: 12734 - DNA, 22 bp, Artificial Sequence
  chemically synthesized
cagtgagctgagatcgcaccac

SEQ ID NO: 12735 - DNA, 22 bp, Artificial Sequence
  chemically synthesized
agatcgcaccactgcactccag

SEQ ID NO: 12736 - DNA, 22 bp, Artificial Sequence
  chemically synthesized
cactccagcctgggcgacagag

SEQ ID NO: 12737 - DNA, 22 bp, Artificial Sequence
  chemically synthesized
cagcctgggcgacagagcaaga

SEQ ID NO: 12738 - DNA, 22 bp, Artificial Sequence
  chemically synthesized
ggcgacagagcaagactctgtc

SEQ ID NO: 12739 - DNA, 22 bp, Artificial Sequence
  chemically synthesized
tgtcaaaaaaaaaagagttgaa

SEQ ID NO: 12740 - DNA, 22 bp, Artificial Sequence
  chemically synthesized
tcaaaaaaaaaagagttgaaga

SEQ ID NO: 12741 - DNA, 22 bp, Artificial Sequence
  chemically synthesized
aagagaaaaagtctaggctaaa

SEQ ID NO: 12742 - DNA, 22 bp, Artificial Sequence
  chemically synthesized
ggctaaattcaaagaaaaaaag

SEQ ID NO: 12743 - DNA, 22 bp, Artificial Sequence
  chemically synthesized
aattcaaagaaaaaaagtgagc

SEQ ID NO: 12744 - DNA, 22 bp, Artificial Sequence
  chemically synthesized
aaagaaaaaaagtgagcccaaa

SEQ ID NO: 12745 - DNA, 22 bp, Artificial Sequence
  chemically synthesized
gcagagcaagggaaaagcaggg

SEQ ID NO: 12746 - DNA, 22 bp, Artificial Sequence
  chemically synthesized
cagagcaagggaaaagcaggga

SEQ ID NO: 12747 - DNA, 22 bp, Artificial Sequence
  chemically synthesized
gaacactccataaagtgaacag

SEQ ID NO: 12748 - DNA, 22 bp, Artificial Sequence
  chemically synthesized
cataaagtgaacagctgcaatg

SEQ ID NO: 12749 - DNA, 22 bp, Artificial Sequence
  chemically synthesized
caatgaaaataagggaagaaag

SEQ ID NO: 12750 - DNA, 22 bp, Artificial Sequence
  chemically synthesized
agttcatctccgtttctttcct

SEQ ID NO: 12751 - DNA, 22 bp, Artificial Sequence
  chemically synthesized
gttcatctccgtttctttcctt

SEQ ID NO: 12752 - DNA, 22 bp, Artificial Sequence
  chemically synthesized
atctccgtttctttcctttcct

SEQ ID NO: 12753 - DNA, 22 bp, Artificial Sequence
  chemically synthesized
cgtttctttcctttccttttta

SEQ ID NO: 12754 - DNA, 22 bp, Artificial Sequence
  chemically synthesized
ctttcctttcctttttactttc

SEQ ID NO: 12755 - DNA, 22 bp, Artificial Sequence
  chemically synthesized
tttcctttcctttttactttcc

SEQ ID NO: 12756 - DNA, 22 bp, Artificial Sequence
  chemically synthesized
tcctttcctttttactttcctt

SEQ ID NO: 12757 - DNA, 22 bp, Artificial Sequence
  chemically synthesized
cctttcctttttactttccttt

SEQ ID NO: 12758 - DNA, 22 bp, Artificial Sequence
  chemically synthesized
ctttcctttttactttcctttc

SEQ ID NO: 12759 - DNA, 22 bp, Artificial Sequence
  chemically synthesized
tcctttttactttcctttctct

SEQ ID NO: 12760 - DNA, 22 bp, Artificial Sequence
  chemically synthesized
cctttttactttcctttctctt

SEQ ID NO: 12761 - DNA, 22 bp, Artificial Sequence
  chemically synthesized
ctttttactttcctttctcttc

SEQ ID NO: 12762 - DNA, 22 bp, Artificial Sequence
  chemically synthesized
tttactttcctttctcttcctt

SEQ ID NO: 12763 - DNA, 22 bp, Artificial Sequence
  chemically synthesized
ttactttcctttctcttccttt

SEQ ID NO: 12764 - DNA, 22 bp, Artificial Sequence
  chemically synthesized
tactttcctttctcttcctttt

SEQ ID NO: 12765 - DNA, 22 bp, Artificial Sequence
  chemically synthesized
actttcctttctcttccttttt

SEQ ID NO: 12766 - DNA, 22 bp, Artificial Sequence
  chemically synthesized
ctttcctttctcttcctttttg

SEQ ID NO: 12767 - DNA, 22 bp, Artificial Sequence
  chemically synthesized
tcctttctcttcctttttggag

SEQ ID NO: 12768 - DNA, 22 bp, Artificial Sequence
  chemically synthesized
cctttctcttcctttttggagt

SEQ ID NO: 12769 - DNA, 22 bp, Artificial Sequence
  chemically synthesized
ctttctcttcctttttggagtt

SEQ ID NO: 12770 - DNA, 22 bp, Artificial Sequence
  chemically synthesized
tctcttcctttttggagttaat

SEQ ID NO: 12771 - DNA, 22 bp, Artificial Sequence
  chemically synthesized
ctcttcctttttggagttaatc

SEQ ID NO: 12772 - DNA, 22 bp, Artificial Sequence
  chemically synthesized
tcttcctttttggagttaatca

SEQ ID NO: 12773 - DNA, 22 bp, Artificial Sequence
  chemically synthesized
ttcctttttggagttaatcagg

SEQ ID NO: 12774 - DNA, 22 bp, Artificial Sequence
  chemically synthesized
cctttttggagttaatcaggaa

SEQ ID NO: 12775 - DNA, 22 bp, Artificial Sequence
  chemically synthesized
ctttttggagttaatcaggaag

SEQ ID NO: 12776 - DNA, 22 bp, Artificial Sequence
  chemically synthesized
tttggagttaatcaggaagtag

SEQ ID NO: 12777 - DNA, 22 bp, Artificial Sequence
  chemically synthesized
ttggagttaatcaggaagtagt

SEQ ID NO: 12778 - DNA, 22 bp, Artificial Sequence
  chemically synthesized
tggagttaatcaggaagtagtc

SEQ ID NO: 12779 - DNA, 22 bp, Artificial Sequence
  chemically synthesized
ggagttaatcaggaagtagtcc

SEQ ID NO: 12780 - DNA, 22 bp, Artificial Sequence
  chemically synthesized
gagttaatcaggaagtagtccc

SEQ ID NO: 12781 - DNA, 22 bp, Artificial Sequence
  chemically synthesized
atcaggaagtagtcccaaatac

SEQ ID NO: 12782 - DNA, 22 bp, Artificial Sequence
  chemically synthesized
atcttataagcccttggtcctc

SEQ ID NO: 12783 - DNA, 22 bp, Artificial Sequence
  chemically synthesized
ataagcccttggtcctcttgag

SEQ ID NO: 12784 - DNA, 22 bp, Artificial Sequence
  chemically synthesized
taagcccttggtcctcttgaga

SEQ ID NO: 12785 - DNA, 22 bp, Artificial Sequence
  chemically synthesized
ggtcctcttgagatggtatcag

SEQ ID NO: 12786 - DNA, 22 bp, Artificial Sequence
  chemically synthesized
gtcctcttgagatggtatcaga

SEQ ID NO: 12787 - DNA, 22 bp, Artificial Sequence
  chemically synthesized
ttgagatggtatcagatatatt

SEQ ID NO: 12788 - DNA, 22 bp, Artificial Sequence
  chemically synthesized
gagatggtatcagatatattgc

SEQ ID NO: 12789 - DNA, 22 bp, Artificial Sequence
  chemically synthesized
agatggtatcagatatattgct

SEQ ID NO: 12790 - DNA, 22 bp, Artificial Sequence
  chemically synthesized
ctagacccttgaagaaaggaac

SEQ ID NO: 12791 - DNA, 22 bp, Artificial Sequence
  chemically synthesized
gacccttgaagaaaggaacaac

SEQ ID NO: 12792 - DNA, 22 bp, Artificial Sequence
  chemically synthesized
gaagaaaggaacaactccaggc

SEQ ID NO: 12793 - DNA, 22 bp, Artificial Sequence
  chemically synthesized
aagaaaggaacaactccaggca

SEQ ID NO: 12794 - DNA, 22 bp, Artificial Sequence
  chemically synthesized
caggcaacttcttgagtccctg

SEQ ID NO: 12795 - DNA, 22 bp, Artificial Sequence
  chemically synthesized
cttgagtccctgttattaattt

SEQ ID NO: 12796 - DNA, 22 bp, Artificial Sequence
  chemically synthesized
ttgagtccctgttattaatttt

SEQ ID NO: 12797 - DNA, 22 bp, Artificial Sequence
  chemically synthesized
gagtccctgttattaattttat

SEQ ID NO: 12798 - DNA, 22 bp, Artificial Sequence
  chemically synthesized
agtccctgttattaattttata

SEQ ID NO: 12799 - DNA, 22 bp, Artificial Sequence
  chemically synthesized
ttattaattttatacatacaca

SEQ ID NO: 12800 - DNA, 22 bp, Artificial Sequence
  chemically synthesized
ttaattttatacatacacacac

SEQ ID NO: 12801 - DNA, 22 bp, Artificial Sequence
  chemically synthesized
attttatacatacacacacata

SEQ ID NO: 12802 - DNA, 22 bp, Artificial Sequence
  chemically synthesized
tatacatacacacacatatatg

SEQ ID NO: 12803 - DNA, 22 bp, Artificial Sequence
  chemically synthesized
atacatacacacacatatatgt

SEQ ID NO: 12804 - DNA, 22 bp, Artificial Sequence
  chemically synthesized
tacatacacacacatatatgta

SEQ ID NO: 12805 - DNA, 22 bp, Artificial Sequence
  chemically synthesized
cttaacaatggggatatattct

SEQ ID NO: 12806 - DNA, 22 bp, Artificial Sequence
  chemically synthesized
aacaatggggatatattctgag

SEQ ID NO: 12807 - DNA, 22 bp, Artificial Sequence
  chemically synthesized
acaatggggatatattctgaga

SEQ ID NO: 12808 - DNA, 22 bp, Artificial Sequence
  chemically synthesized
tgagaaatgtgtcattaagcaa

SEQ ID NO: 12809 - DNA, 22 bp, Artificial Sequence
  chemically synthesized
agaaatgtgtcattaagcaatt

SEQ ID NO: 12810 - DNA, 22 bp, Artificial Sequence
  chemically synthesized
agcaatttcatcattgtgcgaa

SEQ ID NO: 12811 - DNA, 22 bp, Artificial Sequence
  chemically synthesized
catcattgtgcgaacataatag

SEQ ID NO: 12812 - DNA, 22 bp, Artificial Sequence
  chemically synthesized
atcattgtgcgaacataataga

SEQ ID NO: 12813 - DNA, 22 bp, Artificial Sequence
  chemically synthesized
tgcgaacataatagagtgtact

SEQ ID NO: 12814 - DNA, 22 bp, Artificial Sequence
  chemically synthesized
acctaaacctaaatggtatagc

SEQ ID NO: 12815 - DNA, 22 bp, Artificial Sequence
  chemically synthesized
cctaaacctaaatggtatagct

SEQ ID NO: 12816 - DNA, 22 bp, Artificial Sequence
  chemically synthesized
aacctaaatggtatagcttact

SEQ ID NO: 12817 - DNA, 22 bp, Artificial Sequence
  chemically synthesized
aatggtatagcttactacatac

SEQ ID NO: 12818 - DNA, 22 bp, Artificial Sequence
  chemically synthesized
actacatacctaggttgtattg

SEQ ID NO: 12819 - DNA, 22 bp, Artificial Sequence
  chemically synthesized
ctacatacctaggttgtattga

SEQ ID NO: 12820 - DNA, 22 bp, Artificial Sequence
  chemically synthesized
catacctaggttgtattgatgt

SEQ ID NO: 12821 - DNA, 22 bp, Artificial Sequence
  chemically synthesized
ggttgtattgatgtggcctatt

SEQ ID NO: 12822 - DNA, 22 bp, Artificial Sequence
  chemically synthesized
tattgatgtggcctattgctcc

SEQ ID NO: 12823 - DNA, 22 bp, Artificial Sequence
  chemically synthesized
atgtggcctattgctcctaggc

SEQ ID NO: 12824 - DNA, 22 bp, Artificial Sequence
  chemically synthesized
ttgctcctaggctcctgggctg

SEQ ID NO: 12825 - DNA, 22 bp, Artificial Sequence
  chemically synthesized
ctcctaggctcctgggctgcaa

SEQ ID NO: 12826 - DNA, 22 bp, Artificial Sequence
  chemically synthesized
ctaggctcctgggctgcaaacc

SEQ ID NO: 12827 - DNA, 22 bp, Artificial Sequence
  chemically synthesized
ggctcctgggctgcaaacctgt

SEQ ID NO: 12828 - DNA, 22 bp, Artificial Sequence
  chemically synthesized
ctgggctgcaaacctgtacagc

SEQ ID NO: 12829 - DNA, 22 bp, Artificial Sequence
  chemically synthesized
ggctgcaaacctgtacagcatg

SEQ ID NO: 12830 - DNA, 22 bp, Artificial Sequence
  chemically synthesized
caaacctgtacagcatgtgact

SEQ ID NO: 12831 - DNA, 22 bp, Artificial Sequence
  chemically synthesized
tacagcatgtgactgtactgaa

SEQ ID NO: 12832 - DNA, 22 bp, Artificial Sequence
  chemically synthesized
tactgaacactgtaggcaatgg

SEQ ID NO: 12833 - DNA, 22 bp, Artificial Sequence
  chemically synthesized
aacactgtaggcaatggtaaca

SEQ ID NO: 12834 - DNA, 22 bp, Artificial Sequence
  chemically synthesized
taggcaatggtaacagtggtat

SEQ ID NO: 12835 - DNA, 22 bp, Artificial Sequence
  chemically synthesized
gtgtatctaaacatagaaaagg

SEQ ID NO: 12836 - DNA, 22 bp, Artificial Sequence
  chemically synthesized
tgtatctaaacatagaaaaggt

SEQ ID NO: 12837 - DNA, 22 bp, Artificial Sequence
  chemically synthesized
aacatagaaaaggtacagtgaa

SEQ ID NO: 12838 - DNA, 22 bp, Artificial Sequence
  chemically synthesized
taaccttatgggaccactgtcg

SEQ ID NO: 12839 - DNA, 22 bp, Artificial Sequence
  chemically synthesized
atgggaccactgtcgtataatg

SEQ ID NO: 12840 - DNA, 22 bp, Artificial Sequence
  chemically synthesized
tgggaccactgtcgtataatgt

SEQ ID NO: 12841 - DNA, 22 bp, Artificial Sequence
  chemically synthesized
tcgtataatgtggtccatcatt

SEQ ID NO: 12842 - DNA, 22 bp, Artificial Sequence
  chemically synthesized
accaaaatgtcattgtgcagca

SEQ ID NO: 12843 - DNA, 22 bp, Artificial Sequence
  chemically synthesized
tgcagcaaatgattatctcata

SEQ ID NO: 12844 - DNA, 22 bp, Artificial Sequence
  chemically synthesized
tctcatatatatatatatatga

SEQ ID NO: 12845 - DNA, 22 bp, Artificial Sequence
  chemically synthesized
atatatatatatatatgatatg

SEQ ID NO: 12846 - DNA, 22 bp, Artificial Sequence
  chemically synthesized
agatagagacatctatcctcca

SEQ ID NO: 12847 - DNA, 22 bp, Artificial Sequence
  chemically synthesized
tcctccagagttcaggagtgtc

SEQ ID NO: 12848 - DNA, 22 bp, Artificial Sequence
  chemically synthesized
cagagttcaggagtgtctcttc

SEQ ID NO: 12849 - DNA, 22 bp, Artificial Sequence
  chemically synthesized
aggagtgtctcttcagactagg

SEQ ID NO: 12850 - DNA, 22 bp, Artificial Sequence
  chemically synthesized
ttcagactaggtagatgtagct

SEQ ID NO: 12851 - DNA, 22 bp, Artificial Sequence
  chemically synthesized
cagactaggtagatgtagctta

SEQ ID NO: 12852 - DNA, 22 bp, Artificial Sequence
  chemically synthesized
agactaggtagatgtagcttaa

SEQ ID NO: 12853 - DNA, 22 bp, Artificial Sequence
  chemically synthesized
ggtagatgtagcttaaaaaaaa

SEQ ID NO: 12854 - DNA, 22 bp, Artificial Sequence
  chemically synthesized
aaaaaaaacatatcctgaattc

SEQ ID NO: 12855 - DNA, 22 bp, Artificial Sequence
  chemically synthesized
aaaaaaacatatcctgaattct

SEQ ID NO: 12856 - DNA, 22 bp, Artificial Sequence
  chemically synthesized
aattctagagagatgcttaaat

SEQ ID NO: 12857 - DNA, 22 bp, Artificial Sequence
  chemically synthesized
tagagagatgcttaaatcactg

SEQ ID NO: 12858 - DNA, 22 bp, Artificial Sequence
  chemically synthesized
gagagatgcttaaatcactgca

SEQ ID NO: 12859 - DNA, 22 bp, Artificial Sequence
  chemically synthesized
aaatcactgcaattcctataac

SEQ ID NO: 12860 - DNA, 22 bp, Artificial Sequence
  chemically synthesized
aatcactgcaattcctataaca

SEQ ID NO: 12861 - DNA, 22 bp, Artificial Sequence
  chemically synthesized
caattcctataacacttgccaa

SEQ ID NO: 12862 - DNA, 22 bp, Artificial Sequence
  chemically synthesized
ctataacacttgccaaccaaag

SEQ ID NO: 12863 - DNA, 22 bp, Artificial Sequence
  chemically synthesized
taacacttgccaaccaaaggtg

SEQ ID NO: 12864 - DNA, 22 bp, Artificial Sequence
  chemically synthesized
gccaaccaaaggtgctgttgat

SEQ ID NO: 12865 - DNA, 22 bp, Artificial Sequence
  chemically synthesized
ccaaccaaaggtgctgttgatc

SEQ ID NO: 12866 - DNA, 22 bp, Artificial Sequence
  chemically synthesized
ttgatctgaaattgctttttta

SEQ ID NO: 12867 - DNA, 22 bp, Artificial Sequence
  chemically synthesized
atctgaaattgcttttttaaat

SEQ ID NO: 12868 - DNA, 22 bp, Artificial Sequence
  chemically synthesized
aaattgcttttttaaattaatg

SEQ ID NO: 12869 - DNA, 22 bp, Artificial Sequence
  chemically synthesized
cttttttaaattaatgcagtga

SEQ ID NO: 12870 - DNA, 22 bp, Artificial Sequence
  chemically synthesized
ttttaaattaatgcagtgattt

SEQ ID NO: 12871 - DNA, 22 bp, Artificial Sequence
  chemically synthesized
tttaaattaatgcagtgatttt

SEQ ID NO: 12872 - DNA, 22 bp, Artificial Sequence
  chemically synthesized
ttaaattaatgcagtgattttt

SEQ ID NO: 12873 - DNA, 22 bp, Artificial Sequence
  chemically synthesized
taaattaatgcagtgatttttc

SEQ ID NO: 12874 - DNA, 22 bp, Artificial Sequence
  chemically synthesized
aaattaatgcagtgatttttct

SEQ ID NO: 12875 - DNA, 22 bp, Artificial Sequence
  chemically synthesized
aattaatgcagtgatttttctt

SEQ ID NO: 12876 - DNA, 22 bp, Artificial Sequence
  chemically synthesized
atgcagtgatttttctttaaca

SEQ ID NO: 12877 - DNA, 22 bp, Artificial Sequence
  chemically synthesized
ttctttaacatctagtgacaga

SEQ ID NO: 12878 - DNA, 22 bp, Artificial Sequence
  chemically synthesized
tctttaacatctagtgacagac

SEQ ID NO: 12879 - DNA, 22 bp, Artificial Sequence
  chemically synthesized
ctttaacatctagtgacagaca

SEQ ID NO: 12880 - DNA, 22 bp, Artificial Sequence
  chemically synthesized
tttaacatctagtgacagacac

SEQ ID NO: 12881 - DNA, 22 bp, Artificial Sequence
  chemically synthesized
taacatctagtgacagacactg

SEQ ID NO: 12882 - DNA, 22 bp, Artificial Sequence
  chemically synthesized
aacatctagtgacagacactgg

SEQ ID NO: 12883 - DNA, 22 bp, Artificial Sequence
  chemically synthesized
acatctagtgacagacactggg

SEQ ID NO: 12884 - DNA, 22 bp, Artificial Sequence
  chemically synthesized
gtgacagacactggggtcacat

SEQ ID NO: 12885 - DNA, 22 bp, Artificial Sequence
  chemically synthesized
gggtcacatttgcagctggacc

SEQ ID NO: 12886 - DNA, 22 bp, Artificial Sequence
  chemically synthesized
gcagctggaccataattaggct

SEQ ID NO: 12887 - DNA, 22 bp, Artificial Sequence
  chemically synthesized
cagctggaccataattaggctt

SEQ ID NO: 12888 - DNA, 22 bp, Artificial Sequence
  chemically synthesized
gaccataattaggcttctgttc

SEQ ID NO: 12889 - DNA, 22 bp, Artificial Sequence
  chemically synthesized
ggcttctgttcttcaggagaca

SEQ ID NO: 12890 - DNA, 22 bp, Artificial Sequence
  chemically synthesized
ctgttcttcaggagacatttgt

SEQ ID NO: 12891 - DNA, 22 bp, Artificial Sequence
  chemically synthesized
tgttcttcaggagacatttgtt

SEQ ID NO: 12892 - DNA, 22 bp, Artificial Sequence
  chemically synthesized
ttcttcaggagacatttgttca

SEQ ID NO: 12893 - DNA, 22 bp, Artificial Sequence
  chemically synthesized
ttcaggagacatttgttcaaag

SEQ ID NO: 12894 - DNA, 22 bp, Artificial Sequence
  chemically synthesized
caggagacatttgttcaaagtc

SEQ ID NO: 12895 - DNA, 22 bp, Artificial Sequence
  chemically synthesized
aggagacatttgttcaaagtca

SEQ ID NO: 12896 - DNA, 22 bp, Artificial Sequence
  chemically synthesized
gttcaaagtcatttgggcaacc

SEQ ID NO: 12897 - DNA, 22 bp, Artificial Sequence
  chemically synthesized
ttcaaagtcatttgggcaacca

SEQ ID NO: 12898 - DNA, 22 bp, Artificial Sequence
  chemically synthesized
aaagtcatttgggcaaccatat

SEQ ID NO: 12899 - DNA, 22 bp, Artificial Sequence
  chemically synthesized
gggcaaccatattctgaaaaca

SEQ ID NO: 12900 - DNA, 22 bp, Artificial Sequence
  chemically synthesized
ggcaaccatattctgaaaacag

SEQ ID NO: 12901 - DNA, 22 bp, Artificial Sequence
  chemically synthesized
tgaaaacagcccagccagggtg

SEQ ID NO: 12902 - DNA, 22 bp, Artificial Sequence
  chemically synthesized
aaaacagcccagccagggtgat

SEQ ID NO: 12903 - DNA, 22 bp, Artificial Sequence
  chemically synthesized
tgcaaagatcctcaatgagcta

SEQ ID NO: 12904 - DNA, 22 bp, Artificial Sequence
  chemically synthesized
gcaaagatcctcaatgagctat

SEQ ID NO: 12905 - DNA, 22 bp, Artificial Sequence
  chemically synthesized
caaagatcctcaatgagctatt

SEQ ID NO: 12906 - DNA, 22 bp, Artificial Sequence
  chemically synthesized
aatgagctattttcaagtgatg

SEQ ID NO: 12907 - DNA, 22 bp, Artificial Sequence
  chemically synthesized
ttttcaagtgatgacaaagtgt

SEQ ID NO: 12908 - DNA, 22 bp, Artificial Sequence
  chemically synthesized
tcaagtgatgacaaagtgtgaa

SEQ ID NO: 12909 - DNA, 22 bp, Artificial Sequence
  chemically synthesized
caagtgatgacaaagtgtgaag

SEQ ID NO: 12910 - DNA, 22 bp, Artificial Sequence
  chemically synthesized
aagtgatgacaaagtgtgaagt

SEQ ID NO: 12911 - DNA, 22 bp, Artificial Sequence
  chemically synthesized
accgctcatttgagaactttct

SEQ ID NO: 12912 - DNA, 22 bp, Artificial Sequence
  chemically synthesized
atttgagaactttctttttcat

SEQ ID NO: 12913 - DNA, 22 bp, Artificial Sequence
  chemically synthesized
gagaactttctttttcatccaa

SEQ ID NO: 12914 - DNA, 22 bp, Artificial Sequence
  chemically synthesized
agaactttctttttcatccaaa

SEQ ID NO: 12915 - DNA, 22 bp, Artificial Sequence
  chemically synthesized
tctttttcatccaaagtaaatt

SEQ ID NO: 12916 - DNA, 22 bp, Artificial Sequence
  chemically synthesized
ctttttcatccaaagtaaattc

SEQ ID NO: 12917 - DNA, 22 bp, Artificial Sequence
  chemically synthesized
tttttcatccaaagtaaattca

SEQ ID NO: 12918 - DNA, 22 bp, Artificial Sequence
  chemically synthesized
tttcatccaaagtaaattcaaa

SEQ ID NO: 12919 - DNA, 22 bp, Artificial Sequence
  chemically synthesized
ttcatccaaagtaaattcaaat

SEQ ID NO: 12920 - DNA, 22 bp, Artificial Sequence
  chemically synthesized
tcatccaaagtaaattcaaata

SEQ ID NO: 12921 - DNA, 22 bp, Artificial Sequence
  chemically synthesized
catccaaagtaaattcaaatat

SEQ ID NO: 12922 - DNA, 22 bp, Artificial Sequence
  chemically synthesized
atccaaagtaaattcaaatatg

SEQ ID NO: 12923 - DNA, 22 bp, Artificial Sequence
  chemically synthesized
aaatatgattagaaatctgacc

SEQ ID NO: 12924 - DNA, 22 bp, Artificial Sequence
  chemically synthesized
gaaatctgaccttttattactg

SEQ ID NO: 12925 - DNA, 22 bp, Artificial Sequence
  chemically synthesized
accttttattactggaattctc

SEQ ID NO: 12926 - DNA, 22 bp, Artificial Sequence
  chemically synthesized
ttattactggaattctcttgac

SEQ ID NO: 12927 - DNA, 22 bp, Artificial Sequence
  chemically synthesized
tattactggaattctcttgact

SEQ ID NO: 12928 - DNA, 22 bp, Artificial Sequence
  chemically synthesized
attactggaattctcttgacta

SEQ ID NO: 12929 - DNA, 22 bp, Artificial Sequence
  chemically synthesized
ttactggaattctcttgactaa

SEQ ID NO: 12930 - DNA, 22 bp, Artificial Sequence
  chemically synthesized
ctggaattctcttgactaaaag

SEQ ID NO: 12931 - DNA, 22 bp, Artificial Sequence
  chemically synthesized
gaattctcttgactaaaagtaa

SEQ ID NO: 12932 - DNA, 22 bp, Artificial Sequence
  chemically synthesized
tcttgactaaaagtaaaattga

SEQ ID NO: 12933 - DNA, 22 bp, Artificial Sequence
  chemically synthesized
ttgactaaaagtaaaattgaat

SEQ ID NO: 12934 - DNA, 22 bp, Artificial Sequence
  chemically synthesized
gactaaaagtaaaattgaattt

SEQ ID NO: 12935 - DNA, 22 bp, Artificial Sequence
  chemically synthesized
actaaaagtaaaattgaatttt

SEQ ID NO: 12936 - DNA, 22 bp, Artificial Sequence
  chemically synthesized
aaagtaaaattgaattttaatt

SEQ ID NO: 12937 - DNA, 22 bp, Artificial Sequence
  chemically synthesized
aattttaattcctaaatctcca

SEQ ID NO: 12938 - DNA, 22 bp, Artificial Sequence
  chemically synthesized
taattcctaaatctccatgtgt

SEQ ID NO: 12939 - DNA, 22 bp, Artificial Sequence
  chemically synthesized
aattcctaaatctccatgtgta

SEQ ID NO: 12940 - DNA, 22 bp, Artificial Sequence
  chemically synthesized
attcctaaatctccatgtgtat

SEQ ID NO: 12941 - DNA, 22 bp, Artificial Sequence
  chemically synthesized
ctaaatctccatgtgtatacag

SEQ ID NO: 12942 - DNA, 22 bp, Artificial Sequence
  chemically synthesized
aatctccatgtgtatacagtac

SEQ ID NO: 12943 - DNA, 22 bp, Artificial Sequence
  chemically synthesized
catgtgtatacagtactgtggg

SEQ ID NO: 12944 - DNA, 22 bp, Artificial Sequence
  chemically synthesized
tgggaacatcacagattttggc

SEQ ID NO: 12945 - DNA, 22 bp, Artificial Sequence
  chemically synthesized
tggctccatgccctaaagagaa

SEQ ID NO: 12946 - DNA, 22 bp, Artificial Sequence
  chemically synthesized
ggctccatgccctaaagagaaa

SEQ ID NO: 12947 - DNA, 22 bp, Artificial Sequence
  chemically synthesized
gctccatgccctaaagagaaat

SEQ ID NO: 12948 - DNA, 22 bp, Artificial Sequence
  chemically synthesized
catgccctaaagagaaattggc

SEQ ID NO: 12949 - DNA, 22 bp, Artificial Sequence
  chemically synthesized
aagagaaattggctttcagatt

SEQ ID NO: 12950 - DNA, 22 bp, Artificial Sequence
  chemically synthesized
gctttcagattatttggattaa

SEQ ID NO: 12951 - DNA, 22 bp, Artificial Sequence
  chemically synthesized
tcagattatttggattaaaaac

SEQ ID NO: 12952 - DNA, 22 bp, Artificial Sequence
  chemically synthesized
cagattatttggattaaaaaca

SEQ ID NO: 12953 - DNA, 22 bp, Artificial Sequence
  chemically synthesized
agattatttggattaaaaacaa

SEQ ID NO: 12954 - DNA, 22 bp, Artificial Sequence
  chemically synthesized
tttggattaaaaacaaagactt

SEQ ID NO: 12955 - DNA, 22 bp, Artificial Sequence
  chemically synthesized
ggattaaaaacaaagactttct

SEQ ID NO: 12956 - DNA, 22 bp, Artificial Sequence
  chemically synthesized
gattaaaaacaaagactttctt

SEQ ID NO: 12957 - DNA, 22 bp, Artificial Sequence
  chemically synthesized
aaaacaaagactttcttaagag

SEQ ID NO: 12958 - DNA, 22 bp, Artificial Sequence
  chemically synthesized
tcttaagagatgtaaaattttc

SEQ ID NO: 12959 - DNA, 22 bp, Artificial Sequence
  chemically synthesized
cttaagagatgtaaaattttca

SEQ ID NO: 12960 - DNA, 22 bp, Artificial Sequence
  chemically synthesized
ttaagagatgtaaaattttcat

SEQ ID NO: 12961 - DNA, 22 bp, Artificial Sequence
  chemically synthesized
aagagatgtaaaattttcatga

SEQ ID NO: 12962 - DNA, 22 bp, Artificial Sequence
  chemically synthesized
agagatgtaaaattttcatgat

SEQ ID NO: 12963 - DNA, 22 bp, Artificial Sequence
  chemically synthesized
tcatgatgttttcttttttgct

SEQ ID NO: 12964 - DNA, 22 bp, Artificial Sequence
  chemically synthesized
catgatgttttcttttttgcta

SEQ ID NO: 12965 - DNA, 22 bp, Artificial Sequence
  chemically synthesized
atgatgttttcttttttgctaa

SEQ ID NO: 12966 - DNA, 22 bp, Artificial Sequence
  chemically synthesized
tcttttttgctaaaactaaaga

SEQ ID NO: 12967 - DNA, 22 bp, Artificial Sequence
  chemically synthesized
cttttttgctaaaactaaagaa

SEQ ID NO: 12968 - DNA, 22 bp, Artificial Sequence
  chemically synthesized
ttttttgctaaaactaaagaat

SEQ ID NO: 12969 - DNA, 22 bp, Artificial Sequence
  chemically synthesized
ttttgctaaaactaaagaatta

SEQ ID NO: 12970 - DNA, 22 bp, Artificial Sequence
  chemically synthesized
tttgctaaaactaaagaattat

SEQ ID NO: 12971 - DNA, 22 bp, Artificial Sequence
  chemically synthesized
ttgctaaaactaaagaattatt

SEQ ID NO: 12972 - DNA, 22 bp, Artificial Sequence
  chemically synthesized
tgctaaaactaaagaattattc

SEQ ID NO: 12973 - DNA, 22 bp, Artificial Sequence
  chemically synthesized
gctaaaactaaagaattattct

SEQ ID NO: 12974 - DNA, 22 bp, Artificial Sequence
  chemically synthesized
ctaaaactaaagaattattctt

SEQ ID NO: 12975 - DNA, 22 bp, Artificial Sequence
  chemically synthesized
aaactaaagaattattctttta

SEQ ID NO: 12976 - DNA, 22 bp, Artificial Sequence
  chemically synthesized
aagaattattcttttacatttc

SEQ ID NO: 12977 - DNA, 22 bp, Artificial Sequence
  chemically synthesized
ttcttttacatttcagtttttc

SEQ ID NO: 12978 - DNA, 22 bp, Artificial Sequence
  chemically synthesized
ttttacatttcagtttttcttg

SEQ ID NO: 12979 - DNA, 22 bp, Artificial Sequence
  chemically synthesized
ttacatttcagtttttcttgat

SEQ ID NO: 12980 - DNA, 22 bp, Artificial Sequence
  chemically synthesized
tacatttcagtttttcttgatc

SEQ ID NO: 12981 - DNA, 22 bp, Artificial Sequence
  chemically synthesized
acatttcagtttttcttgatca

SEQ ID NO: 12982 - DNA, 22 bp, Artificial Sequence
  chemically synthesized
catttcagtttttcttgatcat

SEQ ID NO: 12983 - DNA, 22 bp, Artificial Sequence
  chemically synthesized
cagtttttcttgatcatgaaaa

SEQ ID NO: 12984 - DNA, 22 bp, Artificial Sequence
  chemically synthesized
agtttttcttgatcatgaaaac

SEQ ID NO: 12985 - DNA, 22 bp, Artificial Sequence
  chemically synthesized
ttcttgatcatgaaaacgccaa

SEQ ID NO: 12986 - DNA, 22 bp, Artificial Sequence
  chemically synthesized
tcttgatcatgaaaacgccaac

SEQ ID NO: 12987 - DNA, 22 bp, Artificial Sequence
  chemically synthesized
cttgatcatgaaaacgccaaca

SEQ ID NO: 12988 - DNA, 22 bp, Artificial Sequence
  chemically synthesized
ttgatcatgaaaacgccaacaa

SEQ ID NO: 12989 - DNA, 22 bp, Artificial Sequence
  chemically synthesized
gatcatgaaaacgccaacaaaa

SEQ ID NO: 12990 - DNA, 22 bp, Artificial Sequence
  chemically synthesized
atcatgaaaacgccaacaaaat

SEQ ID NO: 12991 - DNA, 22 bp, Artificial Sequence
  chemically synthesized
tgaatcggccaaagaggtataa

SEQ ID NO: 12992 - DNA, 22 bp, Artificial Sequence
  chemically synthesized
aatcggccaaagaggtataatt

SEQ ID NO: 12993 - DNA, 22 bp, Artificial Sequence
  chemically synthesized
aggtaaattggaagagtttgtt

SEQ ID NO: 12994 - DNA, 22 bp, Artificial Sequence
  chemically synthesized
gaagagtttgttcaagggaacc

SEQ ID NO: 12995 - DNA, 22 bp, Artificial Sequence
  chemically synthesized
gttcaagggaaccttgagagag

SEQ ID NO: 12996 - DNA, 22 bp, Artificial Sequence
  chemically synthesized
ttcaagggaaccttgagagaga

SEQ ID NO: 12997 - DNA, 22 bp, Artificial Sequence
  chemically synthesized
aagggaaccttgagagagaatg

SEQ ID NO: 12998 - DNA, 22 bp, Artificial Sequence
  chemically synthesized
gagagagaatgtatggaagaaa

SEQ ID NO: 12999 - DNA, 22 bp, Artificial Sequence
  chemically synthesized
agagagaatgtatggaagaaaa

SEQ ID NO: 13000 - DNA, 22 bp, Artificial Sequence
  chemically synthesized
tgaagaagcacgagaagttttt

SEQ ID NO: 13001 - DNA, 22 bp, Artificial Sequence
  chemically synthesized
gaagaagcacgagaagtttttg

SEQ ID NO: 13002 - DNA, 22 bp, Artificial Sequence
  chemically synthesized
aagaagcacgagaagtttttga

SEQ ID NO: 13003 - DNA, 22 bp, Artificial Sequence
  chemically synthesized
tttcagtgttttcaaaaacttc

SEQ ID NO: 13004 - DNA, 22 bp, Artificial Sequence
  chemically synthesized
tcagtgttttcaaaaacttctc

SEQ ID NO: 13005 - DNA, 22 bp, Artificial Sequence
  chemically synthesized
cagtgttttcaaaaacttctcg

SEQ ID NO: 13006 - DNA, 22 bp, Artificial Sequence
  chemically synthesized
agtgttttcaaaaacttctcgt

SEQ ID NO: 13007 - DNA, 22 bp, Artificial Sequence
  chemically synthesized
tcaaaaacttctcgtgcttctt

SEQ ID NO: 13008 - DNA, 22 bp, Artificial Sequence
  chemically synthesized
caaaaacttctcgtgcttcttc

SEQ ID NO: 13009 - DNA, 22 bp, Artificial Sequence
  chemically synthesized
aaaaacttctcgtgcttcttca

SEQ ID NO: 13010 - DNA, 22 bp, Artificial Sequence
  chemically synthesized
ctcgtgcttcttcaaaactaca

SEQ ID NO: 13011 - DNA, 22 bp, Artificial Sequence
  chemically synthesized
tcgtgcttcttcaaaactacac

SEQ ID NO: 13012 - DNA, 22 bp, Artificial Sequence
  chemically synthesized
gtgcttcttcaaaactacactt

SEQ ID NO: 13013 - DNA, 22 bp, Artificial Sequence
  chemically synthesized
cttcaaaactacacttttcttc

SEQ ID NO: 13014 - DNA, 22 bp, Artificial Sequence
  chemically synthesized
ttcaaaactacacttttcttcc

SEQ ID NO: 13015 - DNA, 22 bp, Artificial Sequence
  chemically synthesized
caaaactacacttttcttccat

SEQ ID NO: 13016 - DNA, 22 bp, Artificial Sequence
  chemically synthesized
aaaactacacttttcttccata

SEQ ID NO: 13017 - DNA, 22 bp, Artificial Sequence
  chemically synthesized
cacttttcttccatacattctc

SEQ ID NO: 13018 - DNA, 22 bp, Artificial Sequence
  chemically synthesized
ttcttccatacattctctctca

SEQ ID NO: 13019 - DNA, 22 bp, Artificial Sequence
  chemically synthesized
tcttccatacattctctctcaa

SEQ ID NO: 13020 - DNA, 22 bp, Artificial Sequence
  chemically synthesized
cttccatacattctctctcaag

SEQ ID NO: 13021 - DNA, 22 bp, Artificial Sequence
  chemically synthesized
ttccatacattctctctcaagg

SEQ ID NO: 13022 - DNA, 22 bp, Artificial Sequence
  chemically synthesized
ccatacattctctctcaaggtt

SEQ ID NO: 13023 - DNA, 22 bp, Artificial Sequence
  chemically synthesized
catacattctctctcaaggttc

SEQ ID NO: 13024 - DNA, 22 bp, Artificial Sequence
  chemically synthesized
tctctcaaggttcccttgaaca

SEQ ID NO: 13025 - DNA, 22 bp, Artificial Sequence
  chemically synthesized
tctcaaggttcccttgaacaaa

SEQ ID NO: 13026 - DNA, 22 bp, Artificial Sequence
  chemically synthesized
tcaaggttcccttgaacaaact

SEQ ID NO: 13027 - DNA, 22 bp, Artificial Sequence
  chemically synthesized
aaggttcccttgaacaaactct

SEQ ID NO: 13028 - DNA, 22 bp, Artificial Sequence
  chemically synthesized
ccttgaacaaactcttccaatt

SEQ ID NO: 13029 - DNA, 22 bp, Artificial Sequence
  chemically synthesized
gaacaaactcttccaatttacc

SEQ ID NO: 13030 - DNA, 22 bp, Artificial Sequence
  chemically synthesized
aacaaactcttccaatttacct

SEQ ID NO: 13031 - DNA, 22 bp, Artificial Sequence
  chemically synthesized
ttccaatttacctgaattatac

SEQ ID NO: 13032 - DNA, 22 bp, Artificial Sequence
  chemically synthesized
ccaatttacctgaattatacct

SEQ ID NO: 13033 - DNA, 22 bp, Artificial Sequence
  chemically synthesized
caatttacctgaattatacctc

SEQ ID NO: 13034 - DNA, 22 bp, Artificial Sequence
  chemically synthesized
acctgaattatacctctttggc

SEQ ID NO: 13035 - DNA, 22 bp, Artificial Sequence
  chemically synthesized
cctgaattatacctctttggcc

SEQ ID NO: 13036 - DNA, 22 bp, Artificial Sequence
  chemically synthesized
aattatacctctttggccgatt

SEQ ID NO: 13037 - DNA, 22 bp, Artificial Sequence
  chemically synthesized
tacctctttggccgattcagaa

SEQ ID NO: 13038 - DNA, 22 bp, Artificial Sequence
  chemically synthesized
tttggccgattcagaattttgt

SEQ ID NO: 13039 - DNA, 22 bp, Artificial Sequence
  chemically synthesized
tggccgattcagaattttgttg

SEQ ID NO: 13040 - DNA, 22 bp, Artificial Sequence
  chemically synthesized
ggccgattcagaattttgttgg

SEQ ID NO: 13041 - DNA, 22 bp, Artificial Sequence
  chemically synthesized
gccgattcagaattttgttggc

SEQ ID NO: 13042 - DNA, 22 bp, Artificial Sequence
  chemically synthesized
agaattttgttggcgttttcat

SEQ ID NO: 13043 - DNA, 22 bp, Artificial Sequence
  chemically synthesized
tgttggcgttttcatgatcaag

SEQ ID NO: 13044 - DNA, 22 bp, Artificial Sequence
  chemically synthesized
gttggcgttttcatgatcaaga

SEQ ID NO: 13045 - DNA, 22 bp, Artificial Sequence
  chemically synthesized
ttggcgttttcatgatcaagaa

SEQ ID NO: 13046 - DNA, 22 bp, Artificial Sequence
  chemically synthesized
gcgttttcatgatcaagaaaaa

SEQ ID NO: 13047 - DNA, 22 bp, Artificial Sequence
  chemically synthesized
tcatgatcaagaaaaactgaaa

SEQ ID NO: 13048 - DNA, 22 bp, Artificial Sequence
  chemically synthesized
catgatcaagaaaaactgaaat

SEQ ID NO: 13049 - DNA, 22 bp, Artificial Sequence
  chemically synthesized
atgatcaagaaaaactgaaatg

SEQ ID NO: 13050 - DNA, 22 bp, Artificial Sequence
  chemically synthesized
aaatgtaaaagaataattcttt

SEQ ID NO: 13051 - DNA, 22 bp, Artificial Sequence
  chemically synthesized
tttagttttagcaaaaaagaaa

SEQ ID NO: 13052 - DNA, 22 bp, Artificial Sequence
  chemically synthesized
tagttttagcaaaaaagaaaac

SEQ ID NO: 13053 - DNA, 22 bp, Artificial Sequence
  chemically synthesized
agttttagcaaaaaagaaaaca

SEQ ID NO: 13054 - DNA, 22 bp, Artificial Sequence
  chemically synthesized
gttttagcaaaaaagaaaacat

SEQ ID NO: 13055 - DNA, 22 bp, Artificial Sequence
  chemically synthesized
tagcaaaaaagaaaacatcatg

SEQ ID NO: 13056 - DNA, 22 bp, Artificial Sequence
  chemically synthesized
agcaaaaaagaaaacatcatga

SEQ ID NO: 13057 - DNA, 22 bp, Artificial Sequence
  chemically synthesized
gcaaaaaagaaaacatcatgaa

SEQ ID NO: 13058 - DNA, 22 bp, Artificial Sequence
  chemically synthesized
tacatctcttaagaaagtcttt

SEQ ID NO: 13059 - DNA, 22 bp, Artificial Sequence
  chemically synthesized
acatctcttaagaaagtctttg

SEQ ID NO: 13060 - DNA, 22 bp, Artificial Sequence
  chemically synthesized
catctcttaagaaagtctttgt

SEQ ID NO: 13061 - DNA, 22 bp, Artificial Sequence
  chemically synthesized
ttaagaaagtctttgtttttaa

SEQ ID NO: 13062 - DNA, 22 bp, Artificial Sequence
  chemically synthesized
aagaaagtctttgtttttaatc

SEQ ID NO: 13063 - DNA, 22 bp, Artificial Sequence
  chemically synthesized
agaaagtctttgtttttaatcc

SEQ ID NO: 13064 - DNA, 22 bp, Artificial Sequence
  chemically synthesized
tgtttttaatccaaataatctg

SEQ ID NO: 13065 - DNA, 22 bp, Artificial Sequence
  chemically synthesized
gtttttaatccaaataatctga

SEQ ID NO: 13066 - DNA, 22 bp, Artificial Sequence
  chemically synthesized
tttttaatccaaataatctgaa

SEQ ID NO: 13067 - DNA, 22 bp, Artificial Sequence
  chemically synthesized
ttaatccaaataatctgaaagc

SEQ ID NO: 13068 - DNA, 22 bp, Artificial Sequence
  chemically synthesized
taatccaaataatctgaaagcc

SEQ ID NO: 13069 - DNA, 22 bp, Artificial Sequence
  chemically synthesized
aatccaaataatctgaaagcca

SEQ ID NO: 13070 - DNA, 22 bp, Artificial Sequence
  chemically synthesized
atccaaataatctgaaagccaa

SEQ ID NO: 13071 - DNA, 22 bp, Artificial Sequence
  chemically synthesized
aaagccaatttctctttagggc

SEQ ID NO: 13072 - DNA, 22 bp, Artificial Sequence
  chemically synthesized
ctctttagggcatggagccaaa

SEQ ID NO: 13073 - DNA, 22 bp, Artificial Sequence
  chemically synthesized
tctttagggcatggagccaaaa

SEQ ID NO: 13074 - DNA, 22 bp, Artificial Sequence
  chemically synthesized
tttagggcatggagccaaaatc

SEQ ID NO: 13075 - DNA, 22 bp, Artificial Sequence
  chemically synthesized
tagggcatggagccaaaatctg

SEQ ID NO: 13076 - DNA, 22 bp, Artificial Sequence
  chemically synthesized
agggcatggagccaaaatctgt

SEQ ID NO: 13077 - DNA, 22 bp, Artificial Sequence
  chemically synthesized
gggcatggagccaaaatctgtg

SEQ ID NO: 13078 - DNA, 22 bp, Artificial Sequence
  chemically synthesized
tgatgttcccacagtactgtat

SEQ ID NO: 13079 - DNA, 22 bp, Artificial Sequence
  chemically synthesized
ccacagtactgtatacacatgg

SEQ ID NO: 13080 - DNA, 22 bp, Artificial Sequence
  chemically synthesized
tatacacatggagatttaggaa

SEQ ID NO: 13081 - DNA, 22 bp, Artificial Sequence
  chemically synthesized
aggaattaaaattcaattttac

SEQ ID NO: 13082 - DNA, 22 bp, Artificial Sequence
  chemically synthesized
ggaattaaaattcaattttact

SEQ ID NO: 13083 - DNA, 22 bp, Artificial Sequence
  chemically synthesized
aaattcaattttacttttagtc

SEQ ID NO: 13084 - DNA, 22 bp, Artificial Sequence
  chemically synthesized
aattttacttttagtcaagaga

SEQ ID NO: 13085 - DNA, 22 bp, Artificial Sequence
  chemically synthesized
tacttttagtcaagagaattcc

SEQ ID NO: 13086 - DNA, 22 bp, Artificial Sequence
  chemically synthesized
acttttagtcaagagaattcca

SEQ ID NO: 13087 - DNA, 22 bp, Artificial Sequence
  chemically synthesized
cttttagtcaagagaattccag

SEQ ID NO: 13088 - DNA, 22 bp, Artificial Sequence
  chemically synthesized
ttagtcaagagaattccagtaa

SEQ ID NO: 13089 - DNA, 22 bp, Artificial Sequence
  chemically synthesized
tagtcaagagaattccagtaat

SEQ ID NO: 13090 - DNA, 22 bp, Artificial Sequence
  chemically synthesized
agtcaagagaattccagtaata

SEQ ID NO: 13091 - DNA, 22 bp, Artificial Sequence
  chemically synthesized
gtcaagagaattccagtaataa

SEQ ID NO: 13092 - DNA, 22 bp, Artificial Sequence
  chemically synthesized
cagtaataaaaggtcagatttc

SEQ ID NO: 13093 - DNA, 22 bp, Artificial Sequence
  chemically synthesized
ctaatcatatttgaatttactt

SEQ ID NO: 13094 - DNA, 22 bp, Artificial Sequence
  chemically synthesized
taatcatatttgaatttacttt

SEQ ID NO: 13095 - DNA, 22 bp, Artificial Sequence
  chemically synthesized
atcatatttgaatttactttgg

SEQ ID NO: 13096 - DNA, 22 bp, Artificial Sequence
  chemically synthesized
gaatttactttggatgaaaaag

SEQ ID NO: 13097 - DNA, 22 bp, Artificial Sequence
  chemically synthesized
aatttactttggatgaaaaaga

SEQ ID NO: 13098 - DNA, 22 bp, Artificial Sequence
  chemically synthesized
actttggatgaaaaagaaagtt

SEQ ID NO: 13099 - DNA, 22 bp, Artificial Sequence
  chemically synthesized
ctttggatgaaaaagaaagttc

SEQ ID NO: 13100 - DNA, 22 bp, Artificial Sequence
  chemically synthesized
tggatgaaaaagaaagttctca

SEQ ID NO: 13101 - DNA, 22 bp, Artificial Sequence
  chemically synthesized
ggatgaaaaagaaagttctcaa

SEQ ID NO: 13102 - DNA, 22 bp, Artificial Sequence
  chemically synthesized
gatgaaaaagaaagttctcaaa

SEQ ID NO: 13103 - DNA, 22 bp, Artificial Sequence
  chemically synthesized
tcaaatgagcggttaacttcac

SEQ ID NO: 13104 - DNA, 22 bp, Artificial Sequence
  chemically synthesized
aaatgagcggttaacttcacac

SEQ ID NO: 13105 - DNA, 22 bp, Artificial Sequence
  chemically synthesized
acttcacactttgtcatcactt

SEQ ID NO: 13106 - DNA, 22 bp, Artificial Sequence
  chemically synthesized
cacactttgtcatcacttgaaa

SEQ ID NO: 13107 - DNA, 22 bp, Artificial Sequence
  chemically synthesized
acactttgtcatcacttgaaaa

SEQ ID NO: 13108 - DNA, 22 bp, Artificial Sequence
  chemically synthesized
tgtcatcacttgaaaatagctc

SEQ ID NO: 13109 - DNA, 22 bp, Artificial Sequence
  chemically synthesized
gtcatcacttgaaaatagctca

SEQ ID NO: 13110 - DNA, 22 bp, Artificial Sequence
  chemically synthesized
tcatcacttgaaaatagctcat

SEQ ID NO: 13111 - DNA, 22 bp, Artificial Sequence
  chemically synthesized
gaaaatagctcattgaggatct

SEQ ID NO: 13112 - DNA, 22 bp, Artificial Sequence
  chemically synthesized
aaaatagctcattgaggatctt

SEQ ID NO: 13113 - DNA, 22 bp, Artificial Sequence
  chemically synthesized
attgaggatctttgcaaagtga

SEQ ID NO: 13114 - DNA, 22 bp, Artificial Sequence
  chemically synthesized
aggatctttgcaaagtgatcca

SEQ ID NO: 13115 - DNA, 22 bp, Artificial Sequence
  chemically synthesized
tgcaaagtgatccatcaccctg

SEQ ID NO: 13116 - DNA, 22 bp, Artificial Sequence
  chemically synthesized
gcaaagtgatccatcaccctgg

SEQ ID NO: 13117 - DNA, 22 bp, Artificial Sequence
  chemically synthesized
caaagtgatccatcaccctggc

SEQ ID NO: 13118 - DNA, 22 bp, Artificial Sequence
  chemically synthesized
gctgggctgttttcagaatatg

SEQ ID NO: 13119 - DNA, 22 bp, Artificial Sequence
  chemically synthesized
ggctgttttcagaatatggttg

SEQ ID NO: 13120 - DNA, 22 bp, Artificial Sequence
  chemically synthesized
ttttcagaatatggttgcccaa

SEQ ID NO: 13121 - DNA, 22 bp, Artificial Sequence
  chemically synthesized
tcagaatatggttgcccaaatg

SEQ ID NO: 13122 - DNA, 22 bp, Artificial Sequence
  chemically synthesized
cagaatatggttgcccaaatga

SEQ ID NO: 13123 - DNA, 22 bp, Artificial Sequence
  chemically synthesized
agaatatggttgcccaaatgac

SEQ ID NO: 13124 - DNA, 22 bp, Artificial Sequence
  chemically synthesized
cccaaatgactttgaacaaatg

SEQ ID NO: 13125 - DNA, 22 bp, Artificial Sequence
  chemically synthesized
tgaacaaatgtctcctgaagaa

SEQ ID NO: 13126 - DNA, 22 bp, Artificial Sequence
  chemically synthesized
gaacaaatgtctcctgaagaac

SEQ ID NO: 13127 - DNA, 22 bp, Artificial Sequence
  chemically synthesized
aacaaatgtctcctgaagaaca

SEQ ID NO: 13128 - DNA, 22 bp, Artificial Sequence
  chemically synthesized
ctgaagaacagaagcctaatta

SEQ ID NO: 13129 - DNA, 22 bp, Artificial Sequence
  chemically synthesized
aagaacagaagcctaattatgg

SEQ ID NO: 13130 - DNA, 22 bp, Artificial Sequence
  chemically synthesized
attatggtccagctgcaaatgt

SEQ ID NO: 13131 - DNA, 22 bp, Artificial Sequence
  chemically synthesized
tggtccagctgcaaatgtgacc

SEQ ID NO: 13132 - DNA, 22 bp, Artificial Sequence
  chemically synthesized
caaatgtgaccccagtgtctgt

SEQ ID NO: 13133 - DNA, 22 bp, Artificial Sequence
  chemically synthesized
tcactagatgttaaagaaaaat

SEQ ID NO: 13134 - DNA, 22 bp, Artificial Sequence
  chemically synthesized
gatgttaaagaaaaatcactgc

SEQ ID NO: 13135 - DNA, 22 bp, Artificial Sequence
  chemically synthesized
aagaaaaatcactgcattaatt

SEQ ID NO: 13136 - DNA, 22 bp, Artificial Sequence
  chemically synthesized
cattaatttaaaaaagcaattt

SEQ ID NO: 13137 - DNA, 22 bp, Artificial Sequence
  chemically synthesized
atttaaaaaagcaatttcagat

SEQ ID NO: 13138 - DNA, 22 bp, Artificial Sequence
  chemically synthesized
aaaaaagcaatttcagatcaac

SEQ ID NO: 13139 - DNA, 22 bp, Artificial Sequence
  chemically synthesized
aaaaagcaatttcagatcaaca

SEQ ID NO: 13140 - DNA, 22 bp, Artificial Sequence
  chemically synthesized
cagatcaacagcacctttggtt

SEQ ID NO: 13141 - DNA, 22 bp, Artificial Sequence
  chemically synthesized
agatcaacagcacctttggttg

SEQ ID NO: 13142 - DNA, 22 bp, Artificial Sequence
  chemically synthesized
tggttggcaagtgttataggaa

SEQ ID NO: 13143 - DNA, 22 bp, Artificial Sequence
  chemically synthesized
ggttggcaagtgttataggaat

SEQ ID NO: 13144 - DNA, 22 bp, Artificial Sequence
  chemically synthesized
gttggcaagtgttataggaatt

SEQ ID NO: 13145 - DNA, 22 bp, Artificial Sequence
  chemically synthesized
gcaagtgttataggaattgcag

SEQ ID NO: 13146 - DNA, 22 bp, Artificial Sequence
  chemically synthesized
taggaattgcagtgatttaagc

SEQ ID NO: 13147 - DNA, 22 bp, Artificial Sequence
  chemically synthesized
cagtgatttaagcatctctcta

SEQ ID NO: 13148 - DNA, 22 bp, Artificial Sequence
  chemically synthesized
aagcatctctctagaattcagg

SEQ ID NO: 13149 - DNA, 22 bp, Artificial Sequence
  chemically synthesized
agcatctctctagaattcagga

SEQ ID NO: 13150 - DNA, 22 bp, Artificial Sequence
  chemically synthesized
tctagaattcaggatatgtttt

SEQ ID NO: 13151 - DNA, 22 bp, Artificial Sequence
  chemically synthesized
tagaattcaggatatgtttttt

SEQ ID NO: 13152 - DNA, 22 bp, Artificial Sequence
  chemically synthesized
gaattcaggatatgtttttttt

SEQ ID NO: 13153 - DNA, 22 bp, Artificial Sequence
  chemically synthesized
aggatatgttttttttaagcta

SEQ ID NO: 13154 - DNA, 22 bp, Artificial Sequence
  chemically synthesized
tttttaagctacatctacctag

SEQ ID NO: 13155 - DNA, 22 bp, Artificial Sequence
  chemically synthesized
ttttaagctacatctacctagt

SEQ ID NO: 13156 - DNA, 22 bp, Artificial Sequence
  chemically synthesized
tttaagctacatctacctagtc

SEQ ID NO: 13157 - DNA, 22 bp, Artificial Sequence
  chemically synthesized
ttaagctacatctacctagtct

SEQ ID NO: 13158 - DNA, 22 bp, Artificial Sequence
  chemically synthesized
taagctacatctacctagtctg

SEQ ID NO: 13159 - DNA, 22 bp, Artificial Sequence
  chemically synthesized
aagctacatctacctagtctga

SEQ ID NO: 13160 - DNA, 22 bp, Artificial Sequence
  chemically synthesized
agctacatctacctagtctgaa

SEQ ID NO: 13161 - DNA, 22 bp, Artificial Sequence
  chemically synthesized
catctacctagtctgaagagac

SEQ ID NO: 13162 - DNA, 22 bp, Artificial Sequence
  chemically synthesized
cctagtctgaagagacactcct

SEQ ID NO: 13163 - DNA, 22 bp, Artificial Sequence
  chemically synthesized
gtctgaagagacactcctgaac

SEQ ID NO: 13164 - DNA, 22 bp, Artificial Sequence
  chemically synthesized
aagagacactcctgaactctgg

SEQ ID NO: 13165 - DNA, 22 bp, Artificial Sequence
  chemically synthesized
ctgaactctggaggatagatgt

SEQ ID NO: 13166 - DNA, 22 bp, Artificial Sequence
  chemically synthesized
aactctggaggatagatgtctc

SEQ ID NO: 13167 - DNA, 22 bp, Artificial Sequence
  chemically synthesized
tggaggatagatgtctctatct

SEQ ID NO: 13168 - DNA, 22 bp, Artificial Sequence
  chemically synthesized
gaggatagatgtctctatctga

SEQ ID NO: 13169 - DNA, 22 bp, Artificial Sequence
  chemically synthesized
tatctgaatcatatttctcctt

SEQ ID NO: 13170 - DNA, 22 bp, Artificial Sequence
  chemically synthesized
tctgaatcatatttctccttcc

SEQ ID NO: 13171 - DNA, 22 bp, Artificial Sequence
  chemically synthesized
aatcatatttctccttccctcc

SEQ ID NO: 13172 - DNA, 22 bp, Artificial Sequence
  chemically synthesized
ctccttccctccctccttcctc

SEQ ID NO: 13173 - DNA, 22 bp, Artificial Sequence
  chemically synthesized
tccttccctccctccttcctct

SEQ ID NO: 13174 - DNA, 22 bp, Artificial Sequence
  chemically synthesized
cttccctccctccttcctctcc

SEQ ID NO: 13175 - DNA, 22 bp, Artificial Sequence
  chemically synthesized
ccctccctccttcctctcctct

SEQ ID NO: 13176 - DNA, 22 bp, Artificial Sequence
  chemically synthesized
cctccctccttcctctcctctc

SEQ ID NO: 13177 - DNA, 22 bp, Artificial Sequence
  chemically synthesized
cctccttcctctcctctcctct

SEQ ID NO: 13178 - DNA, 22 bp, Artificial Sequence
  chemically synthesized
cttcctctcctctcctctctct

SEQ ID NO: 13179 - DNA, 22 bp, Artificial Sequence
  chemically synthesized
cctctcctctcctctctctctc

SEQ ID NO: 13180 - DNA, 22 bp, Artificial Sequence
  chemically synthesized
ctctcctctcctctctctctct

SEQ ID NO: 13181 - DNA, 22 bp, Artificial Sequence
  chemically synthesized
tcctctcctctctctctctctc

SEQ ID NO: 13182 - DNA, 22 bp, Artificial Sequence
  chemically synthesized
ctctcctctctctctctctcta

SEQ ID NO: 13183 - DNA, 22 bp, Artificial Sequence
  chemically synthesized
tcctctctctctctctctatgt

SEQ ID NO: 13184 - DNA, 22 bp, Artificial Sequence
  chemically synthesized
ctctctctctctctctatgtgt

SEQ ID NO: 13185 - DNA, 22 bp, Artificial Sequence
  chemically synthesized
tctctctctctctatgtgtgtg

SEQ ID NO: 13186 - DNA, 22 bp, Artificial Sequence
  chemically synthesized
tctctctctctatgtgtgtgtg

SEQ ID NO: 13187 - DNA, 22 bp, Artificial Sequence
  chemically synthesized
tctctctctatgtgtgtgtgtg

SEQ ID NO: 13188 - DNA, 22 bp, Artificial Sequence
  chemically synthesized
tctctctatgtgtgtgtgtgta

SEQ ID NO: 13189 - DNA, 22 bp, Artificial Sequence
  chemically synthesized
tctctatgtgtgtgtgtgtaca

SEQ ID NO: 13190 - DNA, 22 bp, Artificial Sequence
  chemically synthesized
tctatgtgtgtgtgtgtacata

SEQ ID NO: 13191 - DNA, 22 bp, Artificial Sequence
  chemically synthesized
tatgtgtgtgtgtgtacatata

SEQ ID NO: 13192 - DNA, 22 bp, Artificial Sequence
  chemically synthesized
tgtgtgtgtgtgtacatatata

SEQ ID NO: 13193 - DNA, 22 bp, Artificial Sequence
  chemically synthesized
gctgcacaatgacattttggtc

SEQ ID NO: 13194 - DNA, 22 bp, Artificial Sequence
  chemically synthesized
ctgcacaatgacattttggtca

SEQ ID NO: 13195 - DNA, 22 bp, Artificial Sequence
  chemically synthesized
cacaatgacattttggtcaatg

SEQ ID NO: 13196 - DNA, 22 bp, Artificial Sequence
  chemically synthesized
tggtcaatgatggaccacatta

SEQ ID NO: 13197 - DNA, 22 bp, Artificial Sequence
  chemically synthesized
ggtcaatgatggaccacattat

SEQ ID NO: 13198 - DNA, 22 bp, Artificial Sequence
  chemically synthesized
gtcaatgatggaccacattata

SEQ ID NO: 13199 - DNA, 22 bp, Artificial Sequence
  chemically synthesized
tacgacagtggtcccataaggt

SEQ ID NO: 13200 - DNA, 22 bp, Artificial Sequence
  chemically synthesized
taatactgtattttcactgtac

SEQ ID NO: 13201 - DNA, 22 bp, Artificial Sequence
  chemically synthesized
tattttcactgtaccttttcta

SEQ ID NO: 13202 - DNA, 22 bp, Artificial Sequence
  chemically synthesized
tcactgtaccttttctatgttt

SEQ ID NO: 13203 - DNA, 22 bp, Artificial Sequence
  chemically synthesized
cactgtaccttttctatgttta

SEQ ID NO: 13204 - DNA, 22 bp, Artificial Sequence
  chemically synthesized
actgtaccttttctatgtttag

SEQ ID NO: 13205 - DNA, 22 bp, Artificial Sequence
  chemically synthesized
taccttttctatgtttagatac

SEQ ID NO: 13206 - DNA, 22 bp, Artificial Sequence
  chemically synthesized
ttctatgtttagatacacaaat

SEQ ID NO: 13207 - DNA, 22 bp, Artificial Sequence
  chemically synthesized
tctatgtttagatacacaaata

SEQ ID NO: 13208 - DNA, 22 bp, Artificial Sequence
  chemically synthesized
ctatgtttagatacacaaatac

SEQ ID NO: 13209 - DNA, 22 bp, Artificial Sequence
  chemically synthesized
tatgtttagatacacaaatacc

SEQ ID NO: 13210 - DNA, 22 bp, Artificial Sequence
  chemically synthesized
tgtttagatacacaaataccac

SEQ ID NO: 13211 - DNA, 22 bp, Artificial Sequence
  chemically synthesized
agatacacaaataccactgtta

SEQ ID NO: 13212 - DNA, 22 bp, Artificial Sequence
  chemically synthesized
gatacacaaataccactgttac

SEQ ID NO: 13213 - DNA, 22 bp, Artificial Sequence
  chemically synthesized
ttaccattgcctacagtgttca

SEQ ID NO: 13214 - DNA, 22 bp, Artificial Sequence
  chemically synthesized
ccattgcctacagtgttcagta

SEQ ID NO: 13215 - DNA, 22 bp, Artificial Sequence
  chemically synthesized
cctacagtgttcagtacagtca

SEQ ID NO: 13216 - DNA, 22 bp, Artificial Sequence
  chemically synthesized
cagtgttcagtacagtcacatg

SEQ ID NO: 13217 - DNA, 22 bp, Artificial Sequence
  chemically synthesized
agtacagtcacatgctgtacag

SEQ ID NO: 13218 - DNA, 22 bp, Artificial Sequence
  chemically synthesized
tacaggtttgcagcccaggagc

SEQ ID NO: 13219 - DNA, 22 bp, Artificial Sequence
  chemically synthesized
gcagcccaggagcctaggagca

SEQ ID NO: 13220 - DNA, 22 bp, Artificial Sequence
  chemically synthesized
cagcccaggagcctaggagcaa

SEQ ID NO: 13221 - DNA, 22 bp, Artificial Sequence
  chemically synthesized
ggagcaataggccacatcaata

SEQ ID NO: 13222 - DNA, 22 bp, Artificial Sequence
  chemically synthesized
ggtatgtagtaagctataccat

SEQ ID NO: 13223 - DNA, 22 bp, Artificial Sequence
  chemically synthesized
taccatttaggtttaggtaagt

SEQ ID NO: 13224 - DNA, 22 bp, Artificial Sequence
  chemically synthesized
aggtttaggtaagtacactcta

SEQ ID NO: 13225 - DNA, 22 bp, Artificial Sequence
  chemically synthesized
ggtttaggtaagtacactctat

SEQ ID NO: 13226 - DNA, 22 bp, Artificial Sequence
  chemically synthesized
aggtaagtacactctattatgt

SEQ ID NO: 13227 - DNA, 22 bp, Artificial Sequence
  chemically synthesized
ggtaagtacactctattatgtt

SEQ ID NO: 13228 - DNA, 22 bp, Artificial Sequence
  chemically synthesized
tattatgttcgcacaatgatga

SEQ ID NO: 13229 - DNA, 22 bp, Artificial Sequence
  chemically synthesized
ttatgttcgcacaatgatgaaa

SEQ ID NO: 13230 - DNA, 22 bp, Artificial Sequence
  chemically synthesized
tgttcgcacaatgatgaaattg

SEQ ID NO: 13231 - DNA, 22 bp, Artificial Sequence
  chemically synthesized
gcacaatgatgaaattgcttaa

SEQ ID NO: 13232 - DNA, 22 bp, Artificial Sequence
  chemically synthesized
cttaatgacacatttctcagaa

SEQ ID NO: 13233 - DNA, 22 bp, Artificial Sequence
  chemically synthesized
aatgacacatttctcagaatat

SEQ ID NO: 13234 - DNA, 22 bp, Artificial Sequence
  chemically synthesized
atgacacatttctcagaatata

SEQ ID NO: 13235 - DNA, 22 bp, Artificial Sequence
  chemically synthesized
ctcagaatatatccccattgtt

SEQ ID NO: 13236 - DNA, 22 bp, Artificial Sequence
  chemically synthesized
tcagaatatatccccattgtta

SEQ ID NO: 13237 - DNA, 22 bp, Artificial Sequence
  chemically synthesized
agaatatatccccattgttaag

SEQ ID NO: 13238 - DNA, 22 bp, Artificial Sequence
  chemically synthesized
ttaaggaatgcatggctgtata

SEQ ID NO: 13239 - DNA, 22 bp, Artificial Sequence
  chemically synthesized
aggaatgcatggctgtatacac

SEQ ID NO: 13240 - DNA, 22 bp, Artificial Sequence
  chemically synthesized
tatacacacacatgtgtttgtg

SEQ ID NO: 13241 - DNA, 22 bp, Artificial Sequence
  chemically synthesized
gtgtgttttcatgtatatacat

SEQ ID NO: 13242 - DNA, 22 bp, Artificial Sequence
  chemically synthesized
tgtgttttcatgtatatacata

SEQ ID NO: 13243 - DNA, 22 bp, Artificial Sequence
  chemically synthesized
tcatgtatatacatatatgtgt

SEQ ID NO: 13244 - DNA, 22 bp, Artificial Sequence
  chemically synthesized
catgtatatacatatatgtgtg

SEQ ID NO: 13245 - DNA, 22 bp, Artificial Sequence
  chemically synthesized
atgtatatacatatatgtgtgt

SEQ ID NO: 13246 - DNA, 22 bp, Artificial Sequence
  chemically synthesized
ataacagggactcaagaagttg

SEQ ID NO: 13247 - DNA, 22 bp, Artificial Sequence
  chemically synthesized
aagaagttgcctggagttgttc

SEQ ID NO: 13248 - DNA, 22 bp, Artificial Sequence
  chemically synthesized
cctggagttgttcctttcttca

SEQ ID NO: 13249 - DNA, 22 bp, Artificial Sequence
  chemically synthesized
gagttgttcctttcttcaaggg

SEQ ID NO: 13250 - DNA, 22 bp, Artificial Sequence
  chemically synthesized
ttcctttcttcaagggtctagc

SEQ ID NO: 13251 - DNA, 22 bp, Artificial Sequence
  chemically synthesized
ctttcttcaagggtctagcaat

SEQ ID NO: 13252 - DNA, 22 bp, Artificial Sequence
  chemically synthesized
tcttcaagggtctagcaatata

SEQ ID NO: 13253 - DNA, 22 bp, Artificial Sequence
  chemically synthesized
cttcaagggtctagcaatatat

SEQ ID NO: 13254 - DNA, 22 bp, Artificial Sequence
  chemically synthesized
ttcaagggtctagcaatatatc

SEQ ID NO: 13255 - DNA, 22 bp, Artificial Sequence
  chemically synthesized
caagggtctagcaatatatctg

SEQ ID NO: 13256 - DNA, 22 bp, Artificial Sequence
  chemically synthesized
aagggtctagcaatatatctga

SEQ ID NO: 13257 - DNA, 22 bp, Artificial Sequence
  chemically synthesized
gcaatatatctgataccatctc

SEQ ID NO: 13258 - DNA, 22 bp, Artificial Sequence
  chemically synthesized
ataccatctcaagaggaccaag

SEQ ID NO: 13259 - DNA, 22 bp, Artificial Sequence
  chemically synthesized
aagaggaccaagggcttataag

SEQ ID NO: 13260 - DNA, 22 bp, Artificial Sequence
  chemically synthesized
ataagatgaactttctggggta

SEQ ID NO: 13261 - DNA, 22 bp, Artificial Sequence
  chemically synthesized
taagatgaactttctggggtat

SEQ ID NO: 13262 - DNA, 22 bp, Artificial Sequence
  chemically synthesized
tctggggtatttgggactactt

SEQ ID NO: 13263 - DNA, 22 bp, Artificial Sequence
  chemically synthesized
ctggggtatttgggactacttc

SEQ ID NO: 13264 - DNA, 22 bp, Artificial Sequence
  chemically synthesized
tggggtatttgggactacttcc

SEQ ID NO: 13265 - DNA, 22 bp, Artificial Sequence
  chemically synthesized
gggtatttgggactacttcctg

SEQ ID NO: 13266 - DNA, 22 bp, Artificial Sequence
  chemically synthesized
gggactacttcctgattaactc

SEQ ID NO: 13267 - DNA, 22 bp, Artificial Sequence
  chemically synthesized
ggactacttcctgattaactcc

SEQ ID NO: 13268 - DNA, 22 bp, Artificial Sequence
  chemically synthesized
cttcctgattaactccaaaaag

SEQ ID NO: 13269 - DNA, 22 bp, Artificial Sequence
  chemically synthesized
cctgattaactccaaaaaggaa

SEQ ID NO: 13270 - DNA, 22 bp, Artificial Sequence
  chemically synthesized
ctgattaactccaaaaaggaag

SEQ ID NO: 13271 - DNA, 22 bp, Artificial Sequence
  chemically synthesized
attaactccaaaaaggaagaga

SEQ ID NO: 13272 - DNA, 22 bp, Artificial Sequence
  chemically synthesized
actccaaaaaggaagagaaagg

SEQ ID NO: 13273 - DNA, 22 bp, Artificial Sequence
  chemically synthesized
caaaaaggaagagaaaggaaag

SEQ ID NO: 13274 - DNA, 22 bp, Artificial Sequence
  chemically synthesized
aactttcttcccttattttcat

SEQ ID NO: 13275 - DNA, 22 bp, Artificial Sequence
  chemically synthesized
tcttcccttattttcattgcag

SEQ ID NO: 13276 - DNA, 22 bp, Artificial Sequence
  chemically synthesized
cttcccttattttcattgcagc

SEQ ID NO: 13277 - DNA, 22 bp, Artificial Sequence
  chemically synthesized
ttcccttattttcattgcagct

SEQ ID NO: 13278 - DNA, 22 bp, Artificial Sequence
  chemically synthesized
cccttattttcattgcagctgt

SEQ ID NO: 13279 - DNA, 22 bp, Artificial Sequence
  chemically synthesized
ccttattttcattgcagctgtt

SEQ ID NO: 13280 - DNA, 22 bp, Artificial Sequence
  chemically synthesized
attttcattgcagctgttcact

SEQ ID NO: 13281 - DNA, 22 bp, Artificial Sequence
  chemically synthesized
ttttcattgcagctgttcactt

SEQ ID NO: 13282 - DNA, 22 bp, Artificial Sequence
  chemically synthesized
tcattgcagctgttcactttat

SEQ ID NO: 13283 - DNA, 22 bp, Artificial Sequence
  chemically synthesized
cattgcagctgttcactttatg

SEQ ID NO: 13284 - DNA, 22 bp, Artificial Sequence
  chemically synthesized
attgcagctgttcactttatgg

SEQ ID NO: 13285 - DNA, 22 bp, Artificial Sequence
  chemically synthesized
cagctgttcactttatggagtg

SEQ ID NO: 13286 - DNA, 22 bp, Artificial Sequence
  chemically synthesized
ttcactttatggagtgttctag

SEQ ID NO: 13287 - DNA, 22 bp, Artificial Sequence
  chemically synthesized
actttatggagtgttctagtcc

SEQ ID NO: 13288 - DNA, 22 bp, Artificial Sequence
  chemically synthesized
tatggagtgttctagtcccttg

SEQ ID NO: 13289 - DNA, 22 bp, Artificial Sequence
  chemically synthesized
atggagtgttctagtcccttga

SEQ ID NO: 13290 - DNA, 22 bp, Artificial Sequence
  chemically synthesized
tggagtgttctagtcccttgac

SEQ ID NO: 13291 - DNA, 22 bp, Artificial Sequence
  chemically synthesized
tagtcccttgacatccctgctt

SEQ ID NO: 13292 - DNA, 22 bp, Artificial Sequence
  chemically synthesized
gtcccttgacatccctgctttt

SEQ ID NO: 13293 - DNA, 22 bp, Artificial Sequence
  chemically synthesized
gacatccctgcttttcccttgc

SEQ ID NO: 13294 - DNA, 22 bp, Artificial Sequence
  chemically synthesized
acatccctgcttttcccttgct

SEQ ID NO: 13295 - DNA, 22 bp, Artificial Sequence
  chemically synthesized
cttttcccttgctctgcaagtt

SEQ ID NO: 13296 - DNA, 22 bp, Artificial Sequence
  chemically synthesized
ttcccttgctctgcaagttcct

SEQ ID NO: 13297 - DNA, 22 bp, Artificial Sequence
  chemically synthesized
tcccttgctctgcaagttcctt

SEQ ID NO: 13298 - DNA, 22 bp, Artificial Sequence
  chemically synthesized
cccttgctctgcaagttccttt

SEQ ID NO: 13299 - DNA, 22 bp, Artificial Sequence
  chemically synthesized
ccttgctctgcaagttcctttt

SEQ ID NO: 13300 - DNA, 22 bp, Artificial Sequence
  chemically synthesized
gctctgcaagttccttttgggc

SEQ ID NO: 13301 - DNA, 22 bp, Artificial Sequence
  chemically synthesized
ctctgcaagttccttttgggct

SEQ ID NO: 13302 - DNA, 22 bp, Artificial Sequence
  chemically synthesized
tgcaagttccttttgggctcac

SEQ ID NO: 13303 - DNA, 22 bp, Artificial Sequence
  chemically synthesized
caagttccttttgggctcactt

SEQ ID NO: 13304 - DNA, 22 bp, Artificial Sequence
  chemically synthesized
cttttgggctcactttttttct

SEQ ID NO: 13305 - DNA, 22 bp, Artificial Sequence
  chemically synthesized
ttgggctcactttttttctttg

SEQ ID NO: 13306 - DNA, 22 bp, Artificial Sequence
  chemically synthesized
tgggctcactttttttctttga

SEQ ID NO: 13307 - DNA, 22 bp, Artificial Sequence
  chemically synthesized
gggctcactttttttctttgaa

SEQ ID NO: 13308 - DNA, 22 bp, Artificial Sequence
  chemically synthesized
ggctcactttttttctttgaat

SEQ ID NO: 13309 - DNA, 22 bp, Artificial Sequence
  chemically synthesized
actttttttctttgaatttagc

SEQ ID NO: 13310 - DNA, 22 bp, Artificial Sequence
  chemically synthesized
tttttctttgaatttagcctag

SEQ ID NO: 13311 - DNA, 22 bp, Artificial Sequence
  chemically synthesized
ttttctttgaatttagcctaga

SEQ ID NO: 13312 - DNA, 22 bp, Artificial Sequence
  chemically synthesized
tttctttgaatttagcctagac

SEQ ID NO: 13313 - DNA, 22 bp, Artificial Sequence
  chemically synthesized
ttctttgaatttagcctagact

SEQ ID NO: 13314 - DNA, 22 bp, Artificial Sequence
  chemically synthesized
tctttgaatttagcctagactt

SEQ ID NO: 13315 - DNA, 22 bp, Artificial Sequence
  chemically synthesized
ctttgaatttagcctagacttt

SEQ ID NO: 13316 - DNA, 22 bp, Artificial Sequence
  chemically synthesized
tttgaatttagcctagactttt

SEQ ID NO: 13317 - DNA, 22 bp, Artificial Sequence
  chemically synthesized
tgaatttagcctagactttttc

SEQ ID NO: 13318 - DNA, 22 bp, Artificial Sequence
  chemically synthesized
gaatttagcctagactttttct

SEQ ID NO: 13319 - DNA, 22 bp, Artificial Sequence
  chemically synthesized
aatttagcctagactttttctc

SEQ ID NO: 13320 - DNA, 22 bp, Artificial Sequence
  chemically synthesized
agcctagactttttctcttcaa

SEQ ID NO: 13321 - DNA, 22 bp, Artificial Sequence
  chemically synthesized
gcctagactttttctcttcaac

SEQ ID NO: 13322 - DNA, 22 bp, Artificial Sequence
  chemically synthesized
gactttttctcttcaactcttt

SEQ ID NO: 13323 - DNA, 22 bp, Artificial Sequence
  chemically synthesized
tttctcttcaactctttttttt

SEQ ID NO: 13324 - DNA, 22 bp, Artificial Sequence
  chemically synthesized
ttctcttcaactcttttttttt

SEQ ID NO: 13325 - DNA, 22 bp, Artificial Sequence
  chemically synthesized
tctcttcaactctttttttttt

SEQ ID NO: 13326 - DNA, 22 bp, Artificial Sequence
  chemically synthesized
ctcttcaactcttttttttttg

SEQ ID NO: 13327 - DNA, 22 bp, Artificial Sequence
  chemically synthesized
tcttcaactcttttttttttga

SEQ ID NO: 13328 - DNA, 22 bp, Artificial Sequence
  chemically synthesized
ttcaactcttttttttttgaca

SEQ ID NO: 13329 - DNA, 22 bp, Artificial Sequence
  chemically synthesized
caactcttttttttttgacaga

SEQ ID NO: 13330 - DNA, 22 bp, Artificial Sequence
  chemically synthesized
aactcttttttttttgacagag

SEQ ID NO: 13331 - DNA, 22 bp, Artificial Sequence
  chemically synthesized
ttttttttttgacagagtcttg

SEQ ID NO: 13332 - DNA, 22 bp, Artificial Sequence
  chemically synthesized
ttttttttgacagagtcttgct

SEQ ID NO: 13333 - DNA, 22 bp, Artificial Sequence
  chemically synthesized
tttttttgacagagtcttgctc

SEQ ID NO: 13334 - DNA, 22 bp, Artificial Sequence
  chemically synthesized
ttttttgacagagtcttgctct

SEQ ID NO: 13335 - DNA, 22 bp, Artificial Sequence
  chemically synthesized
tttttgacagagtcttgctctg

SEQ ID NO: 13336 - DNA, 22 bp, Artificial Sequence
  chemically synthesized
ttttgacagagtcttgctctgt

SEQ ID NO: 13337 - DNA, 22 bp, Artificial Sequence
  chemically synthesized
tttgacagagtcttgctctgtc

SEQ ID NO: 13338 - DNA, 22 bp, Artificial Sequence
  chemically synthesized
ttgacagagtcttgctctgtcg

SEQ ID NO: 13339 - DNA, 22 bp, Artificial Sequence
  chemically synthesized
tgacagagtcttgctctgtcgc

SEQ ID NO: 13340 - DNA, 22 bp, Artificial Sequence
  chemically synthesized
gacagagtcttgctctgtcgcc

SEQ ID NO: 13341 - DNA, 22 bp, Artificial Sequence
  chemically synthesized
acagagtcttgctctgtcgccc

SEQ ID NO: 13342 - DNA, 22 bp, Artificial Sequence
  chemically synthesized
gctctgtcgcccaggctggagt

SEQ ID NO: 13343 - DNA, 22 bp, Artificial Sequence
  chemically synthesized
ctctgtcgcccaggctggagtg

SEQ ID NO: 13344 - DNA, 22 bp, Artificial Sequence
  chemically synthesized
tgtcgcccaggctggagtgcag

SEQ ID NO: 13345 - DNA, 22 bp, Artificial Sequence
  chemically synthesized
tcgcccaggctggagtgcagtg

SEQ ID NO: 13346 - DNA, 22 bp, Artificial Sequence
  chemically synthesized
gagtgcagtggtgcgatctcag

SEQ ID NO: 13347 - DNA, 22 bp, Artificial Sequence
  chemically synthesized
agctcactgcaacctccatctc

SEQ ID NO: 13348 - DNA, 22 bp, Artificial Sequence
  chemically synthesized
actgcaacctccatctcccagg

SEQ ID NO: 13349 - DNA, 22 bp, Artificial Sequence
  chemically synthesized
caacctccatctcccaggttca

SEQ ID NO: 13350 - DNA, 22 bp, Artificial Sequence
  chemically synthesized
catctcccaggttcaagctatt

SEQ ID NO: 13351 - DNA, 22 bp, Artificial Sequence
  chemically synthesized
ccaggttcaagctattctcctg

SEQ ID NO: 13352 - DNA, 22 bp, Artificial Sequence
  chemically synthesized
aagctattctcctgcctcagcc

SEQ ID NO: 13353 - DNA, 22 bp, Artificial Sequence
  chemically synthesized
ttctcctgcctcagcctcccaa

SEQ ID NO: 13354 - DNA, 22 bp, Artificial Sequence
  chemically synthesized
tcctgcctcagcctcccaagta

SEQ ID NO: 13355 - DNA, 22 bp, Artificial Sequence
  chemically synthesized
ctgcctcagcctcccaagtagc

SEQ ID NO: 13356 - DNA, 22 bp, Artificial Sequence
  chemically synthesized
cctcagcctcccaagtagctgg

SEQ ID NO: 13357 - DNA, 22 bp, Artificial Sequence
  chemically synthesized
agcctcccaagtagctgggatt

SEQ ID NO: 13358 - DNA, 22 bp, Artificial Sequence
  chemically synthesized
ccaagtagctgggattacaggc

SEQ ID NO: 13359 - DNA, 22 bp, Artificial Sequence
  chemically synthesized
ggattacaggcacccgccacca

SEQ ID NO: 13360 - DNA, 22 bp, Artificial Sequence
  chemically synthesized
caggcacccgccaccatgccca

SEQ ID NO: 13361 - DNA, 22 bp, Artificial Sequence
  chemically synthesized
atttttgtatttttagtaaagc

SEQ ID NO: 13362 - DNA, 22 bp, Artificial Sequence
  chemically synthesized
ttgtatttttagtaaagccggg

SEQ ID NO: 13363 - DNA, 22 bp, Artificial Sequence
  chemically synthesized
tgtatttttagtaaagccgggg

SEQ ID NO: 13364 - DNA, 22 bp, Artificial Sequence
  chemically synthesized
gtatttttagtaaagccggggt

SEQ ID NO: 13365 - DNA, 22 bp, Artificial Sequence
  chemically synthesized
tatttttagtaaagccggggtt

SEQ ID NO: 13366 - DNA, 22 bp, Artificial Sequence
  chemically synthesized
ttagtaaagccggggtttcacc

SEQ ID NO: 13367 - DNA, 22 bp, Artificial Sequence
  chemically synthesized
tagtaaagccggggtttcacca

SEQ ID NO: 13368 - DNA, 22 bp, Artificial Sequence
  chemically synthesized
agtaaagccggggtttcaccat

SEQ ID NO: 13369 - DNA, 22 bp, Artificial Sequence
  chemically synthesized
gtaaagccggggtttcaccatt

SEQ ID NO: 13370 - DNA, 22 bp, Artificial Sequence
  chemically synthesized
caccatttcaccttgttggcca

SEQ ID NO: 13371 - DNA, 22 bp, Artificial Sequence
  chemically synthesized
accatttcaccttgttggccag

SEQ ID NO: 13372 - DNA, 22 bp, Artificial Sequence
  chemically synthesized
caccttgttggccaggctggtg

SEQ ID NO: 13373 - DNA, 22 bp, Artificial Sequence
  chemically synthesized
accttgttggccaggctggtgt

SEQ ID NO: 13374 - DNA, 22 bp, Artificial Sequence
  chemically synthesized
gttggccaggctggtgtcgaac

SEQ ID NO: 13375 - DNA, 22 bp, Artificial Sequence
  chemically synthesized
ttggccaggctggtgtcgaact

SEQ ID NO: 13376 - DNA, 22 bp, Artificial Sequence
  chemically synthesized
gccaggctggtgtcgaactcct

SEQ ID NO: 13377 - DNA, 22 bp, Artificial Sequence
  chemically synthesized
gtgtcgaactcctgacctcaag

SEQ ID NO: 13378 - DNA, 22 bp, Artificial Sequence
  chemically synthesized
ctgacctcaagtgatctgcctg

SEQ ID NO: 13379 - DNA, 22 bp, Artificial Sequence
  chemically synthesized
acctcaagtgatctgcctgcct

SEQ ID NO: 13380 - DNA, 22 bp, Artificial Sequence
  chemically synthesized
aagtgatctgcctgcctgggcc

SEQ ID NO: 13381 - DNA, 22 bp, Artificial Sequence
  chemically synthesized
cctgcctgggcctctgaaagtg

SEQ ID NO: 13382 - DNA, 22 bp, Artificial Sequence
  chemically synthesized
cctgggcctctgaaagtgctgg

SEQ ID NO: 13383 - DNA, 22 bp, Artificial Sequence
  chemically synthesized
ggcctctgaaagtgctgggatt

SEQ ID NO: 13384 - DNA, 22 bp, Artificial Sequence
  chemically synthesized
tgaaagtgctgggattataggt

SEQ ID NO: 13385 - DNA, 22 bp, Artificial Sequence
  chemically synthesized
aaagtgctgggattataggtgt

SEQ ID NO: 13386 - DNA, 22 bp, Artificial Sequence
  chemically synthesized
ggattataggtgtgagccacca

SEQ ID NO: 13387 - DNA, 22 bp, Artificial Sequence
  chemically synthesized
taggtgtgagccaccatgccag

SEQ ID NO: 13388 - DNA, 22 bp, Artificial Sequence
  chemically synthesized
tcttcaactcttcattggccat

SEQ ID NO: 13389 - DNA, 22 bp, Artificial Sequence
  chemically synthesized
ttcaactcttcattggccatat

SEQ ID NO: 13390 - DNA, 22 bp, Artificial Sequence
  chemically synthesized
caactcttcattggccatattt

SEQ ID NO: 13391 - DNA, 22 bp, Artificial Sequence
  chemically synthesized
aactcttcattggccatatttc

SEQ ID NO: 13392 - DNA, 22 bp, Artificial Sequence
  chemically synthesized
ttcattggccatatttctcaat

SEQ ID NO: 13393 - DNA, 22 bp, Artificial Sequence
  chemically synthesized
cattggccatatttctcaattt

SEQ ID NO: 13394 - DNA, 22 bp, Artificial Sequence
  chemically synthesized
attggccatatttctcaatttc

SEQ ID NO: 13395 - DNA, 22 bp, Artificial Sequence
  chemically synthesized
gccatatttctcaatttccttc

SEQ ID NO: 13396 - DNA, 22 bp, Artificial Sequence
  chemically synthesized
ctcaatttccttcactcgtttg

SEQ ID NO: 13397 - DNA, 22 bp, Artificial Sequence
  chemically synthesized
tcaatttccttcactcgtttgc

SEQ ID NO: 13398 - DNA, 22 bp, Artificial Sequence
  chemically synthesized
aatttccttcactcgtttgcaa

SEQ ID NO: 13399 - DNA, 22 bp, Artificial Sequence
  chemically synthesized
ccttcactcgtttgcaatgctg

SEQ ID NO: 13400 - DNA, 22 bp, Artificial Sequence
  chemically synthesized
cttcactcgtttgcaatgctgt

SEQ ID NO: 13401 - DNA, 22 bp, Artificial Sequence
  chemically synthesized
cactcgtttgcaatgctgtgcc

SEQ ID NO: 13402 - DNA, 22 bp, Artificial Sequence
  chemically synthesized
actcgtttgcaatgctgtgccc

SEQ ID NO: 13403 - DNA, 22 bp, Artificial Sequence
  chemically synthesized
gtttgcaatgctgtgcccaccc

SEQ ID NO: 13404 - DNA, 22 bp, Artificial Sequence
  chemically synthesized
gcaatgctgtgcccaccctgca

SEQ ID NO: 13405 - DNA, 22 bp, Artificial Sequence
  chemically synthesized
caatgctgtgcccaccctgcaa

SEQ ID NO: 13406 - DNA, 22 bp, Artificial Sequence
  chemically synthesized
tgcccaccctgcaatcctagcc

SEQ ID NO: 13407 - DNA, 22 bp, Artificial Sequence
  chemically synthesized
caatcctagcccctaaattgga

SEQ ID NO: 13408 - DNA, 22 bp, Artificial Sequence
  chemically synthesized
gcccctaaattggagcagccat

SEQ ID NO: 13409 - DNA, 22 bp, Artificial Sequence
  chemically synthesized
aattggagcagccatctgcctt

SEQ ID NO: 13410 - DNA, 22 bp, Artificial Sequence
  chemically synthesized
gagcagccatctgccttcatcc

SEQ ID NO: 13411 - DNA, 22 bp, Artificial Sequence
  chemically synthesized
ccttcatccttctcttcccaga

SEQ ID NO: 13412 - DNA, 22 bp, Artificial Sequence
  chemically synthesized
catccttctcttcccagacagc

SEQ ID NO: 13413 - DNA, 22 bp, Artificial Sequence
  chemically synthesized
atccttctcttcccagacagcc

SEQ ID NO: 13414 - DNA, 22 bp, Artificial Sequence
  chemically synthesized
ctcttcccagacagccgaggac

SEQ ID NO: 13415 - DNA, 22 bp, Artificial Sequence
  chemically synthesized
tcttcccagacagccgaggact

SEQ ID NO: 13416 - DNA, 22 bp, Artificial Sequence
  chemically synthesized
ttcccagacagccgaggactgt

SEQ ID NO: 13417 - DNA, 22 bp, Artificial Sequence
  chemically synthesized
cccagacagccgaggactgtga

SEQ ID NO: 13418 - DNA, 22 bp, Artificial Sequence
  chemically synthesized
ccagacagccgaggactgtgaa

SEQ ID NO: 13419 - DNA, 22 bp, Artificial Sequence
  chemically synthesized
tgaaggaaaaaaatcaccaaaa

SEQ ID NO: 13420 - DNA, 22 bp, Artificial Sequence
  chemically synthesized
atgcctcacagcctccacccac

SEQ ID NO: 13421 - DNA, 22 bp, Artificial Sequence
  chemically synthesized
acagcctccacccacctctctg

SEQ ID NO: 13422 - DNA, 22 bp, Artificial Sequence
  chemically synthesized
cacccacctctctgctcagcaa

SEQ ID NO: 13423 - DNA, 22 bp, Artificial Sequence
  chemically synthesized
tctgctcagcaactcatttact

SEQ ID NO: 13424 - DNA, 22 bp, Artificial Sequence
  chemically synthesized
tgctcagcaactcatttacttg

SEQ ID NO: 13425 - DNA, 22 bp, Artificial Sequence
  chemically synthesized
ctcagcaactcatttacttggc

SEQ ID NO: 13426 - DNA, 22 bp, Artificial Sequence
  chemically synthesized
agcaactcatttacttggccct

SEQ ID NO: 13427 - DNA, 22 bp, Artificial Sequence
  chemically synthesized
atttacttggccctggacactc

SEQ ID NO: 13428 - DNA, 22 bp, Artificial Sequence
  chemically synthesized
acttggccctggacactcctaa

SEQ ID NO: 13429 - DNA, 22 bp, Artificial Sequence
  chemically synthesized
cttggccctggacactcctaaa

SEQ ID NO: 13430 - DNA, 22 bp, Artificial Sequence
  chemically synthesized
ggccctggacactcctaaatag

SEQ ID NO: 13431 - DNA, 22 bp, Artificial Sequence
  chemically synthesized
gccctggacactcctaaatagc

SEQ ID NO: 13432 - DNA, 22 bp, Artificial Sequence
  chemically synthesized
gacactcctaaatagcatccat

SEQ ID NO: 13433 - DNA, 22 bp, Artificial Sequence
  chemically synthesized
ctaaatagcatccatgcctgca

SEQ ID NO: 13434 - DNA, 22 bp, Artificial Sequence
  chemically synthesized
aatagcatccatgcctgcatcc

SEQ ID NO: 13435 - DNA, 22 bp, Artificial Sequence
  chemically synthesized
catccatttacagtcgttcctc

SEQ ID NO: 13436 - DNA, 22 bp, Artificial Sequence
  chemically synthesized
acagtcgttcctcagtatccat

SEQ ID NO: 13437 - DNA, 22 bp, Artificial Sequence
  chemically synthesized
cagtcgttcctcagtatccatg

SEQ ID NO: 13438 - DNA, 22 bp, Artificial Sequence
  chemically synthesized
ctcagtatccatggaaaattgg

SEQ ID NO: 13439 - DNA, 22 bp, Artificial Sequence
  chemically synthesized
agtatccatggaaaattggtgg

SEQ ID NO: 13440 - DNA, 22 bp, Artificial Sequence
  chemically synthesized
gtggcaagaccccctgcaaata

SEQ ID NO: 13441 - DNA, 22 bp, Artificial Sequence
  chemically synthesized
caaatatcaagatctgtggatg

SEQ ID NO: 13442 - DNA, 22 bp, Artificial Sequence
  chemically synthesized
tggatgctcaagtctccgatat

SEQ ID NO: 13443 - DNA, 22 bp, Artificial Sequence
  chemically synthesized
aagtctccgatataaaaatggc

SEQ ID NO: 13444 - DNA, 22 bp, Artificial Sequence
  chemically synthesized
cgatataaaaatggcttactat

SEQ ID NO: 13445 - DNA, 22 bp, Artificial Sequence
  chemically synthesized
actatttgcatataacctaaac

SEQ ID NO: 13446 - DNA, 22 bp, Artificial Sequence
  chemically synthesized
ctatttgcatataacctaaaca

SEQ ID NO: 13447 - DNA, 22 bp, Artificial Sequence
  chemically synthesized
tttgcatataacctaaacacat

SEQ ID NO: 13448 - DNA, 22 bp, Artificial Sequence
  chemically synthesized
gcatataacctaaacacatcct

SEQ ID NO: 13449 - DNA, 22 bp, Artificial Sequence
  chemically synthesized
catataacctaaacacatcctc

SEQ ID NO: 13450 - DNA, 22 bp, Artificial Sequence
  chemically synthesized
aacacatcctcctttgtacttt

SEQ ID NO: 13451 - DNA, 22 bp, Artificial Sequence
  chemically synthesized
ctttgtactttaaatcatctct

SEQ ID NO: 13452 - DNA, 22 bp, Artificial Sequence
  chemically synthesized
tgtactttaaatcatctctagg

SEQ ID NO: 13453 - DNA, 22 bp, Artificial Sequence
  chemically synthesized
gtactttaaatcatctctaggt

SEQ ID NO: 13454 - DNA, 22 bp, Artificial Sequence
  chemically synthesized
tactttaaatcatctctaggtt

SEQ ID NO: 13455 - DNA, 22 bp, Artificial Sequence
  chemically synthesized
taaatcatctctaggtttctct

SEQ ID NO: 13456 - DNA, 22 bp, Artificial Sequence
  chemically synthesized
aaatcatctctaggtttctctt

SEQ ID NO: 13457 - DNA, 22 bp, Artificial Sequence
  chemically synthesized
aatcatctctaggtttctctta

SEQ ID NO: 13458 - DNA, 22 bp, Artificial Sequence
  chemically synthesized
taggtttctcttaatagctaat

SEQ ID NO: 13459 - DNA, 22 bp, Artificial Sequence
  chemically synthesized
ggtttctcttaatagctaatac

SEQ ID NO: 13460 - DNA, 22 bp, Artificial Sequence
  chemically synthesized
ctcttaatagctaatacaatgt

SEQ ID NO: 13461 - DNA, 22 bp, Artificial Sequence
  chemically synthesized
tcttaatagctaatacaatgta

SEQ ID NO: 13462 - DNA, 22 bp, Artificial Sequence
  chemically synthesized
ttaatagctaatacaatgtaaa

SEQ ID NO: 13463 - DNA, 22 bp, Artificial Sequence
  chemically synthesized
aatagctaatacaatgtaaatg

SEQ ID NO: 13464 - DNA, 22 bp, Artificial Sequence
  chemically synthesized
atagctaatacaatgtaaatgc

SEQ ID NO: 13465 - DNA, 22 bp, Artificial Sequence
  chemically synthesized
atacaatgtaaatgctatgtaa

SEQ ID NO: 13466 - DNA, 22 bp, Artificial Sequence
  chemically synthesized
tgtaaatagttgttatgctgta

SEQ ID NO: 13467 - DNA, 22 bp, Artificial Sequence
  chemically synthesized
ttatgctgtattgtttagggaa

SEQ ID NO: 13468 - DNA, 22 bp, Artificial Sequence
  chemically synthesized
tgctgtattgtttagggaataa

SEQ ID NO: 13469 - DNA, 22 bp, Artificial Sequence
  chemically synthesized
tattgtttagggaataatgaaa

SEQ ID NO: 13470 - DNA, 22 bp, Artificial Sequence
  chemically synthesized
tttagggaataatgaaagataa

SEQ ID NO: 13471 - DNA, 22 bp, Artificial Sequence
  chemically synthesized
agggaataatgaaagataaaag

SEQ ID NO: 13472 - DNA, 22 bp, Artificial Sequence
  chemically synthesized
gggaataatgaaagataaaaga

SEQ ID NO: 13473 - DNA, 22 bp, Artificial Sequence
  chemically synthesized
tacatgttcagtagagatgcaa

SEQ ID NO: 13474 - DNA, 22 bp, Artificial Sequence
  chemically synthesized
agtagagatgcaaccatccatt

SEQ ID NO: 13475 - DNA, 22 bp, Artificial Sequence
  chemically synthesized
ttttcttgaatatttttgatct

SEQ ID NO: 13476 - DNA, 22 bp, Artificial Sequence
  chemically synthesized
tttcttgaatatttttgatctg

SEQ ID NO: 13477 - DNA, 22 bp, Artificial Sequence
  chemically synthesized
ttcttgaatatttttgatctgc

SEQ ID NO: 13478 - DNA, 22 bp, Artificial Sequence
  chemically synthesized
tcttgaatatttttgatctgca

SEQ ID NO: 13479 - DNA, 22 bp, Artificial Sequence
  chemically synthesized
cttgaatatttttgatctgcag

SEQ ID NO: 13480 - DNA, 22 bp, Artificial Sequence
  chemically synthesized
ttgaatatttttgatctgcagt

SEQ ID NO: 13481 - DNA, 22 bp, Artificial Sequence
  chemically synthesized
gaatatttttgatctgcagtta

SEQ ID NO: 13482 - DNA, 22 bp, Artificial Sequence
  chemically synthesized
aatatttttgatctgcagttaa

SEQ ID NO: 13483 - DNA, 22 bp, Artificial Sequence
  chemically synthesized
ttgatctgcagttaattgaatc

SEQ ID NO: 13484 - DNA, 22 bp, Artificial Sequence
  chemically synthesized
tgatctgcagttaattgaatct

SEQ ID NO: 13485 - DNA, 22 bp, Artificial Sequence
  chemically synthesized
gatctgcagttaattgaatctg

SEQ ID NO: 13486 - DNA, 22 bp, Artificial Sequence
  chemically synthesized
atctgcagttaattgaatctgt

SEQ ID NO: 13487 - DNA, 22 bp, Artificial Sequence
  chemically synthesized
cagttaattgaatctgtggctg

SEQ ID NO: 13488 - DNA, 22 bp, Artificial Sequence
  chemically synthesized
attgaatctgtggctgtggaac

SEQ ID NO: 13489 - DNA, 22 bp, Artificial Sequence
  chemically synthesized
aatctgtggctgtggaactcac

SEQ ID NO: 13490 - DNA, 22 bp, Artificial Sequence
  chemically synthesized
tggctgtggaactcacaaggag

SEQ ID NO: 13491 - DNA, 22 bp, Artificial Sequence
  chemically synthesized
tggaactcacaaggagagctga

SEQ ID NO: 13492 - DNA, 22 bp, Artificial Sequence
  chemically synthesized
acaaggagagctgactgtacag

SEQ ID NO: 13493 - DNA, 22 bp, Artificial Sequence
  chemically synthesized
actgtacagtgtggttgagtga

SEQ ID NO: 13494 - DNA, 22 bp, Artificial Sequence
  chemically synthesized
tacagtgtggttgagtgaaaaa

SEQ ID NO: 13495 - DNA, 22 bp, Artificial Sequence
  chemically synthesized
agtgaaaaaacagactttagaa

SEQ ID NO: 13496 - DNA, 22 bp, Artificial Sequence
  chemically synthesized
tagaatcagatcagacagaaat

SEQ ID NO: 13497 - DNA, 22 bp, Artificial Sequence
  chemically synthesized
agaatcagatcagacagaaata

SEQ ID NO: 13498 - DNA, 22 bp, Artificial Sequence
  chemically synthesized
gaatcagatcagacagaaatag

SEQ ID NO: 13499 - DNA, 22 bp, Artificial Sequence
  chemically synthesized
gaatcaagtatctgcctcctct

SEQ ID NO: 13500 - DNA, 22 bp, Artificial Sequence
  chemically synthesized
aatcaagtatctgcctcctcta

SEQ ID NO: 13501 - DNA, 22 bp, Artificial Sequence
  chemically synthesized
cctcctctagacctgtgacctt

SEQ ID NO: 13502 - DNA, 22 bp, Artificial Sequence
  chemically synthesized
ctctagacctgtgaccttggac

SEQ ID NO: 13503 - DNA, 22 bp, Artificial Sequence
  chemically synthesized
tagacctgtgaccttggacaag

SEQ ID NO: 13504 - DNA, 22 bp, Artificial Sequence
  chemically synthesized
gacctgtgaccttggacaagtc

SEQ ID NO: 13505 - DNA, 22 bp, Artificial Sequence
  chemically synthesized
tgaccttggacaagtcacacaa

SEQ ID NO: 13506 - DNA, 22 bp, Artificial Sequence
  chemically synthesized
ggacaagtcacacaagctctga

SEQ ID NO: 13507 - DNA, 22 bp, Artificial Sequence
  chemically synthesized
gacaagtcacacaagctctgaa

SEQ ID NO: 13508 - DNA, 22 bp, Artificial Sequence
  chemically synthesized
tgaaccttaactttgtcaaatg

SEQ ID NO: 13509 - DNA, 22 bp, Artificial Sequence
  chemically synthesized
aaccttaactttgtcaaatgta

SEQ ID NO: 13510 - DNA, 22 bp, Artificial Sequence
  chemically synthesized
aactttgtcaaatgtaaattag

SEQ ID NO: 13511 - DNA, 22 bp, Artificial Sequence
  chemically synthesized
actttgtcaaatgtaaattagg

SEQ ID NO: 13512 - DNA, 22 bp, Artificial Sequence
  chemically synthesized
tgtcaaatgtaaattaggttta

SEQ ID NO: 13513 - DNA, 22 bp, Artificial Sequence
  chemically synthesized
gtcaaatgtaaattaggtttaa

SEQ ID NO: 13514 - DNA, 22 bp, Artificial Sequence
  chemically synthesized
tcaaatgtaaattaggtttaac

SEQ ID NO: 13515 - DNA, 22 bp, Artificial Sequence
  chemically synthesized
ggtttaacagtagtataataag

SEQ ID NO: 13516 - DNA, 22 bp, Artificial Sequence
  chemically synthesized
aacagtagtataataagaatat

SEQ ID NO: 13517 - DNA, 22 bp, Artificial Sequence
  chemically synthesized
acagtagtataataagaatatc

SEQ ID NO: 13518 - DNA, 22 bp, Artificial Sequence
  chemically synthesized
tctcacaggtgttggcaggatc

SEQ ID NO: 13519 - DNA, 22 bp, Artificial Sequence
  chemically synthesized
acaggtgttggcaggatcagtg

SEQ ID NO: 13520 - DNA, 22 bp, Artificial Sequence
  chemically synthesized
gcaggatcagtgagacaatatg

SEQ ID NO: 13521 - DNA, 22 bp, Artificial Sequence
  chemically synthesized
gttatctctttttctccctact

SEQ ID NO: 13522 - DNA, 22 bp, Artificial Sequence
  chemically synthesized
tctctttttctccctactcctt

SEQ ID NO: 13523 - DNA, 22 bp, Artificial Sequence
  chemically synthesized
tttttctccctactcctttcat

SEQ ID NO: 13524 - DNA, 22 bp, Artificial Sequence
  chemically synthesized
tttctccctactcctttcatgt

SEQ ID NO: 13525 - DNA, 22 bp, Artificial Sequence
  chemically synthesized
ttctccctactcctttcatgtt

SEQ ID NO: 13526 - DNA, 22 bp, Artificial Sequence
  chemically synthesized
tctccctactcctttcatgttg

SEQ ID NO: 13527 - DNA, 22 bp, Artificial Sequence
  chemically synthesized
ctccctactcctttcatgttgg

SEQ ID NO: 13528 - DNA, 22 bp, Artificial Sequence
  chemically synthesized
tccctactcctttcatgttggc

SEQ ID NO: 13529 - DNA, 22 bp, Artificial Sequence
  chemically synthesized
cctactcctttcatgttggccc

SEQ ID NO: 13530 - DNA, 22 bp, Artificial Sequence
  chemically synthesized
ctcctttcatgttggccctact

SEQ ID NO: 13531 - DNA, 22 bp, Artificial Sequence
  chemically synthesized
ctttcatgttggccctactttc

SEQ ID NO: 13532 - DNA, 22 bp, Artificial Sequence
  chemically synthesized
tcatgttggccctactttcttc

SEQ ID NO: 13533 - DNA, 22 bp, Artificial Sequence
  chemically synthesized
catgttggccctactttcttct

SEQ ID NO: 13534 - DNA, 22 bp, Artificial Sequence
  chemically synthesized
atgttggccctactttcttctg

SEQ ID NO: 13535 - DNA, 22 bp, Artificial Sequence
  chemically synthesized
gccctactttcttctgttttaa

SEQ ID NO: 13536 - DNA, 22 bp, Artificial Sequence
  chemically synthesized
ctttcttctgttttaaatttct

SEQ ID NO: 13537 - DNA, 22 bp, Artificial Sequence
  chemically synthesized
tcttctgttttaaatttctcaa

SEQ ID NO: 13538 - DNA, 22 bp, Artificial Sequence
  chemically synthesized
cttctgttttaaatttctcaat

SEQ ID NO: 13539 - DNA, 22 bp, Artificial Sequence
  chemically synthesized
ttctgttttaaatttctcaatt

SEQ ID NO: 13540 - DNA, 22 bp, Artificial Sequence
  chemically synthesized
ctgttttaaatttctcaattct

SEQ ID NO: 13541 - DNA, 22 bp, Artificial Sequence
  chemically synthesized
tgttttaaatttctcaattctc

SEQ ID NO: 13542 - DNA, 22 bp, Artificial Sequence
  chemically synthesized
ttttaaatttctcaattctctt

SEQ ID NO: 13543 - DNA, 22 bp, Artificial Sequence
  chemically synthesized
taaatttctcaattctctttag

SEQ ID NO: 13544 - DNA, 22 bp, Artificial Sequence
  chemically synthesized
aaatttctcaattctctttagc

SEQ ID NO: 13545 - DNA, 22 bp, Artificial Sequence
  chemically synthesized
aatttctcaattctctttagct

SEQ ID NO: 13546 - DNA, 22 bp, Artificial Sequence
  chemically synthesized
ctcaattctctttagctcttta

SEQ ID NO: 13547 - DNA, 22 bp, Artificial Sequence
  chemically synthesized
tcaattctctttagctctttaa

SEQ ID NO: 13548 - DNA, 22 bp, Artificial Sequence
  chemically synthesized
aattctctttagctctttaata

SEQ ID NO: 13549 - DNA, 22 bp, Artificial Sequence
  chemically synthesized
tctttagctctttaataacttc

SEQ ID NO: 13550 - DNA, 22 bp, Artificial Sequence
  chemically synthesized
tttagctctttaataacttctg

SEQ ID NO: 13551 - DNA, 22 bp, Artificial Sequence
  chemically synthesized
tagctctttaataacttctgtg

SEQ ID NO: 13552 - DNA, 22 bp, Artificial Sequence
  chemically synthesized
agctctttaataacttctgtgt

SEQ ID NO: 13553 - DNA, 22 bp, Artificial Sequence
  chemically synthesized
gctctttaataacttctgtgta

SEQ ID NO: 13554 - DNA, 22 bp, Artificial Sequence
  chemically synthesized
tttaataacttctgtgtagctc

SEQ ID NO: 13555 - DNA, 22 bp, Artificial Sequence
  chemically synthesized
taataacttctgtgtagctctt

SEQ ID NO: 13556 - DNA, 22 bp, Artificial Sequence
  chemically synthesized
aataacttctgtgtagctcttt

SEQ ID NO: 13557 - DNA, 22 bp, Artificial Sequence
  chemically synthesized
ataacttctgtgtagctctttt

SEQ ID NO: 13558 - DNA, 22 bp, Artificial Sequence
  chemically synthesized
ctgtgtagctcttttccttcct

SEQ ID NO: 13559 - DNA, 22 bp, Artificial Sequence
  chemically synthesized
tgtgtagctcttttccttcctt

SEQ ID NO: 13560 - DNA, 22 bp, Artificial Sequence
  chemically synthesized
tgtagctcttttccttccttaa

SEQ ID NO: 13561 - DNA, 22 bp, Artificial Sequence
  chemically synthesized
ttttccttccttaatcacattt

SEQ ID NO: 13562 - DNA, 22 bp, Artificial Sequence
  chemically synthesized
ttccttccttaatcacatttat

SEQ ID NO: 13563 - DNA, 22 bp, Artificial Sequence
  chemically synthesized
tccttccttaatcacatttata

SEQ ID NO: 13564 - DNA, 22 bp, Artificial Sequence
  chemically synthesized
ccttccttaatcacatttatat

SEQ ID NO: 13565 - DNA, 22 bp, Artificial Sequence
  chemically synthesized
cttccttaatcacatttatata

SEQ ID NO: 13566 - DNA, 22 bp, Artificial Sequence
  chemically synthesized
ccttaatcacatttatataatg

SEQ ID NO: 13567 - DNA, 22 bp, Artificial Sequence
  chemically synthesized
cttaatcacatttatataatga

SEQ ID NO: 13568 - DNA, 22 bp, Artificial Sequence
  chemically synthesized
aatcacatttatataatgaaat

SEQ ID NO: 13569 - DNA, 22 bp, Artificial Sequence
  chemically synthesized
atcacatttatataatgaaatg

SEQ ID NO: 13570 - DNA, 22 bp, Artificial Sequence
  chemically synthesized
atataatgaaatgactattgtc

SEQ ID NO: 13571 - DNA, 22 bp, Artificial Sequence
  chemically synthesized
tataatgaaatgactattgtca

SEQ ID NO: 13572 - DNA, 22 bp, Artificial Sequence
  chemically synthesized
ttgtcacaatcaggaatgacct

SEQ ID NO: 13573 - DNA, 22 bp, Artificial Sequence
  chemically synthesized
tcacaatcaggaatgacctaaa

SEQ ID NO: 13574 - DNA, 22 bp, Artificial Sequence
  chemically synthesized
aagaataattttgagtttatgt

SEQ ID NO: 13575 - DNA, 22 bp, Artificial Sequence
  chemically synthesized
tgagtttatgtatttactggct

SEQ ID NO: 13576 - DNA, 22 bp, Artificial Sequence
  chemically synthesized
gagtttatgtatttactggctg

SEQ ID NO: 13577 - DNA, 22 bp, Artificial Sequence
  chemically synthesized
agtttatgtatttactggctgc

SEQ ID NO: 13578 - DNA, 22 bp, Artificial Sequence
  chemically synthesized
atgtatttactggctgctctaa

SEQ ID NO: 13579 - DNA, 22 bp, Artificial Sequence
  chemically synthesized
tgtatttactggctgctctaaa

SEQ ID NO: 13580 - DNA, 22 bp, Artificial Sequence
  chemically synthesized
actggctgctctaaataatttc

SEQ ID NO: 13581 - DNA, 22 bp, Artificial Sequence
  chemically synthesized
ctggctgctctaaataatttct

SEQ ID NO: 13582 - DNA, 22 bp, Artificial Sequence
  chemically synthesized
gctgctctaaataatttctaat

SEQ ID NO: 13583 - DNA, 22 bp, Artificial Sequence
  chemically synthesized
ctctaaataatttctaattgtt

SEQ ID NO: 13584 - DNA, 22 bp, Artificial Sequence
  chemically synthesized
taaataatttctaattgttgat

SEQ ID NO: 13585 - DNA, 22 bp, Artificial Sequence
  chemically synthesized
aataatttctaattgttgatct

SEQ ID NO: 13586 - DNA, 22 bp, Artificial Sequence
  chemically synthesized
ctaattgttgatctctcccttt

SEQ ID NO: 13587 - DNA, 22 bp, Artificial Sequence
  chemically synthesized
taattgttgatctctccctttt

SEQ ID NO: 13588 - DNA, 22 bp, Artificial Sequence
  chemically synthesized
attgttgatctctcccttttta

SEQ ID NO: 13589 - DNA, 22 bp, Artificial Sequence
  chemically synthesized
ttgatctctccctttttaggaa

SEQ ID NO: 13590 - DNA, 22 bp, Artificial Sequence
  chemically synthesized
atctctccctttttaggaaact

SEQ ID NO: 13591 - DNA, 22 bp, Artificial Sequence
  chemically synthesized
tccctttttaggaaactctttt

SEQ ID NO: 13592 - DNA, 22 bp, Artificial Sequence
  chemically synthesized
cctttttaggaaactcttttta

SEQ ID NO: 13593 - DNA, 22 bp, Artificial Sequence
  chemically synthesized
tttaggaaactctttttataat

SEQ ID NO: 13594 - DNA, 22 bp, Artificial Sequence
  chemically synthesized
ttaggaaactctttttataata

SEQ ID NO: 13595 - DNA, 22 bp, Artificial Sequence
  chemically synthesized
taggaaactctttttataataa

SEQ ID NO: 13596 - DNA, 22 bp, Artificial Sequence
  chemically synthesized
aggaaactctttttataataat

SEQ ID NO: 13597 - DNA, 22 bp, Artificial Sequence
  chemically synthesized
ggaaactctttttataataatc

SEQ ID NO: 13598 - DNA, 22 bp, Artificial Sequence
  chemically synthesized
tttttataataatcactctatt

SEQ ID NO: 13599 - DNA, 22 bp, Artificial Sequence
  chemically synthesized
tttataataatcactctattct

SEQ ID NO: 13600 - DNA, 22 bp, Artificial Sequence
  chemically synthesized
ttataataatcactctattctg

SEQ ID NO: 13601 - DNA, 22 bp, Artificial Sequence
  chemically synthesized
tataataatcactctattctgg

SEQ ID NO: 13602 - DNA, 22 bp, Artificial Sequence
  chemically synthesized
ataataatcactctattctggt

SEQ ID NO: 13603 - DNA, 22 bp, Artificial Sequence
  chemically synthesized
taataatcactctattctggtt

SEQ ID NO: 13604 - DNA, 22 bp, Artificial Sequence
  chemically synthesized
tattctggttccccgctttgct

SEQ ID NO: 13605 - DNA, 22 bp, Artificial Sequence
  chemically synthesized
ttctggttccccgctttgctct

SEQ ID NO: 13606 - DNA, 22 bp, Artificial Sequence
  chemically synthesized
tggttccccgctttgctctaac

SEQ ID NO: 13607 - DNA, 22 bp, Artificial Sequence
  chemically synthesized
gttccccgctttgctctaactc

SEQ ID NO: 13608 - DNA, 22 bp, Artificial Sequence
  chemically synthesized
cccgctttgctctaactcctgt

SEQ ID NO: 13609 - DNA, 22 bp, Artificial Sequence
  chemically synthesized
tgctctaactcctgttatccat

SEQ ID NO: 13610 - DNA, 22 bp, Artificial Sequence
  chemically synthesized
gctctaactcctgttatccatc

SEQ ID NO: 13611 - DNA, 22 bp, Artificial Sequence
  chemically synthesized
ctctaactcctgttatccatcc

SEQ ID NO: 13612 - DNA, 22 bp, Artificial Sequence
  chemically synthesized
taactcctgttatccatccagc

SEQ ID NO: 13613 - DNA, 22 bp, Artificial Sequence
  chemically synthesized
actcctgttatccatccagcac

SEQ ID NO: 13614 - DNA, 22 bp, Artificial Sequence
  chemically synthesized
ctgttatccatccagcacttga

SEQ ID NO: 13615 - DNA, 22 bp, Artificial Sequence
  chemically synthesized
ttatccatccagcacttgaatt

SEQ ID NO: 13616 - DNA, 22 bp, Artificial Sequence
  chemically synthesized
tccatccagcacttgaattgat

SEQ ID NO: 13617 - DNA, 22 bp, Artificial Sequence
  chemically synthesized
gaattgattaactcctgttcct

SEQ ID NO: 13618 - DNA, 22 bp, Artificial Sequence
  chemically synthesized
aattgattaactcctgttcctc

SEQ ID NO: 13619 - DNA, 22 bp, Artificial Sequence
  chemically synthesized
attaactcctgttcctctccat

SEQ ID NO: 13620 - DNA, 22 bp, Artificial Sequence
  chemically synthesized
actcctgttcctctccatggcc

SEQ ID NO: 13621 - DNA, 22 bp, Artificial Sequence
  chemically synthesized
ctgttcctctccatggccctta

SEQ ID NO: 13622 - DNA, 22 bp, Artificial Sequence
  chemically synthesized
ttcctctccatggcccttaaat

SEQ ID NO: 13623 - DNA, 22 bp, Artificial Sequence
  chemically synthesized
ctctccatggcccttaaatgtc

SEQ ID NO: 13624 - DNA, 22 bp, Artificial Sequence
  chemically synthesized
tccatggcccttaaatgtccag

SEQ ID NO: 13625 - DNA, 22 bp, Artificial Sequence
  chemically synthesized
catggcccttaaatgtccaggg

SEQ ID NO: 13626 - DNA, 22 bp, Artificial Sequence
  chemically synthesized
aaatgtccagggttctcccagg

SEQ ID NO: 13627 - DNA, 22 bp, Artificial Sequence
  chemically synthesized
aatgtccagggttctcccaggc

SEQ ID NO: 13628 - DNA, 22 bp, Artificial Sequence
  chemically synthesized
tcccaggctccagcctcagctt

SEQ ID NO: 13629 - DNA, 22 bp, Artificial Sequence
  chemically synthesized
ccaggctccagcctcagctttt

SEQ ID NO: 13630 - DNA, 22 bp, Artificial Sequence
  chemically synthesized
cagcctcagctttttccttttt

SEQ ID NO: 13631 - DNA, 22 bp, Artificial Sequence
  chemically synthesized
agctttttcctttttcacctta

SEQ ID NO: 13632 - DNA, 22 bp, Artificial Sequence
  chemically synthesized
tttcctttttcaccttatatat

SEQ ID NO: 13633 - DNA, 22 bp, Artificial Sequence
  chemically synthesized
ttcctttttcaccttatatata

SEQ ID NO: 13634 - DNA, 22 bp, Artificial Sequence
  chemically synthesized
tcctttttcaccttatatatac

SEQ ID NO: 13635 - DNA, 22 bp, Artificial Sequence
  chemically synthesized
cctttttcaccttatatatact

SEQ ID NO: 13636 - DNA, 22 bp, Artificial Sequence
  chemically synthesized
ctttttcaccttatatatactt

SEQ ID NO: 13637 - DNA, 22 bp, Artificial Sequence
  chemically synthesized
tttcaccttatatatacttgct

SEQ ID NO: 13638 - DNA, 22 bp, Artificial Sequence
  chemically synthesized
ttcaccttatatatacttgcta

SEQ ID NO: 13639 - DNA, 22 bp, Artificial Sequence
  chemically synthesized
tcaccttatatatacttgctag

SEQ ID NO: 13640 - DNA, 22 bp, Artificial Sequence
  chemically synthesized
caccttatatatacttgctagg

SEQ ID NO: 13641 - DNA, 22 bp, Artificial Sequence
  chemically synthesized
accttatatatacttgctaggg

SEQ ID NO: 13642 - DNA, 22 bp, Artificial Sequence
  chemically synthesized
atatatacttgctagggctggg

SEQ ID NO: 13643 - DNA, 22 bp, Artificial Sequence
  chemically synthesized
tatatacttgctagggctggga

SEQ ID NO: 13644 - DNA, 22 bp, Artificial Sequence
  chemically synthesized
gctagggctgggacaagagtga

SEQ ID NO: 13645 - DNA, 22 bp, Artificial Sequence
  chemically synthesized
ctagggctgggacaagagtgaa

SEQ ID NO: 13646 - DNA, 22 bp, Artificial Sequence
  chemically synthesized
gggctgggacaagagtgaacca

SEQ ID NO: 13647 - DNA, 22 bp, Artificial Sequence
  chemically synthesized
ggacaagagtgaaccaaacaag

SEQ ID NO: 13648 - DNA, 22 bp, Artificial Sequence
  chemically synthesized
aagaggtcctcacttctcgggg

SEQ ID NO: 13649 - DNA, 22 bp, Artificial Sequence
  chemically synthesized
agaggtcctcacttctcggggc

SEQ ID NO: 13650 - DNA, 22 bp, Artificial Sequence
  chemically synthesized
acttctcggggcatacaagtat

SEQ ID NO: 13651 - DNA, 22 bp, Artificial Sequence
  chemically synthesized
ctcggggcatacaagtatattt

SEQ ID NO: 13652 - DNA, 22 bp, Artificial Sequence
  chemically synthesized
tcggggcatacaagtatattta

SEQ ID NO: 13653 - DNA, 22 bp, Artificial Sequence
  chemically synthesized
ggggcatacaagtatatttatg

SEQ ID NO: 13654 - DNA, 22 bp, Artificial Sequence
  chemically synthesized
atgccctacaggccttgcttac

SEQ ID NO: 13655 - DNA, 22 bp, Artificial Sequence
  chemically synthesized
tgccctacaggccttgcttacc

SEQ ID NO: 13656 - DNA, 22 bp, Artificial Sequence
  chemically synthesized
caggccttgcttaccacagtct

SEQ ID NO: 13657 - DNA, 22 bp, Artificial Sequence
  chemically synthesized
gcttaccacagtctagtccggc

SEQ ID NO: 13658 - DNA, 22 bp, Artificial Sequence
  chemically synthesized
cttaccacagtctagtccggcc

SEQ ID NO: 13659 - DNA, 22 bp, Artificial Sequence
  chemically synthesized
accacagtctagtccggccctg

SEQ ID NO: 13660 - DNA, 22 bp, Artificial Sequence
  chemically synthesized
ccacagtctagtccggccctga

SEQ ID NO: 13661 - DNA, 22 bp, Artificial Sequence
  chemically synthesized
gtccggccctgaccctgtcaac

SEQ ID NO: 13662 - DNA, 22 bp, Artificial Sequence
  chemically synthesized
accctgtcaacaaaatttactg

SEQ ID NO: 13663 - DNA, 22 bp, Artificial Sequence
  chemically synthesized
tcaacaaaatttactgagcata

SEQ ID NO: 13664 - DNA, 22 bp, Artificial Sequence
  chemically synthesized
actgagcatacaaccactactg

SEQ ID NO: 13665 - DNA, 22 bp, Artificial Sequence
  chemically synthesized
ctgagcatacaaccactactgc

SEQ ID NO: 13666 - DNA, 22 bp, Artificial Sequence
  chemically synthesized
agcatacaaccactactgccag

SEQ ID NO: 13667 - DNA, 22 bp, Artificial Sequence
  chemically synthesized
ctgccaggcactgtactaggta

SEQ ID NO: 13668 - DNA, 22 bp, Artificial Sequence
  chemically synthesized
ccaggcactgtactaggtatca

SEQ ID NO: 13669 - DNA, 22 bp, Artificial Sequence
  chemically synthesized
tactaggtatcacaatatccat

SEQ ID NO: 13670 - DNA, 22 bp, Artificial Sequence
  chemically synthesized
ggtatcacaatatccatgctca

SEQ ID NO: 13671 - DNA, 22 bp, Artificial Sequence
  chemically synthesized
actctccagatgcccacacacg

SEQ ID NO: 13672 - DNA, 22 bp, Artificial Sequence
  chemically synthesized
tccagatgcccacacacgtggc

SEQ ID NO: 13673 - DNA, 22 bp, Artificial Sequence
  chemically synthesized
cagatgcccacacacgtggctg

SEQ ID NO: 13674 - DNA, 22 bp, Artificial Sequence
  chemically synthesized
taactactgtttacagaacaat

SEQ ID NO: 13675 - DNA, 22 bp, Artificial Sequence
  chemically synthesized
ctgtttacagaacaatgagttc

SEQ ID NO: 13676 - DNA, 22 bp, Artificial Sequence
  chemically synthesized
tttacagaacaatgagttccaa

SEQ ID NO: 13677 - DNA, 22 bp, Artificial Sequence
  chemically synthesized
acagaacaatgagttccaaata

SEQ ID NO: 13678 - DNA, 22 bp, Artificial Sequence
  chemically synthesized
cagaacaatgagttccaaatac

SEQ ID NO: 13679 - DNA, 22 bp, Artificial Sequence
  chemically synthesized
caaatactcacctatagtcaga

SEQ ID NO: 13680 - DNA, 22 bp, Artificial Sequence
  chemically synthesized
acctatagtcagatacgtctcc

SEQ ID NO: 13681 - DNA, 22 bp, Artificial Sequence
  chemically synthesized
tagtcagatacgtctcctgaat

SEQ ID NO: 13682 - DNA, 22 bp, Artificial Sequence
  chemically synthesized
ctgaatttcagattatctttcc

SEQ ID NO: 13683 - DNA, 22 bp, Artificial Sequence
  chemically synthesized
aatttcagattatctttccaac

SEQ ID NO: 13684 - DNA, 22 bp, Artificial Sequence
  chemically synthesized
cagattatctttccaactccct

SEQ ID NO: 13685 - DNA, 22 bp, Artificial Sequence
  chemically synthesized
agattatctttccaactcccta

SEQ ID NO: 13686 - DNA, 22 bp, Artificial Sequence
  chemically synthesized
tctttccaactccctaactgta

SEQ ID NO: 13687 - DNA, 22 bp, Artificial Sequence
  chemically synthesized
tccaactccctaactgtatatc

SEQ ID NO: 13688 - DNA, 22 bp, Artificial Sequence
  chemically synthesized
ccaactccctaactgtatatca

SEQ ID NO: 13689 - DNA, 22 bp, Artificial Sequence
  chemically synthesized
caactccctaactgtatatcat

SEQ ID NO: 13690 - DNA, 22 bp, Artificial Sequence
  chemically synthesized
cctaactgtatatcataatgta

SEQ ID NO: 13691 - DNA, 22 bp, Artificial Sequence
  chemically synthesized
actgtatatcataatgtagcca

SEQ ID NO: 13692 - DNA, 22 bp, Artificial Sequence
  chemically synthesized
tatatcataatgtagccagtaa

SEQ ID NO: 13693 - DNA, 22 bp, Artificial Sequence
  chemically synthesized
atgtatatgtaatgcttctgct

SEQ ID NO: 13694 - DNA, 22 bp, Artificial Sequence
  chemically synthesized
ctgctgtgttggacactgtgct

SEQ ID NO: 13695 - DNA, 22 bp, Artificial Sequence
  chemically synthesized
tgctgtgttggacactgtgctc

SEQ ID NO: 13696 - DNA, 22 bp, Artificial Sequence
  chemically synthesized
ctgtgttggacactgtgctcag

SEQ ID NO: 13697 - DNA, 22 bp, Artificial Sequence
  chemically synthesized
tgttggacactgtgctcagtaa

SEQ ID NO: 13698 - DNA, 22 bp, Artificial Sequence
  chemically synthesized
gacactgtgctcagtaactttg

SEQ ID NO: 13699 - DNA, 22 bp, Artificial Sequence
  chemically synthesized
tgctcagtaactttgcatccat

SEQ ID NO: 13700 - DNA, 22 bp, Artificial Sequence
  chemically synthesized
agtaactttgcatccattatct

SEQ ID NO: 13701 - DNA, 22 bp, Artificial Sequence
  chemically synthesized
tgcatccattatctcacttcat

SEQ ID NO: 13702 - DNA, 22 bp, Artificial Sequence
  chemically synthesized
gcatccattatctcacttcatc

SEQ ID NO: 13703 - DNA, 22 bp, Artificial Sequence
  chemically synthesized
catccattatctcacttcatcc

SEQ ID NO: 13704 - DNA, 22 bp, Artificial Sequence
  chemically synthesized
tctcacttcatcctcacaaaag

SEQ ID NO: 13705 - DNA, 22 bp, Artificial Sequence
  chemically synthesized
acttcatcctcacaaaagtccc

SEQ ID NO: 13706 - DNA, 22 bp, Artificial Sequence
  chemically synthesized
catcctcacaaaagtcccacga

SEQ ID NO: 13707 - DNA, 22 bp, Artificial Sequence
  chemically synthesized
atcctcacaaaagtcccacgag

SEQ ID NO: 13708 - DNA, 22 bp, Artificial Sequence
  chemically synthesized
acaaaagtcccacgagataggc

SEQ ID NO: 13709 - DNA, 22 bp, Artificial Sequence
  chemically synthesized
tcatcttatttttatgaatgag

SEQ ID NO: 13710 - DNA, 22 bp, Artificial Sequence
  chemically synthesized
atttttatgaatgaggaagata

SEQ ID NO: 13711 - DNA, 22 bp, Artificial Sequence
  chemically synthesized
tttttatgaatgaggaagatag

SEQ ID NO: 13712 - DNA, 22 bp, Artificial Sequence
  chemically synthesized
ttatgaatgaggaagatagatt

SEQ ID NO: 13713 - DNA, 22 bp, Artificial Sequence
  chemically synthesized
tatgaatgaggaagatagattc

SEQ ID NO: 13714 - DNA, 22 bp, Artificial Sequence
  chemically synthesized
atgaatgaggaagatagattca

SEQ ID NO: 13715 - DNA, 22 bp, Artificial Sequence
  chemically synthesized
tgaatgaggaagatagattcat

SEQ ID NO: 13716 - DNA, 22 bp, Artificial Sequence
  chemically synthesized
atagaggctaagggctttgccc

SEQ ID NO: 13717 - DNA, 22 bp, Artificial Sequence
  chemically synthesized
agggctttgcccaaggtaacat

SEQ ID NO: 13718 - DNA, 22 bp, Artificial Sequence
  chemically synthesized
tgcccaaggtaacatactaaaa

SEQ ID NO: 13719 - DNA, 22 bp, Artificial Sequence
  chemically synthesized
gcccaaggtaacatactaaaac

SEQ ID NO: 13720 - DNA, 22 bp, Artificial Sequence
  chemically synthesized
cccaaggtaacatactaaaaca

SEQ ID NO: 13721 - DNA, 22 bp, Artificial Sequence
  chemically synthesized
aaacattcaggattcagactct

SEQ ID NO: 13722 - DNA, 22 bp, Artificial Sequence
  chemically synthesized
aggattcagactctggcagtca

SEQ ID NO: 13723 - DNA, 22 bp, Artificial Sequence
  chemically synthesized
agactctggcagtcagactaaa

SEQ ID NO: 13724 - DNA, 22 bp, Artificial Sequence
  chemically synthesized
tggcagtcagactaaagagcca

SEQ ID NO: 13725 - DNA, 22 bp, Artificial Sequence
  chemically synthesized
gcagtcagactaaagagccagt

SEQ ID NO: 13726 - DNA, 22 bp, Artificial Sequence
  chemically synthesized
aagagccagttctcttagacat

SEQ ID NO: 13727 - DNA, 22 bp, Artificial Sequence
  chemically synthesized
tcttagacattattctgtggtc

SEQ ID NO: 13728 - DNA, 22 bp, Artificial Sequence
  chemically synthesized
ttagacattattctgtggtcca

SEQ ID NO: 13729 - DNA, 22 bp, Artificial Sequence
  chemically synthesized
agacattattctgtggtccata

SEQ ID NO: 13730 - DNA, 22 bp, Artificial Sequence
  chemically synthesized
gacattattctgtggtccataa

SEQ ID NO: 13731 - DNA, 22 bp, Artificial Sequence
  chemically synthesized
ttctgtggtccataatcacatc

SEQ ID NO: 13732 - DNA, 22 bp, Artificial Sequence
  chemically synthesized
tgtggtccataatcacatcaaa

SEQ ID NO: 13733 - DNA, 22 bp, Artificial Sequence
  chemically synthesized
tggtccataatcacatcaaaca

SEQ ID NO: 13734 - DNA, 22 bp, Artificial Sequence
  chemically synthesized
tagccatttccccttccatacc

SEQ ID NO: 13735 - DNA, 22 bp, Artificial Sequence
  chemically synthesized
gccatttccccttccataccca

SEQ ID NO: 13736 - DNA, 22 bp, Artificial Sequence
  chemically synthesized
ccccttccatacccagatggtt

SEQ ID NO: 13737 - DNA, 22 bp, Artificial Sequence
  chemically synthesized
cccttccatacccagatggtta

SEQ ID NO: 13738 - DNA, 22 bp, Artificial Sequence
  chemically synthesized
ccatacccagatggttaagtca

SEQ ID NO: 13739 - DNA, 22 bp, Artificial Sequence
  chemically synthesized
catacccagatggttaagtcat

SEQ ID NO: 13740 - DNA, 22 bp, Artificial Sequence
  chemically synthesized
agtcataccacttctacttcct

SEQ ID NO: 13741 - DNA, 22 bp, Artificial Sequence
  chemically synthesized
ctacttccttaatatcatttga

SEQ ID NO: 13742 - DNA, 22 bp, Artificial Sequence
  chemically synthesized
tacttccttaatatcatttgaa

SEQ ID NO: 13743 - DNA, 22 bp, Artificial Sequence
  chemically synthesized
cttccttaatatcatttgaact

SEQ ID NO: 13744 - DNA, 22 bp, Artificial Sequence
  chemically synthesized
ccttaatatcatttgaactccc

SEQ ID NO: 13745 - DNA, 22 bp, Artificial Sequence
  chemically synthesized
cttaatatcatttgaactcccc

SEQ ID NO: 13746 - DNA, 22 bp, Artificial Sequence
  chemically synthesized
aatatcatttgaactcccctct

SEQ ID NO: 13747 - DNA, 22 bp, Artificial Sequence
  chemically synthesized
atatcatttgaactcccctctt

SEQ ID NO: 13748 - DNA, 22 bp, Artificial Sequence
  chemically synthesized
gaactcccctctttttttgtac

SEQ ID NO: 13749 - DNA, 22 bp, Artificial Sequence
  chemically synthesized
aactcccctctttttttgtact

SEQ ID NO: 13750 - DNA, 22 bp, Artificial Sequence
  chemically synthesized
ccctctttttttgtactgctac

SEQ ID NO: 13751 - DNA, 22 bp, Artificial Sequence
  chemically synthesized
tttttttgtactgctactgttc

SEQ ID NO: 13752 - DNA, 22 bp, Artificial Sequence
  chemically synthesized
tttttgtactgctactgttcag

SEQ ID NO: 13753 - DNA, 22 bp, Artificial Sequence
  chemically synthesized
ttttgtactgctactgttcagg

SEQ ID NO: 13754 - DNA, 22 bp, Artificial Sequence
  chemically synthesized
tttgtactgctactgttcaggt

SEQ ID NO: 13755 - DNA, 22 bp, Artificial Sequence
  chemically synthesized
ttgtactgctactgttcaggtt

SEQ ID NO: 13756 - DNA, 22 bp, Artificial Sequence
  chemically synthesized
tgtactgctactgttcaggttc

SEQ ID NO: 13757 - DNA, 22 bp, Artificial Sequence
  chemically synthesized
gtactgctactgttcaggttct

SEQ ID NO: 13758 - DNA, 22 bp, Artificial Sequence
  chemically synthesized
tactgctactgttcaggttcta

SEQ ID NO: 13759 - DNA, 22 bp, Artificial Sequence
  chemically synthesized
ctactgttcaggttctagcctt

SEQ ID NO: 13760 - DNA, 22 bp, Artificial Sequence
  chemically synthesized
ctgttcaggttctagcctttat

SEQ ID NO: 13761 - DNA, 22 bp, Artificial Sequence
  chemically synthesized
ttcaggttctagcctttatgtc

SEQ ID NO: 13762 - DNA, 22 bp, Artificial Sequence
  chemically synthesized
aggttctagcctttatgtctcc

SEQ ID NO: 13763 - DNA, 22 bp, Artificial Sequence
  chemically synthesized
tagcctttatgtctcccgcaga

SEQ ID NO: 13764 - DNA, 22 bp, Artificial Sequence
  chemically synthesized
gcctttatgtctcccgcagata

SEQ ID NO: 13765 - DNA, 22 bp, Artificial Sequence
  chemically synthesized
tatgtctcccgcagataattgc

SEQ ID NO: 13766 - DNA, 22 bp, Artificial Sequence
  chemically synthesized
atgtctcccgcagataattgca

SEQ ID NO: 13767 - DNA, 22 bp, Artificial Sequence
  chemically synthesized
tgtctcccgcagataattgcaa

SEQ ID NO: 13768 - DNA, 22 bp, Artificial Sequence
  chemically synthesized
ccgcagataattgcaatagtct

SEQ ID NO: 13769 - DNA, 22 bp, Artificial Sequence
  chemically synthesized
caatagtctcaggactgctctc

SEQ ID NO: 13770 - DNA, 22 bp, Artificial Sequence
  chemically synthesized
aggactgctctctcctagtctt

SEQ ID NO: 13771 - DNA, 22 bp, Artificial Sequence
  chemically synthesized
ctctctcctagtcttggtacgg

SEQ ID NO: 13772 - DNA, 22 bp, Artificial Sequence
  chemically synthesized
tctcctagtcttggtacggccc

SEQ ID NO: 13773 - DNA, 22 bp, Artificial Sequence
  chemically synthesized
tcctagtcttggtacggccccc

SEQ ID NO: 13774 - DNA, 22 bp, Artificial Sequence
  chemically synthesized
ctagtcttggtacggccccctc

SEQ ID NO: 13775 - DNA, 22 bp, Artificial Sequence
  chemically synthesized
gtcttggtacggccccctcccc

SEQ ID NO: 13776 - DNA, 22 bp, Artificial Sequence
  chemically synthesized
ggtacggccccctcccccacta

SEQ ID NO: 13777 - DNA, 22 bp, Artificial Sequence
  chemically synthesized
gtacggccccctcccccactat

SEQ ID NO: 13778 - DNA, 22 bp, Artificial Sequence
  chemically synthesized
ccccactatcatttcattagcg

SEQ ID NO: 13779 - DNA, 22 bp, Artificial Sequence
  chemically synthesized
tcatttcattagcgtgttgcca

SEQ ID NO: 13780 - DNA, 22 bp, Artificial Sequence
  chemically synthesized
cattagcgtgttgccagactgg

SEQ ID NO: 13781 - DNA, 22 bp, Artificial Sequence
  chemically synthesized
attagcgtgttgccagactggg

SEQ ID NO: 13782 - DNA, 22 bp, Artificial Sequence
  chemically synthesized
gcgtgttgccagactgggcatc

SEQ ID NO: 13783 - DNA, 22 bp, Artificial Sequence
  chemically synthesized
ccagactgggcatcctaaatca

SEQ ID NO: 13784 - DNA, 22 bp, Artificial Sequence
  chemically synthesized
ggcatcctaaatcagccatcag

SEQ ID NO: 13785 - DNA, 22 bp, Artificial Sequence
  chemically synthesized
aatcagccatcagtggtactcc

SEQ ID NO: 13786 - DNA, 22 bp, Artificial Sequence
  chemically synthesized
cttatgtttatacttcgatacc

SEQ ID NO: 13787 - DNA, 22 bp, Artificial Sequence
  chemically synthesized
atgtttatacttcgatacctcc

SEQ ID NO: 13788 - DNA, 22 bp, Artificial Sequence
  chemically synthesized
tgtttatacttcgatacctcca

SEQ ID NO: 13789 - DNA, 22 bp, Artificial Sequence
  chemically synthesized
atacttcgatacctccatattg

SEQ ID NO: 13790 - DNA, 22 bp, Artificial Sequence
  chemically synthesized
tacttcgatacctccatattgc

SEQ ID NO: 13791 - DNA, 22 bp, Artificial Sequence
  chemically synthesized
cgatacctccatattgcatttt

SEQ ID NO: 13792 - DNA, 22 bp, Artificial Sequence
  chemically synthesized
gatacctccatattgcatttta

SEQ ID NO: 13793 - DNA, 22 bp, Artificial Sequence
  chemically synthesized
catattgcattttattgtccaa

SEQ ID NO: 13794 - DNA, 22 bp, Artificial Sequence
  chemically synthesized
cattttattgtccaatctcctt

SEQ ID NO: 13795 - DNA, 22 bp, Artificial Sequence
  chemically synthesized
tattgtccaatctccttaggtt

SEQ ID NO: 13796 - DNA, 22 bp, Artificial Sequence
  chemically synthesized
attgtccaatctccttaggtta

SEQ ID NO: 13797 - DNA, 22 bp, Artificial Sequence
  chemically synthesized
ttgtccaatctccttaggttaa

SEQ ID NO: 13798 - DNA, 22 bp, Artificial Sequence
  chemically synthesized
tccaatctccttaggttaatga

SEQ ID NO: 13799 - DNA, 22 bp, Artificial Sequence
  chemically synthesized
cttaggttaatgacttcattat

SEQ ID NO: 13800 - DNA, 22 bp, Artificial Sequence
  chemically synthesized
aggttaatgacttcattatctg

SEQ ID NO: 13801 - DNA, 22 bp, Artificial Sequence
  chemically synthesized
ggttaatgacttcattatctga

SEQ ID NO: 13802 - DNA, 22 bp, Artificial Sequence
  chemically synthesized
atgacttcattatctgatgacc

SEQ ID NO: 13803 - DNA, 22 bp, Artificial Sequence
  chemically synthesized
cattatctgatgaccagctctg

SEQ ID NO: 13804 - DNA, 22 bp, Artificial Sequence
  chemically synthesized
attatctgatgaccagctctgc

SEQ ID NO: 13805 - DNA, 22 bp, Artificial Sequence
  chemically synthesized
tctgatgaccagctctgcctag

SEQ ID NO: 13806 - DNA, 22 bp, Artificial Sequence
  chemically synthesized
atgaccagctctgcctagttta

SEQ ID NO: 13807 - DNA, 22 bp, Artificial Sequence
  chemically synthesized
tgcctagtttacctgtctcact

SEQ ID NO: 13808 - DNA, 22 bp, Artificial Sequence
  chemically synthesized
cctagtttacctgtctcacttg

SEQ ID NO: 13809 - DNA, 22 bp, Artificial Sequence
  chemically synthesized
gtttacctgtctcacttgtcat

SEQ ID NO: 13810 - DNA, 22 bp, Artificial Sequence
  chemically synthesized
acctgtctcacttgtcatagtc

SEQ ID NO: 13811 - DNA, 22 bp, Artificial Sequence
  chemically synthesized
cctgtctcacttgtcatagtcc

SEQ ID NO: 13812 - DNA, 22 bp, Artificial Sequence
  chemically synthesized
tctcacttgtcatagtccatat

SEQ ID NO: 13813 - DNA, 22 bp, Artificial Sequence
  chemically synthesized
acttgtcatagtccatatggaa

SEQ ID NO: 13814 - DNA, 22 bp, Artificial Sequence
  chemically synthesized
gtcatagtccatatggaaccat

SEQ ID NO: 13815 - DNA, 22 bp, Artificial Sequence
  chemically synthesized
tcatagtccatatggaaccata

SEQ ID NO: 13816 - DNA, 22 bp, Artificial Sequence
  chemically synthesized
ctgaaatacctcacgttcttgc

SEQ ID NO: 13817 - DNA, 22 bp, Artificial Sequence
  chemically synthesized
aaatacctcacgttcttgcaaa

SEQ ID NO: 13818 - DNA, 22 bp, Artificial Sequence
  chemically synthesized
acgttcttgcaaatctgagtct

SEQ ID NO: 13819 - DNA, 22 bp, Artificial Sequence
  chemically synthesized
ttgcaaatctgagtctttgcac

SEQ ID NO: 13820 - DNA, 22 bp, Artificial Sequence
  chemically synthesized
gcaaatctgagtctttgcacga

SEQ ID NO: 13821 - DNA, 22 bp, Artificial Sequence
  chemically synthesized
caaatctgagtctttgcacgag

SEQ ID NO: 13822 - DNA, 22 bp, Artificial Sequence
  chemically synthesized
agtctttgcacgagtgatcctc

SEQ ID NO: 13823 - DNA, 22 bp, Artificial Sequence
  chemically synthesized
tgcacgagtgatcctctttgca

SEQ ID NO: 13824 - DNA, 22 bp, Artificial Sequence
  chemically synthesized
gcacgagtgatcctctttgcat

SEQ ID NO: 13825 - DNA, 22 bp, Artificial Sequence
  chemically synthesized
cacgagtgatcctctttgcata

SEQ ID NO: 13826 - DNA, 22 bp, Artificial Sequence
  chemically synthesized
tttgcataaaatgcccttatat

SEQ ID NO: 13827 - DNA, 22 bp, Artificial Sequence
  chemically synthesized
tgcataaaatgcccttatatca

SEQ ID NO: 13828 - DNA, 22 bp, Artificial Sequence
  chemically synthesized
gcataaaatgcccttatatcag

SEQ ID NO: 13829 - DNA, 22 bp, Artificial Sequence
  chemically synthesized
cataaaatgcccttatatcaga

SEQ ID NO: 13830 - DNA, 22 bp, Artificial Sequence
  chemically synthesized
atatcagacatttaaagagaga

SEQ ID NO: 13831 - DNA, 22 bp, Artificial Sequence
  chemically synthesized
tatcagacatttaaagagagag

SEQ ID NO: 13832 - DNA, 22 bp, Artificial Sequence
  chemically synthesized
aaagagagagaacgcctactca

SEQ ID NO: 13833 - DNA, 22 bp, Artificial Sequence
  chemically synthesized
aagagagagaacgcctactcat

SEQ ID NO: 13834 - DNA, 22 bp, Artificial Sequence
  chemically synthesized
ctcatcttttaagacccagatg

SEQ ID NO: 13835 - DNA, 22 bp, Artificial Sequence
  chemically synthesized
atcttttaagacccagatgaaa

SEQ ID NO: 13836 - DNA, 22 bp, Artificial Sequence
  chemically synthesized
ttaagacccagatgaaaatatt

SEQ ID NO: 13837 - DNA, 22 bp, Artificial Sequence
  chemically synthesized
taagacccagatgaaaatattc

SEQ ID NO: 13838 - DNA, 22 bp, Artificial Sequence
  chemically synthesized
aagacccagatgaaaatattct

SEQ ID NO: 13839 - DNA, 22 bp, Artificial Sequence
  chemically synthesized
agacccagatgaaaatattctc

SEQ ID NO: 13840 - DNA, 22 bp, Artificial Sequence
  chemically synthesized
tctctctatcaattgtttcccc

SEQ ID NO: 13841 - DNA, 22 bp, Artificial Sequence
  chemically synthesized
tctctatcaattgtttccccat

SEQ ID NO: 13842 - DNA, 22 bp, Artificial Sequence
  chemically synthesized
tctatcaattgtttccccattt

SEQ ID NO: 13843 - DNA, 22 bp, Artificial Sequence
  chemically synthesized
tatcaattgtttccccatttaa

SEQ ID NO: 13844 - DNA, 22 bp, Artificial Sequence
  chemically synthesized
tcaattgtttccccatttaatg

SEQ ID NO: 13845 - DNA, 22 bp, Artificial Sequence
  chemically synthesized
tttccccatttaatgtgttcct

SEQ ID NO: 13846 - DNA, 22 bp, Artificial Sequence
  chemically synthesized
ccccatttaatgtgttcctttc

SEQ ID NO: 13847 - DNA, 22 bp, Artificial Sequence
  chemically synthesized
cccatttaatgtgttcctttct

SEQ ID NO: 13848 - DNA, 22 bp, Artificial Sequence
  chemically synthesized
aatgtgttcctttctctatgat

SEQ ID NO: 13849 - DNA, 22 bp, Artificial Sequence
  chemically synthesized
atgtgttcctttctctatgatc

SEQ ID NO: 13850 - DNA, 22 bp, Artificial Sequence
  chemically synthesized
ctttctctatgatcccttagta

SEQ ID NO: 13851 - DNA, 22 bp, Artificial Sequence
  chemically synthesized
tctctatgatcccttagtacct

SEQ ID NO: 13852 - DNA, 22 bp, Artificial Sequence
  chemically synthesized
ctctatgatcccttagtaccta

SEQ ID NO: 13853 - DNA, 22 bp, Artificial Sequence
  chemically synthesized
tctatgatcccttagtacctag

SEQ ID NO: 13854 - DNA, 22 bp, Artificial Sequence
  chemically synthesized
tatgatcccttagtacctagtg

SEQ ID NO: 13855 - DNA, 22 bp, Artificial Sequence
  chemically synthesized
tgatcccttagtacctagtgca

SEQ ID NO: 13856 - DNA, 22 bp, Artificial Sequence
  chemically synthesized
agtacctagtgcacattttatc

SEQ ID NO: 13857 - DNA, 22 bp, Artificial Sequence
  chemically synthesized
gtacctagtgcacattttatca

SEQ ID NO: 13858 - DNA, 22 bp, Artificial Sequence
  chemically synthesized
gtgcacattttatcacattata

SEQ ID NO: 13859 - DNA, 22 bp, Artificial Sequence
  chemically synthesized
tatcacattatattgaaacctc

SEQ ID NO: 13860 - DNA, 22 bp, Artificial Sequence
  chemically synthesized
atcacattatattgaaacctct

SEQ ID NO: 13861 - DNA, 22 bp, Artificial Sequence
  chemically synthesized
tcacattatattgaaacctctc

SEQ ID NO: 13862 - DNA, 22 bp, Artificial Sequence
  chemically synthesized
tattgaaacctctcacctggcc

SEQ ID NO: 13863 - DNA, 22 bp, Artificial Sequence
  chemically synthesized
aaacctctcacctggcctcatg

SEQ ID NO: 13864 - DNA, 22 bp, Artificial Sequence
  chemically synthesized
tcacctggcctcatgctgcttt

SEQ ID NO: 13865 - DNA, 22 bp, Artificial Sequence
  chemically synthesized
acctggcctcatgctgctttag

SEQ ID NO: 13866 - DNA, 22 bp, Artificial Sequence
  chemically synthesized
gcctcatgctgctttagatcaa

SEQ ID NO: 13867 - DNA, 22 bp, Artificial Sequence
  chemically synthesized
atgctgctttagatcaaagagg

SEQ ID NO: 13868 - DNA, 22 bp, Artificial Sequence
  chemically synthesized
ctttagatcaaagagggagtct

SEQ ID NO: 13869 - DNA, 22 bp, Artificial Sequence
  chemically synthesized
tagatcaaagagggagtctggt

SEQ ID NO: 13870 - DNA, 22 bp, Artificial Sequence
  chemically synthesized
agatcaaagagggagtctggtt

SEQ ID NO: 13871 - DNA, 22 bp, Artificial Sequence
  chemically synthesized
gatcaaagagggagtctggttt

SEQ ID NO: 13872 - DNA, 22 bp, Artificial Sequence
  chemically synthesized
gtttatccccatacccctagta

SEQ ID NO: 13873 - DNA, 22 bp, Artificial Sequence
  chemically synthesized
atccccatacccctagtaccct

SEQ ID NO: 13874 - DNA, 22 bp, Artificial Sequence
  chemically synthesized
tccccatacccctagtaccctg

SEQ ID NO: 13875 - DNA, 22 bp, Artificial Sequence
  chemically synthesized
gtaccctgacacagtacctggc

SEQ ID NO: 13876 - DNA, 22 bp, Artificial Sequence
  chemically synthesized
acacagtacctggcaccatagt

SEQ ID NO: 13877 - DNA, 22 bp, Artificial Sequence
  chemically synthesized
gcaccatagttgtaactcagta

SEQ ID NO: 13878 - DNA, 22 bp, Artificial Sequence
  chemically synthesized
taactcagtaatgtctgaatga

SEQ ID NO: 13879 - DNA, 22 bp, Artificial Sequence
  chemically synthesized
agtaatgtctgaatgaaggaca

SEQ ID NO: 13880 - DNA, 22 bp, Artificial Sequence
  chemically synthesized
aatgaaggacatctttgatgca

SEQ ID NO: 13881 - DNA, 22 bp, Artificial Sequence
  chemically synthesized
tgatgcatacactttacaaaac

SEQ ID NO: 13882 - DNA, 22 bp, Artificial Sequence
  chemically synthesized
gatgcatacactttacaaaact

SEQ ID NO: 13883 - DNA, 22 bp, Artificial Sequence
  chemically synthesized
atgcatacactttacaaaacta

SEQ ID NO: 13884 - DNA, 22 bp, Artificial Sequence
  chemically synthesized
tacaaaactaaactggttttac

SEQ ID NO: 13885 - DNA, 22 bp, Artificial Sequence
  chemically synthesized
acaaaactaaactggttttaca

SEQ ID NO: 13886 - DNA, 22 bp, Artificial Sequence
  chemically synthesized
caaaactaaactggttttacag

SEQ ID NO: 13887 - DNA, 22 bp, Artificial Sequence
  chemically synthesized
aactggttttacagaactgttt

SEQ ID NO: 13888 - DNA, 22 bp, Artificial Sequence
  chemically synthesized
gttttacagaactgttttaatt

SEQ ID NO: 13889 - DNA, 22 bp, Artificial Sequence
  chemically synthesized
tacagaactgttttaatttcaa

SEQ ID NO: 13890 - DNA, 22 bp, Artificial Sequence
  chemically synthesized
acagaactgttttaatttcaaa

SEQ ID NO: 13891 - DNA, 22 bp, Artificial Sequence
  chemically synthesized
cagaactgttttaatttcaaaa

SEQ ID NO: 13892 - DNA, 22 bp, Artificial Sequence
  chemically synthesized
ttttaatttcaaaattccaaac

SEQ ID NO: 13893 - DNA, 22 bp, Artificial Sequence
  chemically synthesized
taatttcaaaattccaaactgt

SEQ ID NO: 13894 - DNA, 22 bp, Artificial Sequence
  chemically synthesized
aatttcaaaattccaaactgtt

SEQ ID NO: 13895 - DNA, 22 bp, Artificial Sequence
  chemically synthesized
atttcaaaattccaaactgttg

SEQ ID NO: 13896 - DNA, 22 bp, Artificial Sequence
  chemically synthesized
caaaattccaaactgttgcaat

SEQ ID NO: 13897 - DNA, 22 bp, Artificial Sequence
  chemically synthesized
aaaattccaaactgttgcaata

SEQ ID NO: 13898 - DNA, 22 bp, Artificial Sequence
  chemically synthesized
caaactgttgcaataataccta

SEQ ID NO: 13899 - DNA, 22 bp, Artificial Sequence
  chemically synthesized
ttgcaataatacctaaaggcag

SEQ ID NO: 13900 - DNA, 22 bp, Artificial Sequence
  chemically synthesized
caataatacctaaaggcagcag

SEQ ID NO: 13901 - DNA, 22 bp, Artificial Sequence
  chemically synthesized
aaggcagcagccatgaaaatgc

SEQ ID NO: 13902 - DNA, 22 bp, Artificial Sequence
  chemically synthesized
agcaaatcactcaccgaaactc

SEQ ID NO: 13903 - DNA, 22 bp, Artificial Sequence
  chemically synthesized
accgaaactccttttagaagcc

SEQ ID NO: 13904 - DNA, 22 bp, Artificial Sequence
  chemically synthesized
cttttagaagccaatgagagtt

SEQ ID NO: 13905 - DNA, 22 bp, Artificial Sequence
  chemically synthesized
ttagaagccaatgagagtttaa

SEQ ID NO: 13906 - DNA, 22 bp, Artificial Sequence
  chemically synthesized
tagaagccaatgagagtttaat

SEQ ID NO: 13907 - DNA, 22 bp, Artificial Sequence
  chemically synthesized
agaagccaatgagagtttaata

SEQ ID NO: 13908 - DNA, 22 bp, Artificial Sequence
  chemically synthesized
gaagccaatgagagtttaatag

SEQ ID NO: 13909 - DNA, 22 bp, Artificial Sequence
  chemically synthesized
aatagcagaagagagtgctgca

SEQ ID NO: 13910 - DNA, 22 bp, Artificial Sequence
  chemically synthesized
atagcagaagagagtgctgcat

SEQ ID NO: 13911 - DNA, 22 bp, Artificial Sequence
  chemically synthesized
cattaatactgtctatccttag

SEQ ID NO: 13912 - DNA, 22 bp, Artificial Sequence
  chemically synthesized
atactgtctatccttagaaaaa

SEQ ID NO: 13913 - DNA, 22 bp, Artificial Sequence
  chemically synthesized
tctatccttagaaaaattcccc

SEQ ID NO: 13914 - DNA, 22 bp, Artificial Sequence
  chemically synthesized
tccttagaaaaattcccctggc

SEQ ID NO: 13915 - DNA, 22 bp, Artificial Sequence
  chemically synthesized
agaaaaattcccctggcccctt

SEQ ID NO: 13916 - DNA, 22 bp, Artificial Sequence
  chemically synthesized
gaaaaattcccctggccccttc

SEQ ID NO: 13917 - DNA, 22 bp, Artificial Sequence
  chemically synthesized
ccctggccccttcctcaagggc

SEQ ID NO: 13918 - DNA, 22 bp, Artificial Sequence
  chemically synthesized
gccccttcctcaagggcttatt

SEQ ID NO: 13919 - DNA, 22 bp, Artificial Sequence
  chemically synthesized
cctcaagggcttattatctctg

SEQ ID NO: 13920 - DNA, 22 bp, Artificial Sequence
  chemically synthesized
ctcaagggcttattatctctgg

SEQ ID NO: 13921 - DNA, 22 bp, Artificial Sequence
  chemically synthesized
aagggcttattatctctggcta

SEQ ID NO: 13922 - DNA, 22 bp, Artificial Sequence
  chemically synthesized
attatctctggctacaatggct

SEQ ID NO: 13923 - DNA, 22 bp, Artificial Sequence
  chemically synthesized
ttatctctggctacaatggctg

SEQ ID NO: 13924 - DNA, 22 bp, Artificial Sequence
  chemically synthesized
tctctggctacaatggctgcag

SEQ ID NO: 13925 - DNA, 22 bp, Artificial Sequence
  chemically synthesized
tggctacaatggctgcagaatc

SEQ ID NO: 13926 - DNA, 22 bp, Artificial Sequence
  chemically synthesized
gctacaatggctgcagaatcac

SEQ ID NO: 13927 - DNA, 22 bp, Artificial Sequence
  chemically synthesized
caatggctgcagaatcacattg

SEQ ID NO: 13928 - DNA, 22 bp, Artificial Sequence
  chemically synthesized
cagaatcacattgcctttctcc

SEQ ID NO: 13929 - DNA, 22 bp, Artificial Sequence
  chemically synthesized
cctttctccttagtattatctg

SEQ ID NO: 13930 - DNA, 22 bp, Artificial Sequence
  chemically synthesized
tctccttagtattatctgggga

SEQ ID NO: 13931 - DNA, 22 bp, Artificial Sequence
  chemically synthesized
ctccttagtattatctggggat

SEQ ID NO: 13932 - DNA, 22 bp, Artificial Sequence
  chemically synthesized
tccttagtattatctggggatc

SEQ ID NO: 13933 - DNA, 22 bp, Artificial Sequence
  chemically synthesized
cttagtattatctggggatcgt

SEQ ID NO: 13934 - DNA, 22 bp, Artificial Sequence
  chemically synthesized
agtattatctggggatcgtata

SEQ ID NO: 13935 - DNA, 22 bp, Artificial Sequence
  chemically synthesized
gtattatctggggatcgtatac

SEQ ID NO: 13936 - DNA, 22 bp, Artificial Sequence
  chemically synthesized
tctggggatcgtatacttaact

SEQ ID NO: 13937 - DNA, 22 bp, Artificial Sequence
  chemically synthesized
gggatcgtatacttaacttccc

SEQ ID NO: 13938 - DNA, 22 bp, Artificial Sequence
  chemically synthesized
aacttcccttcaggtttatcgc

SEQ ID NO: 13939 - DNA, 22 bp, Artificial Sequence
  chemically synthesized
acttcccttcaggtttatcgct

SEQ ID NO: 13940 - DNA, 22 bp, Artificial Sequence
  chemically synthesized
cccttcaggtttatcgctagtc

SEQ ID NO: 13941 - DNA, 22 bp, Artificial Sequence
  chemically synthesized
ccttcaggtttatcgctagtca

SEQ ID NO: 13942 - DNA, 22 bp, Artificial Sequence
  chemically synthesized
caggtttatcgctagtcattat

SEQ ID NO: 13943 - DNA, 22 bp, Artificial Sequence
  chemically synthesized
aggtttatcgctagtcattatt

SEQ ID NO: 13944 - DNA, 22 bp, Artificial Sequence
  chemically synthesized
atcgctagtcattatttcccag

SEQ ID NO: 13945 - DNA, 22 bp, Artificial Sequence
  chemically synthesized
tcgctagtcattatttcccagg

SEQ ID NO: 13946 - DNA, 22 bp, Artificial Sequence
  chemically synthesized
gtcattatttcccaggctccaa

SEQ ID NO: 13947 - DNA, 22 bp, Artificial Sequence
  chemically synthesized
tttcccaggctccaaaagcctg

SEQ ID NO: 13948 - DNA, 22 bp, Artificial Sequence
  chemically synthesized
cccaggctccaaaagcctggtt

SEQ ID NO: 13949 - DNA, 22 bp, Artificial Sequence
  chemically synthesized
ccaggctccaaaagcctggttc

SEQ ID NO: 13950 - DNA, 22 bp, Artificial Sequence
  chemically synthesized
caaaagcctggttcatccttat

SEQ ID NO: 13951 - DNA, 22 bp, Artificial Sequence
  chemically synthesized
gttcatccttattcttatctat

SEQ ID NO: 13952 - DNA, 22 bp, Artificial Sequence
  chemically synthesized
atccttattcttatctatcctt

SEQ ID NO: 13953 - DNA, 22 bp, Artificial Sequence
  chemically synthesized
attcttatctatcctttcccca

SEQ ID NO: 13954 - DNA, 22 bp, Artificial Sequence
  chemically synthesized
ttcttatctatcctttccccag

SEQ ID NO: 13955 - DNA, 22 bp, Artificial Sequence
  chemically synthesized
ttatctatcctttccccagcat

SEQ ID NO: 13956 - DNA, 22 bp, Artificial Sequence
  chemically synthesized
atctatcctttccccagcatct

SEQ ID NO: 13957 - DNA, 22 bp, Artificial Sequence
  chemically synthesized
tctatcctttccccagcatctg

SEQ ID NO: 13958 - DNA, 22 bp, Artificial Sequence
  chemically synthesized
tcctttccccagcatctgaagt

SEQ ID NO: 13959 - DNA, 22 bp, Artificial Sequence
  chemically synthesized
tccccagcatctgaagtcttca

SEQ ID NO: 13960 - DNA, 22 bp, Artificial Sequence
  chemically synthesized
ccccagcatctgaagtcttcaa

SEQ ID NO: 13961 - DNA, 22 bp, Artificial Sequence
  chemically synthesized
cccagcatctgaagtcttcaag

SEQ ID NO: 13962 - DNA, 22 bp, Artificial Sequence
  chemically synthesized
aagtcttcaagggggcagaagc

SEQ ID NO: 13963 - DNA, 22 bp, Artificial Sequence
  chemically synthesized
caagggggcagaagccctctta

SEQ ID NO: 13964 - DNA, 22 bp, Artificial Sequence
  chemically synthesized
aagggggcagaagccctcttac

SEQ ID NO: 13965 - DNA, 22 bp, Artificial Sequence
  chemically synthesized
ttacaaccttcatcatctcacc

SEQ ID NO: 13966 - DNA, 22 bp, Artificial Sequence
  chemically synthesized
acaaccttcatcatctcaccac

SEQ ID NO: 13967 - DNA, 22 bp, Artificial Sequence
  chemically synthesized
caaccttcatcatctcaccact

SEQ ID NO: 13968 - DNA, 22 bp, Artificial Sequence
  chemically synthesized
catcatctcaccacttatatag

SEQ ID NO: 13969 - DNA, 22 bp, Artificial Sequence
  chemically synthesized
atcatctcaccacttatataga

SEQ ID NO: 13970 - DNA, 22 bp, Artificial Sequence
  chemically synthesized
accacttatatagaagaaaggg

SEQ ID NO: 13971 - DNA, 22 bp, Artificial Sequence
  chemically synthesized
atatagaagaaagggtttggat

SEQ ID NO: 13972 - DNA, 22 bp, Artificial Sequence
  chemically synthesized
tatagaagaaagggtttggatg

SEQ ID NO: 13973 - DNA, 22 bp, Artificial Sequence
  chemically synthesized
ggatgctttgtcctcccagatg

SEQ ID NO: 13974 - DNA, 22 bp, Artificial Sequence
  chemically synthesized
gatgctttgtcctcccagatgt

SEQ ID NO: 13975 - DNA, 22 bp, Artificial Sequence
  chemically synthesized
tgtcctcccagatgtcacacta

SEQ ID NO: 13976 - DNA, 22 bp, Artificial Sequence
  chemically synthesized
gtcctcccagatgtcacactaa

SEQ ID NO: 13977 - DNA, 22 bp, Artificial Sequence
  chemically synthesized
tcctcccagatgtcacactaat

SEQ ID NO: 13978 - DNA, 22 bp, Artificial Sequence
  chemically synthesized
ccagatgtcacactaatgagat

SEQ ID NO: 13979 - DNA, 22 bp, Artificial Sequence
  chemically synthesized
atgagatatatctaatggcctt

SEQ ID NO: 13980 - DNA, 22 bp, Artificial Sequence
  chemically synthesized
atggccttgctttatgtcctgc

SEQ ID NO: 13981 - DNA, 22 bp, Artificial Sequence
  chemically synthesized
gctttatgtcctgctttgtgag

SEQ ID NO: 13982 - DNA, 22 bp, Artificial Sequence
  chemically synthesized
ctttatgtcctgctttgtgagt

SEQ ID NO: 13983 - DNA, 22 bp, Artificial Sequence
  chemically synthesized
tatgtcctgctttgtgagtttt

SEQ ID NO: 13984 - DNA, 22 bp, Artificial Sequence
  chemically synthesized
atgtcctgctttgtgagttttc

SEQ ID NO: 13985 - DNA, 22 bp, Artificial Sequence
  chemically synthesized
tgtcctgctttgtgagttttcc

SEQ ID NO: 13986 - DNA, 22 bp, Artificial Sequence
  chemically synthesized
ctttgtgagttttccaacaaat

SEQ ID NO: 13987 - DNA, 22 bp, Artificial Sequence
  chemically synthesized
tgtgagttttccaacaaatttt

SEQ ID NO: 13988 - DNA, 22 bp, Artificial Sequence
  chemically synthesized
gtgagttttccaacaaattttc

SEQ ID NO: 13989 - DNA, 22 bp, Artificial Sequence
  chemically synthesized
tgagttttccaacaaattttct

SEQ ID NO: 13990 - DNA, 22 bp, Artificial Sequence
  chemically synthesized
tccaacaaattttctttatccc

SEQ ID NO: 13991 - DNA, 22 bp, Artificial Sequence
  chemically synthesized
ccaacaaattttctttatccct

SEQ ID NO: 13992 - DNA, 22 bp, Artificial Sequence
  chemically synthesized
caacaaattttctttatccctt

SEQ ID NO: 13993 - DNA, 22 bp, Artificial Sequence
  chemically synthesized
tctttatcccttgactttactc

SEQ ID NO: 13994 - DNA, 22 bp, Artificial Sequence
  chemically synthesized
ctttatcccttgactttactca

SEQ ID NO: 13995 - DNA, 22 bp, Artificial Sequence
  chemically synthesized
tttatcccttgactttactcac

SEQ ID NO: 13996 - DNA, 22 bp, Artificial Sequence
  chemically synthesized
tatcccttgactttactcactt

SEQ ID NO: 13997 - DNA, 22 bp, Artificial Sequence
  chemically synthesized
atcccttgactttactcacttt

SEQ ID NO: 13998 - DNA, 22 bp, Artificial Sequence
  chemically synthesized
tcccttgactttactcactttg

SEQ ID NO: 13999 - DNA, 22 bp, Artificial Sequence
  chemically synthesized
gactttactcactttgctagtt

SEQ ID NO: 14000 - DNA, 22 bp, Artificial Sequence
  chemically synthesized
actttactcactttgctagttt

SEQ ID NO: 14001 - DNA, 22 bp, Artificial Sequence
  chemically synthesized
tactcactttgctagtttaacc

SEQ ID NO: 14002 - DNA, 22 bp, Artificial Sequence
  chemically synthesized
actcactttgctagtttaacct

SEQ ID NO: 14003 - DNA, 22 bp, Artificial Sequence
  chemically synthesized
ctcactttgctagtttaacctc

SEQ ID NO: 14004 - DNA, 22 bp, Artificial Sequence
  chemically synthesized
actttgctagtttaacctctgt

SEQ ID NO: 14005 - DNA, 22 bp, Artificial Sequence
  chemically synthesized
tgctagtttaacctctgtattt

SEQ ID NO: 14006 - DNA, 22 bp, Artificial Sequence
  chemically synthesized
gctagtttaacctctgtatttt

SEQ ID NO: 14007 - DNA, 22 bp, Artificial Sequence
  chemically synthesized
ctagtttaacctctgtattttt

SEQ ID NO: 14008 - DNA, 22 bp, Artificial Sequence
  chemically synthesized
gtttaacctctgtatttttttt

SEQ ID NO: 14009 - DNA, 22 bp, Artificial Sequence
  chemically synthesized
aacctctgtatttttttttatc

SEQ ID NO: 14010 - DNA, 22 bp, Artificial Sequence
  chemically synthesized
acctctgtatttttttttatcg

SEQ ID NO: 14011 - DNA, 22 bp, Artificial Sequence
  chemically synthesized
tgtatttttttttatcgttatt

SEQ ID NO: 14012 - DNA, 22 bp, Artificial Sequence
  chemically synthesized
tatttttttttatcgttatttc

SEQ ID NO: 14013 - DNA, 22 bp, Artificial Sequence
  chemically synthesized
ttttttatcgttatttcagcat

SEQ ID NO: 14014 - DNA, 22 bp, Artificial Sequence
  chemically synthesized
tttttatcgttatttcagcatt

SEQ ID NO: 14015 - DNA, 22 bp, Artificial Sequence
  chemically synthesized
ttttatcgttatttcagcattt

SEQ ID NO: 14016 - DNA, 22 bp, Artificial Sequence
  chemically synthesized
tttatcgttatttcagcatttc

SEQ ID NO: 14017 - DNA, 22 bp, Artificial Sequence
  chemically synthesized
ttatcgttatttcagcatttca

SEQ ID NO: 14018 - DNA, 22 bp, Artificial Sequence
  chemically synthesized
tatcgttatttcagcatttcag

SEQ ID NO: 14019 - DNA, 22 bp, Artificial Sequence
  chemically synthesized
atcgttatttcagcatttcagt

SEQ ID NO: 14020 - DNA, 22 bp, Artificial Sequence
  chemically synthesized
tcgttatttcagcatttcagtc

SEQ ID NO: 14021 - DNA, 22 bp, Artificial Sequence
  chemically synthesized
tttcagcatttcagtctgattt

SEQ ID NO: 14022 - DNA, 22 bp, Artificial Sequence
  chemically synthesized
cagcatttcagtctgatttcac

SEQ ID NO: 14023 - DNA, 22 bp, Artificial Sequence
  chemically synthesized
agcatttcagtctgatttcaca

SEQ ID NO: 14024 - DNA, 22 bp, Artificial Sequence
  chemically synthesized
cagtctgatttcacagctgaca

SEQ ID NO: 14025 - DNA, 22 bp, Artificial Sequence
  chemically synthesized
agtctgatttcacagctgacat

SEQ ID NO: 14026 - DNA, 22 bp, Artificial Sequence
  chemically synthesized
atttcacagctgacatcatgtc

SEQ ID NO: 14027 - DNA, 22 bp, Artificial Sequence
  chemically synthesized
cacagctgacatcatgtctgga

SEQ ID NO: 14028 - DNA, 22 bp, Artificial Sequence
  chemically synthesized
acagctgacatcatgtctggag

SEQ ID NO: 14029 - DNA, 22 bp, Artificial Sequence
  chemically synthesized
acatcatgtctggagtgggaac

SEQ ID NO: 14030 - DNA, 22 bp, Artificial Sequence
  chemically synthesized
gagtgggaaccacagggccagt

SEQ ID NO: 14031 - DNA, 22 bp, Artificial Sequence
  chemically synthesized
tctgggggtgcttagggttggc

SEQ ID NO: 14032 - DNA, 22 bp, Artificial Sequence
  chemically synthesized
ctgggggtgcttagggttggca

SEQ ID NO: 14033 - DNA, 22 bp, Artificial Sequence
  chemically synthesized
tgggggtgcttagggttggcac

SEQ ID NO: 14034 - DNA, 22 bp, Artificial Sequence
  chemically synthesized
ggggtgcttagggttggcaccc

SEQ ID NO: 14035 - DNA, 22 bp, Artificial Sequence
  chemically synthesized
agggttggcacccctgatcctg

SEQ ID NO: 14036 - DNA, 22 bp, Artificial Sequence
  chemically synthesized
gggttggcacccctgatcctgg

SEQ ID NO: 14037 - DNA, 22 bp, Artificial Sequence
  chemically synthesized
gcacccctgatcctggtactgt

SEQ ID NO: 14038 - DNA, 22 bp, Artificial Sequence
  chemically synthesized
atcctggtactgtcagctacta

SEQ ID NO: 14039 - DNA, 22 bp, Artificial Sequence
  chemically synthesized
gtactgtcagctactagatttg

SEQ ID NO: 14040 - DNA, 22 bp, Artificial Sequence
  chemically synthesized
tcagctactagatttgattcta

SEQ ID NO: 14041 - DNA, 22 bp, Artificial Sequence
  chemically synthesized
ctagatttgattctagaaagtt

SEQ ID NO: 14042 - DNA, 22 bp, Artificial Sequence
  chemically synthesized
gatttgattctagaaagttgac

SEQ ID NO: 14043 - DNA, 22 bp, Artificial Sequence
  chemically synthesized
gattctagaaagttgacaagta

SEQ ID NO: 14044 - DNA, 22 bp, Artificial Sequence
  chemically synthesized
attctagaaagttgacaagtaa

SEQ ID NO: 14045 - DNA, 22 bp, Artificial Sequence
  chemically synthesized
tagaaagttgacaagtaagtgt

SEQ ID NO: 14046 - DNA, 22 bp, Artificial Sequence
  chemically synthesized
gaaagttgacaagtaagtgtga

SEQ ID NO: 14047 - DNA, 22 bp, Artificial Sequence
  chemically synthesized
acaagtaagtgtgataaatgct

SEQ ID NO: 14048 - DNA, 22 bp, Artificial Sequence
  chemically synthesized
cctgtgagaacatgctgtttgt

SEQ ID NO: 14049 - DNA, 22 bp, Artificial Sequence
  chemically synthesized
ctgtgagaacatgctgtttgtc

SEQ ID NO: 14050 - DNA, 22 bp, Artificial Sequence
  chemically synthesized
tgagaacatgctgtttgtccaa

SEQ ID NO: 14051 - DNA, 22 bp, Artificial Sequence
  chemically synthesized
tttgtccaaatgggataatttc

SEQ ID NO: 14052 - DNA, 22 bp, Artificial Sequence
  chemically synthesized
gtccaaatgggataatttcttc

SEQ ID NO: 14053 - DNA, 22 bp, Artificial Sequence
  chemically synthesized
tccaaatgggataatttcttcc

SEQ ID NO: 14054 - DNA, 22 bp, Artificial Sequence
  chemically synthesized
cttccctgtatgccttcctctg

SEQ ID NO: 14055 - DNA, 22 bp, Artificial Sequence
  chemically synthesized
ttccctgtatgccttcctctgg

SEQ ID NO: 14056 - DNA, 22 bp, Artificial Sequence
  chemically synthesized
ccctgtatgccttcctctggga

SEQ ID NO: 14057 - DNA, 22 bp, Artificial Sequence
  chemically synthesized
cctgtatgccttcctctgggaa

SEQ ID NO: 14058 - DNA, 22 bp, Artificial Sequence
  chemically synthesized
tatgccttcctctgggaaatac

SEQ ID NO: 14059 - DNA, 22 bp, Artificial Sequence
  chemically synthesized
cctctgggaaatacataaagtc

SEQ ID NO: 14060 - DNA, 22 bp, Artificial Sequence
  chemically synthesized
ctctgggaaatacataaagtca

SEQ ID NO: 14061 - DNA, 22 bp, Artificial Sequence
  chemically synthesized
tgggaaatacataaagtcactg

SEQ ID NO: 14062 - DNA, 22 bp, Artificial Sequence
  chemically synthesized
ggaaatacataaagtcactgta

SEQ ID NO: 14063 - DNA, 22 bp, Artificial Sequence
  chemically synthesized
tagttgtgaaaaaacaaagtga

SEQ ID NO: 14064 - DNA, 22 bp, Artificial Sequence
  chemically synthesized
tgaaaaaacaaagtgatatatg

SEQ ID NO: 14065 - DNA, 22 bp, Artificial Sequence
  chemically synthesized
cattagctaacttcctactctt

SEQ ID NO: 14066 - DNA, 22 bp, Artificial Sequence
  chemically synthesized
gctaacttcctactctttatgt

SEQ ID NO: 14067 - DNA, 22 bp, Artificial Sequence
  chemically synthesized
acttcctactctttatgtcaat

SEQ ID NO: 14068 - DNA, 22 bp, Artificial Sequence
  chemically synthesized
cctactctttatgtcaattctt

SEQ ID NO: 14069 - DNA, 22 bp, Artificial Sequence
  chemically synthesized
ctactctttatgtcaattctta

SEQ ID NO: 14070 - DNA, 22 bp, Artificial Sequence
  chemically synthesized
ctctttatgtcaattcttaagc

SEQ ID NO: 14071 - DNA, 22 bp, Artificial Sequence
  chemically synthesized
tttatgtcaattcttaagcttg

SEQ ID NO: 14072 - DNA, 22 bp, Artificial Sequence
  chemically synthesized
tatgtcaattcttaagcttgct

SEQ ID NO: 14073 - DNA, 22 bp, Artificial Sequence
  chemically synthesized
atgtcaattcttaagcttgctt

SEQ ID NO: 14074 - DNA, 22 bp, Artificial Sequence
  chemically synthesized
tgtcaattcttaagcttgcttt

SEQ ID NO: 14075 - DNA, 22 bp, Artificial Sequence
  chemically synthesized
ttaagcttgcttttctccccta

SEQ ID NO: 14076 - DNA, 22 bp, Artificial Sequence
  chemically synthesized
aagcttgcttttctcccctagg

SEQ ID NO: 14077 - DNA, 22 bp, Artificial Sequence
  chemically synthesized
agcttgcttttctcccctaggg

SEQ ID NO: 14078 - DNA, 22 bp, Artificial Sequence
  chemically synthesized
gcttttctcccctagggaactc

SEQ ID NO: 14079 - DNA, 22 bp, Artificial Sequence
  chemically synthesized
cttttctcccctagggaactca

SEQ ID NO: 14080 - DNA, 22 bp, Artificial Sequence
  chemically synthesized
ttctcccctagggaactcaact

SEQ ID NO: 14081 - DNA, 22 bp, Artificial Sequence
  chemically synthesized
tctcccctagggaactcaactg

SEQ ID NO: 14082 - DNA, 22 bp, Artificial Sequence
  chemically synthesized
ctcccctagggaactcaactga

SEQ ID NO: 14083 - DNA, 22 bp, Artificial Sequence
  chemically synthesized
tcccctagggaactcaactgag

SEQ ID NO: 14084 - DNA, 22 bp, Artificial Sequence
  chemically synthesized
ccctagggaactcaactgagta

SEQ ID NO: 14085 - DNA, 22 bp, Artificial Sequence
  chemically synthesized
gggaactcaactgagtattgtg

SEQ ID NO: 14086 - DNA, 22 bp, Artificial Sequence
  chemically synthesized
aactgagtattgtgtttcccca

SEQ ID NO: 14087 - DNA, 22 bp, Artificial Sequence
  chemically synthesized
agtattgtgtttccccaaatat

SEQ ID NO: 14088 - DNA, 22 bp, Artificial Sequence
  chemically synthesized
tgtttccccaaatatcaactcc

SEQ ID NO: 14089 - DNA, 22 bp, Artificial Sequence
  chemically synthesized
ccccaaatatcaactccaagat

SEQ ID NO: 14090 - DNA, 22 bp, Artificial Sequence
  chemically synthesized
cccaaatatcaactccaagatg

SEQ ID NO: 14091 - DNA, 22 bp, Artificial Sequence
  chemically synthesized
caagatgtttgacatagagaca

SEQ ID NO: 14092 - DNA, 22 bp, Artificial Sequence
  chemically synthesized
gacatagagacaaaatgatttt

SEQ ID NO: 14093 - DNA, 22 bp, Artificial Sequence
  chemically synthesized
acatagagacaaaatgattttt

SEQ ID NO: 14094 - DNA, 22 bp, Artificial Sequence
  chemically synthesized
tttcctaatccatgaaaagctt

SEQ ID NO: 14095 - DNA, 22 bp, Artificial Sequence
  chemically synthesized
ttcctaatccatgaaaagcttt

SEQ ID NO: 14096 - DNA, 22 bp, Artificial Sequence
  chemically synthesized
tcctaatccatgaaaagctttg

SEQ ID NO: 14097 - DNA, 22 bp, Artificial Sequence
  chemically synthesized
cctaatccatgaaaagctttgg

SEQ ID NO: 14098 - DNA, 22 bp, Artificial Sequence
  chemically synthesized
ctaatccatgaaaagctttggt

SEQ ID NO: 14099 - DNA, 22 bp, Artificial Sequence
  chemically synthesized
atccatgaaaagctttggtgat

SEQ ID NO: 14100 - DNA, 22 bp, Artificial Sequence
  chemically synthesized
tggtgataactaacagcttgct

SEQ ID NO: 14101 - DNA, 22 bp, Artificial Sequence
  chemically synthesized
ggtgataactaacagcttgcta

SEQ ID NO: 14102 - DNA, 22 bp, Artificial Sequence
  chemically synthesized
gtgataactaacagcttgctaa

SEQ ID NO: 14103 - DNA, 22 bp, Artificial Sequence
  chemically synthesized
acagcttgctaatgaaaggtta

SEQ ID NO: 14104 - DNA, 22 bp, Artificial Sequence
  chemically synthesized
gctaatgaaaggttaatcttta

SEQ ID NO: 14105 - DNA, 22 bp, Artificial Sequence
  chemically synthesized
ctaatgaaaggttaatctttat

SEQ ID NO: 14106 - DNA, 22 bp, Artificial Sequence
  chemically synthesized
atgaaaggttaatctttatgtt

SEQ ID NO: 14107 - DNA, 22 bp, Artificial Sequence
  chemically synthesized
atctttatgttttaactaaaac

SEQ ID NO: 14108 - DNA, 22 bp, Artificial Sequence
  chemically synthesized
tatgttttaactaaaactttaa

SEQ ID NO: 14109 - DNA, 22 bp, Artificial Sequence
  chemically synthesized
atgttttaactaaaactttaaa

SEQ ID NO: 14110 - DNA, 22 bp, Artificial Sequence
  chemically synthesized
tgttttaactaaaactttaaat

SEQ ID NO: 14111 - DNA, 22 bp, Artificial Sequence
  chemically synthesized
taactaaaactttaaattgaag

SEQ ID NO: 14112 - DNA, 22 bp, Artificial Sequence
  chemically synthesized
aactaaaactttaaattgaaga

SEQ ID NO: 14113 - DNA, 22 bp, Artificial Sequence
  chemically synthesized
actaaaactttaaattgaagat

SEQ ID NO: 14114 - DNA, 22 bp, Artificial Sequence
  chemically synthesized
aaactttaaattgaagatatat

SEQ ID NO: 14115 - DNA, 22 bp, Artificial Sequence
  chemically synthesized
taaattgaagatatataattta

SEQ ID NO: 14116 - DNA, 22 bp, Artificial Sequence
  chemically synthesized
aaattgaagatatataatttaa

SEQ ID NO: 14117 - DNA, 22 bp, Artificial Sequence
  chemically synthesized
aattgaagatatataatttaaa

SEQ ID NO: 14118 - DNA, 22 bp, Artificial Sequence
  chemically synthesized
aagatatataatttaaaaaatt

SEQ ID NO: 14119 - DNA, 22 bp, Artificial Sequence
  chemically synthesized
aaaaaattagagacacacctca

SEQ ID NO: 14120 - DNA, 22 bp, Artificial Sequence
  chemically synthesized
aaaaattagagacacacctcat

SEQ ID NO: 14121 - DNA, 22 bp, Artificial Sequence
  chemically synthesized
gagacacacctcattacatact

SEQ ID NO: 14122 - DNA, 22 bp, Artificial Sequence
  chemically synthesized
attacatacttctgaaaccttg

SEQ ID NO: 14123 - DNA, 22 bp, Artificial Sequence
  chemically synthesized
catacttctgaaaccttgaaat

SEQ ID NO: 14124 - DNA, 22 bp, Artificial Sequence
  chemically synthesized
ctgaaaccttgaaatgtcatat

SEQ ID NO: 14125 - DNA, 22 bp, Artificial Sequence
  chemically synthesized
tgaaaccttgaaatgtcatata

SEQ ID NO: 14126 - DNA, 22 bp, Artificial Sequence
  chemically synthesized
aaaccttgaaatgtcatatatc

SEQ ID NO: 14127 - DNA, 22 bp, Artificial Sequence
  chemically synthesized
gaaatgtcatatatcttaaaat

SEQ ID NO: 14128 - DNA, 22 bp, Artificial Sequence
  chemically synthesized
aaatgtcatatatcttaaaatc

SEQ ID NO: 14129 - DNA, 22 bp, Artificial Sequence
  chemically synthesized
aaaatcagactttttgtgtaaa

SEQ ID NO: 14130 - DNA, 22 bp, Artificial Sequence
  chemically synthesized
aaatcagactttttgtgtaaat

SEQ ID NO: 14131 - DNA, 22 bp, Artificial Sequence
  chemically synthesized
tttgtgtaaataaggccattgt

SEQ ID NO: 14132 - DNA, 22 bp, Artificial Sequence
  chemically synthesized
ttgtgtaaataaggccattgtt

SEQ ID NO: 14133 - DNA, 22 bp, Artificial Sequence
  chemically synthesized
tgtgtaaataaggccattgttt

SEQ ID NO: 14134 - DNA, 22 bp, Artificial Sequence
  chemically synthesized
gtgtaaataaggccattgtttg

SEQ ID NO: 14135 - DNA, 22 bp, Artificial Sequence
  chemically synthesized
tgtaaataaggccattgtttgt

SEQ ID NO: 14136 - DNA, 22 bp, Artificial Sequence
  chemically synthesized
tttgtgcttttgtttcccattt

SEQ ID NO: 14137 - DNA, 22 bp, Artificial Sequence
  chemically synthesized
gtgcttttgtttcccattttga

SEQ ID NO: 14138 - DNA, 22 bp, Artificial Sequence
  chemically synthesized
tgcttttgtttcccattttgat

SEQ ID NO: 14139 - DNA, 22 bp, Artificial Sequence
  chemically synthesized
ttgtttcccattttgatttcaa

SEQ ID NO: 14140 - DNA, 22 bp, Artificial Sequence
  chemically synthesized
tgtttcccattttgatttcaaa

SEQ ID NO: 14141 - DNA, 22 bp, Artificial Sequence
  chemically synthesized
gtttcccattttgatttcaaag

SEQ ID NO: 14142 - DNA, 22 bp, Artificial Sequence
  chemically synthesized
tttcccattttgatttcaaagt

SEQ ID NO: 14143 - DNA, 22 bp, Artificial Sequence
  chemically synthesized
cccattttgatttcaaagtggt

SEQ ID NO: 14144 - DNA, 22 bp, Artificial Sequence
  chemically synthesized
ccattttgatttcaaagtggta

SEQ ID NO: 14145 - DNA, 22 bp, Artificial Sequence
  chemically synthesized
tgatttcaaagtggtaagtcca

SEQ ID NO: 14146 - DNA, 22 bp, Artificial Sequence
  chemically synthesized
gatttcaaagtggtaagtccaa

SEQ ID NO: 14147 - DNA, 22 bp, Artificial Sequence
  chemically synthesized
atttcaaagtggtaagtccaaa

SEQ ID NO: 14148 - DNA, 22 bp, Artificial Sequence
  chemically synthesized
caaagtggtaagtccaaacaaa

SEQ ID NO: 14149 - DNA, 22 bp, Artificial Sequence
  chemically synthesized
aaagtggtaagtccaaacaaaa

SEQ ID NO: 14150 - DNA, 22 bp, Artificial Sequence
  chemically synthesized
ttttttttcactatattctgct

SEQ ID NO: 14151 - DNA, 22 bp, Artificial Sequence
  chemically synthesized
tttttcactatattctgctatt

SEQ ID NO: 14152 - DNA, 22 bp, Artificial Sequence
  chemically synthesized
ttttcactatattctgctattt

SEQ ID NO: 14153 - DNA, 22 bp, Artificial Sequence
  chemically synthesized
tttcactatattctgctatttc

SEQ ID NO: 14154 - DNA, 22 bp, Artificial Sequence
  chemically synthesized
ttcactatattctgctatttct

SEQ ID NO: 14155 - DNA, 22 bp, Artificial Sequence
  chemically synthesized
tcactatattctgctatttctt

SEQ ID NO: 14156 - DNA, 22 bp, Artificial Sequence
  chemically synthesized
cactatattctgctatttcttt

SEQ ID NO: 14157 - DNA, 22 bp, Artificial Sequence
  chemically synthesized
actatattctgctatttctttg

SEQ ID NO: 14158 - DNA, 22 bp, Artificial Sequence
  chemically synthesized
tattctgctatttctttgtttt

SEQ ID NO: 14159 - DNA, 22 bp, Artificial Sequence
  chemically synthesized
tgctatttctttgttttcccac

SEQ ID NO: 14160 - DNA, 22 bp, Artificial Sequence
  chemically synthesized
ctatttctttgttttcccactt

SEQ ID NO: 14161 - DNA, 22 bp, Artificial Sequence
  chemically synthesized
tttctttgttttcccactttta

SEQ ID NO: 14162 - DNA, 22 bp, Artificial Sequence
  chemically synthesized
ctttgttttcccacttttaatt

SEQ ID NO: 14163 - DNA, 22 bp, Artificial Sequence
  chemically synthesized
tttgttttcccacttttaattt

SEQ ID NO: 14164 - DNA, 22 bp, Artificial Sequence
  chemically synthesized
tgttttcccacttttaattttt

SEQ ID NO: 14165 - DNA, 22 bp, Artificial Sequence
  chemically synthesized
gttttcccacttttaatttttt

SEQ ID NO: 14166 - DNA, 22 bp, Artificial Sequence
  chemically synthesized
ttttcccacttttaattttttt

SEQ ID NO: 14167 - DNA, 22 bp, Artificial Sequence
  chemically synthesized
tcccacttttaatttttttaaa

SEQ ID NO: 14168 - DNA, 22 bp, Artificial Sequence
  chemically synthesized
cccacttttaatttttttaaac

SEQ ID NO: 14169 - DNA, 22 bp, Artificial Sequence
  chemically synthesized
ccacttttaatttttttaaacc

SEQ ID NO: 14170 - DNA, 22 bp, Artificial Sequence
  chemically synthesized
ttaatttttttaaaccaaggag

SEQ ID NO: 14171 - DNA, 22 bp, Artificial Sequence
  chemically synthesized
taatttttttaaaccaaggaga

SEQ ID NO: 14172 - DNA, 22 bp, Artificial Sequence
  chemically synthesized
aatttttttaaaccaaggagat

SEQ ID NO: 14173 - DNA, 22 bp, Artificial Sequence
  chemically synthesized
atttttttaaaccaaggagatg

SEQ ID NO: 14174 - DNA, 22 bp, Artificial Sequence
  chemically synthesized
ttttaaaccaaggagatgaatg

SEQ ID NO: 14175 - DNA, 22 bp, Artificial Sequence
  chemically synthesized
tttaaaccaaggagatgaatgt

SEQ ID NO: 14176 - DNA, 22 bp, Artificial Sequence
  chemically synthesized
ttaaaccaaggagatgaatgtt

SEQ ID NO: 14177 - DNA, 22 bp, Artificial Sequence
  chemically synthesized
taaaccaaggagatgaatgttt

SEQ ID NO: 14178 - DNA, 22 bp, Artificial Sequence
  chemically synthesized
aaaccaaggagatgaatgtttt

SEQ ID NO: 14179 - DNA, 22 bp, Artificial Sequence
  chemically synthesized
aaccaaggagatgaatgttttc

SEQ ID NO: 14180 - DNA, 22 bp, Artificial Sequence
  chemically synthesized
tctaacaggaattacatgacca

SEQ ID NO: 14181 - DNA, 22 bp, Artificial Sequence
  chemically synthesized
ctaacaggaattacatgaccaa

SEQ ID NO: 14182 - DNA, 22 bp, Artificial Sequence
  chemically synthesized
taacaggaattacatgaccaaa

SEQ ID NO: 14183 - DNA, 22 bp, Artificial Sequence
  chemically synthesized
acaggaattacatgaccaaatc

SEQ ID NO: 14184 - DNA, 22 bp, Artificial Sequence
  chemically synthesized
catgaccaaatcatgaactgaa

SEQ ID NO: 14185 - DNA, 22 bp, Artificial Sequence
  chemically synthesized
aacagtgtttattaaacataaa

SEQ ID NO: 14186 - DNA, 22 bp, Artificial Sequence
  chemically synthesized
attaaacataaatgcatcataa

SEQ ID NO: 14187 - DNA, 22 bp, Artificial Sequence
  chemically synthesized
ttaaacataaatgcatcataag

SEQ ID NO: 14188 - DNA, 22 bp, Artificial Sequence
  chemically synthesized
aacataaatgcatcataagcat

SEQ ID NO: 14189 - DNA, 22 bp, Artificial Sequence
  chemically synthesized
tcgatctatttagttttaaaaa

SEQ ID NO: 14190 - DNA, 22 bp, Artificial Sequence
  chemically synthesized
tttagttttaaaaatgaagaag

SEQ ID NO: 14191 - DNA, 22 bp, Artificial Sequence
  chemically synthesized
agttttaaaaatgaagaagaag

SEQ ID NO: 14192 - DNA, 22 bp, Artificial Sequence
  chemically synthesized
gttttaaaaatgaagaagaaga

SEQ ID NO: 14193 - DNA, 22 bp, Artificial Sequence
  chemically synthesized
taaaaatgaagaagaagaaaac

SEQ ID NO: 14194 - DNA, 22 bp, Artificial Sequence
  chemically synthesized
aaaaatgaagaagaagaaaacc

SEQ ID NO: 14195 - DNA, 22 bp, Artificial Sequence
  chemically synthesized
aaaatgaagaagaagaaaacct

SEQ ID NO: 14196 - DNA, 22 bp, Artificial Sequence
  chemically synthesized
gctaacaaagaaccagtactta

SEQ ID NO: 14197 - DNA, 22 bp, Artificial Sequence
  chemically synthesized
acaaagaaccagtacttaccaa

SEQ ID NO: 14198 - DNA, 22 bp, Artificial Sequence
  chemically synthesized
accaacctgcgtgctggctgtt

SEQ ID NO: 14199 - DNA, 22 bp, Artificial Sequence
  chemically synthesized
ccaacctgcgtgctggctgtta

SEQ ID NO: 14200 - DNA, 22 bp, Artificial Sequence
  chemically synthesized
cgtgctggctgttagactcttc

SEQ ID NO: 14201 - DNA, 22 bp, Artificial Sequence
  chemically synthesized
gctgttagactcttcaatattg

SEQ ID NO: 14202 - DNA, 22 bp, Artificial Sequence
  chemically synthesized
ttagactcttcaatattgctgt

SEQ ID NO: 14203 - DNA, 22 bp, Artificial Sequence
  chemically synthesized
gactcttcaatattgctgtcaa

SEQ ID NO: 14204 - DNA, 22 bp, Artificial Sequence
  chemically synthesized
ttcaatattgctgtcaaatcat

SEQ ID NO: 14205 - DNA, 22 bp, Artificial Sequence
  chemically synthesized
caatattgctgtcaaatcatgt

SEQ ID NO: 14206 - DNA, 22 bp, Artificial Sequence
  chemically synthesized
aatattgctgtcaaatcatgta

SEQ ID NO: 14207 - DNA, 22 bp, Artificial Sequence
  chemically synthesized
ctgtcaaatcatgtaatcaaaa

SEQ ID NO: 14208 - DNA, 22 bp, Artificial Sequence
  chemically synthesized
tcaaatcatgtaatcaaaattt

SEQ ID NO: 14209 - DNA, 22 bp, Artificial Sequence
  chemically synthesized
agtgaagaagacagcatcagat

SEQ ID NO: 14210 - DNA, 22 bp, Artificial Sequence
  chemically synthesized
gtgaagaagacagcatcagata

SEQ ID NO: 14211 - DNA, 22 bp, Artificial Sequence
  chemically synthesized
ctatatctaaaaggcaagcata

SEQ ID NO: 14212 - DNA, 22 bp, Artificial Sequence
  chemically synthesized
tatatctaaaaggcaagcatac

SEQ ID NO: 14213 - DNA, 22 bp, Artificial Sequence
  chemically synthesized
tatctaaaaggcaagcatactc

SEQ ID NO: 14214 - DNA, 22 bp, Artificial Sequence
  chemically synthesized
aaaggcaagcatactcaatgta

SEQ ID NO: 14215 - DNA, 22 bp, Artificial Sequence
  chemically synthesized
aatgtattttaaaaaaggaaac

SEQ ID NO: 14216 - DNA, 22 bp, Artificial Sequence
  chemically synthesized
taaaaaaggaaacaaacctgta

SEQ ID NO: 14217 - DNA, 22 bp, Artificial Sequence
  chemically synthesized
aaaaaaggaaacaaacctgtac

SEQ ID NO: 14218 - DNA, 22 bp, Artificial Sequence
  chemically synthesized
aaaaaggaaacaaacctgtaca

SEQ ID NO: 14219 - DNA, 22 bp, Artificial Sequence
  chemically synthesized
tacattcagcactgagtagata

SEQ ID NO: 14220 - DNA, 22 bp, Artificial Sequence
  chemically synthesized
agcactgagtagatatcctaaa

SEQ ID NO: 14221 - DNA, 22 bp, Artificial Sequence
  chemically synthesized
agtagatatcctaaaaggcaga

SEQ ID NO: 14222 - DNA, 22 bp, Artificial Sequence
  chemically synthesized
aaaggcagatggtgatgaggcc

SEQ ID NO: 14223 - DNA, 22 bp, Artificial Sequence
  chemically synthesized
gtgattctgccatgatcatgtt

SEQ ID NO: 14224 - DNA, 22 bp, Artificial Sequence
  chemically synthesized
tgccatgatcatgttcacgcgc

SEQ ID NO: 14225 - DNA, 22 bp, Artificial Sequence
  chemically synthesized
ccatgatcatgttcacgcgctg

SEQ ID NO: 14226 - DNA, 22 bp, Artificial Sequence
  chemically synthesized
acgcgctgcataacctttgcta

SEQ ID NO: 14227 - DNA, 22 bp, Artificial Sequence
  chemically synthesized
cataacctttgctagcagattg

SEQ ID NO: 14228 - DNA, 22 bp, Artificial Sequence
  chemically synthesized
tgctagcagattgtgaaagtgg

SEQ ID NO: 14229 - DNA, 22 bp, Artificial Sequence
  chemically synthesized
gctagcagattgtgaaagtggt

SEQ ID NO: 14230 - DNA, 20 bp, Artificial Sequence
  chemically synthesized
tttagacaaacgtggttttt

SEQ ID NO: 14231 - DNA, 20 bp, Artificial Sequence
  chemically synthesized
aaacgtggtttttgagtcca

SEQ ID NO: 14232 - DNA, 20 bp, Artificial Sequence
  chemically synthesized
tggtttttgagtccaaagat

SEQ ID NO: 14233 - DNA, 20 bp, Artificial Sequence
  chemically synthesized
ggtttttgagtccaaagatc

SEQ ID NO: 14234 - DNA, 20 bp, Artificial Sequence
  chemically synthesized
gtttttgagtccaaagatca

SEQ ID NO: 14235 - DNA, 20 bp, Artificial Sequence
  chemically synthesized
ttgagtccaaagatcagggc

SEQ ID NO: 14236 - DNA, 20 bp, Artificial Sequence
  chemically synthesized
tgagtccaaagatcagggct

SEQ ID NO: 14237 - DNA, 20 bp, Artificial Sequence
  chemically synthesized
ggctgggttgacctgaatac

SEQ ID NO: 14238 - DNA, 20 bp, Artificial Sequence
  chemically synthesized
gttgacctgaatactggata

SEQ ID NO: 14239 - DNA, 20 bp, Artificial Sequence
  chemically synthesized
ttgacctgaatactggatac

SEQ ID NO: 14240 - DNA, 20 bp, Artificial Sequence
  chemically synthesized
tgacctgaatactggataca

SEQ ID NO: 14241 - DNA, 20 bp, Artificial Sequence
  chemically synthesized
tggatacagggcatataaaa

SEQ ID NO: 14242 - DNA, 20 bp, Artificial Sequence
  chemically synthesized
ggatacagggcatataaaac

SEQ ID NO: 14243 - DNA, 20 bp, Artificial Sequence
  chemically synthesized
gatacagggcatataaaaca

SEQ ID NO: 14244 - DNA, 20 bp, Artificial Sequence
  chemically synthesized
atacagggcatataaaacag

SEQ ID NO: 14245 - DNA, 20 bp, Artificial Sequence
  chemically synthesized
agggcatataaaacaggggc

SEQ ID NO: 14246 - DNA, 20 bp, Artificial Sequence
  chemically synthesized
gggcatataaaacaggggca

SEQ ID NO: 14247 - DNA, 20 bp, Artificial Sequence
  chemically synthesized
tataaaacaggggcaaggca

SEQ ID NO: 14248 - DNA, 20 bp, Artificial Sequence
  chemically synthesized
aggggcaaggcacagactca

SEQ ID NO: 14249 - DNA, 20 bp, Artificial Sequence
  chemically synthesized
ggcaaggcacagactcatag

SEQ ID NO: 14250 - DNA, 20 bp, Artificial Sequence
  chemically synthesized
caaggcacagactcatagca

SEQ ID NO: 14251 - DNA, 20 bp, Artificial Sequence
  chemically synthesized
atagcagagcaatcaccacc

SEQ ID NO: 14252 - DNA, 20 bp, Artificial Sequence
  chemically synthesized
agagcaatcaccaccaagcc

SEQ ID NO: 14253 - DNA, 20 bp, Artificial Sequence
  chemically synthesized
accaagcctggaataactgc

SEQ ID NO: 14254 - DNA, 20 bp, Artificial Sequence
  chemically synthesized
ccaagcctggaataactgca

SEQ ID NO: 14255 - DNA, 20 bp, Artificial Sequence
  chemically synthesized
caagcctggaataactgcaa

SEQ ID NO: 14256 - DNA, 20 bp, Artificial Sequence
  chemically synthesized
ggctctgctgacatcttcct

SEQ ID NO: 14257 - DNA, 20 bp, Artificial Sequence
  chemically synthesized
gctctgctgacatcttcctg

SEQ ID NO: 14258 - DNA, 20 bp, Artificial Sequence
  chemically synthesized
tgacatcttcctgaggtgcc

SEQ ID NO: 14259 - DNA, 20 bp, Artificial Sequence
  chemically synthesized
gacatcttcctgaggtgcca

SEQ ID NO: 14260 - DNA, 20 bp, Artificial Sequence
  chemically synthesized
tcctgaggtgccaaggaaat

SEQ ID NO: 14261 - DNA, 20 bp, Artificial Sequence
  chemically synthesized
cctgaggtgccaaggaaatg

SEQ ID NO: 14262 - DNA, 20 bp, Artificial Sequence
  chemically synthesized
aggtgccaaggaaatgagga

SEQ ID NO: 14263 - DNA, 20 bp, Artificial Sequence
  chemically synthesized
gtgccaaggaaatgaggatg

SEQ ID NO: 14264 - DNA, 20 bp, Artificial Sequence
  chemically synthesized
tgccaaggaaatgaggatgg

SEQ ID NO: 14265 - DNA, 20 bp, Artificial Sequence
  chemically synthesized
caaggaaatgaggatggagg

SEQ ID NO: 14266 - DNA, 20 bp, Artificial Sequence
  chemically synthesized
aaggaaatgaggatggagga

SEQ ID NO: 14267 - DNA, 20 bp, Artificial Sequence
  chemically synthesized
atgaatgttctccatgactt

SEQ ID NO: 14268 - DNA, 20 bp, Artificial Sequence
  chemically synthesized
tgaatgttctccatgacttt

SEQ ID NO: 14269 - DNA, 20 bp, Artificial Sequence
  chemically synthesized
ttctccatgactttgggatc

SEQ ID NO: 14270 - DNA, 20 bp, Artificial Sequence
  chemically synthesized
tccagtcaacacattacctc

SEQ ID NO: 14271 - DNA, 20 bp, Artificial Sequence
  chemically synthesized
ccagtcaacacattacctcc

SEQ ID NO: 14272 - DNA, 20 bp, Artificial Sequence
  chemically synthesized
ttacctccaggtgaattacc

SEQ ID NO: 14273 - DNA, 20 bp, Artificial Sequence
  chemically synthesized
aggtgaattaccaagactcc

SEQ ID NO: 14274 - DNA, 20 bp, Artificial Sequence
  chemically synthesized
ggtgaattaccaagactccc

SEQ ID NO: 14275 - DNA, 20 bp, Artificial Sequence
  chemically synthesized
attaccaagactcccaggac

SEQ ID NO: 14276 - DNA, 20 bp, Artificial Sequence
  chemically synthesized
ctcccaggactggttcatct

SEQ ID NO: 14277 - DNA, 20 bp, Artificial Sequence
  chemically synthesized
catcttggtgtccgtgatcg

SEQ ID NO: 14278 - DNA, 20 bp, Artificial Sequence
  chemically synthesized
gtgtccgtgatcgcagacct

SEQ ID NO: 14279 - DNA, 20 bp, Artificial Sequence
  chemically synthesized
tgtccgtgatcgcagacctc

SEQ ID NO: 14280 - DNA, 20 bp, Artificial Sequence
  chemically synthesized
tctacgtcctcttccccatc

SEQ ID NO: 14281 - DNA, 20 bp, Artificial Sequence
  chemically synthesized
tccccatctggttccatctt

SEQ ID NO: 14282 - DNA, 20 bp, Artificial Sequence
  chemically synthesized
ccccatctggttccatcttc

SEQ ID NO: 14283 - DNA, 20 bp, Artificial Sequence
  chemically synthesized
catctggttccatcttcagg

SEQ ID NO: 14284 - DNA, 20 bp, Artificial Sequence
  chemically synthesized
gttccatcttcaggaagctg

SEQ ID NO: 14285 - DNA, 20 bp, Artificial Sequence
  chemically synthesized
ttccatcttcaggaagctgt

SEQ ID NO: 14286 - DNA, 20 bp, Artificial Sequence
  chemically synthesized
ctgtgggcattaaactcctt

SEQ ID NO: 14287 - DNA, 20 bp, Artificial Sequence
  chemically synthesized
tgtgggcattaaactccttt

SEQ ID NO: 14288 - DNA, 20 bp, Artificial Sequence
  chemically synthesized
gggcattaaactcctttggg

SEQ ID NO: 14289 - DNA, 20 bp, Artificial Sequence
  chemically synthesized
ctcctttgggtagctgtgat

SEQ ID NO: 14290 - DNA, 20 bp, Artificial Sequence
  chemically synthesized
cctttgggtagctgtgattg

SEQ ID NO: 14291 - DNA, 20 bp, Artificial Sequence
  chemically synthesized
gggtagctgtgattggagac

SEQ ID NO: 14292 - DNA, 20 bp, Artificial Sequence
  chemically synthesized
actggctcaacctcgtcttt

SEQ ID NO: 14293 - DNA, 20 bp, Artificial Sequence
  chemically synthesized
ggctcaacctcgtctttaag

SEQ ID NO: 14294 - DNA, 20 bp, Artificial Sequence
  chemically synthesized
caacctcgtctttaagtggt

SEQ ID NO: 14295 - DNA, 20 bp, Artificial Sequence
  chemically synthesized
tttaagtggtaagaaccata

SEQ ID NO: 14296 - DNA, 20 bp, Artificial Sequence
  chemically synthesized
taagtggtaagaaccatata

SEQ ID NO: 14297 - DNA, 20 bp, Artificial Sequence
  chemically synthesized
agtggtaagaaccatataga

SEQ ID NO: 14298 - DNA, 20 bp, Artificial Sequence
  chemically synthesized
gtggtaagaaccatatagag

SEQ ID NO: 14299 - DNA, 20 bp, Artificial Sequence
  chemically synthesized
ggtaagaaccatatagagag

SEQ ID NO: 14300 - DNA, 20 bp, Artificial Sequence
  chemically synthesized
gaaccatatagagaggagat

SEQ ID NO: 14301 - DNA, 20 bp, Artificial Sequence
  chemically synthesized
catatagagaggagatcagc

SEQ ID NO: 14302 - DNA, 20 bp, Artificial Sequence
  chemically synthesized
agagaggagatcagcaagaa

SEQ ID NO: 14303 - DNA, 20 bp, Artificial Sequence
  chemically synthesized
agaggagatcagcaagaaaa

SEQ ID NO: 14304 - DNA, 20 bp, Artificial Sequence
  chemically synthesized
gaggagatcagcaagaaaag

SEQ ID NO: 14305 - DNA, 20 bp, Artificial Sequence
  chemically synthesized
agatcagcaagaaaagaggc

SEQ ID NO: 14306 - DNA, 20 bp, Artificial Sequence
  chemically synthesized
ctctcgcaatgtctgtccat

SEQ ID NO: 14307 - DNA, 20 bp, Artificial Sequence
  chemically synthesized
tcgcaatgtctgtccatcag

SEQ ID NO: 14308 - DNA, 20 bp, Artificial Sequence
  chemically synthesized
ccatcagaagttgctttccc

SEQ ID NO: 14309 - DNA, 20 bp, Artificial Sequence
  chemically synthesized
catcagaagttgctttcccc

SEQ ID NO: 14310 - DNA, 20 bp, Artificial Sequence
  chemically synthesized
gttgctttccccaggctatt

SEQ ID NO: 14311 - DNA, 20 bp, Artificial Sequence
  chemically synthesized
ttgctttccccaggctattc

SEQ ID NO: 14312 - DNA, 20 bp, Artificial Sequence
  chemically synthesized
ctttccccaggctattcagg

SEQ ID NO: 14313 - DNA, 20 bp, Artificial Sequence
  chemically synthesized
ccaggctattcaggaagcca

SEQ ID NO: 14314 - DNA, 20 bp, Artificial Sequence
  chemically synthesized
caggctattcaggaagccac

SEQ ID NO: 14315 - DNA, 20 bp, Artificial Sequence
  chemically synthesized
ccaacccctctctctgactt

SEQ ID NO: 14316 - DNA, 20 bp, Artificial Sequence
  chemically synthesized
gactttggatcatctacata

SEQ ID NO: 14317 - DNA, 20 bp, Artificial Sequence
  chemically synthesized
actttggatcatctacataa

SEQ ID NO: 14318 - DNA, 20 bp, Artificial Sequence
  chemically synthesized
ctttggatcatctacataaa

SEQ ID NO: 14319 - DNA, 20 bp, Artificial Sequence
  chemically synthesized
tttggatcatctacataaag

SEQ ID NO: 14320 - DNA, 20 bp, Artificial Sequence
  chemically synthesized
ttggatcatctacataaagg

SEQ ID NO: 14321 - DNA, 20 bp, Artificial Sequence
  chemically synthesized
gatcatctacataaaggggg

SEQ ID NO: 14322 - DNA, 20 bp, Artificial Sequence
  chemically synthesized
atctacataaagggggaaga

SEQ ID NO: 14323 - DNA, 20 bp, Artificial Sequence
  chemically synthesized
gaagacagaaaaaatcctac

SEQ ID NO: 14324 - DNA, 20 bp, Artificial Sequence
  chemically synthesized
acagaaaaaatcctaccagt

SEQ ID NO: 14325 - DNA, 20 bp, Artificial Sequence
  chemically synthesized
ctaccagtgagttgaaaata

SEQ ID NO: 14326 - DNA, 20 bp, Artificial Sequence
  chemically synthesized
taccagtgagttgaaaatac

SEQ ID NO: 14327 - DNA, 20 bp, Artificial Sequence
  chemically synthesized
agtgagttgaaaatacagga

SEQ ID NO: 14328 - DNA, 20 bp, Artificial Sequence
  chemically synthesized
acaggaaagcctatttcata

SEQ ID NO: 14329 - DNA, 20 bp, Artificial Sequence
  chemically synthesized
caggaaagcctatttcatat

SEQ ID NO: 14330 - DNA, 20 bp, Artificial Sequence
  chemically synthesized
agcctatttcatatgggtta

SEQ ID NO: 14331 - DNA, 20 bp, Artificial Sequence
  chemically synthesized
gcctatttcatatgggttaa

SEQ ID NO: 14332 - DNA, 20 bp, Artificial Sequence
  chemically synthesized
cctatttcatatgggttaaa

SEQ ID NO: 14333 - DNA, 20 bp, Artificial Sequence
  chemically synthesized
atttcatatgggttaaaggg

SEQ ID NO: 14334 - DNA, 20 bp, Artificial Sequence
  chemically synthesized
tttcatatgggttaaagggt

SEQ ID NO: 14335 - DNA, 20 bp, Artificial Sequence
  chemically synthesized
atatgggttaaagggtagga

SEQ ID NO: 14336 - DNA, 20 bp, Artificial Sequence
  chemically synthesized
ggacagttgaatttcgtgaa

SEQ ID NO: 14337 - DNA, 20 bp, Artificial Sequence
  chemically synthesized
ttgaatttcgtgaaaagtct

SEQ ID NO: 14338 - DNA, 20 bp, Artificial Sequence
  chemically synthesized
cgtgaaaagtctgagttata

SEQ ID NO: 14339 - DNA, 20 bp, Artificial Sequence
  chemically synthesized
gtgaaaagtctgagttatat

SEQ ID NO: 14340 - DNA, 20 bp, Artificial Sequence
  chemically synthesized
gtctgagttatataggcttt

SEQ ID NO: 14341 - DNA, 20 bp, Artificial Sequence
  chemically synthesized
agttatataggctttgagca

SEQ ID NO: 14342 - DNA, 20 bp, Artificial Sequence
  chemically synthesized
ttatataggctttgagcaaa

SEQ ID NO: 14343 - DNA, 20 bp, Artificial Sequence
  chemically synthesized
ctttgagcaaagagttttat

SEQ ID NO: 14344 - DNA, 20 bp, Artificial Sequence
  chemically synthesized
caaagagttttattagtatg

SEQ ID NO: 14345 - DNA, 20 bp, Artificial Sequence
  chemically synthesized
agagttttattagtatgaag

SEQ ID NO: 14346 - DNA, 20 bp, Artificial Sequence
  chemically synthesized
gttttattagtatgaagcag

SEQ ID NO: 14347 - DNA, 20 bp, Artificial Sequence
  chemically synthesized
tttattagtatgaagcagaa

SEQ ID NO: 14348 - DNA, 20 bp, Artificial Sequence
  chemically synthesized
ttattagtatgaagcagaag

SEQ ID NO: 14349 - DNA, 20 bp, Artificial Sequence
  chemically synthesized
gaagcagaagaggtaacata

SEQ ID NO: 14350 - DNA, 20 bp, Artificial Sequence
  chemically synthesized
cagaagaggtaacataaaga

SEQ ID NO: 14351 - DNA, 20 bp, Artificial Sequence
  chemically synthesized
gtaacataaagaaagatgta

SEQ ID NO: 14352 - DNA, 20 bp, Artificial Sequence
  chemically synthesized
taacataaagaaagatgtat

SEQ ID NO: 14353 - DNA, 20 bp, Artificial Sequence
  chemically synthesized
aacataaagaaagatgtatg

SEQ ID NO: 14354 - DNA, 20 bp, Artificial Sequence
  chemically synthesized
taaagaaagatgtatggggc

SEQ ID NO: 14355 - DNA, 20 bp, Artificial Sequence
  chemically synthesized
aaagaaagatgtatggggcc

SEQ ID NO: 14356 - DNA, 20 bp, Artificial Sequence
  chemically synthesized
aagatgtatggggccaggca

SEQ ID NO: 14357 - DNA, 20 bp, Artificial Sequence
  chemically synthesized
atgtatggggccaggcatgg

SEQ ID NO: 14358 - DNA, 20 bp, Artificial Sequence
  chemically synthesized
gtggctcacacctgtaatcc

SEQ ID NO: 14359 - DNA, 20 bp, Artificial Sequence
  chemically synthesized
cacctgtaatcccagcactt

SEQ ID NO: 14360 - DNA, 20 bp, Artificial Sequence
  chemically synthesized
acctgtaatcccagcacttt

SEQ ID NO: 14361 - DNA, 20 bp, Artificial Sequence
  chemically synthesized
ctgtaatcccagcactttgg

SEQ ID NO: 14362 - DNA, 20 bp, Artificial Sequence
  chemically synthesized
tgtaatcccagcactttggg

SEQ ID NO: 14363 - DNA, 20 bp, Artificial Sequence
  chemically synthesized
tcccagcactttgggaggcc

SEQ ID NO: 14364 - DNA, 20 bp, Artificial Sequence
  chemically synthesized
cccagcactttgggaggccg

SEQ ID NO: 14365 - DNA, 20 bp, Artificial Sequence
  chemically synthesized
agcactttgggaggccgagg

SEQ ID NO: 14366 - DNA, 20 bp, Artificial Sequence
  chemically synthesized
gcactttgggaggccgaggt

SEQ ID NO: 14367 - DNA, 20 bp, Artificial Sequence
  chemically synthesized
cgaggtgggcgaatcactcc

SEQ ID NO: 14368 - DNA, 20 bp, Artificial Sequence
  chemically synthesized
gaggtgggcgaatcactcct

SEQ ID NO: 14369 - DNA, 20 bp, Artificial Sequence
  chemically synthesized
gaatcactcctgggtgaact

SEQ ID NO: 14370 - DNA, 20 bp, Artificial Sequence
  chemically synthesized
aatcactcctgggtgaactc

SEQ ID NO: 14371 - DNA, 20 bp, Artificial Sequence
  chemically synthesized
tcactcctgggtgaactcag

SEQ ID NO: 14372 - DNA, 20 bp, Artificial Sequence
  chemically synthesized
ctgggtgaactcaggagttc

SEQ ID NO: 14373 - DNA, 20 bp, Artificial Sequence
  chemically synthesized
tgaactcaggagttcaagac

SEQ ID NO: 14374 - DNA, 20 bp, Artificial Sequence
  chemically synthesized
tcaggagttcaagaccagcc

SEQ ID NO: 14375 - DNA, 20 bp, Artificial Sequence
  chemically synthesized
caggagttcaagaccagcct

SEQ ID NO: 14376 - DNA, 20 bp, Artificial Sequence
  chemically synthesized
caagaccagcctgggcaaca

SEQ ID NO: 14377 - DNA, 20 bp, Artificial Sequence
  chemically synthesized
tacaaaaacattacgaaaat

SEQ ID NO: 14378 - DNA, 20 bp, Artificial Sequence
  chemically synthesized
aaaacattacgaaaattagc

SEQ ID NO: 14379 - DNA, 20 bp, Artificial Sequence
  chemically synthesized
aaacattacgaaaattagct

SEQ ID NO: 14380 - DNA, 20 bp, Artificial Sequence
  chemically synthesized
cgaaaattagctgggcgtgt

SEQ ID NO: 14381 - DNA, 20 bp, Artificial Sequence
  chemically synthesized
agctgggcgtgttggtgctg

SEQ ID NO: 14382 - DNA, 20 bp, Artificial Sequence
  chemically synthesized
gcgtgttggtgctgtagtcc

SEQ ID NO: 14383 - DNA, 20 bp, Artificial Sequence
  chemically synthesized
gtgctgtagtcccagctact

SEQ ID NO: 14384 - DNA, 20 bp, Artificial Sequence
  chemically synthesized
tgctgtagtcccagctactc

SEQ ID NO: 14385 - DNA, 20 bp, Artificial Sequence
  chemically synthesized
ctgtagtcccagctactcag

SEQ ID NO: 14386 - DNA, 20 bp, Artificial Sequence
  chemically synthesized
tgtagtcccagctactcagg

SEQ ID NO: 14387 - DNA, 20 bp, Artificial Sequence
  chemically synthesized
tcccagctactcaggaggct

SEQ ID NO: 14388 - DNA, 20 bp, Artificial Sequence
  chemically synthesized
cccagctactcaggaggctg

SEQ ID NO: 14389 - DNA, 20 bp, Artificial Sequence
  chemically synthesized
gctactcaggaggctgaggt

SEQ ID NO: 14390 - DNA, 20 bp, Artificial Sequence
  chemically synthesized
tactcaggaggctgaggtga

SEQ ID NO: 14391 - DNA, 20 bp, Artificial Sequence
  chemically synthesized
actcaggaggctgaggtgag

SEQ ID NO: 14392 - DNA, 20 bp, Artificial Sequence
  chemically synthesized
caggaggctgaggtgagagg

SEQ ID NO: 14393 - DNA, 20 bp, Artificial Sequence
  chemically synthesized
ggaggctgaggtgagaggcg

SEQ ID NO: 14394 - DNA, 20 bp, Artificial Sequence
  chemically synthesized
gaggctgaggtgagaggcgg

SEQ ID NO: 14395 - DNA, 20 bp, Artificial Sequence
  chemically synthesized
ggctgaggtgagaggcggag

SEQ ID NO: 14396 - DNA, 20 bp, Artificial Sequence
  chemically synthesized
gctgaggtgagaggcggagg

SEQ ID NO: 14397 - DNA, 20 bp, Artificial Sequence
  chemically synthesized
gtgagaggcggaggaggttg

SEQ ID NO: 14398 - DNA, 20 bp, Artificial Sequence
  chemically synthesized
gaggcggaggaggttgcagt

SEQ ID NO: 14399 - DNA, 20 bp, Artificial Sequence
  chemically synthesized
ggaggaggttgcagtgagtc

SEQ ID NO: 14400 - DNA, 20 bp, Artificial Sequence
  chemically synthesized
aagatcatgccactgcactc

SEQ ID NO: 14401 - DNA, 20 bp, Artificial Sequence
  chemically synthesized
catgccactgcactccagcc

SEQ ID NO: 14402 - DNA, 20 bp, Artificial Sequence
  chemically synthesized
atgccactgcactccagcct

SEQ ID NO: 14403 - DNA, 20 bp, Artificial Sequence
  chemically synthesized
ctgcactccagcctgggcaa

SEQ ID NO: 14404 - DNA, 20 bp, Artificial Sequence
  chemically synthesized
gcactccagcctgggcaaca

SEQ ID NO: 14405 - DNA, 20 bp, Artificial Sequence
  chemically synthesized
tccagcctgggcaacagagt

SEQ ID NO: 14406 - DNA, 20 bp, Artificial Sequence
  chemically synthesized
cctgtctcaaaaaaaaaaaa

SEQ ID NO: 14407 - DNA, 20 bp, Artificial Sequence
  chemically synthesized
tctcaaaaaaaaaaaaaaga

SEQ ID NO: 14408 - DNA, 20 bp, Artificial Sequence
  chemically synthesized
tgatgtatgctgtatgaaaa

SEQ ID NO: 14409 - DNA, 20 bp, Artificial Sequence
  chemically synthesized
gatgtatgctgtatgaaaaa

SEQ ID NO: 14410 - DNA, 20 bp, Artificial Sequence
  chemically synthesized
gtatgaaaaaaggaaacaca

SEQ ID NO: 14411 - DNA, 20 bp, Artificial Sequence
  chemically synthesized
gaaacacacagatgattcaa

SEQ ID NO: 14412 - DNA, 20 bp, Artificial Sequence
  chemically synthesized
tgattcaacagcctgttttg

SEQ ID NO: 14413 - DNA, 20 bp, Artificial Sequence
  chemically synthesized
gattcaacagcctgttttgt

SEQ ID NO: 14414 - DNA, 20 bp, Artificial Sequence
  chemically synthesized
attcaacagcctgttttgtg

SEQ ID NO: 14415 - DNA, 20 bp, Artificial Sequence
  chemically synthesized
ctgttttgtggggtaatgaa

SEQ ID NO: 14416 - DNA, 20 bp, Artificial Sequence
  chemically synthesized
ggggtaatgaaaagtcaccc

SEQ ID NO: 14417 - DNA, 20 bp, Artificial Sequence
  chemically synthesized
gggtaatgaaaagtcaccct

SEQ ID NO: 14418 - DNA, 20 bp, Artificial Sequence
  chemically synthesized
tgaaaagtcaccctgggaac

SEQ ID NO: 14419 - DNA, 20 bp, Artificial Sequence
  chemically synthesized
gaaaagtcaccctgggaact

SEQ ID NO: 14420 - DNA, 20 bp, Artificial Sequence
  chemically synthesized
tcaccctgggaactgggctc

SEQ ID NO: 14421 - DNA, 20 bp, Artificial Sequence
  chemically synthesized
acccaccaactacatgtcct

SEQ ID NO: 14422 - DNA, 20 bp, Artificial Sequence
  chemically synthesized
accaactacatgtccttggc

SEQ ID NO: 14423 - DNA, 20 bp, Artificial Sequence
  chemically synthesized
gcaagtcatatcaattatct

SEQ ID NO: 14424 - DNA, 20 bp, Artificial Sequence
  chemically synthesized
tctgttttataatctacaaa

SEQ ID NO: 14425 - DNA, 20 bp, Artificial Sequence
  chemically synthesized
ctgttttataatctacaaat

SEQ ID NO: 14426 - DNA, 20 bp, Artificial Sequence
  chemically synthesized
atctacaaataggttatctc

SEQ ID NO: 14427 - DNA, 20 bp, Artificial Sequence
  chemically synthesized
tacaaataggttatctctgg

SEQ ID NO: 14428 - DNA, 20 bp, Artificial Sequence
  chemically synthesized
tctggcagcttaataataat

SEQ ID NO: 14429 - DNA, 20 bp, Artificial Sequence
  chemically synthesized
ctggcagcttaataataatc

SEQ ID NO: 14430 - DNA, 20 bp, Artificial Sequence
  chemically synthesized
tggcagcttaataataatca

SEQ ID NO: 14431 - DNA, 20 bp, Artificial Sequence
  chemically synthesized
cagggttaacatttattaaa

SEQ ID NO: 14432 - DNA, 20 bp, Artificial Sequence
  chemically synthesized
atttattaaacagtgtgtgc

SEQ ID NO: 14433 - DNA, 20 bp, Artificial Sequence
  chemically synthesized
tgtgctatgtgcttttctgt

SEQ ID NO: 14434 - DNA, 20 bp, Artificial Sequence
  chemically synthesized
gtgctatgtgcttttctgtg

SEQ ID NO: 14435 - DNA, 20 bp, Artificial Sequence
  chemically synthesized
ctatgtgcttttctgtgagg

SEQ ID NO: 14436 - DNA, 20 bp, Artificial Sequence
  chemically synthesized
gaggtagttactgctattta

SEQ ID NO: 14437 - DNA, 20 bp, Artificial Sequence
  chemically synthesized
gttactgctatttacagaaa

SEQ ID NO: 14438 - DNA, 20 bp, Artificial Sequence
  chemically synthesized
actgctatttacagaaacag

SEQ ID NO: 14439 - DNA, 20 bp, Artificial Sequence
  chemically synthesized
atttacagaaacagtagatg

SEQ ID NO: 14440 - DNA, 20 bp, Artificial Sequence
  chemically synthesized
ttacagaaacagtagatgca

SEQ ID NO: 14441 - DNA, 20 bp, Artificial Sequence
  chemically synthesized
aaacagtagatgcagagacc

SEQ ID NO: 14442 - DNA, 20 bp, Artificial Sequence
  chemically synthesized
aacagtagatgcagagacca

SEQ ID NO: 14443 - DNA, 20 bp, Artificial Sequence
  chemically synthesized
gatgcagagaccaaggtgct

SEQ ID NO: 14444 - DNA, 20 bp, Artificial Sequence
  chemically synthesized
aaggtgctgagttaaatgat

SEQ ID NO: 14445 - DNA, 20 bp, Artificial Sequence
  chemically synthesized
aggtgctgagttaaatgatt

SEQ ID NO: 14446 - DNA, 20 bp, Artificial Sequence
  chemically synthesized
agttaaatgattaggccaac

SEQ ID NO: 14447 - DNA, 20 bp, Artificial Sequence
  chemically synthesized
gttaaatgattaggccaaca

SEQ ID NO: 14448 - DNA, 20 bp, Artificial Sequence
  chemically synthesized
aatgattaggccaacaaggt

SEQ ID NO: 14449 - DNA, 20 bp, Artificial Sequence
  chemically synthesized
caacaaggttagtacatgcc

SEQ ID NO: 14450 - DNA, 20 bp, Artificial Sequence
  chemically synthesized
aaggttagtacatgccgagc

SEQ ID NO: 14451 - DNA, 20 bp, Artificial Sequence
  chemically synthesized
aggttagtacatgccgagcc

SEQ ID NO: 14452 - DNA, 20 bp, Artificial Sequence
  chemically synthesized
tagtacatgccgagccagga

SEQ ID NO: 14453 - DNA, 20 bp, Artificial Sequence
  chemically synthesized
tacatgccgagccaggatgg

SEQ ID NO: 14454 - DNA, 20 bp, Artificial Sequence
  chemically synthesized
gccgagccaggatggaagcc

SEQ ID NO: 14455 - DNA, 20 bp, Artificial Sequence
  chemically synthesized
ccgagccaggatggaagccc

SEQ ID NO: 14456 - DNA, 20 bp, Artificial Sequence
  chemically synthesized
agccaggatggaagcccagg

SEQ ID NO: 14457 - DNA, 20 bp, Artificial Sequence
  chemically synthesized
gccaggatggaagcccaggt

SEQ ID NO: 14458 - DNA, 20 bp, Artificial Sequence
  chemically synthesized
aggatggaagcccaggtagg

SEQ ID NO: 14459 - DNA, 20 bp, Artificial Sequence
  chemically synthesized
ggatggaagcccaggtaggc

SEQ ID NO: 14460 - DNA, 20 bp, Artificial Sequence
  chemically synthesized
ggaagcccaggtaggcaggc

SEQ ID NO: 14461 - DNA, 20 bp, Artificial Sequence
  chemically synthesized
ggtaggcaggctggcttccg

SEQ ID NO: 14462 - DNA, 20 bp, Artificial Sequence
  chemically synthesized
cttatgaactatgttacgtc

SEQ ID NO: 14463 - DNA, 20 bp, Artificial Sequence
  chemically synthesized
gtgctgataaactgactctc

SEQ ID NO: 14464 - DNA, 20 bp, Artificial Sequence
  chemically synthesized
tgctgataaactgactctct

SEQ ID NO: 14465 - DNA, 20 bp, Artificial Sequence
  chemically synthesized
gctgataaactgactctctg

SEQ ID NO: 14466 - DNA, 20 bp, Artificial Sequence
  chemically synthesized
tgataaactgactctctggg

SEQ ID NO: 14467 - DNA, 20 bp, Artificial Sequence
  chemically synthesized
taaactgactctctggggag

SEQ ID NO: 14468 - DNA, 20 bp, Artificial Sequence
  chemically synthesized
aaactgactctctggggagc

SEQ ID NO: 14469 - DNA, 20 bp, Artificial Sequence
  chemically synthesized
aactgactctctggggagca

SEQ ID NO: 14470 - DNA, 20 bp, Artificial Sequence
  chemically synthesized
actgactctctggggagcag

SEQ ID NO: 14471 - DNA, 20 bp, Artificial Sequence
  chemically synthesized
actctctggggagcagggga

SEQ ID NO: 14472 - DNA, 20 bp, Artificial Sequence
  chemically synthesized
ggggagcaggggaaagccct

SEQ ID NO: 14473 - DNA, 20 bp, Artificial Sequence
  chemically synthesized
gcaggggaaagccctgagtt

SEQ ID NO: 14474 - DNA, 20 bp, Artificial Sequence
  chemically synthesized
tcacgtaaacattcccattc

SEQ ID NO: 14475 - DNA, 20 bp, Artificial Sequence
  chemically synthesized
tttcttttgtttgtttgttt

SEQ ID NO: 14476 - DNA, 20 bp, Artificial Sequence
  chemically synthesized
ttttgtttgtttgtttgaga

SEQ ID NO: 14477 - DNA, 20 bp, Artificial Sequence
  chemically synthesized
ttgtttgtttgtttgagatg

SEQ ID NO: 14478 - DNA, 20 bp, Artificial Sequence
  chemically synthesized
tggagtctcgcactgttgcc

SEQ ID NO: 14479 - DNA, 20 bp, Artificial Sequence
  chemically synthesized
gtctcgcactgttgcctggc

SEQ ID NO: 14480 - DNA, 20 bp, Artificial Sequence
  chemically synthesized
ctcgcactgttgcctggctg

SEQ ID NO: 14481 - DNA, 20 bp, Artificial Sequence
  chemically synthesized
gttgcctggctggagtgcaa

SEQ ID NO: 14482 - DNA, 20 bp, Artificial Sequence
  chemically synthesized
ggagtgcaatggtgcaatct

SEQ ID NO: 14483 - DNA, 20 bp, Artificial Sequence
  chemically synthesized
cactgcaacctctgcctctc

SEQ ID NO: 14484 - DNA, 20 bp, Artificial Sequence
  chemically synthesized
aacctctgcctctccggttc

SEQ ID NO: 14485 - DNA, 20 bp, Artificial Sequence
  chemically synthesized
ttcaagtgattctcctgcct

SEQ ID NO: 14486 - DNA, 20 bp, Artificial Sequence
  chemically synthesized
ttctcctgcctcagcctccc

SEQ ID NO: 14487 - DNA, 20 bp, Artificial Sequence
  chemically synthesized
tcctgcctcagcctcccaag

SEQ ID NO: 14488 - DNA, 20 bp, Artificial Sequence
  chemically synthesized
gcctcagcctcccaagtagc

SEQ ID NO: 14489 - DNA, 20 bp, Artificial Sequence
  chemically synthesized
cctcagcctcccaagtagct

SEQ ID NO: 14490 - DNA, 20 bp, Artificial Sequence
  chemically synthesized
ctcccaagtagctgggatta

SEQ ID NO: 14491 - DNA, 20 bp, Artificial Sequence
  chemically synthesized
tcccaagtagctgggattac

SEQ ID NO: 14492 - DNA, 20 bp, Artificial Sequence
  chemically synthesized
caggtgcccgccaccatgcc

SEQ ID NO: 14493 - DNA, 20 bp, Artificial Sequence
  chemically synthesized
gctaattttttttgtatttt

SEQ ID NO: 14494 - DNA, 20 bp, Artificial Sequence
  chemically synthesized
aattttttttgtatttttag

SEQ ID NO: 14495 - DNA, 20 bp, Artificial Sequence
  chemically synthesized
ttttttttgtatttttagta

SEQ ID NO: 14496 - DNA, 20 bp, Artificial Sequence
  chemically synthesized
ttgtatttttagtagagaca

SEQ ID NO: 14497 - DNA, 20 bp, Artificial Sequence
  chemically synthesized
catggtttcactatgttgac

SEQ ID NO: 14498 - DNA, 20 bp, Artificial Sequence
  chemically synthesized
atggtttcactatgttgact

SEQ ID NO: 14499 - DNA, 20 bp, Artificial Sequence
  chemically synthesized
tttcactatgttgactaggc

SEQ ID NO: 14500 - DNA, 20 bp, Artificial Sequence
  chemically synthesized
acctcatgatctgcctgcct

SEQ ID NO: 14501 - DNA, 20 bp, Artificial Sequence
  chemically synthesized
ctgcctgccttggcctccct

SEQ ID NO: 14502 - DNA, 20 bp, Artificial Sequence
  chemically synthesized
gccttggcctccctaagtgc

SEQ ID NO: 14503 - DNA, 20 bp, Artificial Sequence
  chemically synthesized
ccttggcctccctaagtgct

SEQ ID NO: 14504 - DNA, 20 bp, Artificial Sequence
  chemically synthesized
ctccctaagtgctaggatta

SEQ ID NO: 14505 - DNA, 20 bp, Artificial Sequence
  chemically synthesized
tccctaagtgctaggattac

SEQ ID NO: 14506 - DNA, 20 bp, Artificial Sequence
  chemically synthesized
agtgctaggattacaggcgt

SEQ ID NO: 14507 - DNA, 20 bp, Artificial Sequence
  chemically synthesized
caggcgtgagccactacacc

SEQ ID NO: 14508 - DNA, 20 bp, Artificial Sequence
  chemically synthesized
gcatgattctaaaaaataaa

SEQ ID NO: 14509 - DNA, 20 bp, Artificial Sequence
  chemically synthesized
ttctaaaaaataaaaagatg

SEQ ID NO: 14510 - DNA, 20 bp, Artificial Sequence
  chemically synthesized
caaacatctgatctccattg

SEQ ID NO: 14511 - DNA, 20 bp, Artificial Sequence
  chemically synthesized
gaagaaccatgcaatctctc

SEQ ID NO: 14512 - DNA, 20 bp, Artificial Sequence
  chemically synthesized
aagaaccatgcaatctctct

SEQ ID NO: 14513 - DNA, 20 bp, Artificial Sequence
  chemically synthesized
atgcaatctctctgggttga

SEQ ID NO: 14514 - DNA, 20 bp, Artificial Sequence
  chemically synthesized
gcaatctctctgggttgata

SEQ ID NO: 14515 - DNA, 20 bp, Artificial Sequence
  chemically synthesized
caatctctctgggttgatag

SEQ ID NO: 14516 - DNA, 20 bp, Artificial Sequence
  chemically synthesized
ctctctgggttgatagaggc

SEQ ID NO: 14517 - DNA, 20 bp, Artificial Sequence
  chemically synthesized
ctctgggttgatagaggcca

SEQ ID NO: 14518 - DNA, 20 bp, Artificial Sequence
  chemically synthesized
gggttgatagaggccagagt

SEQ ID NO: 14519 - DNA, 20 bp, Artificial Sequence
  chemically synthesized
ttgatagaggccagagttag

SEQ ID NO: 14520 - DNA, 20 bp, Artificial Sequence
  chemically synthesized
ttagtggctctccctgattt

SEQ ID NO: 14521 - DNA, 20 bp, Artificial Sequence
  chemically synthesized
tggctctccctgatttcggt

SEQ ID NO: 14522 - DNA, 20 bp, Artificial Sequence
  chemically synthesized
aaatcactattccaccatca

SEQ ID NO: 14523 - DNA, 20 bp, Artificial Sequence
  chemically synthesized
aatcactattccaccatcac

SEQ ID NO: 14524 - DNA, 20 bp, Artificial Sequence
  chemically synthesized
attccaccatcacgggataa

SEQ ID NO: 14525 - DNA, 20 bp, Artificial Sequence
  chemically synthesized
ttccaccatcacgggataaa

SEQ ID NO: 14526 - DNA, 20 bp, Artificial Sequence
  chemically synthesized
gggataaaaggcatcctgac

SEQ ID NO: 14527 - DNA, 20 bp, Artificial Sequence
  chemically synthesized
ataaaaggcatcctgactgg

SEQ ID NO: 14528 - DNA, 20 bp, Artificial Sequence
  chemically synthesized
gcggttgacacctatttcca

SEQ ID NO: 14529 - DNA, 20 bp, Artificial Sequence
  chemically synthesized
gacacctatttccacagtga

SEQ ID NO: 14530 - DNA, 20 bp, Artificial Sequence
  chemically synthesized
tccacagtgaaagatatatc

SEQ ID NO: 14531 - DNA, 20 bp, Artificial Sequence
  chemically synthesized
agatatatctagtactttta

SEQ ID NO: 14532 - DNA, 20 bp, Artificial Sequence
  chemically synthesized
gatatatctagtacttttaa

SEQ ID NO: 14533 - DNA, 20 bp, Artificial Sequence
  chemically synthesized
atatatctagtacttttaaa

SEQ ID NO: 14534 - DNA, 20 bp, Artificial Sequence
  chemically synthesized
tatatctagtacttttaaag

SEQ ID NO: 14535 - DNA, 20 bp, Artificial Sequence
  chemically synthesized
atctagtacttttaaagggg

SEQ ID NO: 14536 - DNA, 20 bp, Artificial Sequence
  chemically synthesized
tagtacttttaaaggggaag

SEQ ID NO: 14537 - DNA, 20 bp, Artificial Sequence
  chemically synthesized
aaaggggaagtggtttgtct

SEQ ID NO: 14538 - DNA, 20 bp, Artificial Sequence
  chemically synthesized
gtctgagatactctgtttca

SEQ ID NO: 14539 - DNA, 20 bp, Artificial Sequence
  chemically synthesized
tgagatactctgtttcaaag

SEQ ID NO: 14540 - DNA, 20 bp, Artificial Sequence
  chemically synthesized
agatactctgtttcaaagta

SEQ ID NO: 14541 - DNA, 20 bp, Artificial Sequence
  chemically synthesized
atactctgtttcaaagtaga

SEQ ID NO: 14542 - DNA, 20 bp, Artificial Sequence
  chemically synthesized
tactctgtttcaaagtagag

SEQ ID NO: 14543 - DNA, 20 bp, Artificial Sequence
  chemically synthesized
gtttcaaagtagagaggata

SEQ ID NO: 14544 - DNA, 20 bp, Artificial Sequence
  chemically synthesized
aagtagagaggatacagaac

SEQ ID NO: 14545 - DNA, 20 bp, Artificial Sequence
  chemically synthesized
ggatacagaacaagcatctg

SEQ ID NO: 14546 - DNA, 20 bp, Artificial Sequence
  chemically synthesized
tgaagctatatacatcctta

SEQ ID NO: 14547 - DNA, 20 bp, Artificial Sequence
  chemically synthesized
aagctatatacatccttaca

SEQ ID NO: 14548 - DNA, 20 bp, Artificial Sequence
  chemically synthesized
gctatatacatccttacaga

SEQ ID NO: 14549 - DNA, 20 bp, Artificial Sequence
  chemically synthesized
cttacagagagcaattctga

SEQ ID NO: 14550 - DNA, 20 bp, Artificial Sequence
  chemically synthesized
gagcaattctgatggaaatg

SEQ ID NO: 14551 - DNA, 20 bp, Artificial Sequence
  chemically synthesized
agcaattctgatggaaatgc

SEQ ID NO: 14552 - DNA, 20 bp, Artificial Sequence
  chemically synthesized
aaatgcaggccatgtttccc

SEQ ID NO: 14553 - DNA, 20 bp, Artificial Sequence
  chemically synthesized
aatgcaggccatgtttccct

SEQ ID NO: 14554 - DNA, 20 bp, Artificial Sequence
  chemically synthesized
atgcaggccatgtttccctg

SEQ ID NO: 14555 - DNA, 20 bp, Artificial Sequence
  chemically synthesized
tgcaggccatgtttccctgg

SEQ ID NO: 14556 - DNA, 20 bp, Artificial Sequence
  chemically synthesized
gcaggccatgtttccctggg

SEQ ID NO: 14557 - DNA, 20 bp, Artificial Sequence
  chemically synthesized
caggccatgtttccctgggg

SEQ ID NO: 14558 - DNA, 20 bp, Artificial Sequence
  chemically synthesized
aggccatgtttccctggggg

SEQ ID NO: 14559 - DNA, 20 bp, Artificial Sequence
  chemically synthesized
tccctggggggggctcgtcc

SEQ ID NO: 14560 - DNA, 20 bp, Artificial Sequence
  chemically synthesized
ccctggggggggctcgtcct

SEQ ID NO: 14561 - DNA, 20 bp, Artificial Sequence
  chemically synthesized
cctggggggggctcgtccta

SEQ ID NO: 14562 - DNA, 20 bp, Artificial Sequence
  chemically synthesized
ctggggggggctcgtcctag

SEQ ID NO: 14563 - DNA, 20 bp, Artificial Sequence
  chemically synthesized
ggggggctcgtcctaggggc

SEQ ID NO: 14564 - DNA, 20 bp, Artificial Sequence
  chemically synthesized
ggggctcgtcctaggggctg

SEQ ID NO: 14565 - DNA, 20 bp, Artificial Sequence
  chemically synthesized
tggagtgcattctctgatgt

SEQ ID NO: 14566 - DNA, 20 bp, Artificial Sequence
  chemically synthesized
gagtgcattctctgatgtca

SEQ ID NO: 14567 - DNA, 20 bp, Artificial Sequence
  chemically synthesized
agtgcattctctgatgtcag

SEQ ID NO: 14568 - DNA, 20 bp, Artificial Sequence
  chemically synthesized
tctgatgtcagaggaaatgc

SEQ ID NO: 14569 - DNA, 20 bp, Artificial Sequence
  chemically synthesized
gaggaaatgcaagattccct

SEQ ID NO: 14570 - DNA, 20 bp, Artificial Sequence
  chemically synthesized
aggaaatgcaagattccctg

SEQ ID NO: 14571 - DNA, 20 bp, Artificial Sequence
  chemically synthesized
tgcaagattccctgaggcct

SEQ ID NO: 14572 - DNA, 20 bp, Artificial Sequence
  chemically synthesized
gcaagattccctgaggcctg

SEQ ID NO: 14573 - DNA, 20 bp, Artificial Sequence
  chemically synthesized
caagattccctgaggcctga

SEQ ID NO: 14574 - DNA, 20 bp, Artificial Sequence
  chemically synthesized
ctgaggcctgagggaaccca

SEQ ID NO: 14575 - DNA, 20 bp, Artificial Sequence
  chemically synthesized
agggaacccatggtatatgc

SEQ ID NO: 14576 - DNA, 20 bp, Artificial Sequence
  chemically synthesized
cccatggtatatgcaagtcc

SEQ ID NO: 14577 - DNA, 20 bp, Artificial Sequence
  chemically synthesized
caagtccaagtttcaaactg

SEQ ID NO: 14578 - DNA, 20 bp, Artificial Sequence
  chemically synthesized
tagttccatatgcattcttc

SEQ ID NO: 14579 - DNA, 20 bp, Artificial Sequence
  chemically synthesized
agttccatatgcattcttcc

SEQ ID NO: 14580 - DNA, 20 bp, Artificial Sequence
  chemically synthesized
ttccaggacaaatacttctt

SEQ ID NO: 14581 - DNA, 20 bp, Artificial Sequence
  chemically synthesized
tccaggacaaatacttcttg

SEQ ID NO: 14582 - DNA, 20 bp, Artificial Sequence
  chemically synthesized
ttcttgaggttaaaaaaaaa

SEQ ID NO: 14583 - DNA, 20 bp, Artificial Sequence
  chemically synthesized
gttaaaaaaaaaaagtcaca

SEQ ID NO: 14584 - DNA, 20 bp, Artificial Sequence
  chemically synthesized
gtcacatagctgccatttta

SEQ ID NO: 14585 - DNA, 20 bp, Artificial Sequence
  chemically synthesized
agctgccattttatggattt

SEQ ID NO: 14586 - DNA, 20 bp, Artificial Sequence
  chemically synthesized
gctgccattttatggatttc

SEQ ID NO: 14587 - DNA, 20 bp, Artificial Sequence
  chemically synthesized
attttttttttttttttttt

SEQ ID NO: 14588 - DNA, 20 bp, Artificial Sequence
  chemically synthesized
ttttttttttttttttgaga

SEQ ID NO: 14589 - DNA, 20 bp, Artificial Sequence
  chemically synthesized
ttttttttttttttgagatg

SEQ ID NO: 14590 - DNA, 20 bp, Artificial Sequence
  chemically synthesized
tggagtcttgctctgtcacc

SEQ ID NO: 14591 - DNA, 20 bp, Artificial Sequence
  chemically synthesized
ttgctctgtcacccagcctg

SEQ ID NO: 14592 - DNA, 20 bp, Artificial Sequence
  chemically synthesized
ctgtcacccagcctgtagtg

SEQ ID NO: 14593 - DNA, 20 bp, Artificial Sequence
  chemically synthesized
tcacccagcctgtagtgcag

SEQ ID NO: 14594 - DNA, 20 bp, Artificial Sequence
  chemically synthesized
gtagtgcagtggcataatct

SEQ ID NO: 14595 - DNA, 20 bp, Artificial Sequence
  chemically synthesized
agtggcataatctcggctca

SEQ ID NO: 14596 - DNA, 20 bp, Artificial Sequence
  chemically synthesized
tcacggcaacctccgcctcc

SEQ ID NO: 14597 - DNA, 20 bp, Artificial Sequence
  chemically synthesized
cacggcaacctccgcctccc

SEQ ID NO: 14598 - DNA, 20 bp, Artificial Sequence
  chemically synthesized
aacctccgcctcccaggttc

SEQ ID NO: 14599 - DNA, 20 bp, Artificial Sequence
  chemically synthesized
ttcaagcgattctcttgcct

SEQ ID NO: 14600 - DNA, 20 bp, Artificial Sequence
  chemically synthesized
ttctcttgccttagcctccc

SEQ ID NO: 14601 - DNA, 20 bp, Artificial Sequence
  chemically synthesized
tcttgccttagcctcccgag

SEQ ID NO: 14602 - DNA, 20 bp, Artificial Sequence
  chemically synthesized
gccttagcctcccgagtagc

SEQ ID NO: 14603 - DNA, 20 bp, Artificial Sequence
  chemically synthesized
ccttagcctcccgagtagct

SEQ ID NO: 14604 - DNA, 20 bp, Artificial Sequence
  chemically synthesized
ctcccgagtagctgggatta

SEQ ID NO: 14605 - DNA, 20 bp, Artificial Sequence
  chemically synthesized
cagtcacgcaccaccacatc

SEQ ID NO: 14606 - DNA, 20 bp, Artificial Sequence
  chemically synthesized
ggctaattctttatattttt

SEQ ID NO: 14607 - DNA, 20 bp, Artificial Sequence
  chemically synthesized
taattctttatattttttgg

SEQ ID NO: 14608 - DNA, 20 bp, Artificial Sequence
  chemically synthesized
tttatattttttggtagaaa

SEQ ID NO: 14609 - DNA, 20 bp, Artificial Sequence
  chemically synthesized
gaaacggtgtttcaccatgt

SEQ ID NO: 14610 - DNA, 20 bp, Artificial Sequence
  chemically synthesized
cggtgtttcaccatgttggc

SEQ ID NO: 14611 - DNA, 20 bp, Artificial Sequence
  chemically synthesized
ggtgtttcaccatgttggcc

SEQ ID NO: 14612 - DNA, 20 bp, Artificial Sequence
  chemically synthesized
tttcaccatgttggccaggc

SEQ ID NO: 14613 - DNA, 20 bp, Artificial Sequence
  chemically synthesized
ctcatgtgatctgcctgcct

SEQ ID NO: 14614 - DNA, 20 bp, Artificial Sequence
  chemically synthesized
ctgcctgccttggcctccca

SEQ ID NO: 14615 - DNA, 20 bp, Artificial Sequence
  chemically synthesized
ccttggcctcccaaagtgct

SEQ ID NO: 14616 - DNA, 20 bp, Artificial Sequence
  chemically synthesized
ctcccaaagtgctgagatta

SEQ ID NO: 14617 - DNA, 20 bp, Artificial Sequence
  chemically synthesized
tcccaaagtgctgagattac

SEQ ID NO: 14618 - DNA, 20 bp, Artificial Sequence
  chemically synthesized
agtgctgagattacaggtgt

SEQ ID NO: 14619 - DNA, 20 bp, Artificial Sequence
  chemically synthesized
tgtgagccaccgcgcctgcc

SEQ ID NO: 14620 - DNA, 20 bp, Artificial Sequence
  chemically synthesized
tgagccaccgcgcctgcctg

SEQ ID NO: 14621 - DNA, 20 bp, Artificial Sequence
  chemically synthesized
caccgcgcctgcctggagtt

SEQ ID NO: 14622 - DNA, 20 bp, Artificial Sequence
  chemically synthesized
ctgcctggagttcagaatct

SEQ ID NO: 14623 - DNA, 20 bp, Artificial Sequence
  chemically synthesized
tgcctggagttcagaatctt

SEQ ID NO: 14624 - DNA, 20 bp, Artificial Sequence
  chemically synthesized
cttcattatttgtgtttaaa

SEQ ID NO: 14625 - DNA, 20 bp, Artificial Sequence
  chemically synthesized
ttgtgtttaaatagatcata

SEQ ID NO: 14626 - DNA, 20 bp, Artificial Sequence
  chemically synthesized
gtttaaatagatcatacagt

SEQ ID NO: 14627 - DNA, 20 bp, Artificial Sequence
  chemically synthesized
tttaaatagatcatacagtc

SEQ ID NO: 14628 - DNA, 20 bp, Artificial Sequence
  chemically synthesized
atagatcatacagtcaggca

SEQ ID NO: 14629 - DNA, 20 bp, Artificial Sequence
  chemically synthesized
gatcatacagtcaggcacgg

SEQ ID NO: 14630 - DNA, 20 bp, Artificial Sequence
  chemically synthesized
gtggctcatgcctgtaatcc

SEQ ID NO: 14631 - DNA, 20 bp, Artificial Sequence
  chemically synthesized
tgcctgtaatcccagcactt

SEQ ID NO: 14632 - DNA, 20 bp, Artificial Sequence
  chemically synthesized
gcctgtaatcccagcacttt

SEQ ID NO: 14633 - DNA, 20 bp, Artificial Sequence
  chemically synthesized
ctgtaatcccagcactttgg

SEQ ID NO: 14634 - DNA, 20 bp, Artificial Sequence
  chemically synthesized
tgtaatcccagcactttggg

SEQ ID NO: 14635 - DNA, 20 bp, Artificial Sequence
  chemically synthesized
tcccagcactttgggaggct

SEQ ID NO: 14636 - DNA, 20 bp, Artificial Sequence
  chemically synthesized
cccagcactttgggaggctg

SEQ ID NO: 14637 - DNA, 20 bp, Artificial Sequence
  chemically synthesized
agcactttgggaggctgagg

SEQ ID NO: 14638 - DNA, 20 bp, Artificial Sequence
  chemically synthesized
gcactttgggaggctgaggt

SEQ ID NO: 14639 - DNA, 20 bp, Artificial Sequence
  chemically synthesized
actttgggaggctgaggtgg

SEQ ID NO: 14640 - DNA, 20 bp, Artificial Sequence
  chemically synthesized
ctttgggaggctgaggtggg

SEQ ID NO: 14641 - DNA, 20 bp, Artificial Sequence
  chemically synthesized
ctgaggtgggaggattgcct

SEQ ID NO: 14642 - DNA, 20 bp, Artificial Sequence
  chemically synthesized
gtgggaggattgcctgagtt

SEQ ID NO: 14643 - DNA, 20 bp, Artificial Sequence
  chemically synthesized
tgggaggattgcctgagttc

SEQ ID NO: 14644 - DNA, 20 bp, Artificial Sequence
  chemically synthesized
ggaggattgcctgagttcag

SEQ ID NO: 14645 - DNA, 20 bp, Artificial Sequence
  chemically synthesized
gattgcctgagttcaggaga

SEQ ID NO: 14646 - DNA, 20 bp, Artificial Sequence
  chemically synthesized
ttgcctgagttcaggagatg

SEQ ID NO: 14647 - DNA, 20 bp, Artificial Sequence
  chemically synthesized
tgagttcaggagatggagac

SEQ ID NO: 14648 - DNA, 20 bp, Artificial Sequence
  chemically synthesized
tcaggagatggagaccagcc

SEQ ID NO: 14649 - DNA, 20 bp, Artificial Sequence
  chemically synthesized
caggagatggagaccagcct

SEQ ID NO: 14650 - DNA, 20 bp, Artificial Sequence
  chemically synthesized
ggagaccagcctgggcaaca

SEQ ID NO: 14651 - DNA, 20 bp, Artificial Sequence
  chemically synthesized
tctactaaaaatacaaaaac

SEQ ID NO: 14652 - DNA, 20 bp, Artificial Sequence
  chemically synthesized
ctaaaaatacaaaaactagc

SEQ ID NO: 14653 - DNA, 20 bp, Artificial Sequence
  chemically synthesized
atacaaaaactagctggatg

SEQ ID NO: 14654 - DNA, 20 bp, Artificial Sequence
  chemically synthesized
caaaaactagctggatgtgg

SEQ ID NO: 14655 - DNA, 20 bp, Artificial Sequence
  chemically synthesized
gatgtggtggcacacacctg

SEQ ID NO: 14656 - DNA, 20 bp, Artificial Sequence
  chemically synthesized
gtggcacacacctgtagtcc

SEQ ID NO: 14657 - DNA, 20 bp, Artificial Sequence
  chemically synthesized
cacctgtagtcccagctatt

SEQ ID NO: 14658 - DNA, 20 bp, Artificial Sequence
  chemically synthesized
acctgtagtcccagctattc

SEQ ID NO: 14659 - DNA, 20 bp, Artificial Sequence
  chemically synthesized
ctgtagtcccagctattcag

SEQ ID NO: 14660 - DNA, 20 bp, Artificial Sequence
  chemically synthesized
tgtagtcccagctattcagg

SEQ ID NO: 14661 - DNA, 20 bp, Artificial Sequence
  chemically synthesized
tcccagctattcaggaggct

SEQ ID NO: 14662 - DNA, 20 bp, Artificial Sequence
  chemically synthesized
cccagctattcaggaggctg

SEQ ID NO: 14663 - DNA, 20 bp, Artificial Sequence
  chemically synthesized
agctattcaggaggctgagg

SEQ ID NO: 14664 - DNA, 20 bp, Artificial Sequence
  chemically synthesized
gctattcaggaggctgaggt

SEQ ID NO: 14665 - DNA, 20 bp, Artificial Sequence
  chemically synthesized
tattcaggaggctgaggtgg

SEQ ID NO: 14666 - DNA, 20 bp, Artificial Sequence
  chemically synthesized
attcaggaggctgaggtggg

SEQ ID NO: 14667 - DNA, 20 bp, Artificial Sequence
  chemically synthesized
aggctgaggtgggaggatcc

SEQ ID NO: 14668 - DNA, 20 bp, Artificial Sequence
  chemically synthesized
ggctgaggtgggaggatccc

SEQ ID NO: 14669 - DNA, 20 bp, Artificial Sequence
  chemically synthesized
ctgaggtgggaggatcccag

SEQ ID NO: 14670 - DNA, 20 bp, Artificial Sequence
  chemically synthesized
tgaggtgggaggatcccagg

SEQ ID NO: 14671 - DNA, 20 bp, Artificial Sequence
  chemically synthesized
ggtgggaggatcccaggagg

SEQ ID NO: 14672 - DNA, 20 bp, Artificial Sequence
  chemically synthesized
tgggaggatcccaggaggta

SEQ ID NO: 14673 - DNA, 20 bp, Artificial Sequence
  chemically synthesized
gggaggatcccaggaggtag

SEQ ID NO: 14674 - DNA, 20 bp, Artificial Sequence
  chemically synthesized
caggaggtagaggtcacaat

SEQ ID NO: 14675 - DNA, 20 bp, Artificial Sequence
  chemically synthesized
ggtagaggtcacaatgagcc

SEQ ID NO: 14676 - DNA, 20 bp, Artificial Sequence
  chemically synthesized
gagattgcgccactgcactc

SEQ ID NO: 14677 - DNA, 20 bp, Artificial Sequence
  chemically synthesized
agattgcgccactgcactcc

SEQ ID NO: 14678 - DNA, 20 bp, Artificial Sequence
  chemically synthesized
tgcgccactgcactccaggc

SEQ ID NO: 14679 - DNA, 20 bp, Artificial Sequence
  chemically synthesized
gcgccactgcactccaggct

SEQ ID NO: 14680 - DNA, 20 bp, Artificial Sequence
  chemically synthesized
gcactccaggctgggttact

SEQ ID NO: 14681 - DNA, 20 bp, Artificial Sequence
  chemically synthesized
tccaggctgggttactgagc

SEQ ID NO: 14682 - DNA, 20 bp, Artificial Sequence
  chemically synthesized
atcctgtctcaaaaaaaaaa

SEQ ID NO: 14683 - DNA, 20 bp, Artificial Sequence
  chemically synthesized
aaaaagataatacattcaaa

SEQ ID NO: 14684 - DNA, 20 bp, Artificial Sequence
  chemically synthesized
tcaaacagttcaaaatgcaa

SEQ ID NO: 14685 - DNA, 20 bp, Artificial Sequence
  chemically synthesized
aatgcaaaagttacatacat

SEQ ID NO: 14686 - DNA, 20 bp, Artificial Sequence
  chemically synthesized
atgcaaaagttacatacata

SEQ ID NO: 14687 - DNA, 20 bp, Artificial Sequence
  chemically synthesized
caaaagttacatacataagg

SEQ ID NO: 14688 - DNA, 20 bp, Artificial Sequence
  chemically synthesized
ctccctctcacacttctccc

SEQ ID NO: 14689 - DNA, 20 bp, Artificial Sequence
  chemically synthesized
cacacttctccccagccacc

SEQ ID NO: 14690 - DNA, 20 bp, Artificial Sequence
  chemically synthesized
agccacccagttctcccttc

SEQ ID NO: 14691 - DNA, 20 bp, Artificial Sequence
  chemically synthesized
ccacccagttctcccttcta

SEQ ID NO: 14692 - DNA, 20 bp, Artificial Sequence
  chemically synthesized
cacccagttctcccttctag

SEQ ID NO: 14693 - DNA, 20 bp, Artificial Sequence
  chemically synthesized
gcaacatgtgaaatccttct

SEQ ID NO: 14694 - DNA, 20 bp, Artificial Sequence
  chemically synthesized
caacatgtgaaatccttctc

SEQ ID NO: 14695 - DNA, 20 bp, Artificial Sequence
  chemically synthesized
ctcaggctacactcttcttg

SEQ ID NO: 14696 - DNA, 20 bp, Artificial Sequence
  chemically synthesized
tcaggctacactcttcttga

SEQ ID NO: 14697 - DNA, 20 bp, Artificial Sequence
  chemically synthesized
ctacactcttcttgaaggtg

SEQ ID NO: 14698 - DNA, 20 bp, Artificial Sequence
  chemically synthesized
tacactcttcttgaaggtgt

SEQ ID NO: 14699 - DNA, 20 bp, Artificial Sequence
  chemically synthesized
cttcttgaaggtgtaggctt

SEQ ID NO: 14700 - DNA, 20 bp, Artificial Sequence
  chemically synthesized
ttcttgaaggtgtaggcttt

SEQ ID NO: 14701 - DNA, 20 bp, Artificial Sequence
  chemically synthesized
aaggtgtaggctttgggcaa

SEQ ID NO: 14702 - DNA, 20 bp, Artificial Sequence
  chemically synthesized
tttgggcaaaagcattcatt

SEQ ID NO: 14703 - DNA, 20 bp, Artificial Sequence
  chemically synthesized
aagcattcattcagtaaccc

SEQ ID NO: 14704 - DNA, 20 bp, Artificial Sequence
  chemically synthesized
aaacttgttctgtttttcca

SEQ ID NO: 14705 - DNA, 20 bp, Artificial Sequence
  chemically synthesized
aacttgttctgtttttccat

SEQ ID NO: 14706 - DNA, 20 bp, Artificial Sequence
  chemically synthesized
tttttccataggattctctt

SEQ ID NO: 14707 - DNA, 20 bp, Artificial Sequence
  chemically synthesized
tccataggattctctttgga

SEQ ID NO: 14708 - DNA, 20 bp, Artificial Sequence
  chemically synthesized
tctttggacagcgtccatac

SEQ ID NO: 14709 - DNA, 20 bp, Artificial Sequence
  chemically synthesized
ttggacagcgtccatactgg

SEQ ID NO: 14710 - DNA, 20 bp, Artificial Sequence
  chemically synthesized
tggacagcgtccatactggt

SEQ ID NO: 14711 - DNA, 20 bp, Artificial Sequence
  chemically synthesized
gcgtccatactggtgggttt

SEQ ID NO: 14712 - DNA, 20 bp, Artificial Sequence
  chemically synthesized
gttttggatactgactacta

SEQ ID NO: 14713 - DNA, 20 bp, Artificial Sequence
  chemically synthesized
acacttccgtgcccctgata

SEQ ID NO: 14714 - DNA, 20 bp, Artificial Sequence
  chemically synthesized
cttccgtgcccctgataaag

SEQ ID NO: 14715 - DNA, 20 bp, Artificial Sequence
  chemically synthesized
agcagttccctgtaacctgt

SEQ ID NO: 14716 - DNA, 20 bp, Artificial Sequence
  chemically synthesized
ttccctgtaacctgtgagac

SEQ ID NO: 14717 - DNA, 20 bp, Artificial Sequence
  chemically synthesized
tgtaacctgtgagactggac

SEQ ID NO: 14718 - DNA, 20 bp, Artificial Sequence
  chemically synthesized
gtaacctgtgagactggacc

SEQ ID NO: 14719 - DNA, 20 bp, Artificial Sequence
  chemically synthesized
cctgtgagactggaccaggt

SEQ ID NO: 14720 - DNA, 20 bp, Artificial Sequence
  chemically synthesized
actggaccaggtaagcgtcc

SEQ ID NO: 14721 - DNA, 20 bp, Artificial Sequence
  chemically synthesized
ggtaagcgtcccagcccctg

SEQ ID NO: 14722 - DNA, 20 bp, Artificial Sequence
  chemically synthesized
agcgtcccagcccctgcaga

SEQ ID NO: 14723 - DNA, 20 bp, Artificial Sequence
  chemically synthesized
gtcccagcccctgcagacag

SEQ ID NO: 14724 - DNA, 20 bp, Artificial Sequence
  chemically synthesized
agcccctgcagacagaagct

SEQ ID NO: 14725 - DNA, 20 bp, Artificial Sequence
  chemically synthesized
ccctgcagacagaagctgag

SEQ ID NO: 14726 - DNA, 20 bp, Artificial Sequence
  chemically synthesized
tggacctcgtttacctgtta

SEQ ID NO: 14727 - DNA, 20 bp, Artificial Sequence
  chemically synthesized
ttatggatgaaactgacctt

SEQ ID NO: 14728 - DNA, 20 bp, Artificial Sequence
  chemically synthesized
tatggatgaaactgaccttg

SEQ ID NO: 14729 - DNA, 20 bp, Artificial Sequence
  chemically synthesized
atggatgaaactgaccttga

SEQ ID NO: 14730 - DNA, 20 bp, Artificial Sequence
  chemically synthesized
tggatgaaactgaccttgag

SEQ ID NO: 14731 - DNA, 20 bp, Artificial Sequence
  chemically synthesized
aactgaccttgaggggacat

SEQ ID NO: 14732 - DNA, 20 bp, Artificial Sequence
  chemically synthesized
actgaccttgaggggacatg

SEQ ID NO: 14733 - DNA, 20 bp, Artificial Sequence
  chemically synthesized
tgaccttgaggggacatgag

SEQ ID NO: 14734 - DNA, 20 bp, Artificial Sequence
  chemically synthesized
accttgaggggacatgagga

SEQ ID NO: 14735 - DNA, 20 bp, Artificial Sequence
  chemically synthesized
cttttgtcatgctcttcaat

SEQ ID NO: 14736 - DNA, 20 bp, Artificial Sequence
  chemically synthesized
ttctgcaatactttcctgaa

SEQ ID NO: 14737 - DNA, 20 bp, Artificial Sequence
  chemically synthesized
caatactttcctgaatagca

SEQ ID NO: 14738 - DNA, 20 bp, Artificial Sequence
  chemically synthesized
tactttcctgaatagcacag

SEQ ID NO: 14739 - DNA, 20 bp, Artificial Sequence
  chemically synthesized
cctgaatagcacagtagtat

SEQ ID NO: 14740 - DNA, 20 bp, Artificial Sequence
  chemically synthesized
tattggaaatctgcctatta

SEQ ID NO: 14741 - DNA, 20 bp, Artificial Sequence
  chemically synthesized
aatctgcctattacagaacc

SEQ ID NO: 14742 - DNA, 20 bp, Artificial Sequence
  chemically synthesized
tgcctattacagaacctgga

SEQ ID NO: 14743 - DNA, 20 bp, Artificial Sequence
  chemically synthesized
cctattacagaacctggatg

SEQ ID NO: 14744 - DNA, 20 bp, Artificial Sequence
  chemically synthesized
tacagaacctggatggagtc

SEQ ID NO: 14745 - DNA, 20 bp, Artificial Sequence
  chemically synthesized
cagaacctggatggagtcca

SEQ ID NO: 14746 - DNA, 20 bp, Artificial Sequence
  chemically synthesized
gaacctggatggagtccaga

SEQ ID NO: 14747 - DNA, 20 bp, Artificial Sequence
  chemically synthesized
aacctggatggagtccagag

SEQ ID NO: 14748 - DNA, 20 bp, Artificial Sequence
  chemically synthesized
ggatggagtccagagaggca

SEQ ID NO: 14749 - DNA, 20 bp, Artificial Sequence
  chemically synthesized
gatggagtccagagaggcac

SEQ ID NO: 14750 - DNA, 20 bp, Artificial Sequence
  chemically synthesized
cagagaggcacgggcatcca

SEQ ID NO: 14751 - DNA, 20 bp, Artificial Sequence
  chemically synthesized
agagaggcacgggcatccat

SEQ ID NO: 14752 - DNA, 20 bp, Artificial Sequence
  chemically synthesized
ggcacgggcatccatgggca

SEQ ID NO: 14753 - DNA, 20 bp, Artificial Sequence
  chemically synthesized
gcacgggcatccatgggcaa

SEQ ID NO: 14754 - DNA, 20 bp, Artificial Sequence
  chemically synthesized
cacgggcatccatgggcaaa

SEQ ID NO: 14755 - DNA, 20 bp, Artificial Sequence
  chemically synthesized
tccatgggcaaagggctcgt

SEQ ID NO: 14756 - DNA, 20 bp, Artificial Sequence
  chemically synthesized
catgggcaaagggctcgtga

SEQ ID NO: 14757 - DNA, 20 bp, Artificial Sequence
  chemically synthesized
tcgtgagagtcaccgccctg

SEQ ID NO: 14758 - DNA, 20 bp, Artificial Sequence
  chemically synthesized
tgcagggcggtgactctcac

SEQ ID NO: 14759 - DNA, 20 bp, Artificial Sequence
  chemically synthesized
tctcacgagccctttgccca

SEQ ID NO: 14760 - DNA, 20 bp, Artificial Sequence
  chemically synthesized
catggatgcccgtgcctctc

SEQ ID NO: 14761 - DNA, 20 bp, Artificial Sequence
  chemically synthesized
gtgcctctctggactccatc

SEQ ID NO: 14762 - DNA, 20 bp, Artificial Sequence
  chemically synthesized
tgcctctctggactccatcc

SEQ ID NO: 14763 - DNA, 20 bp, Artificial Sequence
  chemically synthesized
actccatccaggttctgtaa

SEQ ID NO: 14764 - DNA, 20 bp, Artificial Sequence
  chemically synthesized
ctccatccaggttctgtaat

SEQ ID NO: 14765 - DNA, 20 bp, Artificial Sequence
  chemically synthesized
catccaggttctgtaatagg

SEQ ID NO: 14766 - DNA, 20 bp, Artificial Sequence
  chemically synthesized
tccaatactactgtgctatt

SEQ ID NO: 14767 - DNA, 20 bp, Artificial Sequence
  chemically synthesized
ccaatactactgtgctattc

SEQ ID NO: 14768 - DNA, 20 bp, Artificial Sequence
  chemically synthesized
tactactgtgctattcagga

SEQ ID NO: 14769 - DNA, 20 bp, Artificial Sequence
  chemically synthesized
tgctattcaggaaagtattg

SEQ ID NO: 14770 - DNA, 20 bp, Artificial Sequence
  chemically synthesized
tattcaggaaagtattgcag

SEQ ID NO: 14771 - DNA, 20 bp, Artificial Sequence
  chemically synthesized
gaattaatttgtgccaattg

SEQ ID NO: 14772 - DNA, 20 bp, Artificial Sequence
  chemically synthesized
attaatttgtgccaattgaa

SEQ ID NO: 14773 - DNA, 20 bp, Artificial Sequence
  chemically synthesized
ccaattgaagagcatgacaa

SEQ ID NO: 14774 - DNA, 20 bp, Artificial Sequence
  chemically synthesized
aagagcatgacaaaagtaca

SEQ ID NO: 14775 - DNA, 20 bp, Artificial Sequence
  chemically synthesized
agagcatgacaaaagtacaa

SEQ ID NO: 14776 - DNA, 20 bp, Artificial Sequence
  chemically synthesized
atgacaaaagtacaaaggaa

SEQ ID NO: 14777 - DNA, 20 bp, Artificial Sequence
  chemically synthesized
ggctctcctcatgtcccctc

SEQ ID NO: 14778 - DNA, 20 bp, Artificial Sequence
  chemically synthesized
gctctcctcatgtcccctca

SEQ ID NO: 14779 - DNA, 20 bp, Artificial Sequence
  chemically synthesized
tcctcatgtcccctcaaggt

SEQ ID NO: 14780 - DNA, 20 bp, Artificial Sequence
  chemically synthesized
aaggtcagtttcatccataa

SEQ ID NO: 14781 - DNA, 20 bp, Artificial Sequence
  chemically synthesized
aggtcagtttcatccataac

SEQ ID NO: 14782 - DNA, 20 bp, Artificial Sequence
  chemically synthesized
ttcatccataacaggtaaac

SEQ ID NO: 14783 - DNA, 20 bp, Artificial Sequence
  chemically synthesized
tcatccataacaggtaaacg

SEQ ID NO: 14784 - DNA, 20 bp, Artificial Sequence
  chemically synthesized
acaggtaaacgaggtccact

SEQ ID NO: 14785 - DNA, 20 bp, Artificial Sequence
  chemically synthesized
gtccactcagcttctgtctg

SEQ ID NO: 14786 - DNA, 20 bp, Artificial Sequence
  chemically synthesized
tccactcagcttctgtctgc

SEQ ID NO: 14787 - DNA, 20 bp, Artificial Sequence
  chemically synthesized
ccactcagcttctgtctgca

SEQ ID NO: 14788 - DNA, 20 bp, Artificial Sequence
  chemically synthesized
cactcagcttctgtctgcag

SEQ ID NO: 14789 - DNA, 20 bp, Artificial Sequence
  chemically synthesized
cagcttctgtctgcaggggc

SEQ ID NO: 14790 - DNA, 20 bp, Artificial Sequence
  chemically synthesized
agcttctgtctgcaggggct

SEQ ID NO: 14791 - DNA, 20 bp, Artificial Sequence
  chemically synthesized
caggggctgggacgcttacc

SEQ ID NO: 14792 - DNA, 20 bp, Artificial Sequence
  chemically synthesized
gctgggacgcttacctggtc

SEQ ID NO: 14793 - DNA, 20 bp, Artificial Sequence
  chemically synthesized
gcttacctggtccagtctca

SEQ ID NO: 14794 - DNA, 20 bp, Artificial Sequence
  chemically synthesized
cttacctggtccagtctcac

SEQ ID NO: 14795 - DNA, 20 bp, Artificial Sequence
  chemically synthesized
tggtccagtctcacaggtta

SEQ ID NO: 14796 - DNA, 20 bp, Artificial Sequence
  chemically synthesized
ggtccagtctcacaggttac

SEQ ID NO: 14797 - DNA, 20 bp, Artificial Sequence
  chemically synthesized
gtccagtctcacaggttaca

SEQ ID NO: 14798 - DNA, 20 bp, Artificial Sequence
  chemically synthesized
gttacagggaactgctttat

SEQ ID NO: 14799 - DNA, 20 bp, Artificial Sequence
  chemically synthesized
ttacagggaactgctttatc

SEQ ID NO: 14800 - DNA, 20 bp, Artificial Sequence
  chemically synthesized
tacagggaactgctttatca

SEQ ID NO: 14801 - DNA, 20 bp, Artificial Sequence
  chemically synthesized
acagggaactgctttatcag

SEQ ID NO: 14802 - DNA, 20 bp, Artificial Sequence
  chemically synthesized
gaactgctttatcaggggca

SEQ ID NO: 14803 - DNA, 20 bp, Artificial Sequence
  chemically synthesized
ctgctttatcaggggcacgg

SEQ ID NO: 14804 - DNA, 20 bp, Artificial Sequence
  chemically synthesized
ggggcacggaagtgttgctg

SEQ ID NO: 14805 - DNA, 20 bp, Artificial Sequence
  chemically synthesized
gcacggaagtgttgctgtag

SEQ ID NO: 14806 - DNA, 20 bp, Artificial Sequence
  chemically synthesized
ggaagtgttgctgtagtagt

SEQ ID NO: 14807 - DNA, 20 bp, Artificial Sequence
  chemically synthesized
agtcagtatccaaaacccac

SEQ ID NO: 14808 - DNA, 20 bp, Artificial Sequence
  chemically synthesized
gtatccaaaacccaccagta

SEQ ID NO: 14809 - DNA, 20 bp, Artificial Sequence
  chemically synthesized
accagtatggacgctgtcca

SEQ ID NO: 14810 - DNA, 20 bp, Artificial Sequence
  chemically synthesized
cagtatggacgctgtccaaa

SEQ ID NO: 14811 - DNA, 20 bp, Artificial Sequence
  chemically synthesized
gctgtccaaagagaatccta

SEQ ID NO: 14812 - DNA, 20 bp, Artificial Sequence
  chemically synthesized
aagagaatcctatggaaaaa

SEQ ID NO: 14813 - DNA, 20 bp, Artificial Sequence
  chemically synthesized
atcctatggaaaaacagaac

SEQ ID NO: 14814 - DNA, 20 bp, Artificial Sequence
  chemically synthesized
ggaaaaacagaacaagtttc

SEQ ID NO: 14815 - DNA, 20 bp, Artificial Sequence
  chemically synthesized
gaaaaacagaacaagtttct

SEQ ID NO: 14816 - DNA, 20 bp, Artificial Sequence
  chemically synthesized
aaaaacagaacaagtttctg

SEQ ID NO: 14817 - DNA, 20 bp, Artificial Sequence
  chemically synthesized
tgaatgaatgcttttgccca

SEQ ID NO: 14818 - DNA, 20 bp, Artificial Sequence
  chemically synthesized
tgcccaaagcctacaccttc

SEQ ID NO: 14819 - DNA, 20 bp, Artificial Sequence
  chemically synthesized
ccaaagcctacaccttcaag

SEQ ID NO: 14820 - DNA, 20 bp, Artificial Sequence
  chemically synthesized
aaagcctacaccttcaagaa

SEQ ID NO: 14821 - DNA, 20 bp, Artificial Sequence
  chemically synthesized
ctacaccttcaagaagagtg

SEQ ID NO: 14822 - DNA, 20 bp, Artificial Sequence
  chemically synthesized
cttcaagaagagtgtagcct

SEQ ID NO: 14823 - DNA, 20 bp, Artificial Sequence
  chemically synthesized
caagaagagtgtagcctgag

SEQ ID NO: 14824 - DNA, 20 bp, Artificial Sequence
  chemically synthesized
aagaagagtgtagcctgaga

SEQ ID NO: 14825 - DNA, 20 bp, Artificial Sequence
  chemically synthesized
aggatttcacatgttgcctc

SEQ ID NO: 14826 - DNA, 20 bp, Artificial Sequence
  chemically synthesized
atttcacatgttgcctctag

SEQ ID NO: 14827 - DNA, 20 bp, Artificial Sequence
  chemically synthesized
tttcacatgttgcctctaga

SEQ ID NO: 14828 - DNA, 20 bp, Artificial Sequence
  chemically synthesized
ttcacatgttgcctctagaa

SEQ ID NO: 14829 - DNA, 20 bp, Artificial Sequence
  chemically synthesized
cacatgttgcctctagaagg

SEQ ID NO: 14830 - DNA, 20 bp, Artificial Sequence
  chemically synthesized
ttgcctctagaagggagaac

SEQ ID NO: 14831 - DNA, 20 bp, Artificial Sequence
  chemically synthesized
tgcctctagaagggagaact

SEQ ID NO: 14832 - DNA, 20 bp, Artificial Sequence
  chemically synthesized
ctctagaagggagaactggg

SEQ ID NO: 14833 - DNA, 20 bp, Artificial Sequence
  chemically synthesized
agaagggagaactgggtggc

SEQ ID NO: 14834 - DNA, 20 bp, Artificial Sequence
  chemically synthesized
gaagggagaactgggtggct

SEQ ID NO: 14835 - DNA, 20 bp, Artificial Sequence
  chemically synthesized
aagggagaactgggtggctg

SEQ ID NO: 14836 - DNA, 20 bp, Artificial Sequence
  chemically synthesized
gggagaactgggtggctggg

SEQ ID NO: 14837 - DNA, 20 bp, Artificial Sequence
  chemically synthesized
agaactgggtggctggggag

SEQ ID NO: 14838 - DNA, 20 bp, Artificial Sequence
  chemically synthesized
gggtggctggggagaagtgt

SEQ ID NO: 14839 - DNA, 20 bp, Artificial Sequence
  chemically synthesized
gtggctggggagaagtgtga

SEQ ID NO: 14840 - DNA, 20 bp, Artificial Sequence
  chemically synthesized
tggctggggagaagtgtgag

SEQ ID NO: 14841 - DNA, 20 bp, Artificial Sequence
  chemically synthesized
ggctggggagaagtgtgaga

SEQ ID NO: 14842 - DNA, 20 bp, Artificial Sequence
  chemically synthesized
ctggggagaagtgtgagagg

SEQ ID NO: 14843 - DNA, 20 bp, Artificial Sequence
  chemically synthesized
gtattatctttttttttttt

SEQ ID NO: 14844 - DNA, 20 bp, Artificial Sequence
  chemically synthesized
tatcttttttttttttgaga

SEQ ID NO: 14845 - DNA, 20 bp, Artificial Sequence
  chemically synthesized
atcttttttttttttgagac

SEQ ID NO: 14846 - DNA, 20 bp, Artificial Sequence
  chemically synthesized
tttttttttgagacaggatc

SEQ ID NO: 14847 - DNA, 20 bp, Artificial Sequence
  chemically synthesized
ttttgagacaggatctggct

SEQ ID NO: 14848 - DNA, 20 bp, Artificial Sequence
  chemically synthesized
caggatctggctcagtaacc

SEQ ID NO: 14849 - DNA, 20 bp, Artificial Sequence
  chemically synthesized
tctggctcagtaacccagcc

SEQ ID NO: 14850 - DNA, 20 bp, Artificial Sequence
  chemically synthesized
tggctcagtaacccagcctg

SEQ ID NO: 14851 - DNA, 20 bp, Artificial Sequence
  chemically synthesized
cagtaacccagcctggagtg

SEQ ID NO: 14852 - DNA, 20 bp, Artificial Sequence
  chemically synthesized
taacccagcctggagtgcag

SEQ ID NO: 14853 - DNA, 20 bp, Artificial Sequence
  chemically synthesized
ggagtgcagtggcgcaatct

SEQ ID NO: 14854 - DNA, 20 bp, Artificial Sequence
  chemically synthesized
tcattgtgacctctacctcc

SEQ ID NO: 14855 - DNA, 20 bp, Artificial Sequence
  chemically synthesized
cattgtgacctctacctcct

SEQ ID NO: 14856 - DNA, 20 bp, Artificial Sequence
  chemically synthesized
ctcctgggatcctcccacct

SEQ ID NO: 14857 - DNA, 20 bp, Artificial Sequence
  chemically synthesized
tcccacctcagcctcctgaa

SEQ ID NO: 14858 - DNA, 20 bp, Artificial Sequence
  chemically synthesized
acctcagcctcctgaatagc

SEQ ID NO: 14859 - DNA, 20 bp, Artificial Sequence
  chemically synthesized
cctcagcctcctgaatagct

SEQ ID NO: 14860 - DNA, 20 bp, Artificial Sequence
  chemically synthesized
ctcctgaatagctgggacta

SEQ ID NO: 14861 - DNA, 20 bp, Artificial Sequence
  chemically synthesized
tcctgaatagctgggactac

SEQ ID NO: 14862 - DNA, 20 bp, Artificial Sequence
  chemically synthesized
caggtgtgtgccaccacatc

SEQ ID NO: 14863 - DNA, 20 bp, Artificial Sequence
  chemically synthesized
tgtgtgccaccacatccagc

SEQ ID NO: 14864 - DNA, 20 bp, Artificial Sequence
  chemically synthesized
ccagctagtttttgtatttt

SEQ ID NO: 14865 - DNA, 20 bp, Artificial Sequence
  chemically synthesized
gctagtttttgtatttttag

SEQ ID NO: 14866 - DNA, 20 bp, Artificial Sequence
  chemically synthesized
tagtttttgtatttttagta

SEQ ID NO: 14867 - DNA, 20 bp, Artificial Sequence
  chemically synthesized
ttttgtatttttagtagaga

SEQ ID NO: 14868 - DNA, 20 bp, Artificial Sequence
  chemically synthesized
tttgtatttttagtagagac

SEQ ID NO: 14869 - DNA, 20 bp, Artificial Sequence
  chemically synthesized
ttgtatttttagtagagacg

SEQ ID NO: 14870 - DNA, 20 bp, Artificial Sequence
  chemically synthesized
cggggtttcaccatgttgcc

SEQ ID NO: 14871 - DNA, 20 bp, Artificial Sequence
  chemically synthesized
ggggtttcaccatgttgccc

SEQ ID NO: 14872 - DNA, 20 bp, Artificial Sequence
  chemically synthesized
tttcaccatgttgcccaggc

SEQ ID NO: 14873 - DNA, 20 bp, Artificial Sequence
  chemically synthesized
tggtctccatctcctgaact

SEQ ID NO: 14874 - DNA, 20 bp, Artificial Sequence
  chemically synthesized
ggtctccatctcctgaactc

SEQ ID NO: 14875 - DNA, 20 bp, Artificial Sequence
  chemically synthesized
ctcaggcaatcctcccacct

SEQ ID NO: 14876 - DNA, 20 bp, Artificial Sequence
  chemically synthesized
cctcccacctcagcctccca

SEQ ID NO: 14877 - DNA, 20 bp, Artificial Sequence
  chemically synthesized
acctcagcctcccaaagtgc

SEQ ID NO: 14878 - DNA, 20 bp, Artificial Sequence
  chemically synthesized
cctcagcctcccaaagtgct

SEQ ID NO: 14879 - DNA, 20 bp, Artificial Sequence
  chemically synthesized
ctcccaaagtgctgggatta

SEQ ID NO: 14880 - DNA, 20 bp, Artificial Sequence
  chemically synthesized
tcccaaagtgctgggattac

SEQ ID NO: 14881 - DNA, 20 bp, Artificial Sequence
  chemically synthesized
agtgctgggattacaggcat

SEQ ID NO: 14882 - DNA, 20 bp, Artificial Sequence
  chemically synthesized
ctatttaaacacaaataatg

SEQ ID NO: 14883 - DNA, 20 bp, Artificial Sequence
  chemically synthesized
aaacacaaataatgaagccc

SEQ ID NO: 14884 - DNA, 20 bp, Artificial Sequence
  chemically synthesized
aagcccaagattctgaactc

SEQ ID NO: 14885 - DNA, 20 bp, Artificial Sequence
  chemically synthesized
agcccaagattctgaactcc

SEQ ID NO: 14886 - DNA, 20 bp, Artificial Sequence
  chemically synthesized
ccaagattctgaactccagg

SEQ ID NO: 14887 - DNA, 20 bp, Artificial Sequence
  chemically synthesized
caagattctgaactccaggc

SEQ ID NO: 14888 - DNA, 20 bp, Artificial Sequence
  chemically synthesized
ttctgaactccaggcaggcg

SEQ ID NO: 14889 - DNA, 20 bp, Artificial Sequence
  chemically synthesized
tgaactccaggcaggcgcgg

SEQ ID NO: 14890 - DNA, 20 bp, Artificial Sequence
  chemically synthesized
gtggctcacacctgtaatct

SEQ ID NO: 14891 - DNA, 20 bp, Artificial Sequence
  chemically synthesized
cacctgtaatctcagcactt

SEQ ID NO: 14892 - DNA, 20 bp, Artificial Sequence
  chemically synthesized
acctgtaatctcagcacttt

SEQ ID NO: 14893 - DNA, 20 bp, Artificial Sequence
  chemically synthesized
ctgtaatctcagcactttgg

SEQ ID NO: 14894 - DNA, 20 bp, Artificial Sequence
  chemically synthesized
tgtaatctcagcactttggg

SEQ ID NO: 14895 - DNA, 20 bp, Artificial Sequence
  chemically synthesized
tctcagcactttgggaggcc

SEQ ID NO: 14896 - DNA, 20 bp, Artificial Sequence
  chemically synthesized
ctcagcactttgggaggcca

SEQ ID NO: 14897 - DNA, 20 bp, Artificial Sequence
  chemically synthesized
agcactttgggaggccaagg

SEQ ID NO: 14898 - DNA, 20 bp, Artificial Sequence
  chemically synthesized
gcactttgggaggccaaggc

SEQ ID NO: 14899 - DNA, 20 bp, Artificial Sequence
  chemically synthesized
ctttgggaggccaaggcagg

SEQ ID NO: 14900 - DNA, 20 bp, Artificial Sequence
  chemically synthesized
ccaaggcaggcagatcacat

SEQ ID NO: 14901 - DNA, 20 bp, Artificial Sequence
  chemically synthesized
caaggcaggcagatcacatg

SEQ ID NO: 14902 - DNA, 20 bp, Artificial Sequence
  chemically synthesized
gcaggcagatcacatgaggt

SEQ ID NO: 14903 - DNA, 20 bp, Artificial Sequence
  chemically synthesized
caggcagatcacatgaggtc

SEQ ID NO: 14904 - DNA, 20 bp, Artificial Sequence
  chemically synthesized
ggcagatcacatgaggtcag

SEQ ID NO: 14905 - DNA, 20 bp, Artificial Sequence
  chemically synthesized
tcacatgaggtcaggagttt

SEQ ID NO: 14906 - DNA, 20 bp, Artificial Sequence
  chemically synthesized
tgaggtcaggagtttgagac

SEQ ID NO: 14907 - DNA, 20 bp, Artificial Sequence
  chemically synthesized
tcaggagtttgagaccagcc

SEQ ID NO: 14908 - DNA, 20 bp, Artificial Sequence
  chemically synthesized
tgagaccagcctggccaaca

SEQ ID NO: 14909 - DNA, 20 bp, Artificial Sequence
  chemically synthesized
cgtttctaccaaaaaatata

SEQ ID NO: 14910 - DNA, 20 bp, Artificial Sequence
  chemically synthesized
taccaaaaaatataaagaat

SEQ ID NO: 14911 - DNA, 20 bp, Artificial Sequence
  chemically synthesized
aaaaaatataaagaattagc

SEQ ID NO: 14912 - DNA, 20 bp, Artificial Sequence
  chemically synthesized
tataaagaattagccagatg

SEQ ID NO: 14913 - DNA, 20 bp, Artificial Sequence
  chemically synthesized
aaagaattagccagatgtgg

SEQ ID NO: 14914 - DNA, 20 bp, Artificial Sequence
  chemically synthesized
gtggtgcgtgactgtaatcc

SEQ ID NO: 14915 - DNA, 20 bp, Artificial Sequence
  chemically synthesized
tgactgtaatcccagctact

SEQ ID NO: 14916 - DNA, 20 bp, Artificial Sequence
  chemically synthesized
gactgtaatcccagctactc

SEQ ID NO: 14917 - DNA, 20 bp, Artificial Sequence
  chemically synthesized
ctgtaatcccagctactcgg

SEQ ID NO: 14918 - DNA, 20 bp, Artificial Sequence
  chemically synthesized
tgtaatcccagctactcggg

SEQ ID NO: 14919 - DNA, 20 bp, Artificial Sequence
  chemically synthesized
tcccagctactcgggaggct

SEQ ID NO: 14920 - DNA, 20 bp, Artificial Sequence
  chemically synthesized
cccagctactcgggaggcta

SEQ ID NO: 14921 - DNA, 20 bp, Artificial Sequence
  chemically synthesized
gctactcgggaggctaaggc

SEQ ID NO: 14922 - DNA, 20 bp, Artificial Sequence
  chemically synthesized
tactcgggaggctaaggcaa

SEQ ID NO: 14923 - DNA, 20 bp, Artificial Sequence
  chemically synthesized
gcaagagaatcgcttgaacc

SEQ ID NO: 14924 - DNA, 20 bp, Artificial Sequence
  chemically synthesized
caagagaatcgcttgaacct

SEQ ID NO: 14925 - DNA, 20 bp, Artificial Sequence
  chemically synthesized
agagaatcgcttgaacctgg

SEQ ID NO: 14926 - DNA, 20 bp, Artificial Sequence
  chemically synthesized
gagaatcgcttgaacctggg

SEQ ID NO: 14927 - DNA, 20 bp, Artificial Sequence
  chemically synthesized
aatcgcttgaacctgggagg

SEQ ID NO: 14928 - DNA, 20 bp, Artificial Sequence
  chemically synthesized
tcgcttgaacctgggaggcg

SEQ ID NO: 14929 - DNA, 20 bp, Artificial Sequence
  chemically synthesized
cgcttgaacctgggaggcgg

SEQ ID NO: 14930 - DNA, 20 bp, Artificial Sequence
  chemically synthesized
tgggaggcggaggttgccgt

SEQ ID NO: 14931 - DNA, 20 bp, Artificial Sequence
  chemically synthesized
ggcggaggttgccgtgagcc

SEQ ID NO: 14932 - DNA, 20 bp, Artificial Sequence
  chemically synthesized
gagattatgccactgcacta

SEQ ID NO: 14933 - DNA, 20 bp, Artificial Sequence
  chemically synthesized
agattatgccactgcactac

SEQ ID NO: 14934 - DNA, 20 bp, Artificial Sequence
  chemically synthesized
tatgccactgcactacaggc

SEQ ID NO: 14935 - DNA, 20 bp, Artificial Sequence
  chemically synthesized
atgccactgcactacaggct

SEQ ID NO: 14936 - DNA, 20 bp, Artificial Sequence
  chemically synthesized
ctgcactacaggctgggtga

SEQ ID NO: 14937 - DNA, 20 bp, Artificial Sequence
  chemically synthesized
gcactacaggctgggtgaca

SEQ ID NO: 14938 - DNA, 20 bp, Artificial Sequence
  chemically synthesized
tacaggctgggtgacagagc

SEQ ID NO: 14939 - DNA, 20 bp, Artificial Sequence
  chemically synthesized
aaatcctgaaatccataaaa

SEQ ID NO: 14940 - DNA, 20 bp, Artificial Sequence
  chemically synthesized
tcctgaaatccataaaatgg

SEQ ID NO: 14941 - DNA, 20 bp, Artificial Sequence
  chemically synthesized
gactttttttttttaacctc

SEQ ID NO: 14942 - DNA, 20 bp, Artificial Sequence
  chemically synthesized
tttttttttttaacctcaag

SEQ ID NO: 14943 - DNA, 20 bp, Artificial Sequence
  chemically synthesized
acctcaagaagtatttgtcc

SEQ ID NO: 14944 - DNA, 20 bp, Artificial Sequence
  chemically synthesized
tcaagaagtatttgtcctgg

SEQ ID NO: 14945 - DNA, 20 bp, Artificial Sequence
  chemically synthesized
ttgtcctggaagaatgcata

SEQ ID NO: 14946 - DNA, 20 bp, Artificial Sequence
  chemically synthesized
gaagaatgcatatggaacta

SEQ ID NO: 14947 - DNA, 20 bp, Artificial Sequence
  chemically synthesized
tggaactacagtttgaaact

SEQ ID NO: 14948 - DNA, 20 bp, Artificial Sequence
  chemically synthesized
acttggacttgcatatacca

SEQ ID NO: 14949 - DNA, 20 bp, Artificial Sequence
  chemically synthesized
cttggacttgcatataccat

SEQ ID NO: 14950 - DNA, 20 bp, Artificial Sequence
  chemically synthesized
gcatataccatgggttccct

SEQ ID NO: 14951 - DNA, 20 bp, Artificial Sequence
  chemically synthesized
catataccatgggttccctc

SEQ ID NO: 14952 - DNA, 20 bp, Artificial Sequence
  chemically synthesized
ccatgggttccctcaggcct

SEQ ID NO: 14953 - DNA, 20 bp, Artificial Sequence
  chemically synthesized
catgggttccctcaggcctc

SEQ ID NO: 14954 - DNA, 20 bp, Artificial Sequence
  chemically synthesized
atgggttccctcaggcctca

SEQ ID NO: 14955 - DNA, 20 bp, Artificial Sequence
  chemically synthesized
tcttgcatttcctctgacat

SEQ ID NO: 14956 - DNA, 20 bp, Artificial Sequence
  chemically synthesized
ttgcatttcctctgacatca

SEQ ID NO: 14957 - DNA, 20 bp, Artificial Sequence
  chemically synthesized
tgacatcagagaatgcactc

SEQ ID NO: 14958 - DNA, 20 bp, Artificial Sequence
  chemically synthesized
agagaatgcactccagcccc

SEQ ID NO: 14959 - DNA, 20 bp, Artificial Sequence
  chemically synthesized
gagaatgcactccagcccct

SEQ ID NO: 14960 - DNA, 20 bp, Artificial Sequence
  chemically synthesized
tgcactccagcccctaggac

SEQ ID NO: 14961 - DNA, 20 bp, Artificial Sequence
  chemically synthesized
cccctaggacgagccccccc

SEQ ID NO: 14962 - DNA, 20 bp, Artificial Sequence
  chemically synthesized
ccctaggacgagcccccccc

SEQ ID NO: 14963 - DNA, 20 bp, Artificial Sequence
  chemically synthesized
cctaggacgagcccccccca

SEQ ID NO: 14964 - DNA, 20 bp, Artificial Sequence
  chemically synthesized
gagccccccccagggaaaca

SEQ ID NO: 14965 - DNA, 20 bp, Artificial Sequence
  chemically synthesized
aacatggcctgcatttccat

SEQ ID NO: 14966 - DNA, 20 bp, Artificial Sequence
  chemically synthesized
ccatcagaattgctctctgt

SEQ ID NO: 14967 - DNA, 20 bp, Artificial Sequence
  chemically synthesized
catcagaattgctctctgta

SEQ ID NO: 14968 - DNA, 20 bp, Artificial Sequence
  chemically synthesized
gctctctgtaaggatgtata

SEQ ID NO: 14969 - DNA, 20 bp, Artificial Sequence
  chemically synthesized
tgtaaggatgtatatagctt

SEQ ID NO: 14970 - DNA, 20 bp, Artificial Sequence
  chemically synthesized
gtatcctctctactttgaaa

SEQ ID NO: 14971 - DNA, 20 bp, Artificial Sequence
  chemically synthesized
atcctctctactttgaaaca

SEQ ID NO: 14972 - DNA, 20 bp, Artificial Sequence
  chemically synthesized
tactttgaaacagagtatct

SEQ ID NO: 14973 - DNA, 20 bp, Artificial Sequence
  chemically synthesized
acaaaccacttcccctttaa

SEQ ID NO: 14974 - DNA, 20 bp, Artificial Sequence
  chemically synthesized
cacttcccctttaaaagtac

SEQ ID NO: 14975 - DNA, 20 bp, Artificial Sequence
  chemically synthesized
actagatatatctttcactg

SEQ ID NO: 14976 - DNA, 20 bp, Artificial Sequence
  chemically synthesized
tatatctttcactgtggaaa

SEQ ID NO: 14977 - DNA, 20 bp, Artificial Sequence
  chemically synthesized
atatctttcactgtggaaat

SEQ ID NO: 14978 - DNA, 20 bp, Artificial Sequence
  chemically synthesized
tggaaataggtgtcaaccgc

SEQ ID NO: 14979 - DNA, 20 bp, Artificial Sequence
  chemically synthesized
aataggtgtcaaccgccagt

SEQ ID NO: 14980 - DNA, 20 bp, Artificial Sequence
  chemically synthesized
ataggtgtcaaccgccagtc

SEQ ID NO: 14981 - DNA, 20 bp, Artificial Sequence
  chemically synthesized
ggatgccttttatcccgtga

SEQ ID NO: 14982 - DNA, 20 bp, Artificial Sequence
  chemically synthesized
tgccttttatcccgtgatgg

SEQ ID NO: 14983 - DNA, 20 bp, Artificial Sequence
  chemically synthesized
tttatcccgtgatggtggaa

SEQ ID NO: 14984 - DNA, 20 bp, Artificial Sequence
  chemically synthesized
tagtgatttctcaccgaaat

SEQ ID NO: 14985 - DNA, 20 bp, Artificial Sequence
  chemically synthesized
agtgatttctcaccgaaatc

SEQ ID NO: 14986 - DNA, 20 bp, Artificial Sequence
  chemically synthesized
gtgatttctcaccgaaatca

SEQ ID NO: 14987 - DNA, 20 bp, Artificial Sequence
  chemically synthesized
gatttctcaccgaaatcagg

SEQ ID NO: 14988 - DNA, 20 bp, Artificial Sequence
  chemically synthesized
tttctcaccgaaatcaggga

SEQ ID NO: 14989 - DNA, 20 bp, Artificial Sequence
  chemically synthesized
tcagggagagccactaactc

SEQ ID NO: 14990 - DNA, 20 bp, Artificial Sequence
  chemically synthesized
aactctggcctctatcaacc

SEQ ID NO: 14991 - DNA, 20 bp, Artificial Sequence
  chemically synthesized
ctctggcctctatcaaccca

SEQ ID NO: 14992 - DNA, 20 bp, Artificial Sequence
  chemically synthesized
ctggcctctatcaacccaga

SEQ ID NO: 14993 - DNA, 20 bp, Artificial Sequence
  chemically synthesized
atcaacccagagagattgca

SEQ ID NO: 14994 - DNA, 20 bp, Artificial Sequence
  chemically synthesized
gagattgcatggttcttcaa

SEQ ID NO: 14995 - DNA, 20 bp, Artificial Sequence
  chemically synthesized
gattgcatggttcttcaatg

SEQ ID NO: 14996 - DNA, 20 bp, Artificial Sequence
  chemically synthesized
catggttcttcaatggagat

SEQ ID NO: 14997 - DNA, 20 bp, Artificial Sequence
  chemically synthesized
ttcaatggagatcagatgtt

SEQ ID NO: 14998 - DNA, 20 bp, Artificial Sequence
  chemically synthesized
cacttcatctttttattttt

SEQ ID NO: 14999 - DNA, 20 bp, Artificial Sequence
  chemically synthesized
ttttattttttagaatcatg

SEQ ID NO: 15000 - DNA, 20 bp, Artificial Sequence
  chemically synthesized
attttttagaatcatgcggc

SEQ ID NO: 15001 - DNA, 20 bp, Artificial Sequence
  chemically synthesized
ttttttagaatcatgcggct

SEQ ID NO: 15002 - DNA, 20 bp, Artificial Sequence
  chemically synthesized
tagaatcatgcggctgggtg

SEQ ID NO: 15003 - DNA, 20 bp, Artificial Sequence
  chemically synthesized
aatcatgcggctgggtgtag

SEQ ID NO: 15004 - DNA, 20 bp, Artificial Sequence
  chemically synthesized
gtggctcacgcctgtaatcc

SEQ ID NO: 15005 - DNA, 20 bp, Artificial Sequence
  chemically synthesized
acgcctgtaatcctagcact

SEQ ID NO: 15006 - DNA, 20 bp, Artificial Sequence
  chemically synthesized
cgcctgtaatcctagcactt

SEQ ID NO: 15007 - DNA, 20 bp, Artificial Sequence
  chemically synthesized
gcctgtaatcctagcactta

SEQ ID NO: 15008 - DNA, 20 bp, Artificial Sequence
  chemically synthesized
ctgtaatcctagcacttagg

SEQ ID NO: 15009 - DNA, 20 bp, Artificial Sequence
  chemically synthesized
tgtaatcctagcacttaggg

SEQ ID NO: 15010 - DNA, 20 bp, Artificial Sequence
  chemically synthesized
tcctagcacttagggaggcc

SEQ ID NO: 15011 - DNA, 20 bp, Artificial Sequence
  chemically synthesized
cctagcacttagggaggcca

SEQ ID NO: 15012 - DNA, 20 bp, Artificial Sequence
  chemically synthesized
agcacttagggaggccaagg

SEQ ID NO: 15013 - DNA, 20 bp, Artificial Sequence
  chemically synthesized
gcacttagggaggccaaggc

SEQ ID NO: 15014 - DNA, 20 bp, Artificial Sequence
  chemically synthesized
cttagggaggccaaggcagg

SEQ ID NO: 15015 - DNA, 20 bp, Artificial Sequence
  chemically synthesized
ggccaaggcaggcagatcat

SEQ ID NO: 15016 - DNA, 20 bp, Artificial Sequence
  chemically synthesized
gccaaggcaggcagatcatg

SEQ ID NO: 15017 - DNA, 20 bp, Artificial Sequence
  chemically synthesized
aggcaggcagatcatgaggt

SEQ ID NO: 15018 - DNA, 20 bp, Artificial Sequence
  chemically synthesized
ggcaggcagatcatgaggtc

SEQ ID NO: 15019 - DNA, 20 bp, Artificial Sequence
  chemically synthesized
caggcagatcatgaggtcag

SEQ ID NO: 15020 - DNA, 20 bp, Artificial Sequence
  chemically synthesized
gatcatgaggtcaggagttc

SEQ ID NO: 15021 - DNA, 20 bp, Artificial Sequence
  chemically synthesized
tgaggtcaggagttcgagac

SEQ ID NO: 15022 - DNA, 20 bp, Artificial Sequence
  chemically synthesized
tcaggagttcgagaccagcc

SEQ ID NO: 15023 - DNA, 20 bp, Artificial Sequence
  chemically synthesized
cgagaccagcctagtcaaca

SEQ ID NO: 15024 - DNA, 20 bp, Artificial Sequence
  chemically synthesized
actaaaaatacaaaaaaaat

SEQ ID NO: 15025 - DNA, 20 bp, Artificial Sequence
  chemically synthesized
aaaatacaaaaaaaattagc

SEQ ID NO: 15026 - DNA, 20 bp, Artificial Sequence
  chemically synthesized
aaatacaaaaaaaattagct

SEQ ID NO: 15027 - DNA, 20 bp, Artificial Sequence
  chemically synthesized
caaaaaaaattagctgggca

SEQ ID NO: 15028 - DNA, 20 bp, Artificial Sequence
  chemically synthesized
aaaaaattagctgggcatgg

SEQ ID NO: 15029 - DNA, 20 bp, Artificial Sequence
  chemically synthesized
aaattagctgggcatggtgg

SEQ ID NO: 15030 - DNA, 20 bp, Artificial Sequence
  chemically synthesized
aattagctgggcatggtggc

SEQ ID NO: 15031 - DNA, 20 bp, Artificial Sequence
  chemically synthesized
gtggcgggcacctgtaatcc

SEQ ID NO: 15032 - DNA, 20 bp, Artificial Sequence
  chemically synthesized
cacctgtaatcccagctact

SEQ ID NO: 15033 - DNA, 20 bp, Artificial Sequence
  chemically synthesized
acctgtaatcccagctactt

SEQ ID NO: 15034 - DNA, 20 bp, Artificial Sequence
  chemically synthesized
ctgtaatcccagctacttgg

SEQ ID NO: 15035 - DNA, 20 bp, Artificial Sequence
  chemically synthesized
tgtaatcccagctacttggg

SEQ ID NO: 15036 - DNA, 20 bp, Artificial Sequence
  chemically synthesized
tcccagctacttgggaggct

SEQ ID NO: 15037 - DNA, 20 bp, Artificial Sequence
  chemically synthesized
cccagctacttgggaggctg

SEQ ID NO: 15038 - DNA, 20 bp, Artificial Sequence
  chemically synthesized
agctacttgggaggctgagg

SEQ ID NO: 15039 - DNA, 20 bp, Artificial Sequence
  chemically synthesized
gctacttgggaggctgaggc

SEQ ID NO: 15040 - DNA, 20 bp, Artificial Sequence
  chemically synthesized
tacttgggaggctgaggcag

SEQ ID NO: 15041 - DNA, 20 bp, Artificial Sequence
  chemically synthesized
ggcaggagaatcacttgaac

SEQ ID NO: 15042 - DNA, 20 bp, Artificial Sequence
  chemically synthesized
caggagaatcacttgaaccg

SEQ ID NO: 15043 - DNA, 20 bp, Artificial Sequence
  chemically synthesized
ggagaatcacttgaaccgga

SEQ ID NO: 15044 - DNA, 20 bp, Artificial Sequence
  chemically synthesized
gagaatcacttgaaccggag

SEQ ID NO: 15045 - DNA, 20 bp, Artificial Sequence
  chemically synthesized
aatcacttgaaccggagagg

SEQ ID NO: 15046 - DNA, 20 bp, Artificial Sequence
  chemically synthesized
tcacttgaaccggagaggca

SEQ ID NO: 15047 - DNA, 20 bp, Artificial Sequence
  chemically synthesized
cacttgaaccggagaggcag

SEQ ID NO: 15048 - DNA, 20 bp, Artificial Sequence
  chemically synthesized
aaccggagaggcagaggttg

SEQ ID NO: 15049 - DNA, 20 bp, Artificial Sequence
  chemically synthesized
ggagaggcagaggttgcagt

SEQ ID NO: 15050 - DNA, 20 bp, Artificial Sequence
  chemically synthesized
ggcagaggttgcagtgagct

SEQ ID NO: 15051 - DNA, 20 bp, Artificial Sequence
  chemically synthesized
gagattgcaccattgcactc

SEQ ID NO: 15052 - DNA, 20 bp, Artificial Sequence
  chemically synthesized
ttgcaccattgcactccagc

SEQ ID NO: 15053 - DNA, 20 bp, Artificial Sequence
  chemically synthesized
tgcaccattgcactccagcc

SEQ ID NO: 15054 - DNA, 20 bp, Artificial Sequence
  chemically synthesized
attgcactccagccaggcaa

SEQ ID NO: 15055 - DNA, 20 bp, Artificial Sequence
  chemically synthesized
ctccagccaggcaacagtgc

SEQ ID NO: 15056 - DNA, 20 bp, Artificial Sequence
  chemically synthesized
catctcaaacaaacaaacaa

SEQ ID NO: 15057 - DNA, 20 bp, Artificial Sequence
  chemically synthesized
tcaaacaaacaaacaaaaga

SEQ ID NO: 15058 - DNA, 20 bp, Artificial Sequence
  chemically synthesized
acaaacaaacaaaagaaaga

SEQ ID NO: 15059 - DNA, 20 bp, Artificial Sequence
  chemically synthesized
acaaacaaaagaaagaaaga

SEQ ID NO: 15060 - DNA, 20 bp, Artificial Sequence
  chemically synthesized
acaaaagaaagaaagaaaga

SEQ ID NO: 15061 - DNA, 20 bp, Artificial Sequence
  chemically synthesized
aaagaaagaaagaaagaaag

SEQ ID NO: 15062 - DNA, 20 bp, Artificial Sequence
  chemically synthesized
aaagaaagaaagaaagtggc

SEQ ID NO: 15063 - DNA, 20 bp, Artificial Sequence
  chemically synthesized
aagaaagaaagtggccagaa

SEQ ID NO: 15064 - DNA, 20 bp, Artificial Sequence
  chemically synthesized
agaaagaaagtggccagaat

SEQ ID NO: 15065 - DNA, 20 bp, Artificial Sequence
  chemically synthesized
gaatgggaatgtttacgtga

SEQ ID NO: 15066 - DNA, 20 bp, Artificial Sequence
  chemically synthesized
aatgtttacgtgatagaaat

SEQ ID NO: 15067 - DNA, 20 bp, Artificial Sequence
  chemically synthesized
aaattggcaaatgctaaact

SEQ ID NO: 15068 - DNA, 20 bp, Artificial Sequence
  chemically synthesized
aattggcaaatgctaaactc

SEQ ID NO: 15069 - DNA, 20 bp, Artificial Sequence
  chemically synthesized
attggcaaatgctaaactca

SEQ ID NO: 15070 - DNA, 20 bp, Artificial Sequence
  chemically synthesized
cagggctttcccctgctccc

SEQ ID NO: 15071 - DNA, 20 bp, Artificial Sequence
  chemically synthesized
gggctttcccctgctcccca

SEQ ID NO: 15072 - DNA, 20 bp, Artificial Sequence
  chemically synthesized
gctttcccctgctccccaga

SEQ ID NO: 15073 - DNA, 20 bp, Artificial Sequence
  chemically synthesized
tcccctgctccccagagagt

SEQ ID NO: 15074 - DNA, 20 bp, Artificial Sequence
  chemically synthesized
tccccagagagtcagtttat

SEQ ID NO: 15075 - DNA, 20 bp, Artificial Sequence
  chemically synthesized
gagagtcagtttatcagcac

SEQ ID NO: 15076 - DNA, 20 bp, Artificial Sequence
  chemically synthesized
tatcagcactggacgtaaca

SEQ ID NO: 15077 - DNA, 20 bp, Artificial Sequence
  chemically synthesized
ctggacgtaacatagttcat

SEQ ID NO: 15078 - DNA, 20 bp, Artificial Sequence
  chemically synthesized
ggacgtaacatagttcataa

SEQ ID NO: 15079 - DNA, 20 bp, Artificial Sequence
  chemically synthesized
agttcataagagcattgccg

SEQ ID NO: 15080 - DNA, 20 bp, Artificial Sequence
  chemically synthesized
tcataagagcattgccgcgg

SEQ ID NO: 15081 - DNA, 20 bp, Artificial Sequence
  chemically synthesized
aagagcattgccgcggaagc

SEQ ID NO: 15082 - DNA, 20 bp, Artificial Sequence
  chemically synthesized
cggaagccagcctgcctacc

SEQ ID NO: 15083 - DNA, 20 bp, Artificial Sequence
  chemically synthesized
ggaagccagcctgcctacct

SEQ ID NO: 15084 - DNA, 20 bp, Artificial Sequence
  chemically synthesized
gcctacctgggcttccatcc

SEQ ID NO: 15085 - DNA, 20 bp, Artificial Sequence
  chemically synthesized
cctgggcttccatcctggct

SEQ ID NO: 15086 - DNA, 20 bp, Artificial Sequence
  chemically synthesized
tcggcatgtactaaccttgt

SEQ ID NO: 15087 - DNA, 20 bp, Artificial Sequence
  chemically synthesized
gttggcctaatcatttaact

SEQ ID NO: 15088 - DNA, 20 bp, Artificial Sequence
  chemically synthesized
aatcatttaactcagcacct

SEQ ID NO: 15089 - DNA, 20 bp, Artificial Sequence
  chemically synthesized
gcatctactgtttctgtaaa

SEQ ID NO: 15090 - DNA, 20 bp, Artificial Sequence
  chemically synthesized
tctactgtttctgtaaatag

SEQ ID NO: 15091 - DNA, 20 bp, Artificial Sequence
  chemically synthesized
aaatagcagtaactacctca

SEQ ID NO: 15092 - DNA, 20 bp, Artificial Sequence
  chemically synthesized
gcagtaactacctcacagaa

SEQ ID NO: 15093 - DNA, 20 bp, Artificial Sequence
  chemically synthesized
ctacctcacagaaaagcaca

SEQ ID NO: 15094 - DNA, 20 bp, Artificial Sequence
  chemically synthesized
acagaaaagcacatagcaca

SEQ ID NO: 15095 - DNA, 20 bp, Artificial Sequence
  chemically synthesized
aaagcacatagcacatggac

SEQ ID NO: 15096 - DNA, 20 bp, Artificial Sequence
  chemically synthesized
tgttaaccctgattattatt

SEQ ID NO: 15097 - DNA, 20 bp, Artificial Sequence
  chemically synthesized
cctgattattattaagctgc

SEQ ID NO: 15098 - DNA, 20 bp, Artificial Sequence
  chemically synthesized
tgattattattaagctgcca

SEQ ID NO: 15099 - DNA, 20 bp, Artificial Sequence
  chemically synthesized
tgccagagataacctatttg

SEQ ID NO: 15100 - DNA, 20 bp, Artificial Sequence
  chemically synthesized
cctatttgtagattataaaa

SEQ ID NO: 15101 - DNA, 20 bp, Artificial Sequence
  chemically synthesized
tagattataaaacagaaact

SEQ ID NO: 15102 - DNA, 20 bp, Artificial Sequence
  chemically synthesized
gataattgatatgacttgcc

SEQ ID NO: 15103 - DNA, 20 bp, Artificial Sequence
  chemically synthesized
ataattgatatgacttgcca

SEQ ID NO: 15104 - DNA, 20 bp, Artificial Sequence
  chemically synthesized
tatgacttgccaaggacatg

SEQ ID NO: 15105 - DNA, 20 bp, Artificial Sequence
  chemically synthesized
acttgccaaggacatgtagt

SEQ ID NO: 15106 - DNA, 20 bp, Artificial Sequence
  chemically synthesized
tgccaaggacatgtagttgg

SEQ ID NO: 15107 - DNA, 20 bp, Artificial Sequence
  chemically synthesized
gccaaggacatgtagttggt

SEQ ID NO: 15108 - DNA, 20 bp, Artificial Sequence
  chemically synthesized
aaggacatgtagttggtggg

SEQ ID NO: 15109 - DNA, 20 bp, Artificial Sequence
  chemically synthesized
gacatgtagttggtgggtgg

SEQ ID NO: 15110 - DNA, 20 bp, Artificial Sequence
  chemically synthesized
tagttggtgggtggcagaac

SEQ ID NO: 15111 - DNA, 20 bp, Artificial Sequence
  chemically synthesized
agttggtgggtggcagaacg

SEQ ID NO: 15112 - DNA, 20 bp, Artificial Sequence
  chemically synthesized
gttggtgggtggcagaacga

SEQ ID NO: 15113 - DNA, 20 bp, Artificial Sequence
  chemically synthesized
gtgggtggcagaacgagggc

SEQ ID NO: 15114 - DNA, 20 bp, Artificial Sequence
  chemically synthesized
gggtggcagaacgagggctg

SEQ ID NO: 15115 - DNA, 20 bp, Artificial Sequence
  chemically synthesized
gcagaacgagggctggagcc

SEQ ID NO: 15116 - DNA, 20 bp, Artificial Sequence
  chemically synthesized
gagggctggagcccagttcc

SEQ ID NO: 15117 - DNA, 20 bp, Artificial Sequence
  chemically synthesized
agggctggagcccagttccc

SEQ ID NO: 15118 - DNA, 20 bp, Artificial Sequence
  chemically synthesized
gggctggagcccagttccca

SEQ ID NO: 15119 - DNA, 20 bp, Artificial Sequence
  chemically synthesized
cttttcattaccccacaaaa

SEQ ID NO: 15120 - DNA, 20 bp, Artificial Sequence
  chemically synthesized
ttttcattaccccacaaaac

SEQ ID NO: 15121 - DNA, 20 bp, Artificial Sequence
  chemically synthesized
gtgtgtttccttttttcata

SEQ ID NO: 15122 - DNA, 20 bp, Artificial Sequence
  chemically synthesized
tctatctttttttttttttt

SEQ ID NO: 15123 - DNA, 20 bp, Artificial Sequence
  chemically synthesized
tcttttttttttttttgaga

SEQ ID NO: 15124 - DNA, 20 bp, Artificial Sequence
  chemically synthesized
cttttttttttttttgagac

SEQ ID NO: 15125 - DNA, 20 bp, Artificial Sequence
  chemically synthesized
ttttttttttttttgagaca

SEQ ID NO: 15126 - DNA, 20 bp, Artificial Sequence
  chemically synthesized
cagggtcttactctgttgcc

SEQ ID NO: 15127 - DNA, 20 bp, Artificial Sequence
  chemically synthesized
agggtcttactctgttgccc

SEQ ID NO: 15128 - DNA, 20 bp, Artificial Sequence
  chemically synthesized
tcttactctgttgcccaggc

SEQ ID NO: 15129 - DNA, 20 bp, Artificial Sequence
  chemically synthesized
ttactctgttgcccaggctg

SEQ ID NO: 15130 - DNA, 20 bp, Artificial Sequence
  chemically synthesized
ctgttgcccaggctggagtg

SEQ ID NO: 15131 - DNA, 20 bp, Artificial Sequence
  chemically synthesized
ttgcccaggctggagtgcag

SEQ ID NO: 15132 - DNA, 20 bp, Artificial Sequence
  chemically synthesized
acctcctccgcctctcacct

SEQ ID NO: 15133 - DNA, 20 bp, Artificial Sequence
  chemically synthesized
gcctctcacctcagcctcct

SEQ ID NO: 15134 - DNA, 20 bp, Artificial Sequence
  chemically synthesized
tctcacctcagcctcctgag

SEQ ID NO: 15135 - DNA, 20 bp, Artificial Sequence
  chemically synthesized
acctcagcctcctgagtagc

SEQ ID NO: 15136 - DNA, 20 bp, Artificial Sequence
  chemically synthesized
cctcagcctcctgagtagct

SEQ ID NO: 15137 - DNA, 20 bp, Artificial Sequence
  chemically synthesized
ctcctgagtagctgggacta

SEQ ID NO: 15138 - DNA, 20 bp, Artificial Sequence
  chemically synthesized
gactacagcaccaacacgcc

SEQ ID NO: 15139 - DNA, 20 bp, Artificial Sequence
  chemically synthesized
taattttcgtaatgtttttg

SEQ ID NO: 15140 - DNA, 20 bp, Artificial Sequence
  chemically synthesized
attttcgtaatgtttttgta

SEQ ID NO: 15141 - DNA, 20 bp, Artificial Sequence
  chemically synthesized
tcgtaatgtttttgtagaga

SEQ ID NO: 15142 - DNA, 20 bp, Artificial Sequence
  chemically synthesized
gtaatgtttttgtagagatg

SEQ ID NO: 15143 - DNA, 20 bp, Artificial Sequence
  chemically synthesized
tggagtttcgccatgttgcc

SEQ ID NO: 15144 - DNA, 20 bp, Artificial Sequence
  chemically synthesized
ggagtttcgccatgttgccc

SEQ ID NO: 15145 - DNA, 20 bp, Artificial Sequence
  chemically synthesized
tttcgccatgttgcccaggc

SEQ ID NO: 15146 - DNA, 20 bp, Artificial Sequence
  chemically synthesized
caggctggtcttgaactcct

SEQ ID NO: 15147 - DNA, 20 bp, Artificial Sequence
  chemically synthesized
cttgaactcctgagttcacc

SEQ ID NO: 15148 - DNA, 20 bp, Artificial Sequence
  chemically synthesized
ttgaactcctgagttcaccc

SEQ ID NO: 15149 - DNA, 20 bp, Artificial Sequence
  chemically synthesized
gaactcctgagttcacccag

SEQ ID NO: 15150 - DNA, 20 bp, Artificial Sequence
  chemically synthesized
caggagtgattcgcccacct

SEQ ID NO: 15151 - DNA, 20 bp, Artificial Sequence
  chemically synthesized
tcgcccacctcggcctccca

SEQ ID NO: 15152 - DNA, 20 bp, Artificial Sequence
  chemically synthesized
acctcggcctcccaaagtgc

SEQ ID NO: 15153 - DNA, 20 bp, Artificial Sequence
  chemically synthesized
cctcggcctcccaaagtgct

SEQ ID NO: 15154 - DNA, 20 bp, Artificial Sequence
  chemically synthesized
ctcccaaagtgctgggatta

SEQ ID NO: 15155 - DNA, 20 bp, Artificial Sequence
  chemically synthesized
tcccaaagtgctgggattac

SEQ ID NO: 15156 - DNA, 20 bp, Artificial Sequence
  chemically synthesized
agtgctgggattacaggtgt

SEQ ID NO: 15157 - DNA, 20 bp, Artificial Sequence
  chemically synthesized
caggtgtgagccaccatgcc

SEQ ID NO: 15158 - DNA, 20 bp, Artificial Sequence
  chemically synthesized
ctaataaaactctttgctca

SEQ ID NO: 15159 - DNA, 20 bp, Artificial Sequence
  chemically synthesized
tgctcaaagcctatataact

SEQ ID NO: 15160 - DNA, 20 bp, Artificial Sequence
  chemically synthesized
accctttaacccatatgaaa

SEQ ID NO: 15161 - DNA, 20 bp, Artificial Sequence
  chemically synthesized
ccctttaacccatatgaaat

SEQ ID NO: 15162 - DNA, 20 bp, Artificial Sequence
  chemically synthesized
ttcctgtattttcaactcac

SEQ ID NO: 15163 - DNA, 20 bp, Artificial Sequence
  chemically synthesized
ctgtattttcaactcactgg

SEQ ID NO: 15164 - DNA, 20 bp, Artificial Sequence
  chemically synthesized
tgtattttcaactcactggt

SEQ ID NO: 15165 - DNA, 20 bp, Artificial Sequence
  chemically synthesized
ttctgtcttccccctttatg

SEQ ID NO: 15166 - DNA, 20 bp, Artificial Sequence
  chemically synthesized
ccctttatgtagatgatcca

SEQ ID NO: 15167 - DNA, 20 bp, Artificial Sequence
  chemically synthesized
ttatgtagatgatccaaagt

SEQ ID NO: 15168 - DNA, 20 bp, Artificial Sequence
  chemically synthesized
atgtagatgatccaaagtca

SEQ ID NO: 15169 - DNA, 20 bp, Artificial Sequence
  chemically synthesized
gtagatgatccaaagtcaga

SEQ ID NO: 15170 - DNA, 20 bp, Artificial Sequence
  chemically synthesized
agatgatccaaagtcagaga

SEQ ID NO: 15171 - DNA, 20 bp, Artificial Sequence
  chemically synthesized
gatgatccaaagtcagagag

SEQ ID NO: 15172 - DNA, 20 bp, Artificial Sequence
  chemically synthesized
atgatccaaagtcagagaga

SEQ ID NO: 15173 - DNA, 20 bp, Artificial Sequence
  chemically synthesized
tgatccaaagtcagagagag

SEQ ID NO: 15174 - DNA, 20 bp, Artificial Sequence
  chemically synthesized
ccaaagtcagagagaggggt

SEQ ID NO: 15175 - DNA, 20 bp, Artificial Sequence
  chemically synthesized
aagtcagagagaggggttgg

SEQ ID NO: 15176 - DNA, 20 bp, Artificial Sequence
  chemically synthesized
gagagaggggttggaagcat

SEQ ID NO: 15177 - DNA, 20 bp, Artificial Sequence
  chemically synthesized
agaggggttggaagcatgag

SEQ ID NO: 15178 - DNA, 20 bp, Artificial Sequence
  chemically synthesized
ttggaagcatgagtagcccg

SEQ ID NO: 15179 - DNA, 20 bp, Artificial Sequence
  chemically synthesized
gtagcccgtggcttcctgaa

SEQ ID NO: 15180 - DNA, 20 bp, Artificial Sequence
  chemically synthesized
ccgtggcttcctgaatagcc

SEQ ID NO: 15181 - DNA, 20 bp, Artificial Sequence
  chemically synthesized
cgtggcttcctgaatagcct

SEQ ID NO: 15182 - DNA, 20 bp, Artificial Sequence
  chemically synthesized
gtggcttcctgaatagcctg

SEQ ID NO: 15183 - DNA, 20 bp, Artificial Sequence
  chemically synthesized
cttcctgaatagcctgggga

SEQ ID NO: 15184 - DNA, 20 bp, Artificial Sequence
  chemically synthesized
ctggggaaagcaacttctga

SEQ ID NO: 15185 - DNA, 20 bp, Artificial Sequence
  chemically synthesized
ggaaagcaacttctgatgga

SEQ ID NO: 15186 - DNA, 20 bp, Artificial Sequence
  chemically synthesized
ttctgatggacagacattgc

SEQ ID NO: 15187 - DNA, 20 bp, Artificial Sequence
  chemically synthesized
ctgatggacagacattgcga

SEQ ID NO: 15188 - DNA, 20 bp, Artificial Sequence
  chemically synthesized
gacattgcgagagcgaatgc

SEQ ID NO: 15189 - DNA, 20 bp, Artificial Sequence
  chemically synthesized
ttgctgatctcctctctata

SEQ ID NO: 15190 - DNA, 20 bp, Artificial Sequence
  chemically synthesized
tatatggttcttaccactta

SEQ ID NO: 15191 - DNA, 20 bp, Artificial Sequence
  chemically synthesized
ggttcttaccacttaaagac

SEQ ID NO: 15192 - DNA, 20 bp, Artificial Sequence
  chemically synthesized
gttcttaccacttaaagacg

SEQ ID NO: 15193 - DNA, 20 bp, Artificial Sequence
  chemically synthesized
taccacttaaagacgaggtt

SEQ ID NO: 15194 - DNA, 20 bp, Artificial Sequence
  chemically synthesized
acttaaagacgaggttgagc

SEQ ID NO: 15195 - DNA, 20 bp, Artificial Sequence
  chemically synthesized
gttgagccagtctccaatca

SEQ ID NO: 15196 - DNA, 20 bp, Artificial Sequence
  chemically synthesized
tctccaatcacagctaccca

SEQ ID NO: 15197 - DNA, 20 bp, Artificial Sequence
  chemically synthesized
ctccaatcacagctacccaa

SEQ ID NO: 15198 - DNA, 20 bp, Artificial Sequence
  chemically synthesized
ccaatcacagctacccaaag

SEQ ID NO: 15199 - DNA, 20 bp, Artificial Sequence
  chemically synthesized
ccaaaggagtttaatgccca

SEQ ID NO: 15200 - DNA, 20 bp, Artificial Sequence
  chemically synthesized
ttaatgcccacagcttcctg

SEQ ID NO: 15201 - DNA, 20 bp, Artificial Sequence
  chemically synthesized
tgcccacagcttcctgaaga

SEQ ID NO: 15202 - DNA, 20 bp, Artificial Sequence
  chemically synthesized
cagcttcctgaagatggaac

SEQ ID NO: 15203 - DNA, 20 bp, Artificial Sequence
  chemically synthesized
ttcctgaagatggaaccaga

SEQ ID NO: 15204 - DNA, 20 bp, Artificial Sequence
  chemically synthesized
tcctgaagatggaaccagat

SEQ ID NO: 15205 - DNA, 20 bp, Artificial Sequence
  chemically synthesized
cctgaagatggaaccagatg

SEQ ID NO: 15206 - DNA, 20 bp, Artificial Sequence
  chemically synthesized
gaagatggaaccagatgggg

SEQ ID NO: 15207 - DNA, 20 bp, Artificial Sequence
  chemically synthesized
agatggaaccagatggggaa

SEQ ID NO: 15208 - DNA, 20 bp, Artificial Sequence
  chemically synthesized
gatggaaccagatggggaag

SEQ ID NO: 15209 - DNA, 20 bp, Artificial Sequence
  chemically synthesized
accagatggggaagaggacg

SEQ ID NO: 15210 - DNA, 20 bp, Artificial Sequence
  chemically synthesized
agatggggaagaggacgtag

SEQ ID NO: 15211 - DNA, 20 bp, Artificial Sequence
  chemically synthesized
gatggggaagaggacgtaga

SEQ ID NO: 15212 - DNA, 20 bp, Artificial Sequence
  chemically synthesized
aggacgtagaaggcattcct

SEQ ID NO: 15213 - DNA, 20 bp, Artificial Sequence
  chemically synthesized
ggacgtagaaggcattcctg

SEQ ID NO: 15214 - DNA, 20 bp, Artificial Sequence
  chemically synthesized
attcctgaggtctgcgatca

SEQ ID NO: 15215 - DNA, 20 bp, Artificial Sequence
  chemically synthesized
ggtctgcgatcacggacacc

SEQ ID NO: 15216 - DNA, 20 bp, Artificial Sequence
  chemically synthesized
tcacggacaccaagatgaac

SEQ ID NO: 15217 - DNA, 20 bp, Artificial Sequence
  chemically synthesized
acaccaagatgaaccagtcc

SEQ ID NO: 15218 - DNA, 20 bp, Artificial Sequence
  chemically synthesized
caccaagatgaaccagtcct

SEQ ID NO: 15219 - DNA, 20 bp, Artificial Sequence
  chemically synthesized
ccaagatgaaccagtcctgg

SEQ ID NO: 15220 - DNA, 20 bp, Artificial Sequence
  chemically synthesized
tgaaccagtcctgggagtct

SEQ ID NO: 15221 - DNA, 20 bp, Artificial Sequence
  chemically synthesized
gggagtcttggtaattcacc

SEQ ID NO: 15222 - DNA, 20 bp, Artificial Sequence
  chemically synthesized
gagtcttggtaattcacctg

SEQ ID NO: 15223 - DNA, 20 bp, Artificial Sequence
  chemically synthesized
agtcttggtaattcacctgg

SEQ ID NO: 15224 - DNA, 20 bp, Artificial Sequence
  chemically synthesized
cctggaggtaatgtgttgac

SEQ ID NO: 15225 - DNA, 20 bp, Artificial Sequence
  chemically synthesized
aatgtgttgactggatccca

SEQ ID NO: 15226 - DNA, 20 bp, Artificial Sequence
  chemically synthesized
ttgactggatcccaaagtca

SEQ ID NO: 15227 - DNA, 20 bp, Artificial Sequence
  chemically synthesized
gactggatcccaaagtcatg

SEQ ID NO: 15228 - DNA, 20 bp, Artificial Sequence
  chemically synthesized
ttcctccatcctcatttcct

SEQ ID NO: 15229 - DNA, 20 bp, Artificial Sequence
  chemically synthesized
tcctcatttccttggcacct

SEQ ID NO: 15230 - DNA, 20 bp, Artificial Sequence
  chemically synthesized
cctcatttccttggcacctc

SEQ ID NO: 15231 - DNA, 20 bp, Artificial Sequence
  chemically synthesized
catttccttggcacctcagg

SEQ ID NO: 15232 - DNA, 20 bp, Artificial Sequence
  chemically synthesized
ttggcacctcaggaagatgt

SEQ ID NO: 15233 - DNA, 20 bp, Artificial Sequence
  chemically synthesized
gcacctcaggaagatgtcag

SEQ ID NO: 15234 - DNA, 20 bp, Artificial Sequence
  chemically synthesized
acctcaggaagatgtcagca

SEQ ID NO: 15235 - DNA, 20 bp, Artificial Sequence
  chemically synthesized
agatgtcagcagagcccttg

SEQ ID NO: 15236 - DNA, 20 bp, Artificial Sequence
  chemically synthesized
cagagcccttgcagttattc

SEQ ID NO: 15237 - DNA, 20 bp, Artificial Sequence
  chemically synthesized
agagcccttgcagttattcc

SEQ ID NO: 15238 - DNA, 20 bp, Artificial Sequence
  chemically synthesized
ccttgcagttattccaggct

SEQ ID NO: 15239 - DNA, 20 bp, Artificial Sequence
  chemically synthesized
tgcagttattccaggcttgg

SEQ ID NO: 15240 - DNA, 20 bp, Artificial Sequence
  chemically synthesized
ggtggtgattgctctgctat

SEQ ID NO: 15241 - DNA, 20 bp, Artificial Sequence
  chemically synthesized
tgttttatatgccctgtatc

SEQ ID NO: 15242 - DNA, 20 bp, Artificial Sequence
  chemically synthesized
tatgccctgtatccagtatt

SEQ ID NO: 15243 - DNA, 20 bp, Artificial Sequence
  chemically synthesized
atgccctgtatccagtattc

SEQ ID NO: 15244 - DNA, 20 bp, Artificial Sequence
  chemically synthesized
atccagtattcaggtcaacc

SEQ ID NO: 15245 - DNA, 20 bp, Artificial Sequence
  chemically synthesized
gtcaacccagccctgatctt

SEQ ID NO: 15246 - DNA, 20 bp, Artificial Sequence
  chemically synthesized
attttagacaaacgtggttt

SEQ ID NO: 15247 - DNA, 20 bp, Artificial Sequence
  chemically synthesized
tttgagtccaaagatcaggg

SEQ ID NO: 15248 - DNA, 20 bp, Artificial Sequence
  chemically synthesized
aagatcagggctgggttgac

SEQ ID NO: 15249 - DNA, 20 bp, Artificial Sequence
  chemically synthesized
gggctgggttgacctgaata

SEQ ID NO: 15250 - DNA, 20 bp, Artificial Sequence
  chemically synthesized
agagcaatcaccaccaagcc

SEQ ID NO: 15251 - DNA, 20 bp, Artificial Sequence
  chemically synthesized
tcctgaggtgccaaggaaat

SEQ ID NO: 15252 - DNA, 20 bp, Artificial Sequence
  chemically synthesized
aaggaaatgaggatggagga

SEQ ID NO: 15253 - DNA, 20 bp, Artificial Sequence
  chemically synthesized
aaatgaggatggaggaagga

SEQ ID NO: 15254 - DNA, 20 bp, Artificial Sequence
  chemically synthesized
atgaatgttctccatgactt

SEQ ID NO: 15255 - DNA, 20 bp, Artificial Sequence
  chemically synthesized
agtcaacacattacctccag

SEQ ID NO: 15256 - DNA, 20 bp, Artificial Sequence
  chemically synthesized
tgtccgtgatcgcagacctc

SEQ ID NO: 15257 - DNA, 20 bp, Artificial Sequence
  chemically synthesized
gctgtgggcattaaactcct

SEQ ID NO: 15258 - DNA, 20 bp, Artificial Sequence
  chemically synthesized
tccaacccctctctctgact

SEQ ID NO: 15259 - DNA, 20 bp, Artificial Sequence
  chemically synthesized
agacagaaaaaatcctacca

SEQ ID NO: 15260 - DNA, 20 bp, Artificial Sequence
  chemically synthesized
tacaggaaagcctatttcat

SEQ ID NO: 15261 - DNA, 20 bp, Artificial Sequence
  chemically synthesized
agcctatttcatatgggtta

SEQ ID NO: 15262 - DNA, 20 bp, Artificial Sequence
  chemically synthesized
tgggttaaagggtaggacag

SEQ ID NO: 15263 - DNA, 20 bp, Artificial Sequence
  chemically synthesized
agttgaatttcgtgaaaagt

SEQ ID NO: 15264 - DNA, 20 bp, Artificial Sequence
  chemically synthesized
agttatataggctttgagca

SEQ ID NO: 15265 - DNA, 20 bp, Artificial Sequence
  chemically synthesized
actttgggaggccgaggtgg

SEQ ID NO: 15266 - DNA, 20 bp, Artificial Sequence
  chemically synthesized
ccgaggtgggcgaatcactc

SEQ ID NO: 15267 - DNA, 20 bp, Artificial Sequence
  chemically synthesized
aatcactcctgggtgaactc

SEQ ID NO: 15268 - DNA, 20 bp, Artificial Sequence
  chemically synthesized
gagaggcggaggaggttgca

SEQ ID NO: 15269 - DNA, 20 bp, Artificial Sequence
  chemically synthesized
ctgcactccagcctgggcaa

SEQ ID NO: 15270 - DNA, 20 bp, Artificial Sequence
  chemically synthesized
tgattcaacagcctgttttg

SEQ ID NO: 15271 - DNA, 20 bp, Artificial Sequence
  chemically synthesized
tggcaagtcatatcaattat

SEQ ID NO: 15272 - DNA, 20 bp, Artificial Sequence
  chemically synthesized
tctggcagcttaataataat

SEQ ID NO: 15273 - DNA, 20 bp, Artificial Sequence
  chemically synthesized
tagatgcagagaccaaggtg

SEQ ID NO: 15274 - DNA, 20 bp, Artificial Sequence
  chemically synthesized
aaggttagtacatgccgagc

SEQ ID NO: 15275 - DNA, 20 bp, Artificial Sequence
  chemically synthesized
ctggggagcaggggaaagcc

SEQ ID NO: 15276 - DNA, 20 bp, Artificial Sequence
  chemically synthesized
ttttgtttgtttgtttgaga

SEQ ID NO: 15277 - DNA, 20 bp, Artificial Sequence
  chemically synthesized
gtctcgcactgttgcctggc

SEQ ID NO: 15278 - DNA, 20 bp, Artificial Sequence
  chemically synthesized
gcctcagcctcccaagtagc

SEQ ID NO: 15279 - DNA, 20 bp, Artificial Sequence
  chemically synthesized
gccttggcctccctaagtgc

SEQ ID NO: 15280 - DNA, 20 bp, Artificial Sequence
  chemically synthesized
tgaagaaccatgcaatctct

SEQ ID NO: 15281 - DNA, 20 bp, Artificial Sequence
  chemically synthesized
ctctctgggttgatagaggc

SEQ ID NO: 15282 - DNA, 20 bp, Artificial Sequence
  chemically synthesized
aaatcactattccaccatca

SEQ ID NO: 15283 - DNA, 20 bp, Artificial Sequence
  chemically synthesized
atactctgtttcaaagtaga

SEQ ID NO: 15284 - DNA, 20 bp, Artificial Sequence
  chemically synthesized
ggggggctcgtcctaggggc

SEQ ID NO: 15285 - DNA, 20 bp, Artificial Sequence
  chemically synthesized
agtcacatagctgccatttt

SEQ ID NO: 15286 - DNA, 20 bp, Artificial Sequence
  chemically synthesized
agctgccattttatggattt

SEQ ID NO: 15287 - DNA, 20 bp, Artificial Sequence
  chemically synthesized
ttttttttttttttttgaga

SEQ ID NO: 15288 - DNA, 20 bp, Artificial Sequence
  chemically synthesized
gattctcttgccttagcctc

SEQ ID NO: 15289 - DNA, 20 bp, Artificial Sequence
  chemically synthesized
gccttagcctcccgagtagc

SEQ ID NO: 15290 - DNA, 20 bp, Artificial Sequence
  chemically synthesized
tgtgagccaccgcgcctgcc

SEQ ID NO: 15291 - DNA, 20 bp, Artificial Sequence
  chemically synthesized
caccgcgcctgcctggagtt

SEQ ID NO: 15292 - DNA, 20 bp, Artificial Sequence
  chemically synthesized
actttgggaggctgaggtgg

SEQ ID NO: 15293 - DNA, 20 bp, Artificial Sequence
  chemically synthesized
ggctgaggtgggaggattgc

SEQ ID NO: 15294 - DNA, 20 bp, Artificial Sequence
  chemically synthesized
actaaaaatacaaaaactag

SEQ ID NO: 15295 - DNA, 20 bp, Artificial Sequence
  chemically synthesized
tattcaggaggctgaggtgg

SEQ ID NO: 15296 - DNA, 20 bp, Artificial Sequence
  chemically synthesized
ttgcgccactgcactccagg

SEQ ID NO: 15297 - DNA, 20 bp, Artificial Sequence
  chemically synthesized
aaacttgttctgtttttcca

SEQ ID NO: 15298 - DNA, 20 bp, Artificial Sequence
  chemically synthesized
tttggacagcgtccatactg

SEQ ID NO: 15299 - DNA, 20 bp, Artificial Sequence
  chemically synthesized
agcgtccatactggtgggtt

SEQ ID NO: 15300 - DNA, 20 bp, Artificial Sequence
  chemically synthesized
ccagcccctgcagacagaag

SEQ ID NO: 15301 - DNA, 20 bp, Artificial Sequence
  chemically synthesized
gtggacctcgtttacctgtt

SEQ ID NO: 15302 - DNA, 20 bp, Artificial Sequence
  chemically synthesized
ttcacttctgcaatactttc

SEQ ID NO: 15303 - DNA, 20 bp, Artificial Sequence
  chemically synthesized
aaatctgcctattacagaac

SEQ ID NO: 15304 - DNA, 20 bp, Artificial Sequence
  chemically synthesized
tgcctattacagaacctgga

SEQ ID NO: 15305 - DNA, 20 bp, Artificial Sequence
  chemically synthesized
tccatgggcaaagggctcgt

SEQ ID NO: 15306 - DNA, 20 bp, Artificial Sequence
  chemically synthesized
ctctcacgagccctttgccc

SEQ ID NO: 15307 - DNA, 20 bp, Artificial Sequence
  chemically synthesized
ttcaggaaagtattgcagaa

SEQ ID NO: 15308 - DNA, 20 bp, Artificial Sequence
  chemically synthesized
agagcatgacaaaagtacaa

SEQ ID NO: 15309 - DNA, 20 bp, Artificial Sequence
  chemically synthesized
cagtatggacgctgtccaaa

SEQ ID NO: 15310 - DNA, 20 bp, Artificial Sequence
  chemically synthesized
ggaaaaacagaacaagtttc

SEQ ID NO: 15311 - DNA, 20 bp, Artificial Sequence
  chemically synthesized
agaacaagtttctggggtta

SEQ ID NO: 15312 - DNA, 20 bp, Artificial Sequence
  chemically synthesized
caagtttctggggttactga

SEQ ID NO: 15313 - DNA, 20 bp, Artificial Sequence
  chemically synthesized
ccaaagcctacaccttcaag

SEQ ID NO: 15314 - DNA, 20 bp, Artificial Sequence
  chemically synthesized
caagaagagtgtagcctgag

SEQ ID NO: 15315 - DNA, 20 bp, Artificial Sequence
  chemically synthesized
gttgcctctagaagggagaa

SEQ ID NO: 15316 - DNA, 20 bp, Artificial Sequence
  chemically synthesized
acttttgcattttgaactgt

SEQ ID NO: 15317 - DNA, 20 bp, Artificial Sequence
  chemically synthesized
tatcttttttttttttgaga

SEQ ID NO: 15318 - DNA, 20 bp, Artificial Sequence
  chemically synthesized
tctggctcagtaacccagcc

SEQ ID NO: 15319 - DNA, 20 bp, Artificial Sequence
  chemically synthesized
tcattgtgacctctacctcc

SEQ ID NO: 15320 - DNA, 20 bp, Artificial Sequence
  chemically synthesized
gatcctcccacctcagcctc

SEQ ID NO: 15321 - DNA, 20 bp, Artificial Sequence
  chemically synthesized
ttttgtatttttagtagaga

SEQ ID NO: 15322 - DNA, 20 bp, Artificial Sequence
  chemically synthesized
acctcagcctcccaaagtgc

SEQ ID NO: 15323 - DNA, 20 bp, Artificial Sequence
  chemically synthesized
caggcagatcacatgaggtc

SEQ ID NO: 15324 - DNA, 20 bp, Artificial Sequence
  chemically synthesized
cgtttctaccaaaaaatata

SEQ ID NO: 15325 - DNA, 20 bp, Artificial Sequence
  chemically synthesized
tactcgggaggctaaggcaa

SEQ ID NO: 15326 - DNA, 20 bp, Artificial Sequence
  chemically synthesized
ttatgccactgcactacagg

SEQ ID NO: 15327 - DNA, 20 bp, Artificial Sequence
  chemically synthesized
tcaagaagtatttgtcctgg

SEQ ID NO: 15328 - DNA, 20 bp, Artificial Sequence
  chemically synthesized
aacttggacttgcatatacc

SEQ ID NO: 15329 - DNA, 20 bp, Artificial Sequence
  chemically synthesized
atgggttccctcaggcctca

SEQ ID NO: 15330 - DNA, 20 bp, Artificial Sequence
  chemically synthesized
ttgcatttcctctgacatca

SEQ ID NO: 15331 - DNA, 20 bp, Artificial Sequence
  chemically synthesized
aacatggcctgcatttccat

SEQ ID NO: 15332 - DNA, 20 bp, Artificial Sequence
  chemically synthesized
ccatcagaattgctctctgt

SEQ ID NO: 15333 - DNA, 20 bp, Artificial Sequence
  chemically synthesized
gtatcctctctactttgaaa

SEQ ID NO: 15334 - DNA, 20 bp, Artificial Sequence
  chemically synthesized
aataggtgtcaaccgccagt

SEQ ID NO: 15335 - DNA, 20 bp, Artificial Sequence
  chemically synthesized
tgccttttatcccgtgatgg

SEQ ID NO: 15336 - DNA, 20 bp, Artificial Sequence
  chemically synthesized
ttcaatggagatcagatgtt

SEQ ID NO: 15337 - DNA, 20 bp, Artificial Sequence
  chemically synthesized
cacttcatctttttattttt

SEQ ID NO: 15338 - DNA, 20 bp, Artificial Sequence
  chemically synthesized
tattttttagaatcatgcgg

SEQ ID NO: 15339 - DNA, 20 bp, Artificial Sequence
  chemically synthesized
ggcaggcagatcatgaggtc

SEQ ID NO: 15340 - DNA, 20 bp, Artificial Sequence
  chemically synthesized
tacttgggaggctgaggcag

SEQ ID NO: 15341 - DNA, 20 bp, Artificial Sequence
  chemically synthesized
aaagaaagaaagaaagtggc

SEQ ID NO: 15342 - DNA, 20 bp, Artificial Sequence
  chemically synthesized
agaaagaaagtggccagaat

SEQ ID NO: 15343 - DNA, 20 bp, Artificial Sequence
  chemically synthesized
gggctttcccctgctcccca

SEQ ID NO: 15344 - DNA, 20 bp, Artificial Sequence
  chemically synthesized
ttgccaaggacatgtagttg

SEQ ID NO: 15345 - DNA, 20 bp, Artificial Sequence
  chemically synthesized
gagggctggagcccagttcc

SEQ ID NO: 15346 - DNA, 20 bp, Artificial Sequence
  chemically synthesized
ttaccccacaaaacaggctg

SEQ ID NO: 15347 - DNA, 20 bp, Artificial Sequence
  chemically synthesized
tcttttttttttttttgaga

SEQ ID NO: 15348 - DNA, 20 bp, Artificial Sequence
  chemically synthesized
tcttactctgttgcccaggc

SEQ ID NO: 15349 - DNA, 20 bp, Artificial Sequence
  chemically synthesized
ccgcctctcacctcagcctc

SEQ ID NO: 15350 - DNA, 20 bp, Artificial Sequence
  chemically synthesized
tcgtaatgtttttgtagaga

SEQ ID NO: 15351 - DNA, 20 bp, Artificial Sequence
  chemically synthesized
cccaggctggtcttgaactc

SEQ ID NO: 15352 - DNA, 20 bp, Artificial Sequence
  chemically synthesized
ttgaactcctgagttcaccc

SEQ ID NO: 15353 - DNA, 20 bp, Artificial Sequence
  chemically synthesized
acctcggcctcccaaagtgc

SEQ ID NO: 15354 - DNA, 20 bp, Artificial Sequence
  chemically synthesized
ctgtattttcaactcactgg

SEQ ID NO: 15355 - DNA, 20 bp, Artificial Sequence
  chemically synthesized
gatgatccaaagtcagagag

SEQ ID NO: 15356 - DNA, 20 bp, Artificial Sequence
  chemically synthesized
cagagagaggggttggaagc

SEQ ID NO: 15357 - DNA, 20 bp, Artificial Sequence
  chemically synthesized
catgagtagcccgtggcttc

SEQ ID NO: 15358 - DNA, 20 bp, Artificial Sequence
  chemically synthesized
gatggacagacattgcgaga

SEQ ID NO: 15359 - DNA, 20 bp, Artificial Sequence
  chemically synthesized
ctccaatcacagctacccaa

SEQ ID NO: 15360 - DNA, 20 bp, Artificial Sequence
  chemically synthesized
caccaagatgaaccagtcct

SEQ ID NO: 15361 - DNA, 20 bp, Artificial Sequence
  chemically synthesized
acctggaggtaatgtgttga

SEQ ID NO: 15362 - DNA, 20 bp, Artificial Sequence
  chemically synthesized
ttggtggtgattgctctgct

SEQ ID NO: 15363 - DNA, 20 bp, Artificial Sequence
  chemically synthesized
ccatatagagaggagatcag

SEQ ID NO: 15364 - DNA, 20 bp, Artificial Sequence
  chemically synthesized
catctacataaagggggaag

SEQ ID NO: 15365 - DNA, 20 bp, Artificial Sequence
  chemically synthesized
tgaagcagaagaggtaacat

SEQ ID NO: 15366 - DNA, 20 bp, Artificial Sequence
  chemically synthesized
tgaggtagttactgctattt

SEQ ID NO: 15367 - DNA, 20 bp, Artificial Sequence
  chemically synthesized
gtggctctccctgatttcgg

SEQ ID NO: 15368 - DNA, 20 bp, Artificial Sequence
  chemically synthesized
ctaattctttatattttttg

SEQ ID NO: 15369 - DNA, 20 bp, Artificial Sequence
  chemically synthesized
ccaccgcgcctgcctggagt

SEQ ID NO: 15370 - DNA, 20 bp, Artificial Sequence
  chemically synthesized
aaagcattcattcagtaacc

SEQ ID NO: 15371 - DNA, 20 bp, Artificial Sequence
  chemically synthesized
ccagtatggacgctgtccaa

SEQ ID NO: 15372 - DNA, 20 bp, Artificial Sequence
  chemically synthesized
ccgtttctaccaaaaaatat

SEQ ID NO: 15373 - DNA, 20 bp, Artificial Sequence
  chemically synthesized
ctactcgggaggctaaggca

SEQ ID NO: 15374 - DNA, 20 bp, Artificial Sequence
  chemically synthesized
ctcaagaagtatttgtcctg

SEQ ID NO: 15375 - DNA, 20 bp, Artificial Sequence
  chemically synthesized
cttgcatttcctctgacatc

SEQ ID NO: 15376 - DNA, 20 bp, Artificial Sequence
  chemically synthesized
aaacatggcctgcatttcca

SEQ ID NO: 15377 - DNA, 20 bp, Artificial Sequence
  chemically synthesized
acacttcatctttttatttt

SEQ ID NO: 15378 - DNA, 20 bp, Artificial Sequence
  chemically synthesized
ctacttgggaggctgaggca

SEQ ID NO: 15379 - DNA, 20 bp, Artificial Sequence
  chemically synthesized
ccatctcaaacaaacaaaca

SEQ ID NO: 15380 - DNA, 20 bp, Artificial Sequence
  chemically synthesized
ctcaaacaaacaaacaaaag

SEQ ID NO: 15381 - DNA, 20 bp, Artificial Sequence
  chemically synthesized
aacaaacaaacaaaagaaag

SEQ ID NO: 15382 - DNA, 20 bp, Artificial Sequence
  chemically synthesized
aacaaacaaaagaaagaaag

SEQ ID NO: 15383 - DNA, 20 bp, Artificial Sequence
  chemically synthesized
gaaagaaagaaagaaagtgg

SEQ ID NO: 15384 - DNA, 20 bp, Artificial Sequence
  chemically synthesized
agaatgggaatgtttacgtg

SEQ ID NO: 15385 - DNA, 20 bp, Artificial Sequence
  chemically synthesized
taaatagcagtaactacctc

SEQ ID NO: 15386 - DNA, 20 bp, Artificial Sequence
  chemically synthesized
acctatttgtagattataaa

SEQ ID NO: 15387 - DNA, 20 bp, Artificial Sequence
  chemically synthesized
aatactggatacagggcata

SEQ ID NO: 15388 - DNA, 20 bp, Artificial Sequence
  chemically synthesized
tggcgaaactccatctctac

SEQ ID NO: 15389 - DNA, 20 bp, Artificial Sequence
  chemically synthesized
cccgtctctactaaaaatac

SEQ ID NO: 15390 - DNA, 20 bp, Artificial Sequence
  chemically synthesized
ttgctgtagtagtcagtatc

SEQ ID NO: 15391 - DNA, 20 bp, Artificial Sequence
  chemically synthesized
gtccaaagagaatcctatgg

SEQ ID NO: 15392 - DNA, 20 bp, Artificial Sequence
  chemically synthesized
gataacctatttgtagatta

SEQ ID NO: 15393 - DNA, 20 bp, Artificial Sequence
  chemically synthesized
ggtgacttttcattacccca

SEQ ID NO: 15394 - DNA, 20 bp, Artificial Sequence
  chemically synthesized
cctcttctgcttcatactaa

SEQ ID NO: 15395 - DNA, 20 bp, Artificial Sequence
  chemically synthesized
cagccctgatctttggactc

SEQ ID NO: 15396 - DNA, 20 bp, Artificial Sequence
  chemically synthesized
cattaaactcctttgggtag

SEQ ID NO: 15397 - DNA, 20 bp, Artificial Sequence
  chemically synthesized
cgcaatgtctgtccatcaga

SEQ ID NO: 15398 - DNA, 20 bp, Artificial Sequence
  chemically synthesized
ttcaggaagccacgggctac

SEQ ID NO: 15399 - DNA, 20 bp, Artificial Sequence
  chemically synthesized
tcgtgaaaagtctgagttat

SEQ ID NO: 15400 - DNA, 20 bp, Artificial Sequence
  chemically synthesized
agttatataggctttgagca

SEQ ID NO: 15401 - DNA, 20 bp, Artificial Sequence
  chemically synthesized
tatgaaaaaaggaaacacac

SEQ ID NO: 15402 - DNA, 20 bp, Artificial Sequence
  chemically synthesized
aacacacagatgattcaaca

SEQ ID NO: 15403 - DNA, 20 bp, Artificial Sequence
  chemically synthesized
tggcaagtcatatcaattat

SEQ ID NO: 15404 - DNA, 20 bp, Artificial Sequence
  chemically synthesized
gtcatatcaattatctgagt

SEQ ID NO: 15405 - DNA, 20 bp, Artificial Sequence
  chemically synthesized
tctacaaataggttatctct

SEQ ID NO: 15406 - DNA, 20 bp, Artificial Sequence
  chemically synthesized
tgtgtgccagtccatgtgct

SEQ ID NO: 15407 - DNA, 20 bp, Artificial Sequence
  chemically synthesized
agagaccaaggtgctgagtt

SEQ ID NO: 15408 - DNA, 20 bp, Artificial Sequence
  chemically synthesized
atggaagcccaggtaggcag

SEQ ID NO: 15409 - DNA, 20 bp, Artificial Sequence
  chemically synthesized
ctggggagcaggggaaagcc

SEQ ID NO: 15410 - DNA, 20 bp, Artificial Sequence
  chemically synthesized
ccactttctttctttctttc

SEQ ID NO: 15411 - DNA, 20 bp, Artificial Sequence
  chemically synthesized
tttctttctttctttctttt

SEQ ID NO: 15412 - DNA, 20 bp, Artificial Sequence
  chemically synthesized
tttctttctttcttttgttt

SEQ ID NO: 15413 - DNA, 20 bp, Artificial Sequence
  chemically synthesized
aacctctgcctctccggttc

SEQ ID NO: 15414 - DNA, 20 bp, Artificial Sequence
  chemically synthesized
tgcctcagcctcccaagtag

SEQ ID NO: 15415 - DNA, 20 bp, Artificial Sequence
  chemically synthesized
ttttgtatttttagtagaga

SEQ ID NO: 15416 - DNA, 20 bp, Artificial Sequence
  chemically synthesized
tgccttggcctccctaagtg

SEQ ID NO: 15417 - DNA, 20 bp, Artificial Sequence
  chemically synthesized
gtgagccactacacccagcc

SEQ ID NO: 15418 - DNA, 20 bp, Artificial Sequence
  chemically synthesized
aggccagagttagtggctct

SEQ ID NO: 15419 - DNA, 20 bp, Artificial Sequence
  chemically synthesized
tctagtacttttaaagggga

SEQ ID NO: 15420 - DNA, 20 bp, Artificial Sequence
  chemically synthesized
gaagtggtttgtctgagata

SEQ ID NO: 15421 - DNA, 20 bp, Artificial Sequence
  chemically synthesized
aattctgatggaaatgcagg

SEQ ID NO: 15422 - DNA, 20 bp, Artificial Sequence
  chemically synthesized
tctctgatgtcagaggaaat

SEQ ID NO: 15423 - DNA, 20 bp, Artificial Sequence
  chemically synthesized
aacccatggtatatgcaagt

SEQ ID NO: 15424 - DNA, 20 bp, Artificial Sequence
  chemically synthesized
aagtcacatagctgccattt

SEQ ID NO: 15425 - DNA, 20 bp, Artificial Sequence
  chemically synthesized
tagctgccattttatggatt

SEQ ID NO: 15426 - DNA, 20 bp, Artificial Sequence
  chemically synthesized
aacctccgcctcccaggttc

SEQ ID NO: 15427 - DNA, 20 bp, Artificial Sequence
  chemically synthesized
tgccttagcctcccgagtag

SEQ ID NO: 15428 - DNA, 20 bp, Artificial Sequence
  chemically synthesized
tttatattttttggtagaaa

SEQ ID NO: 15429 - DNA, 20 bp, Artificial Sequence
  chemically synthesized
tgccttggcctcccaaagtg

SEQ ID NO: 15430 - DNA, 20 bp, Artificial Sequence
  chemically synthesized
cctgcctggagttcagaatc

SEQ ID NO: 15431 - DNA, 20 bp, Artificial Sequence
  chemically synthesized
agaatcttgggcttcattat

SEQ ID NO: 15432 - DNA, 20 bp, Artificial Sequence
  chemically synthesized
cactttgggaggctgaggtg

SEQ ID NO: 15433 - DNA, 20 bp, Artificial Sequence
  chemically synthesized
gaggtagaggtcacaatgag

SEQ ID NO: 15434 - DNA, 20 bp, Artificial Sequence
  chemically synthesized
gctacactcttcttgaaggt

SEQ ID NO: 15435 - DNA, 20 bp, Artificial Sequence
  chemically synthesized
tcagtaaccccagaaacttg

SEQ ID NO: 15436 - DNA, 20 bp, Artificial Sequence
  chemically synthesized
gaaacttgttctgtttttcc

SEQ ID NO: 15437 - DNA, 20 bp, Artificial Sequence
  chemically synthesized
tttggacagcgtccatactg

SEQ ID NO: 15438 - DNA, 20 bp, Artificial Sequence
  chemically synthesized
gcagacagaagctgagtgga

SEQ ID NO: 15439 - DNA, 20 bp, Artificial Sequence
  chemically synthesized
tccatccaggttctgtaata

SEQ ID NO: 15440 - DNA, 20 bp, Artificial Sequence
  chemically synthesized
tctcctcatgtcccctcaag

SEQ ID NO: 15441 - DNA, 20 bp, Artificial Sequence
  chemically synthesized
taacaggtaaacgaggtcca

SEQ ID NO: 15442 - DNA, 20 bp, Artificial Sequence
  chemically synthesized
gcttctgtctgcaggggctg

SEQ ID NO: 15443 - DNA, 20 bp, Artificial Sequence
  chemically synthesized
cagtctcacaggttacaggg

SEQ ID NO: 15444 - DNA, 20 bp, Artificial Sequence
  chemically synthesized
gaatcctatggaaaaacaga

SEQ ID NO: 15445 - DNA, 20 bp, Artificial Sequence
  chemically synthesized
agtttctggggttactgaat

SEQ ID NO: 15446 - DNA, 20 bp, Artificial Sequence
  chemically synthesized
tcaagaagagtgtagcctga

SEQ ID NO: 15447 - DNA, 20 bp, Artificial Sequence
  chemically synthesized
tatgtaacttttgcattttg

SEQ ID NO: 15448 - DNA, 20 bp, Artificial Sequence
  chemically synthesized
ggtgtgtgccaccacatcca

SEQ ID NO: 15449 - DNA, 20 bp, Artificial Sequence
  chemically synthesized
ttttgtatttttagtagaga

SEQ ID NO: 15450 - DNA, 20 bp, Artificial Sequence
  chemically synthesized
cacctcagcctcccaaagtg

SEQ ID NO: 15451 - DNA, 20 bp, Artificial Sequence
  chemically synthesized
ttaaacacaaataatgaagc

SEQ ID NO: 15452 - DNA, 20 bp, Artificial Sequence
  chemically synthesized
caggcagatcacatgaggtc

SEQ ID NO: 15453 - DNA, 20 bp, Artificial Sequence
  chemically synthesized
gcctggccaacatggtgaaa

SEQ ID NO: 15454 - DNA, 20 bp, Artificial Sequence
  chemically synthesized
tcgggaggctaaggcaagag

SEQ ID NO: 15455 - DNA, 20 bp, Artificial Sequence
  chemically synthesized
gaggcggaggttgccgtgag

SEQ ID NO: 15456 - DNA, 20 bp, Artificial Sequence
  chemically synthesized
tggaagaatgcatatggaac

SEQ ID NO: 15457 - DNA, 20 bp, Artificial Sequence
  chemically synthesized
ttgctctctgtaaggatgta

SEQ ID NO: 15458 - DNA, 20 bp, Artificial Sequence
  chemically synthesized
gtaaggatgtatatagcttc

SEQ ID NO: 15459 - DNA, 20 bp, Artificial Sequence
  chemically synthesized
tttatcccgtgatggtggaa

SEQ ID NO: 15460 - DNA, 20 bp, Artificial Sequence
  chemically synthesized
ctctggcctctatcaaccca

SEQ ID NO: 15461 - DNA, 20 bp, Artificial Sequence
  chemically synthesized
atggttcttcaatggagatc

SEQ ID NO: 15462 - DNA, 20 bp, Artificial Sequence
  chemically synthesized
gaggcagaggttgcagtgag

SEQ ID NO: 15463 - DNA, 20 bp, Artificial Sequence
  chemically synthesized
aaagaaagtggccagaatgg

SEQ ID NO: 15464 - DNA, 20 bp, Artificial Sequence
  chemically synthesized
aaattggcaaatgctaaact

SEQ ID NO: 15465 - DNA, 20 bp, Artificial Sequence
  chemically synthesized
tttcccctgctccccagaga

SEQ ID NO: 15466 - DNA, 20 bp, Artificial Sequence
  chemically synthesized
gcggaagccagcctgcctac

SEQ ID NO: 15467 - DNA, 20 bp, Artificial Sequence
  chemically synthesized
agcaccttggtctctgcatc

SEQ ID NO: 15468 - DNA, 20 bp, Artificial Sequence
  chemically synthesized
atagcacatggactggcaca

SEQ ID NO: 15469 - DNA, 20 bp, Artificial Sequence
  chemically synthesized
cactgtttaataaatgttaa

SEQ ID NO: 15470 - DNA, 20 bp, Artificial Sequence
  chemically synthesized
gctgccagagataacctatt

SEQ ID NO: 15471 - DNA, 20 bp, Artificial Sequence
  chemically synthesized
aacaggctgttgaatcatct

SEQ ID NO: 15472 - DNA, 20 bp, Artificial Sequence
  chemically synthesized
acacgcccagctaattttcg

SEQ ID NO: 15473 - DNA, 20 bp, Artificial Sequence
  chemically synthesized
tcgtaatgtttttgtagaga

SEQ ID NO: 15474 - DNA, 20 bp, Artificial Sequence
  chemically synthesized
gaactcctgagttcacccag

SEQ ID NO: 15475 - DNA, 20 bp, Artificial Sequence
  chemically synthesized
cacctcggcctcccaaagtg

SEQ ID NO: 15476 - DNA, 20 bp, Artificial Sequence
  chemically synthesized
atctttctttatgttacctc

SEQ ID NO: 15477 - DNA, 20 bp, Artificial Sequence
  chemically synthesized
taccctttaacccatatgaa

SEQ ID NO: 15478 - DNA, 20 bp, Artificial Sequence
  chemically synthesized
cctgtattttcaactcactg

SEQ ID NO: 15479 - DNA, 20 bp, Artificial Sequence
  chemically synthesized
ggttggaagcatgagtagcc

SEQ ID NO: 15480 - DNA, 20 bp, Artificial Sequence
  chemically synthesized
ctccaatcacagctacccaa

SEQ ID NO: 15481 - DNA, 20 bp, Artificial Sequence
  chemically synthesized
acccaaaggagtttaatgcc

SEQ ID NO: 15482 - DNA, 20 bp, Artificial Sequence
  chemically synthesized
gcagagcccttgcagttatt

SEQ ID NO: 15483 - DNA, 20 bp, Artificial Sequence
  chemically synthesized
tgcagttattccaggcttgg

SEQ ID NO: 15484 - DNA, 20 bp, Artificial Sequence
  chemically synthesized
gctatgagtctgtgccttgc

SEQ ID NO: 15485 - DNA, 20 bp, Artificial Sequence
  chemically synthesized
ctgatctttggactcaaaaa

SEQ ID NO: 15486 - DNA, 22 bp, Artificial Sequence
  chemically synthesized
tagacaaacgtggtttttgagt

SEQ ID NO: 15487 - DNA, 22 bp, Artificial Sequence
  chemically synthesized
agacaaacgtggtttttgagtc

SEQ ID NO: 15488 - DNA, 22 bp, Artificial Sequence
  chemically synthesized
gacaaacgtggtttttgagtcc

SEQ ID NO: 15489 - DNA, 22 bp, Artificial Sequence
  chemically synthesized
ttgagtccaaagatcagggctg

SEQ ID NO: 15490 - DNA, 22 bp, Artificial Sequence
  chemically synthesized
tgagtccaaagatcagggctgg

SEQ ID NO: 15491 - DNA, 22 bp, Artificial Sequence
  chemically synthesized
gagtccaaagatcagggctggg

SEQ ID NO: 15492 - DNA, 22 bp, Artificial Sequence
  chemically synthesized
agtccaaagatcagggctgggt

SEQ ID NO: 15493 - DNA, 22 bp, Artificial Sequence
  chemically synthesized
ggttgacctgaatactggatac

SEQ ID NO: 15494 - DNA, 22 bp, Artificial Sequence
  chemically synthesized
acctgaatactggatacagggc

SEQ ID NO: 15495 - DNA, 22 bp, Artificial Sequence
  chemically synthesized
aatactggatacagggcatata

SEQ ID NO: 15496 - DNA, 22 bp, Artificial Sequence
  chemically synthesized
gatacagggcatataaaacagg

SEQ ID NO: 15497 - DNA, 22 bp, Artificial Sequence
  chemically synthesized
atagcagagcaatcaccaccaa

SEQ ID NO: 15498 - DNA, 22 bp, Artificial Sequence
  chemically synthesized
gaataactgcaagggctctgct

SEQ ID NO: 15499 - DNA, 22 bp, Artificial Sequence
  chemically synthesized
caagggctctgctgacatcttc

SEQ ID NO: 15500 - DNA, 22 bp, Artificial Sequence
  chemically synthesized
tgctgacatcttcctgaggtgc

SEQ ID NO: 15501 - DNA, 22 bp, Artificial Sequence
  chemically synthesized
ctgacatcttcctgaggtgcca

SEQ ID NO: 15502 - DNA, 22 bp, Artificial Sequence
  chemically synthesized
acatcttcctgaggtgccaagg

SEQ ID NO: 15503 - DNA, 22 bp, Artificial Sequence
  chemically synthesized
cctgaggtgccaaggaaatgag

SEQ ID NO: 15504 - DNA, 22 bp, Artificial Sequence
  chemically synthesized
ctgaggtgccaaggaaatgagg

SEQ ID NO: 15505 - DNA, 22 bp, Artificial Sequence
  chemically synthesized
aggtgccaaggaaatgaggatg

SEQ ID NO: 15506 - DNA, 22 bp, Artificial Sequence
  chemically synthesized
tccatgactttgggatccagtc

SEQ ID NO: 15507 - DNA, 22 bp, Artificial Sequence
  chemically synthesized
catgactttgggatccagtcaa

SEQ ID NO: 15508 - DNA, 22 bp, Artificial Sequence
  chemically synthesized
tgggatccagtcaacacattac

SEQ ID NO: 15509 - DNA, 22 bp, Artificial Sequence
  chemically synthesized
gggatccagtcaacacattacc

SEQ ID NO: 15510 - DNA, 22 bp, Artificial Sequence
  chemically synthesized
ggatccagtcaacacattacct

SEQ ID NO: 15511 - DNA, 22 bp, Artificial Sequence
  chemically synthesized
cctccaggtgaattaccaagac

SEQ ID NO: 15512 - DNA, 22 bp, Artificial Sequence
  chemically synthesized
caggtgaattaccaagactccc

SEQ ID NO: 15513 - DNA, 22 bp, Artificial Sequence
  chemically synthesized
ccaagactcccaggactggttc

SEQ ID NO: 15514 - DNA, 22 bp, Artificial Sequence
  chemically synthesized
ccaggactggttcatcttggtg

SEQ ID NO: 15515 - DNA, 22 bp, Artificial Sequence
  chemically synthesized
gttcatcttggtgtccgtgatc

SEQ ID NO: 15516 - DNA, 22 bp, Artificial Sequence
  chemically synthesized
atcttggtgtccgtgatcgcag

SEQ ID NO: 15517 - DNA, 22 bp, Artificial Sequence
  chemically synthesized
ggtgtccgtgatcgcagacctc

SEQ ID NO: 15518 - DNA, 22 bp, Artificial Sequence
  chemically synthesized
gtgtccgtgatcgcagacctca

SEQ ID NO: 15519 - DNA, 22 bp, Artificial Sequence
  chemically synthesized
aggaatgccttctacgtcctct

SEQ ID NO: 15520 - DNA, 22 bp, Artificial Sequence
  chemically synthesized
ctacgtcctcttccccatctgg

SEQ ID NO: 15521 - DNA, 22 bp, Artificial Sequence
  chemically synthesized
tacgtcctcttccccatctggt

SEQ ID NO: 15522 - DNA, 22 bp, Artificial Sequence
  chemically synthesized
cgtcctcttccccatctggttc

SEQ ID NO: 15523 - DNA, 22 bp, Artificial Sequence
  chemically synthesized
ttccccatctggttccatcttc

SEQ ID NO: 15524 - DNA, 22 bp, Artificial Sequence
  chemically synthesized
ccccatctggttccatcttcag

SEQ ID NO: 15525 - DNA, 22 bp, Artificial Sequence
  chemically synthesized
cccatctggttccatcttcagg

SEQ ID NO: 15526 - DNA, 22 bp, Artificial Sequence
  chemically synthesized
gttccatcttcaggaagctgtg

SEQ ID NO: 15527 - DNA, 22 bp, Artificial Sequence
  chemically synthesized
catcttcaggaagctgtgggca

SEQ ID NO: 15528 - DNA, 22 bp, Artificial Sequence
  chemically synthesized
caggaagctgtgggcattaaac

SEQ ID NO: 15529 - DNA, 22 bp, Artificial Sequence
  chemically synthesized
aggaagctgtgggcattaaact

SEQ ID NO: 15530 - DNA, 22 bp, Artificial Sequence
  chemically synthesized
tgggcattaaactcctttgggt

SEQ ID NO: 15531 - DNA, 22 bp, Artificial Sequence
  chemically synthesized
aactcctttgggtagctgtgat

SEQ ID NO: 15532 - DNA, 22 bp, Artificial Sequence
  chemically synthesized
ctttgggtagctgtgattggag

SEQ ID NO: 15533 - DNA, 22 bp, Artificial Sequence
  chemically synthesized
tgggtagctgtgattggagact

SEQ ID NO: 15534 - DNA, 22 bp, Artificial Sequence
  chemically synthesized
gggtagctgtgattggagactg

SEQ ID NO: 15535 - DNA, 22 bp, Artificial Sequence
  chemically synthesized
ggtagctgtgattggagactgg

SEQ ID NO: 15536 - DNA, 22 bp, Artificial Sequence
  chemically synthesized
tgattggagactggctcaacct

SEQ ID NO: 15537 - DNA, 22 bp, Artificial Sequence
  chemically synthesized
gagactggctcaacctcgtctt

SEQ ID NO: 15538 - DNA, 22 bp, Artificial Sequence
  chemically synthesized
gctcaacctcgtctttaagtgg

SEQ ID NO: 15539 - DNA, 22 bp, Artificial Sequence
  chemically synthesized
aacctcgtctttaagtggtaag

SEQ ID NO: 15540 - DNA, 22 bp, Artificial Sequence
  chemically synthesized
gtctttaagtggtaagaaccat

SEQ ID NO: 15541 - DNA, 22 bp, Artificial Sequence
  chemically synthesized
taagtggtaagaaccatataga

SEQ ID NO: 15542 - DNA, 22 bp, Artificial Sequence
  chemically synthesized
aagtggtaagaaccatatagag

SEQ ID NO: 15543 - DNA, 22 bp, Artificial Sequence
  chemically synthesized
agtggtaagaaccatatagaga

SEQ ID NO: 15544 - DNA, 22 bp, Artificial Sequence
  chemically synthesized
gcattcgctctcgcaatgtctg

SEQ ID NO: 15545 - DNA, 22 bp, Artificial Sequence
  chemically synthesized
gctctcgcaatgtctgtccatc

SEQ ID NO: 15546 - DNA, 22 bp, Artificial Sequence
  chemically synthesized
tcgcaatgtctgtccatcagaa

SEQ ID NO: 15547 - DNA, 22 bp, Artificial Sequence
  chemically synthesized
gcaatgtctgtccatcagaagt

SEQ ID NO: 15548 - DNA, 22 bp, Artificial Sequence
  chemically synthesized
tccatcagaagttgctttcccc

SEQ ID NO: 15549 - DNA, 22 bp, Artificial Sequence
  chemically synthesized
ctttccccaggctattcaggaa

SEQ ID NO: 15550 - DNA, 22 bp, Artificial Sequence
  chemically synthesized
tccccaggctattcaggaagcc

SEQ ID NO: 15551 - DNA, 22 bp, Artificial Sequence
  chemically synthesized
ccccaggctattcaggaagcca

SEQ ID NO: 15552 - DNA, 22 bp, Artificial Sequence
  chemically synthesized
cccaggctattcaggaagccac

SEQ ID NO: 15553 - DNA, 22 bp, Artificial Sequence
  chemically synthesized
ttcaggaagccacgggctactc

SEQ ID NO: 15554 - DNA, 22 bp, Artificial Sequence
  chemically synthesized
aggaagccacgggctactcatg

SEQ ID NO: 15555 - DNA, 22 bp, Artificial Sequence
  chemically synthesized
ctcatgcttccaacccctctct

SEQ ID NO: 15556 - DNA, 22 bp, Artificial Sequence
  chemically synthesized
atgcttccaacccctctctctg

SEQ ID NO: 15557 - DNA, 22 bp, Artificial Sequence
  chemically synthesized
ccaacccctctctctgactttg

SEQ ID NO: 15558 - DNA, 22 bp, Artificial Sequence
  chemically synthesized
caacccctctctctgactttgg

SEQ ID NO: 15559 - DNA, 22 bp, Artificial Sequence
  chemically synthesized
tctctgactttggatcatctac

SEQ ID NO: 15560 - DNA, 22 bp, Artificial Sequence
  chemically synthesized
tctgactttggatcatctacat

SEQ ID NO: 15561 - DNA, 22 bp, Artificial Sequence
  chemically synthesized
tgactttggatcatctacataa

SEQ ID NO: 15562 - DNA, 22 bp, Artificial Sequence
  chemically synthesized
actttggatcatctacataaag

SEQ ID NO: 15563 - DNA, 22 bp, Artificial Sequence
  chemically synthesized
tggatcatctacataaaggggg

SEQ ID NO: 15564 - DNA, 22 bp, Artificial Sequence
  chemically synthesized
ggatcatctacataaaggggga

SEQ ID NO: 15565 - DNA, 22 bp, Artificial Sequence
  chemically synthesized
gatcatctacataaagggggaa

SEQ ID NO: 15566 - DNA, 22 bp, Artificial Sequence
  chemically synthesized
cataaagggggaagacagaaaa

SEQ ID NO: 15567 - DNA, 22 bp, Artificial Sequence
  chemically synthesized
ccagtgagttgaaaatacagga

SEQ ID NO: 15568 - DNA, 22 bp, Artificial Sequence
  chemically synthesized
aaaatacaggaaagcctatttc

SEQ ID NO: 15569 - DNA, 22 bp, Artificial Sequence
  chemically synthesized
tttcatatgggttaaagggtag

SEQ ID NO: 15570 - DNA, 22 bp, Artificial Sequence
  chemically synthesized
catatgggttaaagggtaggac

SEQ ID NO: 15571 - DNA, 22 bp, Artificial Sequence
  chemically synthesized
atatgggttaaagggtaggaca

SEQ ID NO: 15572 - DNA, 22 bp, Artificial Sequence
  chemically synthesized
aagggtaggacagttgaatttc

SEQ ID NO: 15573 - DNA, 22 bp, Artificial Sequence
  chemically synthesized
aatttcgtgaaaagtctgagtt

SEQ ID NO: 15574 - DNA, 22 bp, Artificial Sequence
  chemically synthesized
cgtgaaaagtctgagttatata

SEQ ID NO: 15575 - DNA, 22 bp, Artificial Sequence
  chemically synthesized
gtgaaaagtctgagttatatag

SEQ ID NO: 15576 - DNA, 22 bp, Artificial Sequence
  chemically synthesized
agttatataggctttgagcaaa

SEQ ID NO: 15577 - DNA, 22 bp, Artificial Sequence
  chemically synthesized
tataggctttgagcaaagagtt

SEQ ID NO: 15578 - DNA, 22 bp, Artificial Sequence
  chemically synthesized
tgagcaaagagttttattagta

SEQ ID NO: 15579 - DNA, 22 bp, Artificial Sequence
  chemically synthesized
gagcaaagagttttattagtat

SEQ ID NO: 15580 - DNA, 22 bp, Artificial Sequence
  chemically synthesized
agcaaagagttttattagtatg

SEQ ID NO: 15581 - DNA, 22 bp, Artificial Sequence
  chemically synthesized
tattagtatgaagcagaagagg

SEQ ID NO: 15582 - DNA, 22 bp, Artificial Sequence
  chemically synthesized
attagtatgaagcagaagaggt

SEQ ID NO: 15583 - DNA, 22 bp, Artificial Sequence
  chemically synthesized
ttagtatgaagcagaagaggta

SEQ ID NO: 15584 - DNA, 22 bp, Artificial Sequence
  chemically synthesized
gtatgaagcagaagaggtaaca

SEQ ID NO: 15585 - DNA, 22 bp, Artificial Sequence
  chemically synthesized
acacctgtaatcccagcacttt

SEQ ID NO: 15586 - DNA, 22 bp, Artificial Sequence
  chemically synthesized
taatcccagcactttgggaggc

SEQ ID NO: 15587 - DNA, 22 bp, Artificial Sequence
  chemically synthesized
tgggaggccgaggtgggcgaat

SEQ ID NO: 15588 - DNA, 22 bp, Artificial Sequence
  chemically synthesized
gggaggccgaggtgggcgaatc

SEQ ID NO: 15589 - DNA, 22 bp, Artificial Sequence
  chemically synthesized
ggaggccgaggtgggcgaatca

SEQ ID NO: 15590 - DNA, 22 bp, Artificial Sequence
  chemically synthesized
ctgggtgaactcaggagttcaa

SEQ ID NO: 15591 - DNA, 22 bp, Artificial Sequence
  chemically synthesized
ggtgaactcaggagttcaagac

SEQ ID NO: 15592 - DNA, 22 bp, Artificial Sequence
  chemically synthesized
aggagttcaagaccagcctggg

SEQ ID NO: 15593 - DNA, 22 bp, Artificial Sequence
  chemically synthesized
aagaccagcctgggcaacatgg

SEQ ID NO: 15594 - DNA, 22 bp, Artificial Sequence
  chemically synthesized
ggcaacatggcgaaactccatc

SEQ ID NO: 15595 - DNA, 22 bp, Artificial Sequence
  chemically synthesized
catctctacaaaaacattacga

SEQ ID NO: 15596 - DNA, 22 bp, Artificial Sequence
  chemically synthesized
tacaaaaacattacgaaaatta

SEQ ID NO: 15597 - DNA, 22 bp, Artificial Sequence
  chemically synthesized
caaaaacattacgaaaattagc

SEQ ID NO: 15598 - DNA, 22 bp, Artificial Sequence
  chemically synthesized
cgaaaattagctgggcgtgttg

SEQ ID NO: 15599 - DNA, 22 bp, Artificial Sequence
  chemically synthesized
gctgggcgtgttggtgctgtag

SEQ ID NO: 15600 - DNA, 22 bp, Artificial Sequence
  chemically synthesized
ggcgtgttggtgctgtagtccc

SEQ ID NO: 15601 - DNA, 22 bp, Artificial Sequence
  chemically synthesized
gtgctgtagtcccagctactca

SEQ ID NO: 15602 - DNA, 22 bp, Artificial Sequence
  chemically synthesized
tagtcccagctactcaggaggc

SEQ ID NO: 15603 - DNA, 22 bp, Artificial Sequence
  chemically synthesized
ctcaggaggctgaggtgagagg

SEQ ID NO: 15604 - DNA, 22 bp, Artificial Sequence
  chemically synthesized
aggaggctgaggtgagaggcgg

SEQ ID NO: 15605 - DNA, 22 bp, Artificial Sequence
  chemically synthesized
aggtgagaggcggaggaggttg

SEQ ID NO: 15606 - DNA, 22 bp, Artificial Sequence
  chemically synthesized
cagtgagtcaagatcatgccac

SEQ ID NO: 15607 - DNA, 22 bp, Artificial Sequence
  chemically synthesized
cactccagcctgggcaacagag

SEQ ID NO: 15608 - DNA, 22 bp, Artificial Sequence
  chemically synthesized
cagcctgggcaacagagtaaga

SEQ ID NO: 15609 - DNA, 22 bp, Artificial Sequence
  chemically synthesized
ggcaacagagtaagaccctgtc

SEQ ID NO: 15610 - DNA, 22 bp, Artificial Sequence
  chemically synthesized
tctcaaaaaaaaaaaaaagata

SEQ ID NO: 15611 - DNA, 22 bp, Artificial Sequence
  chemically synthesized
aaaaaaaaaaaaaagatagatg

SEQ ID NO: 15612 - DNA, 22 bp, Artificial Sequence
  chemically synthesized
tatgaaaaaaggaaacacacag

SEQ ID NO: 15613 - DNA, 22 bp, Artificial Sequence
  chemically synthesized
aacagcctgttttgtggggtaa

SEQ ID NO: 15614 - DNA, 22 bp, Artificial Sequence
  chemically synthesized
ttttgtggggtaatgaaaagtc

SEQ ID NO: 15615 - DNA, 22 bp, Artificial Sequence
  chemically synthesized
tgtggggtaatgaaaagtcacc

SEQ ID NO: 15616 - DNA, 22 bp, Artificial Sequence
  chemically synthesized
gtggggtaatgaaaagtcaccc

SEQ ID NO: 15617 - DNA, 22 bp, Artificial Sequence
  chemically synthesized
tggggtaatgaaaagtcaccct

SEQ ID NO: 15618 - DNA, 22 bp, Artificial Sequence
  chemically synthesized
ggaactgggctccagccctcgt

SEQ ID NO: 15619 - DNA, 22 bp, Artificial Sequence
  chemically synthesized
ggctccagccctcgttctgcca

SEQ ID NO: 15620 - DNA, 22 bp, Artificial Sequence
  chemically synthesized
cagccctcgttctgccacccac

SEQ ID NO: 15621 - DNA, 22 bp, Artificial Sequence
  chemically synthesized
gttctgccacccaccaactaca

SEQ ID NO: 15622 - DNA, 22 bp, Artificial Sequence
  chemically synthesized
tgccacccaccaactacatgtc

SEQ ID NO: 15623 - DNA, 22 bp, Artificial Sequence
  chemically synthesized
ccacccaccaactacatgtcct

SEQ ID NO: 15624 - DNA, 22 bp, Artificial Sequence
  chemically synthesized
catgtccttggcaagtcatatc

SEQ ID NO: 15625 - DNA, 22 bp, Artificial Sequence
  chemically synthesized
ggcaagtcatatcaattatctg

SEQ ID NO: 15626 - DNA, 22 bp, Artificial Sequence
  chemically synthesized
gcaagtcatatcaattatctga

SEQ ID NO: 15627 - DNA, 22 bp, Artificial Sequence
  chemically synthesized
tctgagtttctgttttataatc

SEQ ID NO: 15628 - DNA, 22 bp, Artificial Sequence
  chemically synthesized
agtttctgttttataatctaca

SEQ ID NO: 15629 - DNA, 22 bp, Artificial Sequence
  chemically synthesized
ctgttttataatctacaaatag

SEQ ID NO: 15630 - DNA, 22 bp, Artificial Sequence
  chemically synthesized
tgttttataatctacaaatagg

SEQ ID NO: 15631 - DNA, 22 bp, Artificial Sequence
  chemically synthesized
ttttataatctacaaataggtt

SEQ ID NO: 15632 - DNA, 22 bp, Artificial Sequence
  chemically synthesized
tataatctacaaataggttatc

SEQ ID NO: 15633 - DNA, 22 bp, Artificial Sequence
  chemically synthesized
ataatctacaaataggttatct

SEQ ID NO: 15634 - DNA, 22 bp, Artificial Sequence
  chemically synthesized
taatctacaaataggttatctc

SEQ ID NO: 15635 - DNA, 22 bp, Artificial Sequence
  chemically synthesized
caaataggttatctctggcagc

SEQ ID NO: 15636 - DNA, 22 bp, Artificial Sequence
  chemically synthesized
tctctggcagcttaataataat

SEQ ID NO: 15637 - DNA, 22 bp, Artificial Sequence
  chemically synthesized
tggcagcttaataataatcagg

SEQ ID NO: 15638 - DNA, 22 bp, Artificial Sequence
  chemically synthesized
gcagcttaataataatcagggt

SEQ ID NO: 15639 - DNA, 22 bp, Artificial Sequence
  chemically synthesized
aataataatcagggttaacatt

SEQ ID NO: 15640 - DNA, 22 bp, Artificial Sequence
  chemically synthesized
ataataatcagggttaacattt

SEQ ID NO: 15641 - DNA, 22 bp, Artificial Sequence
  chemically synthesized
acatttattaaacagtgtgtgc

SEQ ID NO: 15642 - DNA, 22 bp, Artificial Sequence
  chemically synthesized
attaaacagtgtgtgccagtcc

SEQ ID NO: 15643 - DNA, 22 bp, Artificial Sequence
  chemically synthesized
ttaaacagtgtgtgccagtcca

SEQ ID NO: 15644 - DNA, 22 bp, Artificial Sequence
  chemically synthesized
aacagtgtgtgccagtccatgt

SEQ ID NO: 15645 - DNA, 22 bp, Artificial Sequence
  chemically synthesized
tgtgcttttctgtgaggtagtt

SEQ ID NO: 15646 - DNA, 22 bp, Artificial Sequence
  chemically synthesized
ttctgtgaggtagttactgcta

SEQ ID NO: 15647 - DNA, 22 bp, Artificial Sequence
  chemically synthesized
tctgtgaggtagttactgctat

SEQ ID NO: 15648 - DNA, 22 bp, Artificial Sequence
  chemically synthesized
ctgtgaggtagttactgctatt

SEQ ID NO: 15649 - DNA, 22 bp, Artificial Sequence
  chemically synthesized
tgtgaggtagttactgctattt

SEQ ID NO: 15650 - DNA, 22 bp, Artificial Sequence
  chemically synthesized
tgaggtagttactgctatttac

SEQ ID NO: 15651 - DNA, 22 bp, Artificial Sequence
  chemically synthesized
ctgctatttacagaaacagtag

SEQ ID NO: 15652 - DNA, 22 bp, Artificial Sequence
  chemically synthesized
ctatttacagaaacagtagatg

SEQ ID NO: 15653 - DNA, 22 bp, Artificial Sequence
  chemically synthesized
tttacagaaacagtagatgcag

SEQ ID NO: 15654 - DNA, 22 bp, Artificial Sequence
  chemically synthesized
acagaaacagtagatgcagaga

SEQ ID NO: 15655 - DNA, 22 bp, Artificial Sequence
  chemically synthesized
cagaaacagtagatgcagagac

SEQ ID NO: 15656 - DNA, 22 bp, Artificial Sequence
  chemically synthesized
agttaaatgattaggccaacaa

SEQ ID NO: 15657 - DNA, 22 bp, Artificial Sequence
  chemically synthesized
aatgattaggccaacaaggtta

SEQ ID NO: 15658 - DNA, 22 bp, Artificial Sequence
  chemically synthesized
ggccaacaaggttagtacatgc

SEQ ID NO: 15659 - DNA, 22 bp, Artificial Sequence
  chemically synthesized
gtacatgccgagccaggatgga

SEQ ID NO: 15660 - DNA, 22 bp, Artificial Sequence
  chemically synthesized
gcttccgcggcaatgctcttat

SEQ ID NO: 15661 - DNA, 22 bp, Artificial Sequence
  chemically synthesized
ccgcggcaatgctcttatgaac

SEQ ID NO: 15662 - DNA, 22 bp, Artificial Sequence
  chemically synthesized
cgcggcaatgctcttatgaact

SEQ ID NO: 15663 - DNA, 22 bp, Artificial Sequence
  chemically synthesized
ttatgaactatgttacgtccag

SEQ ID NO: 15664 - DNA, 22 bp, Artificial Sequence
  chemically synthesized
atgaactatgttacgtccagtg

SEQ ID NO: 15665 - DNA, 22 bp, Artificial Sequence
  chemically synthesized
tgaactatgttacgtccagtgc

SEQ ID NO: 15666 - DNA, 22 bp, Artificial Sequence
  chemically synthesized
tgttacgtccagtgctgataaa

SEQ ID NO: 15667 - DNA, 22 bp, Artificial Sequence
  chemically synthesized
cgtccagtgctgataaactgac

SEQ ID NO: 15668 - DNA, 22 bp, Artificial Sequence
  chemically synthesized
ataaactgactctctggggagc

SEQ ID NO: 15669 - DNA, 22 bp, Artificial Sequence
  chemically synthesized
actctctggggagcaggggaaa

SEQ ID NO: 15670 - DNA, 22 bp, Artificial Sequence
  chemically synthesized
tctggggagcaggggaaagccc

SEQ ID NO: 15671 - DNA, 22 bp, Artificial Sequence
  chemically synthesized
tggggagcaggggaaagccctg

SEQ ID NO: 15672 - DNA, 22 bp, Artificial Sequence
  chemically synthesized
gggagcaggggaaagccctgag

SEQ ID NO: 15673 - DNA, 22 bp, Artificial Sequence
  chemically synthesized
agtttagcatttgccaatttct

SEQ ID NO: 15674 - DNA, 22 bp, Artificial Sequence
  chemically synthesized
agcatttgccaatttctatcac

SEQ ID NO: 15675 - DNA, 22 bp, Artificial Sequence
  chemically synthesized
gcatttgccaatttctatcacg

SEQ ID NO: 15676 - DNA, 22 bp, Artificial Sequence
  chemically synthesized
gccaatttctatcacgtaaaca

SEQ ID NO: 15677 - DNA, 22 bp, Artificial Sequence
  chemically synthesized
ccaatttctatcacgtaaacat

SEQ ID NO: 15678 - DNA, 22 bp, Artificial Sequence
  chemically synthesized
ctatcacgtaaacattcccatt

SEQ ID NO: 15679 - DNA, 22 bp, Artificial Sequence
  chemically synthesized
tatcacgtaaacattcccattc

SEQ ID NO: 15680 - DNA, 22 bp, Artificial Sequence
  chemically synthesized
tcacgtaaacattcccattctg

SEQ ID NO: 15681 - DNA, 22 bp, Artificial Sequence
  chemically synthesized
ccattctggccactttctttct

SEQ ID NO: 15682 - DNA, 22 bp, Artificial Sequence
  chemically synthesized
tggccactttctttctttcttt

SEQ ID NO: 15683 - DNA, 22 bp, Artificial Sequence
  chemically synthesized
gccactttctttctttctttct

SEQ ID NO: 15684 - DNA, 22 bp, Artificial Sequence
  chemically synthesized
tctttctttctttcttttgttt

SEQ ID NO: 15685 - DNA, 22 bp, Artificial Sequence
  chemically synthesized
ctttctttctttcttttgtttg

SEQ ID NO: 15686 - DNA, 22 bp, Artificial Sequence
  chemically synthesized
tttctttctttcttttgtttgt

SEQ ID NO: 15687 - DNA, 22 bp, Artificial Sequence
  chemically synthesized
tctttctttcttttgtttgttt

SEQ ID NO: 15688 - DNA, 22 bp, Artificial Sequence
  chemically synthesized
ctttctttcttttgtttgtttg

SEQ ID NO: 15689 - DNA, 22 bp, Artificial Sequence
  chemically synthesized
tttctttcttttgtttgtttgt

SEQ ID NO: 15690 - DNA, 22 bp, Artificial Sequence
  chemically synthesized
tctttcttttgtttgtttgttt

SEQ ID NO: 15691 - DNA, 22 bp, Artificial Sequence
  chemically synthesized
ctttcttttgtttgtttgtttg

SEQ ID NO: 15692 - DNA, 22 bp, Artificial Sequence
  chemically synthesized
tttcttttgtttgtttgtttga

SEQ ID NO: 15693 - DNA, 22 bp, Artificial Sequence
  chemically synthesized
tcttttgtttgtttgtttgaga

SEQ ID NO: 15694 - DNA, 22 bp, Artificial Sequence
  chemically synthesized
cttttgtttgtttgtttgagat

SEQ ID NO: 15695 - DNA, 22 bp, Artificial Sequence
  chemically synthesized
ttttgtttgtttgtttgagatg

SEQ ID NO: 15696 - DNA, 22 bp, Artificial Sequence
  chemically synthesized
ttgtttgtttgtttgagatgga

SEQ ID NO: 15697 - DNA, 22 bp, Artificial Sequence
  chemically synthesized
tgtttgtttgtttgagatggag

SEQ ID NO: 15698 - DNA, 22 bp, Artificial Sequence
  chemically synthesized
gtttgtttgtttgagatggagt

SEQ ID NO: 15699 - DNA, 22 bp, Artificial Sequence
  chemically synthesized
tttgtttgtttgagatggagtc

SEQ ID NO: 15700 - DNA, 22 bp, Artificial Sequence
  chemically synthesized
gtttgtttgagatggagtctcg

SEQ ID NO: 15701 - DNA, 22 bp, Artificial Sequence
  chemically synthesized
tttgtttgagatggagtctcgc

SEQ ID NO: 15702 - DNA, 22 bp, Artificial Sequence
  chemically synthesized
gtttgagatggagtctcgcact

SEQ ID NO: 15703 - DNA, 22 bp, Artificial Sequence
  chemically synthesized
tttgagatggagtctcgcactg

SEQ ID NO: 15704 - DNA, 22 bp, Artificial Sequence
  chemically synthesized
gagatggagtctcgcactgttg

SEQ ID NO: 15705 - DNA, 22 bp, Artificial Sequence
  chemically synthesized
agatggagtctcgcactgttgc

SEQ ID NO: 15706 - DNA, 22 bp, Artificial Sequence
  chemically synthesized
gcactgttgcctggctggagtg

SEQ ID NO: 15707 - DNA, 22 bp, Artificial Sequence
  chemically synthesized
ttgcctggctggagtgcaatgg

SEQ ID NO: 15708 - DNA, 22 bp, Artificial Sequence
  chemically synthesized
cctggctggagtgcaatggtgc

SEQ ID NO: 15709 - DNA, 22 bp, Artificial Sequence
  chemically synthesized
gctggagtgcaatggtgcaatc

SEQ ID NO: 15710 - DNA, 22 bp, Artificial Sequence
  chemically synthesized
gagtgcaatggtgcaatctcag

SEQ ID NO: 15711 - DNA, 22 bp, Artificial Sequence
  chemically synthesized
agctcactgcaacctctgcctc

SEQ ID NO: 15712 - DNA, 22 bp, Artificial Sequence
  chemically synthesized
actgcaacctctgcctctccgg

SEQ ID NO: 15713 - DNA, 22 bp, Artificial Sequence
  chemically synthesized
caacctctgcctctccggttca

SEQ ID NO: 15714 - DNA, 22 bp, Artificial Sequence
  chemically synthesized
tgcctctccggttcaagtgatt

SEQ ID NO: 15715 - DNA, 22 bp, Artificial Sequence
  chemically synthesized
cctctccggttcaagtgattct

SEQ ID NO: 15716 - DNA, 22 bp, Artificial Sequence
  chemically synthesized
tccggttcaagtgattctcctg

SEQ ID NO: 15717 - DNA, 22 bp, Artificial Sequence
  chemically synthesized
cggttcaagtgattctcctgcc

SEQ ID NO: 15718 - DNA, 22 bp, Artificial Sequence
  chemically synthesized
aagtgattctcctgcctcagcc

SEQ ID NO: 15719 - DNA, 22 bp, Artificial Sequence
  chemically synthesized
tcctgcctcagcctcccaagta

SEQ ID NO: 15720 - DNA, 22 bp, Artificial Sequence
  chemically synthesized
ctgcctcagcctcccaagtagc

SEQ ID NO: 15721 - DNA, 22 bp, Artificial Sequence
  chemically synthesized
cctcagcctcccaagtagctgg

SEQ ID NO: 15722 - DNA, 22 bp, Artificial Sequence
  chemically synthesized
agcctcccaagtagctgggatt

SEQ ID NO: 15723 - DNA, 22 bp, Artificial Sequence
  chemically synthesized
ccaagtagctgggattacaggt

SEQ ID NO: 15724 - DNA, 22 bp, Artificial Sequence
  chemically synthesized
ggattacaggtgcccgccacca

SEQ ID NO: 15725 - DNA, 22 bp, Artificial Sequence
  chemically synthesized
caggtgcccgccaccatgccca

SEQ ID NO: 15726 - DNA, 22 bp, Artificial Sequence
  chemically synthesized
attttttttgtatttttagtag

SEQ ID NO: 15727 - DNA, 22 bp, Artificial Sequence
  chemically synthesized
tttttgtatttttagtagagac

SEQ ID NO: 15728 - DNA, 22 bp, Artificial Sequence
  chemically synthesized
ttttgtatttttagtagagaca

SEQ ID NO: 15729 - DNA, 22 bp, Artificial Sequence
  chemically synthesized
tttgtatttttagtagagacat

SEQ ID NO: 15730 - DNA, 22 bp, Artificial Sequence
  chemically synthesized
ttgtatttttagtagagacatg

SEQ ID NO: 15731 - DNA, 22 bp, Artificial Sequence
  chemically synthesized
tgtatttttagtagagacatgg

SEQ ID NO: 15732 - DNA, 22 bp, Artificial Sequence
  chemically synthesized
gtatttttagtagagacatggt

SEQ ID NO: 15733 - DNA, 22 bp, Artificial Sequence
  chemically synthesized
tatttttagtagagacatggtt

SEQ ID NO: 15734 - DNA, 22 bp, Artificial Sequence
  chemically synthesized
ttagtagagacatggtttcact

SEQ ID NO: 15735 - DNA, 22 bp, Artificial Sequence
  chemically synthesized
tagtagagacatggtttcacta

SEQ ID NO: 15736 - DNA, 22 bp, Artificial Sequence
  chemically synthesized
agtagagacatggtttcactat

SEQ ID NO: 15737 - DNA, 22 bp, Artificial Sequence
  chemically synthesized
gtagagacatggtttcactatg

SEQ ID NO: 15738 - DNA, 22 bp, Artificial Sequence
  chemically synthesized
cactatgttgactaggctggtc

SEQ ID NO: 15739 - DNA, 22 bp, Artificial Sequence
  chemically synthesized
actatgttgactaggctggtct

SEQ ID NO: 15740 - DNA, 22 bp, Artificial Sequence
  chemically synthesized
tgttgactaggctggtctcgaa

SEQ ID NO: 15741 - DNA, 22 bp, Artificial Sequence
  chemically synthesized
actaggctggtctcgaactcct

SEQ ID NO: 15742 - DNA, 22 bp, Artificial Sequence
  chemically synthesized
ggctggtctcgaactcctgacc

SEQ ID NO: 15743 - DNA, 22 bp, Artificial Sequence
  chemically synthesized
gtctcgaactcctgacctcatg

SEQ ID NO: 15744 - DNA, 22 bp, Artificial Sequence
  chemically synthesized
gaactcctgacctcatgatctg

SEQ ID NO: 15745 - DNA, 22 bp, Artificial Sequence
  chemically synthesized
ctgacctcatgatctgcctgcc

SEQ ID NO: 15746 - DNA, 22 bp, Artificial Sequence
  chemically synthesized
acctcatgatctgcctgccttg

SEQ ID NO: 15747 - DNA, 22 bp, Artificial Sequence
  chemically synthesized
atgatctgcctgccttggcctc

SEQ ID NO: 15748 - DNA, 22 bp, Artificial Sequence
  chemically synthesized
cctgccttggcctccctaagtg

SEQ ID NO: 15749 - DNA, 22 bp, Artificial Sequence
  chemically synthesized
ccttggcctccctaagtgctag

SEQ ID NO: 15750 - DNA, 22 bp, Artificial Sequence
  chemically synthesized
ggcctccctaagtgctaggatt

SEQ ID NO: 15751 - DNA, 22 bp, Artificial Sequence
  chemically synthesized
gcctccctaagtgctaggatta

SEQ ID NO: 15752 - DNA, 22 bp, Artificial Sequence
  chemically synthesized
cctaagtgctaggattacaggc

SEQ ID NO: 15753 - DNA, 22 bp, Artificial Sequence
  chemically synthesized
agtgctaggattacaggcgtga

SEQ ID NO: 15754 - DNA, 22 bp, Artificial Sequence
  chemically synthesized
ggattacaggcgtgagccacta

SEQ ID NO: 15755 - DNA, 22 bp, Artificial Sequence
  chemically synthesized
caggcgtgagccactacaccca

SEQ ID NO: 15756 - DNA, 22 bp, Artificial Sequence
  chemically synthesized
cacccagccgcatgattctaaa

SEQ ID NO: 15757 - DNA, 22 bp, Artificial Sequence
  chemically synthesized
taaaaaataaaaagatgaagtg

SEQ ID NO: 15758 - DNA, 22 bp, Artificial Sequence
  chemically synthesized
aaaaataaaaagatgaagtgtt

SEQ ID NO: 15759 - DNA, 22 bp, Artificial Sequence
  chemically synthesized
ttccaaacatctgatctccatt

SEQ ID NO: 15760 - DNA, 22 bp, Artificial Sequence
  chemically synthesized
caaacatctgatctccattgaa

SEQ ID NO: 15761 - DNA, 22 bp, Artificial Sequence
  chemically synthesized
atctccattgaagaaccatgca

SEQ ID NO: 15762 - DNA, 22 bp, Artificial Sequence
  chemically synthesized
cattgaagaaccatgcaatctc

SEQ ID NO: 15763 - DNA, 22 bp, Artificial Sequence
  chemically synthesized
aagaaccatgcaatctctctgg

SEQ ID NO: 15764 - DNA, 22 bp, Artificial Sequence
  chemically synthesized
tctgggttgatagaggccagag

SEQ ID NO: 15765 - DNA, 22 bp, Artificial Sequence
  chemically synthesized
tgggttgatagaggccagagtt

SEQ ID NO: 15766 - DNA, 22 bp, Artificial Sequence
  chemically synthesized
ggttgatagaggccagagttag

SEQ ID NO: 15767 - DNA, 22 bp, Artificial Sequence
  chemically synthesized
atagaggccagagttagtggct

SEQ ID NO: 15768 - DNA, 22 bp, Artificial Sequence
  chemically synthesized
gtggctctccctgatttcggtg

SEQ ID NO: 15769 - DNA, 22 bp, Artificial Sequence
  chemically synthesized
tccctgatttcggtgagaaatc

SEQ ID NO: 15770 - DNA, 22 bp, Artificial Sequence
  chemically synthesized
cctgatttcggtgagaaatcac

SEQ ID NO: 15771 - DNA, 22 bp, Artificial Sequence
  chemically synthesized
atttcggtgagaaatcactatt

SEQ ID NO: 15772 - DNA, 22 bp, Artificial Sequence
  chemically synthesized
cggtgagaaatcactattccac

SEQ ID NO: 15773 - DNA, 22 bp, Artificial Sequence
  chemically synthesized
ggtgagaaatcactattccacc

SEQ ID NO: 15774 - DNA, 22 bp, Artificial Sequence
  chemically synthesized
ttccaccatcacgggataaaag

SEQ ID NO: 15775 - DNA, 22 bp, Artificial Sequence
  chemically synthesized
caccatcacgggataaaaggca

SEQ ID NO: 15776 - DNA, 22 bp, Artificial Sequence
  chemically synthesized
actggcggttgacacctatttc

SEQ ID NO: 15777 - DNA, 22 bp, Artificial Sequence
  chemically synthesized
gcggttgacacctatttccaca

SEQ ID NO: 15778 - DNA, 22 bp, Artificial Sequence
  chemically synthesized
acacctatttccacagtgaaag

SEQ ID NO: 15779 - DNA, 22 bp, Artificial Sequence
  chemically synthesized
tttccacagtgaaagatatatc

SEQ ID NO: 15780 - DNA, 22 bp, Artificial Sequence
  chemically synthesized
ccacagtgaaagatatatctag

SEQ ID NO: 15781 - DNA, 22 bp, Artificial Sequence
  chemically synthesized
cacagtgaaagatatatctagt

SEQ ID NO: 15782 - DNA, 22 bp, Artificial Sequence
  chemically synthesized
gtacttttaaaggggaagtggt

SEQ ID NO: 15783 - DNA, 22 bp, Artificial Sequence
  chemically synthesized
ttaaaggggaagtggtttgtct

SEQ ID NO: 15784 - DNA, 22 bp, Artificial Sequence
  chemically synthesized
taaaggggaagtggtttgtctg

SEQ ID NO: 15785 - DNA, 22 bp, Artificial Sequence
  chemically synthesized
aaaggggaagtggtttgtctga

SEQ ID NO: 15786 - DNA, 22 bp, Artificial Sequence
  chemically synthesized
aaggggaagtggtttgtctgag

SEQ ID NO: 15787 - DNA, 22 bp, Artificial Sequence
  chemically synthesized
gtctgagatactctgtttcaaa

SEQ ID NO: 15788 - DNA, 22 bp, Artificial Sequence
  chemically synthesized
tctgagatactctgtttcaaag

SEQ ID NO: 15789 - DNA, 22 bp, Artificial Sequence
  chemically synthesized
agatactctgtttcaaagtaga

SEQ ID NO: 15790 - DNA, 22 bp, Artificial Sequence
  chemically synthesized
tgtttcaaagtagagaggatac

SEQ ID NO: 15791 - DNA, 22 bp, Artificial Sequence
  chemically synthesized
tttcaaagtagagaggatacag

SEQ ID NO: 15792 - DNA, 22 bp, Artificial Sequence
  chemically synthesized
caaagtagagaggatacagaac

SEQ ID NO: 15793 - DNA, 22 bp, Artificial Sequence
  chemically synthesized
aaagtagagaggatacagaaca

SEQ ID NO: 15794 - DNA, 22 bp, Artificial Sequence
  chemically synthesized
aagctatatacatccttacaga

SEQ ID NO: 15795 - DNA, 22 bp, Artificial Sequence
  chemically synthesized
tatacatccttacagagagcaa

SEQ ID NO: 15796 - DNA, 22 bp, Artificial Sequence
  chemically synthesized
acagagagcaattctgatggaa

SEQ ID NO: 15797 - DNA, 22 bp, Artificial Sequence
  chemically synthesized
cagagagcaattctgatggaaa

SEQ ID NO: 15798 - DNA, 22 bp, Artificial Sequence
  chemically synthesized
tgatggaaatgcaggccatgtt

SEQ ID NO: 15799 - DNA, 22 bp, Artificial Sequence
  chemically synthesized
atggaaatgcaggccatgtttc

SEQ ID NO: 15800 - DNA, 22 bp, Artificial Sequence
  chemically synthesized
ccctggggggggctcgtcctag

SEQ ID NO: 15801 - DNA, 22 bp, Artificial Sequence
  chemically synthesized
cctggggggggctcgtcctagg

SEQ ID NO: 15802 - DNA, 22 bp, Artificial Sequence
  chemically synthesized
gggggggctcgtcctaggggct

SEQ ID NO: 15803 - DNA, 22 bp, Artificial Sequence
  chemically synthesized
gtcctaggggctggagtgcatt

SEQ ID NO: 15804 - DNA, 22 bp, Artificial Sequence
  chemically synthesized
ggggctggagtgcattctctga

SEQ ID NO: 15805 - DNA, 22 bp, Artificial Sequence
  chemically synthesized
gagtgcattctctgatgtcaga

SEQ ID NO: 15806 - DNA, 22 bp, Artificial Sequence
  chemically synthesized
tctgatgtcagaggaaatgcaa

SEQ ID NO: 15807 - DNA, 22 bp, Artificial Sequence
  chemically synthesized
tgatgtcagaggaaatgcaaga

SEQ ID NO: 15808 - DNA, 22 bp, Artificial Sequence
  chemically synthesized
atgtcagaggaaatgcaagatt

SEQ ID NO: 15809 - DNA, 22 bp, Artificial Sequence
  chemically synthesized
cctgaggcctgagggaacccat

SEQ ID NO: 15810 - DNA, 22 bp, Artificial Sequence
  chemically synthesized
aggcctgagggaacccatggta

SEQ ID NO: 15811 - DNA, 22 bp, Artificial Sequence
  chemically synthesized
agggaacccatggtatatgcaa

SEQ ID NO: 15812 - DNA, 22 bp, Artificial Sequence
  chemically synthesized
caaactgtagttccatatgcat

SEQ ID NO: 15813 - DNA, 22 bp, Artificial Sequence
  chemically synthesized
aaactgtagttccatatgcatt

SEQ ID NO: 15814 - DNA, 22 bp, Artificial Sequence
  chemically synthesized
tagttccatatgcattcttcca

SEQ ID NO: 15815 - DNA, 22 bp, Artificial Sequence
  chemically synthesized
catatgcattcttccaggacaa

SEQ ID NO: 15816 - DNA, 22 bp, Artificial Sequence
  chemically synthesized
ttccaggacaaatacttcttga

SEQ ID NO: 15817 - DNA, 22 bp, Artificial Sequence
  chemically synthesized
ccaggacaaatacttcttgagg

SEQ ID NO: 15818 - DNA, 22 bp, Artificial Sequence
  chemically synthesized
caggacaaatacttcttgaggt

SEQ ID NO: 15819 - DNA, 22 bp, Artificial Sequence
  chemically synthesized
cttgaggttaaaaaaaaaaagt

SEQ ID NO: 15820 - DNA, 22 bp, Artificial Sequence
  chemically synthesized
ttgaggttaaaaaaaaaaagtc

SEQ ID NO: 15821 - DNA, 22 bp, Artificial Sequence
  chemically synthesized
gaggttaaaaaaaaaaagtcac

SEQ ID NO: 15822 - DNA, 22 bp, Artificial Sequence
  chemically synthesized
aggttaaaaaaaaaaagtcaca

SEQ ID NO: 15823 - DNA, 22 bp, Artificial Sequence
  chemically synthesized
aaaaaaaaaagtcacatagctg

SEQ ID NO: 15824 - DNA, 22 bp, Artificial Sequence
  chemically synthesized
ccattttatggatttcaggatt

SEQ ID NO: 15825 - DNA, 22 bp, Artificial Sequence
  chemically synthesized
tatggatttcaggatttttttt

SEQ ID NO: 15826 - DNA, 22 bp, Artificial Sequence
  chemically synthesized
atggatttcaggattttttttt

SEQ ID NO: 15827 - DNA, 22 bp, Artificial Sequence
  chemically synthesized
tggatttcaggatttttttttt

SEQ ID NO: 15828 - DNA, 22 bp, Artificial Sequence
  chemically synthesized
caggattttttttttttttttt

SEQ ID NO: 15829 - DNA, 22 bp, Artificial Sequence
  chemically synthesized
aggatttttttttttttttttt

SEQ ID NO: 15830 - DNA, 22 bp, Artificial Sequence
  chemically synthesized
ttttttttttttttttgagatg

SEQ ID NO: 15831 - DNA, 22 bp, Artificial Sequence
  chemically synthesized
tttttttttttttttgagatgg

SEQ ID NO: 15832 - DNA, 22 bp, Artificial Sequence
  chemically synthesized
ttttttttttttttgagatgga

SEQ ID NO: 15833 - DNA, 22 bp, Artificial Sequence
  chemically synthesized
tttttttttttttgagatggag

SEQ ID NO: 15834 - DNA, 22 bp, Artificial Sequence
  chemically synthesized
ttttttttttttgagatggagt

SEQ ID NO: 15835 - DNA, 22 bp, Artificial Sequence
  chemically synthesized
tttttttttttgagatggagtc

SEQ ID NO: 15836 - DNA, 22 bp, Artificial Sequence
  chemically synthesized
ttttttttttgagatggagtct

SEQ ID NO: 15837 - DNA, 22 bp, Artificial Sequence
  chemically synthesized
tttttttttgagatggagtctt

SEQ ID NO: 15838 - DNA, 22 bp, Artificial Sequence
  chemically synthesized
ttttttttgagatggagtcttg

SEQ ID NO: 15839 - DNA, 22 bp, Artificial Sequence
  chemically synthesized
tttttttgagatggagtcttgc

SEQ ID NO: 15840 - DNA, 22 bp, Artificial Sequence
  chemically synthesized
ttttttgagatggagtcttgct

SEQ ID NO: 15841 - DNA, 22 bp, Artificial Sequence
  chemically synthesized
tttttgagatggagtcttgctc

SEQ ID NO: 15842 - DNA, 22 bp, Artificial Sequence
  chemically synthesized
ttttgagatggagtcttgctct

SEQ ID NO: 15843 - DNA, 22 bp, Artificial Sequence
  chemically synthesized
tttgagatggagtcttgctctg

SEQ ID NO: 15844 - DNA, 22 bp, Artificial Sequence
  chemically synthesized
ttgagatggagtcttgctctgt

SEQ ID NO: 15845 - DNA, 22 bp, Artificial Sequence
  chemically synthesized
tgagatggagtcttgctctgtc

SEQ ID NO: 15846 - DNA, 22 bp, Artificial Sequence
  chemically synthesized
gagatggagtcttgctctgtca

SEQ ID NO: 15847 - DNA, 22 bp, Artificial Sequence
  chemically synthesized
agatggagtcttgctctgtcac

SEQ ID NO: 15848 - DNA, 22 bp, Artificial Sequence
  chemically synthesized
gctctgtcacccagcctgtagt

SEQ ID NO: 15849 - DNA, 22 bp, Artificial Sequence
  chemically synthesized
ctctgtcacccagcctgtagtg

SEQ ID NO: 15850 - DNA, 22 bp, Artificial Sequence
  chemically synthesized
tgtcacccagcctgtagtgcag

SEQ ID NO: 15851 - DNA, 22 bp, Artificial Sequence
  chemically synthesized
tcacccagcctgtagtgcagtg

SEQ ID NO: 15852 - DNA, 22 bp, Artificial Sequence
  chemically synthesized
tagtgcagtggcataatctcgg

SEQ ID NO: 15853 - DNA, 22 bp, Artificial Sequence
  chemically synthesized
ggctcacggcaacctccgcctc

SEQ ID NO: 15854 - DNA, 22 bp, Artificial Sequence
  chemically synthesized
acggcaacctccgcctcccagg

SEQ ID NO: 15855 - DNA, 22 bp, Artificial Sequence
  chemically synthesized
cgcctcccaggttcaagcgatt

SEQ ID NO: 15856 - DNA, 22 bp, Artificial Sequence
  chemically synthesized
ccaggttcaagcgattctcttg

SEQ ID NO: 15857 - DNA, 22 bp, Artificial Sequence
  chemically synthesized
aagcgattctcttgccttagcc

SEQ ID NO: 15858 - DNA, 22 bp, Artificial Sequence
  chemically synthesized
tcttgccttagcctcccgagta

SEQ ID NO: 15859 - DNA, 22 bp, Artificial Sequence
  chemically synthesized
ttgccttagcctcccgagtagc

SEQ ID NO: 15860 - DNA, 22 bp, Artificial Sequence
  chemically synthesized
gccttagcctcccgagtagctg

SEQ ID NO: 15861 - DNA, 22 bp, Artificial Sequence
  chemically synthesized
ccttagcctcccgagtagctgg

SEQ ID NO: 15862 - DNA, 22 bp, Artificial Sequence
  chemically synthesized
agcctcccgagtagctgggatt

SEQ ID NO: 15863 - DNA, 22 bp, Artificial Sequence
  chemically synthesized
gcctcccgagtagctgggatta

SEQ ID NO: 15864 - DNA, 22 bp, Artificial Sequence
  chemically synthesized
ccgagtagctgggattacagtc

SEQ ID NO: 15865 - DNA, 22 bp, Artificial Sequence
  chemically synthesized
ggattacagtcacgcaccacca

SEQ ID NO: 15866 - DNA, 22 bp, Artificial Sequence
  chemically synthesized
cagtcacgcaccaccacatctg

SEQ ID NO: 15867 - DNA, 22 bp, Artificial Sequence
  chemically synthesized
gctaattctttatattttttgg

SEQ ID NO: 15868 - DNA, 22 bp, Artificial Sequence
  chemically synthesized
attctttatattttttggtaga

SEQ ID NO: 15869 - DNA, 22 bp, Artificial Sequence
  chemically synthesized
tttatattttttggtagaaacg

SEQ ID NO: 15870 - DNA, 22 bp, Artificial Sequence
  chemically synthesized
tatattttttggtagaaacggt

SEQ ID NO: 15871 - DNA, 22 bp, Artificial Sequence
  chemically synthesized
atattttttggtagaaacggtg

SEQ ID NO: 15872 - DNA, 22 bp, Artificial Sequence
  chemically synthesized
tattttttggtagaaacggtgt

SEQ ID NO: 15873 - DNA, 22 bp, Artificial Sequence
  chemically synthesized
tttggtagaaacggtgtttcac

SEQ ID NO: 15874 - DNA, 22 bp, Artificial Sequence
  chemically synthesized
ttggtagaaacggtgtttcacc

SEQ ID NO: 15875 - DNA, 22 bp, Artificial Sequence
  chemically synthesized
tggtagaaacggtgtttcacca

SEQ ID NO: 15876 - DNA, 22 bp, Artificial Sequence
  chemically synthesized
ggtagaaacggtgtttcaccat

SEQ ID NO: 15877 - DNA, 22 bp, Artificial Sequence
  chemically synthesized
gtagaaacggtgtttcaccatg

SEQ ID NO: 15878 - DNA, 22 bp, Artificial Sequence
  chemically synthesized
caccatgttggccaggctggtc

SEQ ID NO: 15879 - DNA, 22 bp, Artificial Sequence
  chemically synthesized
accatgttggccaggctggtct

SEQ ID NO: 15880 - DNA, 22 bp, Artificial Sequence
  chemically synthesized
gccaggctggtctcaaactcct

SEQ ID NO: 15881 - DNA, 22 bp, Artificial Sequence
  chemically synthesized
gtctcaaactcctgacctcatg

SEQ ID NO: 15882 - DNA, 22 bp, Artificial Sequence
  chemically synthesized
aaactcctgacctcatgtgatc

SEQ ID NO: 15883 - DNA, 22 bp, Artificial Sequence
  chemically synthesized
ctgacctcatgtgatctgcctg

SEQ ID NO: 15884 - DNA, 22 bp, Artificial Sequence
  chemically synthesized
acctcatgtgatctgcctgcct

SEQ ID NO: 15885 - DNA, 22 bp, Artificial Sequence
  chemically synthesized
atgtgatctgcctgccttggcc

SEQ ID NO: 15886 - DNA, 22 bp, Artificial Sequence
  chemically synthesized
cctgccttggcctcccaaagtg

SEQ ID NO: 15887 - DNA, 22 bp, Artificial Sequence
  chemically synthesized
ccttggcctcccaaagtgctga

SEQ ID NO: 15888 - DNA, 22 bp, Artificial Sequence
  chemically synthesized
ggcctcccaaagtgctgagatt

SEQ ID NO: 15889 - DNA, 22 bp, Artificial Sequence
  chemically synthesized
gcctcccaaagtgctgagatta

SEQ ID NO: 15890 - DNA, 22 bp, Artificial Sequence
  chemically synthesized
ccaaagtgctgagattacaggt

SEQ ID NO: 15891 - DNA, 22 bp, Artificial Sequence
  chemically synthesized
agattacaggtgtgagccaccg

SEQ ID NO: 15892 - DNA, 22 bp, Artificial Sequence
  chemically synthesized
caggtgtgagccaccgcgcctg

SEQ ID NO: 15893 - DNA, 22 bp, Artificial Sequence
  chemically synthesized
cctggagttcagaatcttgggc

SEQ ID NO: 15894 - DNA, 22 bp, Artificial Sequence
  chemically synthesized
gagttcagaatcttgggcttca

SEQ ID NO: 15895 - DNA, 22 bp, Artificial Sequence
  chemically synthesized
agaatcttgggcttcattattt

SEQ ID NO: 15896 - DNA, 22 bp, Artificial Sequence
  chemically synthesized
gggcttcattatttgtgtttaa

SEQ ID NO: 15897 - DNA, 22 bp, Artificial Sequence
  chemically synthesized
ggcttcattatttgtgtttaaa

SEQ ID NO: 15898 - DNA, 22 bp, Artificial Sequence
  chemically synthesized
cattatttgtgtttaaatagat

SEQ ID NO: 15899 - DNA, 22 bp, Artificial Sequence
  chemically synthesized
attatttgtgtttaaatagatc

SEQ ID NO: 15900 - DNA, 22 bp, Artificial Sequence
  chemically synthesized
tttgtgtttaaatagatcatac

SEQ ID NO: 15901 - DNA, 22 bp, Artificial Sequence
  chemically synthesized
gtgtttaaatagatcatacagt

SEQ ID NO: 15902 - DNA, 22 bp, Artificial Sequence
  chemically synthesized
tgtttaaatagatcatacagtc

SEQ ID NO: 15903 - DNA, 22 bp, Artificial Sequence
  chemically synthesized
aaatagatcatacagtcaggca

SEQ ID NO: 15904 - DNA, 22 bp, Artificial Sequence
  chemically synthesized
aatagatcatacagtcaggcac

SEQ ID NO: 15905 - DNA, 22 bp, Artificial Sequence
  chemically synthesized
atgcctgtaatcccagcacttt

SEQ ID NO: 15906 - DNA, 22 bp, Artificial Sequence
  chemically synthesized
taatcccagcactttgggaggc

SEQ ID NO: 15907 - DNA, 22 bp, Artificial Sequence
  chemically synthesized
tgggaggctgaggtgggaggat

SEQ ID NO: 15908 - DNA, 22 bp, Artificial Sequence
  chemically synthesized
gggaggctgaggtgggaggatt

SEQ ID NO: 15909 - DNA, 22 bp, Artificial Sequence
  chemically synthesized
ggaggctgaggtgggaggattg

SEQ ID NO: 15910 - DNA, 22 bp, Artificial Sequence
  chemically synthesized
aggtgggaggattgcctgagtt

SEQ ID NO: 15911 - DNA, 22 bp, Artificial Sequence
  chemically synthesized
cctgagttcaggagatggagac

SEQ ID NO: 15912 - DNA, 22 bp, Artificial Sequence
  chemically synthesized
agttcaggagatggagaccagc

SEQ ID NO: 15913 - DNA, 22 bp, Artificial Sequence
  chemically synthesized
aggagatggagaccagcctggg

SEQ ID NO: 15914 - DNA, 22 bp, Artificial Sequence
  chemically synthesized
ggcaacatggtgaaaccccgtc

SEQ ID NO: 15915 - DNA, 22 bp, Artificial Sequence
  chemically synthesized
tactaaaaatacaaaaactagc

SEQ ID NO: 15916 - DNA, 22 bp, Artificial Sequence
  chemically synthesized
ctaaaaatacaaaaactagctg

SEQ ID NO: 15917 - DNA, 22 bp, Artificial Sequence
  chemically synthesized
aaaatacaaaaactagctggat

SEQ ID NO: 15918 - DNA, 22 bp, Artificial Sequence
  chemically synthesized
gctggatgtggtggcacacacc

SEQ ID NO: 15919 - DNA, 22 bp, Artificial Sequence
  chemically synthesized
gatgtggtggcacacacctgta

SEQ ID NO: 15920 - DNA, 22 bp, Artificial Sequence
  chemically synthesized
tagtcccagctattcaggaggc

SEQ ID NO: 15921 - DNA, 22 bp, Artificial Sequence
  chemically synthesized
ttcaggaggctgaggtgggagg

SEQ ID NO: 15922 - DNA, 22 bp, Artificial Sequence
  chemically synthesized
aggaggctgaggtgggaggatc

SEQ ID NO: 15923 - DNA, 22 bp, Artificial Sequence
  chemically synthesized
aggtgggaggatcccaggaggt

SEQ ID NO: 15924 - DNA, 22 bp, Artificial Sequence
  chemically synthesized
cgccactgcactccaggctggg

SEQ ID NO: 15925 - DNA, 22 bp, Artificial Sequence
  chemically synthesized
cactccaggctgggttactgag

SEQ ID NO: 15926 - DNA, 22 bp, Artificial Sequence
  chemically synthesized
caggctgggttactgagccaga

SEQ ID NO: 15927 - DNA, 22 bp, Artificial Sequence
  chemically synthesized
ggttactgagccagatcctgtc

SEQ ID NO: 15928 - DNA, 22 bp, Artificial Sequence
  chemically synthesized
ctgagccagatcctgtctcaaa

SEQ ID NO: 15929 - DNA, 22 bp, Artificial Sequence
  chemically synthesized
agccagatcctgtctcaaaaaa

SEQ ID NO: 15930 - DNA, 22 bp, Artificial Sequence
  chemically synthesized
tctcaaaaaaaaaaaagataat

SEQ ID NO: 15931 - DNA, 22 bp, Artificial Sequence
  chemically synthesized
aaaaaaaaaaaagataatacat

SEQ ID NO: 15932 - DNA, 22 bp, Artificial Sequence
  chemically synthesized
aaacagttcaaaatgcaaaagt

SEQ ID NO: 15933 - DNA, 22 bp, Artificial Sequence
  chemically synthesized
aaaatgcaaaagttacatacat

SEQ ID NO: 15934 - DNA, 22 bp, Artificial Sequence
  chemically synthesized
catacataaggaagtgtcatga

SEQ ID NO: 15935 - DNA, 22 bp, Artificial Sequence
  chemically synthesized
cctctcacacttctccccagcc

SEQ ID NO: 15936 - DNA, 22 bp, Artificial Sequence
  chemically synthesized
tcacacttctccccagccaccc

SEQ ID NO: 15937 - DNA, 22 bp, Artificial Sequence
  chemically synthesized
acacttctccccagccacccag

SEQ ID NO: 15938 - DNA, 22 bp, Artificial Sequence
  chemically synthesized
ctccccagccacccagttctcc

SEQ ID NO: 15939 - DNA, 22 bp, Artificial Sequence
  chemically synthesized
tccccagccacccagttctccc

SEQ ID NO: 15940 - DNA, 22 bp, Artificial Sequence
  chemically synthesized
cccagccacccagttctccctt

SEQ ID NO: 15941 - DNA, 22 bp, Artificial Sequence
  chemically synthesized
tcccttctagaggcaacatgtg

SEQ ID NO: 15942 - DNA, 22 bp, Artificial Sequence
  chemically synthesized
ccttctagaggcaacatgtgaa

SEQ ID NO: 15943 - DNA, 22 bp, Artificial Sequence
  chemically synthesized
ctagaggcaacatgtgaaatcc

SEQ ID NO: 15944 - DNA, 22 bp, Artificial Sequence
  chemically synthesized
tagaggcaacatgtgaaatcct

SEQ ID NO: 15945 - DNA, 22 bp, Artificial Sequence
  chemically synthesized
gaggcaacatgtgaaatccttc

SEQ ID NO: 15946 - DNA, 22 bp, Artificial Sequence
  chemically synthesized
ctcaggctacactcttcttgaa

SEQ ID NO: 15947 - DNA, 22 bp, Artificial Sequence
  chemically synthesized
tcaggctacactcttcttgaag

SEQ ID NO: 15948 - DNA, 22 bp, Artificial Sequence
  chemically synthesized
aggctacactcttcttgaaggt

SEQ ID NO: 15949 - DNA, 22 bp, Artificial Sequence
  chemically synthesized
cactcttcttgaaggtgtaggc

SEQ ID NO: 15950 - DNA, 22 bp, Artificial Sequence
  chemically synthesized
ttcttgaaggtgtaggctttgg

SEQ ID NO: 15951 - DNA, 22 bp, Artificial Sequence
  chemically synthesized
cttgaaggtgtaggctttgggc

SEQ ID NO: 15952 - DNA, 22 bp, Artificial Sequence
  chemically synthesized
ttgaaggtgtaggctttgggca

SEQ ID NO: 15953 - DNA, 22 bp, Artificial Sequence
  chemically synthesized
gaaggtgtaggctttgggcaaa

SEQ ID NO: 15954 - DNA, 22 bp, Artificial Sequence
  chemically synthesized
aaggtgtaggctttgggcaaaa

SEQ ID NO: 15955 - DNA, 22 bp, Artificial Sequence
  chemically synthesized
tgggcaaaagcattcattcagt

SEQ ID NO: 15956 - DNA, 22 bp, Artificial Sequence
  chemically synthesized
gggcaaaagcattcattcagta

SEQ ID NO: 15957 - DNA, 22 bp, Artificial Sequence
  chemically synthesized
ggcaaaagcattcattcagtaa

SEQ ID NO: 15958 - DNA, 22 bp, Artificial Sequence
  chemically synthesized
attcagtaaccccagaaacttg

SEQ ID NO: 15959 - DNA, 22 bp, Artificial Sequence
  chemically synthesized
agtaaccccagaaacttgttct

SEQ ID NO: 15960 - DNA, 22 bp, Artificial Sequence
  chemically synthesized
gttctgtttttccataggattc

SEQ ID NO: 15961 - DNA, 22 bp, Artificial Sequence
  chemically synthesized
ttctgtttttccataggattct

SEQ ID NO: 15962 - DNA, 22 bp, Artificial Sequence
  chemically synthesized
tgtttttccataggattctctt

SEQ ID NO: 15963 - DNA, 22 bp, Artificial Sequence
  chemically synthesized
tttttccataggattctctttg

SEQ ID NO: 15964 - DNA, 22 bp, Artificial Sequence
  chemically synthesized
ttccataggattctctttggac

SEQ ID NO: 15965 - DNA, 22 bp, Artificial Sequence
  chemically synthesized
tccataggattctctttggaca

SEQ ID NO: 15966 - DNA, 22 bp, Artificial Sequence
  chemically synthesized
ccataggattctctttggacag

SEQ ID NO: 15967 - DNA, 22 bp, Artificial Sequence
  chemically synthesized
cataggattctctttggacagc

SEQ ID NO: 15968 - DNA, 22 bp, Artificial Sequence
  chemically synthesized
tctttggacagcgtccatactg

SEQ ID NO: 15969 - DNA, 22 bp, Artificial Sequence
  chemically synthesized
tttggacagcgtccatactggt

SEQ ID NO: 15970 - DNA, 22 bp, Artificial Sequence
  chemically synthesized
tggacagcgtccatactggtgg

SEQ ID NO: 15971 - DNA, 22 bp, Artificial Sequence
  chemically synthesized
ggacagcgtccatactggtggg

SEQ ID NO: 15972 - DNA, 22 bp, Artificial Sequence
  chemically synthesized
gacagcgtccatactggtgggt

SEQ ID NO: 15973 - DNA, 22 bp, Artificial Sequence
  chemically synthesized
gtgggttttggatactgactac

SEQ ID NO: 15974 - DNA, 22 bp, Artificial Sequence
  chemically synthesized
tggatactgactactacagcaa

SEQ ID NO: 15975 - DNA, 22 bp, Artificial Sequence
  chemically synthesized
ggatactgactactacagcaac

SEQ ID NO: 15976 - DNA, 22 bp, Artificial Sequence
  chemically synthesized
gatactgactactacagcaaca

SEQ ID NO: 15977 - DNA, 22 bp, Artificial Sequence
  chemically synthesized
actactacagcaacacttccgt

SEQ ID NO: 15978 - DNA, 22 bp, Artificial Sequence
  chemically synthesized
ctacagcaacacttccgtgccc

SEQ ID NO: 15979 - DNA, 22 bp, Artificial Sequence
  chemically synthesized
cagcaacacttccgtgcccctg

SEQ ID NO: 15980 - DNA, 22 bp, Artificial Sequence
  chemically synthesized
ccgtgcccctgataaagcagtt

SEQ ID NO: 15981 - DNA, 22 bp, Artificial Sequence
  chemically synthesized
cgtgcccctgataaagcagttc

SEQ ID NO: 15982 - DNA, 22 bp, Artificial Sequence
  chemically synthesized
ataaagcagttccctgtaacct

SEQ ID NO: 15983 - DNA, 22 bp, Artificial Sequence
  chemically synthesized
cctgtaacctgtgagactggac

SEQ ID NO: 15984 - DNA, 22 bp, Artificial Sequence
  chemically synthesized
taacctgtgagactggaccagg

SEQ ID NO: 15985 - DNA, 22 bp, Artificial Sequence
  chemically synthesized
tgagactggaccaggtaagcgt

SEQ ID NO: 15986 - DNA, 22 bp, Artificial Sequence
  chemically synthesized
gaccaggtaagcgtcccagccc

SEQ ID NO: 15987 - DNA, 22 bp, Artificial Sequence
  chemically synthesized
cagacagaagctgagtggacct

SEQ ID NO: 15988 - DNA, 22 bp, Artificial Sequence
  chemically synthesized
agtggacctcgtttacctgtta

SEQ ID NO: 15989 - DNA, 22 bp, Artificial Sequence
  chemically synthesized
gtttacctgttatggatgaaac

SEQ ID NO: 15990 - DNA, 22 bp, Artificial Sequence
  chemically synthesized
acctgttatggatgaaactgac

SEQ ID NO: 15991 - DNA, 22 bp, Artificial Sequence
  chemically synthesized
cctgttatggatgaaactgacc

SEQ ID NO: 15992 - DNA, 22 bp, Artificial Sequence
  chemically synthesized
ttatggatgaaactgaccttga

SEQ ID NO: 15993 - DNA, 22 bp, Artificial Sequence
  chemically synthesized
tggatgaaactgaccttgaggg

SEQ ID NO: 15994 - DNA, 22 bp, Artificial Sequence
  chemically synthesized
accttgaggggacatgaggaga

SEQ ID NO: 15995 - DNA, 22 bp, Artificial Sequence
  chemically synthesized
gaggggacatgaggagagccat

SEQ ID NO: 15996 - DNA, 22 bp, Artificial Sequence
  chemically synthesized
aggggacatgaggagagccatt

SEQ ID NO: 15997 - DNA, 22 bp, Artificial Sequence
  chemically synthesized
ctttgtacttttgtcatgctct

SEQ ID NO: 15998 - DNA, 22 bp, Artificial Sequence
  chemically synthesized
tgtacttttgtcatgctcttca

SEQ ID NO: 15999 - DNA, 22 bp, Artificial Sequence
  chemically synthesized
gtacttttgtcatgctcttcaa

SEQ ID NO: 16000 - DNA, 22 bp, Artificial Sequence
  chemically synthesized
tacttttgtcatgctcttcaat

SEQ ID NO: 16001 - DNA, 22 bp, Artificial Sequence
  chemically synthesized
ttgtcatgctcttcaattggca

SEQ ID NO: 16002 - DNA, 22 bp, Artificial Sequence
  chemically synthesized
tgtcatgctcttcaattggcac

SEQ ID NO: 16003 - DNA, 22 bp, Artificial Sequence
  chemically synthesized
gtcatgctcttcaattggcaca

SEQ ID NO: 16004 - DNA, 22 bp, Artificial Sequence
  chemically synthesized
tcatgctcttcaattggcacaa

SEQ ID NO: 16005 - DNA, 22 bp, Artificial Sequence
  chemically synthesized
ttcaattggcacaaattaattc

SEQ ID NO: 16006 - DNA, 22 bp, Artificial Sequence
  chemically synthesized
caattggcacaaattaattcac

SEQ ID NO: 16007 - DNA, 22 bp, Artificial Sequence
  chemically synthesized
aattggcacaaattaattcact

SEQ ID NO: 16008 - DNA, 22 bp, Artificial Sequence
  chemically synthesized
gcacaaattaattcacttctgc

SEQ ID NO: 16009 - DNA, 22 bp, Artificial Sequence
  chemically synthesized
attcacttctgcaatactttcc

SEQ ID NO: 16010 - DNA, 22 bp, Artificial Sequence
  chemically synthesized
acttctgcaatactttcctgaa

SEQ ID NO: 16011 - DNA, 22 bp, Artificial Sequence
  chemically synthesized
ctgcaatactttcctgaatagc

SEQ ID NO: 16012 - DNA, 22 bp, Artificial Sequence
  chemically synthesized
tgcaatactttcctgaatagca

SEQ ID NO: 16013 - DNA, 22 bp, Artificial Sequence
  chemically synthesized
caatactttcctgaatagcaca

SEQ ID NO: 16014 - DNA, 22 bp, Artificial Sequence
  chemically synthesized
tcctgaatagcacagtagtatt

SEQ ID NO: 16015 - DNA, 22 bp, Artificial Sequence
  chemically synthesized
cctgaatagcacagtagtattg

SEQ ID NO: 16016 - DNA, 22 bp, Artificial Sequence
  chemically synthesized
ctgaatagcacagtagtattgg

SEQ ID NO: 16017 - DNA, 22 bp, Artificial Sequence
  chemically synthesized
aatagcacagtagtattggaaa

SEQ ID NO: 16018 - DNA, 22 bp, Artificial Sequence
  chemically synthesized
gaaatctgcctattacagaacc

SEQ ID NO: 16019 - DNA, 22 bp, Artificial Sequence
  chemically synthesized
cctattacagaacctggatgga

SEQ ID NO: 16020 - DNA, 22 bp, Artificial Sequence
  chemically synthesized
ttacagaacctggatggagtcc

SEQ ID NO: 16021 - DNA, 22 bp, Artificial Sequence
  chemically synthesized
cagaacctggatggagtccaga

SEQ ID NO: 16022 - DNA, 22 bp, Artificial Sequence
  chemically synthesized
gatggagtccagagaggcacgg

SEQ ID NO: 16023 - DNA, 22 bp, Artificial Sequence
  chemically synthesized
gtgagagtcaccgccctgcagc

SEQ ID NO: 16024 - DNA, 22 bp, Artificial Sequence
  chemically synthesized
cagggcggtgactctcacgagc

SEQ ID NO: 16025 - DNA, 22 bp, Artificial Sequence
  chemically synthesized
tcacgagccctttgcccatgga

SEQ ID NO: 16026 - DNA, 22 bp, Artificial Sequence
  chemically synthesized
acgagccctttgcccatggatg

SEQ ID NO: 16027 - DNA, 22 bp, Artificial Sequence
  chemically synthesized
tgcccatggatgcccgtgcctc

SEQ ID NO: 16028 - DNA, 22 bp, Artificial Sequence
  chemically synthesized
gcccatggatgcccgtgcctct

SEQ ID NO: 16029 - DNA, 22 bp, Artificial Sequence
  chemically synthesized
cccatggatgcccgtgcctctc

SEQ ID NO: 16030 - DNA, 22 bp, Artificial Sequence
  chemically synthesized
tctggactccatccaggttctg

SEQ ID NO: 16031 - DNA, 22 bp, Artificial Sequence
  chemically synthesized
tggactccatccaggttctgta

SEQ ID NO: 16032 - DNA, 22 bp, Artificial Sequence
  chemically synthesized
gactccatccaggttctgtaat

SEQ ID NO: 16033 - DNA, 22 bp, Artificial Sequence
  chemically synthesized
catccaggttctgtaataggca

SEQ ID NO: 16034 - DNA, 22 bp, Artificial Sequence
  chemically synthesized
tgtaataggcagatttccaata

SEQ ID NO: 16035 - DNA, 22 bp, Artificial Sequence
  chemically synthesized
taataggcagatttccaatact

SEQ ID NO: 16036 - DNA, 22 bp, Artificial Sequence
  chemically synthesized
ccaatactactgtgctattcag

SEQ ID NO: 16037 - DNA, 22 bp, Artificial Sequence
  chemically synthesized
caatactactgtgctattcagg

SEQ ID NO: 16038 - DNA, 22 bp, Artificial Sequence
  chemically synthesized
ctgtgctattcaggaaagtatt

SEQ ID NO: 16039 - DNA, 22 bp, Artificial Sequence
  chemically synthesized
tgctattcaggaaagtattgca

SEQ ID NO: 16040 - DNA, 22 bp, Artificial Sequence
  chemically synthesized
ttcaggaaagtattgcagaagt

SEQ ID NO: 16041 - DNA, 22 bp, Artificial Sequence
  chemically synthesized
aggaaagtattgcagaagtgaa

SEQ ID NO: 16042 - DNA, 22 bp, Artificial Sequence
  chemically synthesized
cagaagtgaattaatttgtgcc

SEQ ID NO: 16043 - DNA, 22 bp, Artificial Sequence
  chemically synthesized
atttgtgccaattgaagagcat

SEQ ID NO: 16044 - DNA, 22 bp, Artificial Sequence
  chemically synthesized
gtgccaattgaagagcatgaca

SEQ ID NO: 16045 - DNA, 22 bp, Artificial Sequence
  chemically synthesized
tgccaattgaagagcatgacaa

SEQ ID NO: 16046 - DNA, 22 bp, Artificial Sequence
  chemically synthesized
aagagcatgacaaaagtacaaa

SEQ ID NO: 16047 - DNA, 22 bp, Artificial Sequence
  chemically synthesized
tcctcatgtcccctcaaggtca

SEQ ID NO: 16048 - DNA, 22 bp, Artificial Sequence
  chemically synthesized
ctcatgtcccctcaaggtcagt

SEQ ID NO: 16049 - DNA, 22 bp, Artificial Sequence
  chemically synthesized
atgtcccctcaaggtcagtttc

SEQ ID NO: 16050 - DNA, 22 bp, Artificial Sequence
  chemically synthesized
aaggtcagtttcatccataaca

SEQ ID NO: 16051 - DNA, 22 bp, Artificial Sequence
  chemically synthesized
catccataacaggtaaacgagg

SEQ ID NO: 16052 - DNA, 22 bp, Artificial Sequence
  chemically synthesized
atccataacaggtaaacgaggt

SEQ ID NO: 16053 - DNA, 22 bp, Artificial Sequence
  chemically synthesized
agcttctgtctgcaggggctgg

SEQ ID NO: 16054 - DNA, 22 bp, Artificial Sequence
  chemically synthesized
ctgtctgcaggggctgggacgc

SEQ ID NO: 16055 - DNA, 22 bp, Artificial Sequence
  chemically synthesized
tgtctgcaggggctgggacgct

SEQ ID NO: 16056 - DNA, 22 bp, Artificial Sequence
  chemically synthesized
tctgcaggggctgggacgctta

SEQ ID NO: 16057 - DNA, 22 bp, Artificial Sequence
  chemically synthesized
caggggctgggacgcttacctg

SEQ ID NO: 16058 - DNA, 22 bp, Artificial Sequence
  chemically synthesized
ggacgcttacctggtccagtct

SEQ ID NO: 16059 - DNA, 22 bp, Artificial Sequence
  chemically synthesized
acctggtccagtctcacaggtt

SEQ ID NO: 16060 - DNA, 22 bp, Artificial Sequence
  chemically synthesized
cctggtccagtctcacaggtta

SEQ ID NO: 16061 - DNA, 22 bp, Artificial Sequence
  chemically synthesized
gtccagtctcacaggttacagg

SEQ ID NO: 16062 - DNA, 22 bp, Artificial Sequence
  chemically synthesized
acaggttacagggaactgcttt

SEQ ID NO: 16063 - DNA, 22 bp, Artificial Sequence
  chemically synthesized
cagggaactgctttatcagggg

SEQ ID NO: 16064 - DNA, 22 bp, Artificial Sequence
  chemically synthesized
ctttatcaggggcacggaagtg

SEQ ID NO: 16065 - DNA, 22 bp, Artificial Sequence
  chemically synthesized
tatcaggggcacggaagtgttg

SEQ ID NO: 16066 - DNA, 22 bp, Artificial Sequence
  chemically synthesized
atcaggggcacggaagtgttgc

SEQ ID NO: 16067 - DNA, 22 bp, Artificial Sequence
  chemically synthesized
tcaggggcacggaagtgttgct

SEQ ID NO: 16068 - DNA, 22 bp, Artificial Sequence
  chemically synthesized
ctgtagtagtcagtatccaaaa

SEQ ID NO: 16069 - DNA, 22 bp, Artificial Sequence
  chemically synthesized
tagtagtcagtatccaaaaccc

SEQ ID NO: 16070 - DNA, 22 bp, Artificial Sequence
  chemically synthesized
tccaaagagaatcctatggaaa

SEQ ID NO: 16071 - DNA, 22 bp, Artificial Sequence
  chemically synthesized
tggaaaaacagaacaagtttct

SEQ ID NO: 16072 - DNA, 22 bp, Artificial Sequence
  chemically synthesized
ctggggttactgaatgaatgct

SEQ ID NO: 16073 - DNA, 22 bp, Artificial Sequence
  chemically synthesized
tggggttactgaatgaatgctt

SEQ ID NO: 16074 - DNA, 22 bp, Artificial Sequence
  chemically synthesized
gggttactgaatgaatgctttt

SEQ ID NO: 16075 - DNA, 22 bp, Artificial Sequence
  chemically synthesized
ctgaatgaatgcttttgcccaa

SEQ ID NO: 16076 - DNA, 22 bp, Artificial Sequence
  chemically synthesized
aatgaatgcttttgcccaaagc

SEQ ID NO: 16077 - DNA, 22 bp, Artificial Sequence
  chemically synthesized
ttgcccaaagcctacaccttca

SEQ ID NO: 16078 - DNA, 22 bp, Artificial Sequence
  chemically synthesized
tgcccaaagcctacaccttcaa

SEQ ID NO: 16079 - DNA, 22 bp, Artificial Sequence
  chemically synthesized
gcccaaagcctacaccttcaag

SEQ ID NO: 16080 - DNA, 22 bp, Artificial Sequence
  chemically synthesized
cccaaagcctacaccttcaaga

SEQ ID NO: 16081 - DNA, 22 bp, Artificial Sequence
  chemically synthesized
caccttcaagaagagtgtagcc

SEQ ID NO: 16082 - DNA, 22 bp, Artificial Sequence
  chemically synthesized
caagaagagtgtagcctgagaa

SEQ ID NO: 16083 - DNA, 22 bp, Artificial Sequence
  chemically synthesized
aagaagagtgtagcctgagaag

SEQ ID NO: 16084 - DNA, 22 bp, Artificial Sequence
  chemically synthesized
agaaggatttcacatgttgcct

SEQ ID NO: 16085 - DNA, 22 bp, Artificial Sequence
  chemically synthesized
cacatgttgcctctagaaggga

SEQ ID NO: 16086 - DNA, 22 bp, Artificial Sequence
  chemically synthesized
acatgttgcctctagaagggag

SEQ ID NO: 16087 - DNA, 22 bp, Artificial Sequence
  chemically synthesized
cctctagaagggagaactgggt

SEQ ID NO: 16088 - DNA, 22 bp, Artificial Sequence
  chemically synthesized
tagaagggagaactgggtggct

SEQ ID NO: 16089 - DNA, 22 bp, Artificial Sequence
  chemically synthesized
gaagggagaactgggtggctgg

SEQ ID NO: 16090 - DNA, 22 bp, Artificial Sequence
  chemically synthesized
ggtggctggggagaagtgtgag

SEQ ID NO: 16091 - DNA, 22 bp, Artificial Sequence
  chemically synthesized
gggagaagtgtgagagggagat

SEQ ID NO: 16092 - DNA, 22 bp, Artificial Sequence
  chemically synthesized
catgacacttccttatgtatgt

SEQ ID NO: 16093 - DNA, 22 bp, Artificial Sequence
  chemically synthesized
atgacacttccttatgtatgta

SEQ ID NO: 16094 - DNA, 22 bp, Artificial Sequence
  chemically synthesized
ccttatgtatgtaacttttgca

SEQ ID NO: 16095 - DNA, 22 bp, Artificial Sequence
  chemically synthesized
cttatgtatgtaacttttgcat

SEQ ID NO: 16096 - DNA, 22 bp, Artificial Sequence
  chemically synthesized
atgtatgtaacttttgcatttt

SEQ ID NO: 16097 - DNA, 22 bp, Artificial Sequence
  chemically synthesized
tgtatgtaacttttgcattttg

SEQ ID NO: 16098 - DNA, 22 bp, Artificial Sequence
  chemically synthesized
ttgcattttgaactgtttgaat

SEQ ID NO: 16099 - DNA, 22 bp, Artificial Sequence
  chemically synthesized
tgcattttgaactgtttgaatg

SEQ ID NO: 16100 - DNA, 22 bp, Artificial Sequence
  chemically synthesized
gcattttgaactgtttgaatgt

SEQ ID NO: 16101 - DNA, 22 bp, Artificial Sequence
  chemically synthesized
cattttgaactgtttgaatgta

SEQ ID NO: 16102 - DNA, 22 bp, Artificial Sequence
  chemically synthesized
tgaactgtttgaatgtattatc

SEQ ID NO: 16103 - DNA, 22 bp, Artificial Sequence
  chemically synthesized
gaactgtttgaatgtattatct

SEQ ID NO: 16104 - DNA, 22 bp, Artificial Sequence
  chemically synthesized
aactgtttgaatgtattatctt

SEQ ID NO: 16105 - DNA, 22 bp, Artificial Sequence
  chemically synthesized
tttgaatgtattatcttttttt

SEQ ID NO: 16106 - DNA, 22 bp, Artificial Sequence
  chemically synthesized
gaatgtattatctttttttttt

SEQ ID NO: 16107 - DNA, 22 bp, Artificial Sequence
  chemically synthesized
aatgtattatcttttttttttt

SEQ ID NO: 16108 - DNA, 22 bp, Artificial Sequence
  chemically synthesized
tcttttttttttttgagacagg

SEQ ID NO: 16109 - DNA, 22 bp, Artificial Sequence
  chemically synthesized
ttttttttttgagacaggatct

SEQ ID NO: 16110 - DNA, 22 bp, Artificial Sequence
  chemically synthesized
tttttttttgagacaggatctg

SEQ ID NO: 16111 - DNA, 22 bp, Artificial Sequence
  chemically synthesized
ttttttttgagacaggatctgg

SEQ ID NO: 16112 - DNA, 22 bp, Artificial Sequence
  chemically synthesized
tttttttgagacaggatctggc

SEQ ID NO: 16113 - DNA, 22 bp, Artificial Sequence
  chemically synthesized
ttttttgagacaggatctggct

SEQ ID NO: 16114 - DNA, 22 bp, Artificial Sequence
  chemically synthesized
tttttgagacaggatctggctc

SEQ ID NO: 16115 - DNA, 22 bp, Artificial Sequence
  chemically synthesized
ttttgagacaggatctggctca

SEQ ID NO: 16116 - DNA, 22 bp, Artificial Sequence
  chemically synthesized
tttgagacaggatctggctcag

SEQ ID NO: 16117 - DNA, 22 bp, Artificial Sequence
  chemically synthesized
ttgagacaggatctggctcagt

SEQ ID NO: 16118 - DNA, 22 bp, Artificial Sequence
  chemically synthesized
tgagacaggatctggctcagta

SEQ ID NO: 16119 - DNA, 22 bp, Artificial Sequence
  chemically synthesized
gagacaggatctggctcagtaa

SEQ ID NO: 16120 - DNA, 22 bp, Artificial Sequence
  chemically synthesized
agacaggatctggctcagtaac

SEQ ID NO: 16121 - DNA, 22 bp, Artificial Sequence
  chemically synthesized
gctcagtaacccagcctggagt

SEQ ID NO: 16122 - DNA, 22 bp, Artificial Sequence
  chemically synthesized
agtaacccagcctggagtgcag

SEQ ID NO: 16123 - DNA, 22 bp, Artificial Sequence
  chemically synthesized
gagtgcagtggcgcaatctcgg

SEQ ID NO: 16124 - DNA, 22 bp, Artificial Sequence
  chemically synthesized
ggctcattgtgacctctacctc

SEQ ID NO: 16125 - DNA, 22 bp, Artificial Sequence
  chemically synthesized
attgtgacctctacctcctggg

SEQ ID NO: 16126 - DNA, 22 bp, Artificial Sequence
  chemically synthesized
tgacctctacctcctgggatcc

SEQ ID NO: 16127 - DNA, 22 bp, Artificial Sequence
  chemically synthesized
tacctcctgggatcctcccacc

SEQ ID NO: 16128 - DNA, 22 bp, Artificial Sequence
  chemically synthesized
cctcctgggatcctcccacctc

SEQ ID NO: 16129 - DNA, 22 bp, Artificial Sequence
  chemically synthesized
ctgggatcctcccacctcagcc

SEQ ID NO: 16130 - DNA, 22 bp, Artificial Sequence
  chemically synthesized
ggatcctcccacctcagcctcc

SEQ ID NO: 16131 - DNA, 22 bp, Artificial Sequence
  chemically synthesized
ccacctcagcctcctgaatagc

SEQ ID NO: 16132 - DNA, 22 bp, Artificial Sequence
  chemically synthesized
agcctcctgaatagctgggact

SEQ ID NO: 16133 - DNA, 22 bp, Artificial Sequence
  chemically synthesized
ctgaatagctgggactacaggt

SEQ ID NO: 16134 - DNA, 22 bp, Artificial Sequence
  chemically synthesized
aatagctgggactacaggtgtg

SEQ ID NO: 16135 - DNA, 22 bp, Artificial Sequence
  chemically synthesized
ggactacaggtgtgtgccacca

SEQ ID NO: 16136 - DNA, 22 bp, Artificial Sequence
  chemically synthesized
caggtgtgtgccaccacatcca

SEQ ID NO: 16137 - DNA, 22 bp, Artificial Sequence
  chemically synthesized
gtttttgtatttttagtagaga

SEQ ID NO: 16138 - DNA, 22 bp, Artificial Sequence
  chemically synthesized
ttgtatttttagtagagacggg

SEQ ID NO: 16139 - DNA, 22 bp, Artificial Sequence
  chemically synthesized
tgtatttttagtagagacgggg

SEQ ID NO: 16140 - DNA, 22 bp, Artificial Sequence
  chemically synthesized
gtatttttagtagagacggggt

SEQ ID NO: 16141 - DNA, 22 bp, Artificial Sequence
  chemically synthesized
tatttttagtagagacggggtt

SEQ ID NO: 16142 - DNA, 22 bp, Artificial Sequence
  chemically synthesized
ttagtagagacggggtttcacc

SEQ ID NO: 16143 - DNA, 22 bp, Artificial Sequence
  chemically synthesized
tagtagagacggggtttcacca

SEQ ID NO: 16144 - DNA, 22 bp, Artificial Sequence
  chemically synthesized
agtagagacggggtttcaccat

SEQ ID NO: 16145 - DNA, 22 bp, Artificial Sequence
  chemically synthesized
gtagagacggggtttcaccatg

SEQ ID NO: 16146 - DNA, 22 bp, Artificial Sequence
  chemically synthesized
caccatgttgcccaggctggtc

SEQ ID NO: 16147 - DNA, 22 bp, Artificial Sequence
  chemically synthesized
accatgttgcccaggctggtct

SEQ ID NO: 16148 - DNA, 22 bp, Artificial Sequence
  chemically synthesized
cccaggctggtctccatctcct

SEQ ID NO: 16149 - DNA, 22 bp, Artificial Sequence
  chemically synthesized
gtctccatctcctgaactcagg

SEQ ID NO: 16150 - DNA, 22 bp, Artificial Sequence
  chemically synthesized
catctcctgaactcaggcaatc

SEQ ID NO: 16151 - DNA, 22 bp, Artificial Sequence
  chemically synthesized
ctgaactcaggcaatcctccca

SEQ ID NO: 16152 - DNA, 22 bp, Artificial Sequence
  chemically synthesized
aactcaggcaatcctcccacct

SEQ ID NO: 16153 - DNA, 22 bp, Artificial Sequence
  chemically synthesized
aggcaatcctcccacctcagcc

SEQ ID NO: 16154 - DNA, 22 bp, Artificial Sequence
  chemically synthesized
ccacctcagcctcccaaagtgc

SEQ ID NO: 16155 - DNA, 22 bp, Artificial Sequence
  chemically synthesized
agcctcccaaagtgctgggatt

SEQ ID NO: 16156 - DNA, 22 bp, Artificial Sequence
  chemically synthesized
ccaaagtgctgggattacaggc

SEQ ID NO: 16157 - DNA, 22 bp, Artificial Sequence
  chemically synthesized
ggattacaggcatgagccaccg

SEQ ID NO: 16158 - DNA, 22 bp, Artificial Sequence
  chemically synthesized
caggcatgagccaccgtgcctg

SEQ ID NO: 16159 - DNA, 22 bp, Artificial Sequence
  chemically synthesized
actgtatgatctatttaaacac

SEQ ID NO: 16160 - DNA, 22 bp, Artificial Sequence
  chemically synthesized
tatgatctatttaaacacaaat

SEQ ID NO: 16161 - DNA, 22 bp, Artificial Sequence
  chemically synthesized
tttaaacacaaataatgaagcc

SEQ ID NO: 16162 - DNA, 22 bp, Artificial Sequence
  chemically synthesized
aaacacaaataatgaagcccaa

SEQ ID NO: 16163 - DNA, 22 bp, Artificial Sequence
  chemically synthesized
aacacaaataatgaagcccaag

SEQ ID NO: 16164 - DNA, 22 bp, Artificial Sequence
  chemically synthesized
tgaactccaggcaggcgcggtg

SEQ ID NO: 16165 - DNA, 22 bp, Artificial Sequence
  chemically synthesized
aactccaggcaggcgcggtggc

SEQ ID NO: 16166 - DNA, 22 bp, Artificial Sequence
  chemically synthesized
caggcaggcgcggtggctcaca

SEQ ID NO: 16167 - DNA, 22 bp, Artificial Sequence
  chemically synthesized
acacctgtaatctcagcacttt

SEQ ID NO: 16168 - DNA, 22 bp, Artificial Sequence
  chemically synthesized
taatctcagcactttgggaggc

SEQ ID NO: 16169 - DNA, 22 bp, Artificial Sequence
  chemically synthesized
agcactttgggaggccaaggca

SEQ ID NO: 16170 - DNA, 22 bp, Artificial Sequence
  chemically synthesized
tgggaggccaaggcaggcagat

SEQ ID NO: 16171 - DNA, 22 bp, Artificial Sequence
  chemically synthesized
gggaggccaaggcaggcagatc

SEQ ID NO: 16172 - DNA, 22 bp, Artificial Sequence
  chemically synthesized
ggaggccaaggcaggcagatca

SEQ ID NO: 16173 - DNA, 22 bp, Artificial Sequence
  chemically synthesized
gagaccagcctggccaacatgg

SEQ ID NO: 16174 - DNA, 22 bp, Artificial Sequence
  chemically synthesized
agaccagcctggccaacatggt

SEQ ID NO: 16175 - DNA, 22 bp, Artificial Sequence
  chemically synthesized
gccaacatggtgaaacaccgtt

SEQ ID NO: 16176 - DNA, 22 bp, Artificial Sequence
  chemically synthesized
ctaccaaaaaatataaagaatt

SEQ ID NO: 16177 - DNA, 22 bp, Artificial Sequence
  chemically synthesized
taccaaaaaatataaagaatta

SEQ ID NO: 16178 - DNA, 22 bp, Artificial Sequence
  chemically synthesized
ccaaaaaatataaagaattagc

SEQ ID NO: 16179 - DNA, 22 bp, Artificial Sequence
  chemically synthesized
gccagatgtggtggtgcgtgac

SEQ ID NO: 16180 - DNA, 22 bp, Artificial Sequence
  chemically synthesized
taatcccagctactcgggaggc

SEQ ID NO: 16181 - DNA, 22 bp, Artificial Sequence
  chemically synthesized
ctcgggaggctaaggcaagaga

SEQ ID NO: 16182 - DNA, 22 bp, Artificial Sequence
  chemically synthesized
gggaggctaaggcaagagaatc

SEQ ID NO: 16183 - DNA, 22 bp, Artificial Sequence
  chemically synthesized
aggcaagagaatcgcttgaacc

SEQ ID NO: 16184 - DNA, 22 bp, Artificial Sequence
  chemically synthesized
gaacctgggaggcggaggttgc

SEQ ID NO: 16185 - DNA, 22 bp, Artificial Sequence
  chemically synthesized
aacctgggaggcggaggttgcc

SEQ ID NO: 16186 - DNA, 22 bp, Artificial Sequence
  chemically synthesized
ggaggcggaggttgccgtgagc

SEQ ID NO: 16187 - DNA, 22 bp, Artificial Sequence
  chemically synthesized
ccgtgagccgagattatgccac

SEQ ID NO: 16188 - DNA, 22 bp, Artificial Sequence
  chemically synthesized
tgccactgcactacaggctggg

SEQ ID NO: 16189 - DNA, 22 bp, Artificial Sequence
  chemically synthesized
cactacaggctgggtgacagag

SEQ ID NO: 16190 - DNA, 22 bp, Artificial Sequence
  chemically synthesized
caggctgggtgacagagcaaga

SEQ ID NO: 16191 - DNA, 22 bp, Artificial Sequence
  chemically synthesized
ggtgacagagcaagactccatc

SEQ ID NO: 16192 - DNA, 22 bp, Artificial Sequence
  chemically synthesized
catctcaaaaaaaaaaaaaaaa

SEQ ID NO: 16193 - DNA, 22 bp, Artificial Sequence
  chemically synthesized
aaaaaaaaaaaaaaaaaaatcc

SEQ ID NO: 16194 - DNA, 22 bp, Artificial Sequence
  chemically synthesized
aaatccataaaatggcagctat

SEQ ID NO: 16195 - DNA, 22 bp, Artificial Sequence
  chemically synthesized
tgtgactttttttttttaacct

SEQ ID NO: 16196 - DNA, 22 bp, Artificial Sequence
  chemically synthesized
tttttttttaacctcaagaagt

SEQ ID NO: 16197 - DNA, 22 bp, Artificial Sequence
  chemically synthesized
ttttttttaacctcaagaagta

SEQ ID NO: 16198 - DNA, 22 bp, Artificial Sequence
  chemically synthesized
tttttttaacctcaagaagtat

SEQ ID NO: 16199 - DNA, 22 bp, Artificial Sequence
  chemically synthesized
ttttttaacctcaagaagtatt

SEQ ID NO: 16200 - DNA, 22 bp, Artificial Sequence
  chemically synthesized
tttttaacctcaagaagtattt

SEQ ID NO: 16201 - DNA, 22 bp, Artificial Sequence
  chemically synthesized
ttttaacctcaagaagtatttg

SEQ ID NO: 16202 - DNA, 22 bp, Artificial Sequence
  chemically synthesized
tttaacctcaagaagtatttgt

SEQ ID NO: 16203 - DNA, 22 bp, Artificial Sequence
  chemically synthesized
ttaacctcaagaagtatttgtc

SEQ ID NO: 16204 - DNA, 22 bp, Artificial Sequence
  chemically synthesized
taacctcaagaagtatttgtcc

SEQ ID NO: 16205 - DNA, 22 bp, Artificial Sequence
  chemically synthesized
aacctcaagaagtatttgtcct

SEQ ID NO: 16206 - DNA, 22 bp, Artificial Sequence
  chemically synthesized
acctcaagaagtatttgtcctg

SEQ ID NO: 16207 - DNA, 22 bp, Artificial Sequence
  chemically synthesized
aagaagtatttgtcctggaaga

SEQ ID NO: 16208 - DNA, 22 bp, Artificial Sequence
  chemically synthesized
gtcctggaagaatgcatatgga

SEQ ID NO: 16209 - DNA, 22 bp, Artificial Sequence
  chemically synthesized
tcctggaagaatgcatatggaa

SEQ ID NO: 16210 - DNA, 22 bp, Artificial Sequence
  chemically synthesized
gaagaatgcatatggaactaca

SEQ ID NO: 16211 - DNA, 22 bp, Artificial Sequence
  chemically synthesized
cagtttgaaacttggacttgca

SEQ ID NO: 16212 - DNA, 22 bp, Artificial Sequence
  chemically synthesized
gaaacttggacttgcatatacc

SEQ ID NO: 16213 - DNA, 22 bp, Artificial Sequence
  chemically synthesized
aaacttggacttgcatatacca

SEQ ID NO: 16214 - DNA, 22 bp, Artificial Sequence
  chemically synthesized
ggacttgcatataccatgggtt

SEQ ID NO: 16215 - DNA, 22 bp, Artificial Sequence
  chemically synthesized
gacttgcatataccatgggttc

SEQ ID NO: 16216 - DNA, 22 bp, Artificial Sequence
  chemically synthesized
gcatataccatgggttccctca

SEQ ID NO: 16217 - DNA, 22 bp, Artificial Sequence
  chemically synthesized
catataccatgggttccctcag

SEQ ID NO: 16218 - DNA, 22 bp, Artificial Sequence
  chemically synthesized
cctcaggcctcagggaatcttg

SEQ ID NO: 16219 - DNA, 22 bp, Artificial Sequence
  chemically synthesized
aggcctcagggaatcttgcatt

SEQ ID NO: 16220 - DNA, 22 bp, Artificial Sequence
  chemically synthesized
agggaatcttgcatttcctctg

SEQ ID NO: 16221 - DNA, 22 bp, Artificial Sequence
  chemically synthesized
gcatttcctctgacatcagaga

SEQ ID NO: 16222 - DNA, 22 bp, Artificial Sequence
  chemically synthesized
catttcctctgacatcagagaa

SEQ ID NO: 16223 - DNA, 22 bp, Artificial Sequence
  chemically synthesized
cctctgacatcagagaatgcac

SEQ ID NO: 16224 - DNA, 22 bp, Artificial Sequence
  chemically synthesized
ctctgacatcagagaatgcact

SEQ ID NO: 16225 - DNA, 22 bp, Artificial Sequence
  chemically synthesized
tgacatcagagaatgcactcca

SEQ ID NO: 16226 - DNA, 22 bp, Artificial Sequence
  chemically synthesized
acatcagagaatgcactccagc

SEQ ID NO: 16227 - DNA, 22 bp, Artificial Sequence
  chemically synthesized
cagcccctaggacgagcccccc

SEQ ID NO: 16228 - DNA, 22 bp, Artificial Sequence
  chemically synthesized
ggacgagccccccccagggaaa

SEQ ID NO: 16229 - DNA, 22 bp, Artificial Sequence
  chemically synthesized
catttccatcagaattgctctc

SEQ ID NO: 16230 - DNA, 22 bp, Artificial Sequence
  chemically synthesized
ccatcagaattgctctctgtaa

SEQ ID NO: 16231 - DNA, 22 bp, Artificial Sequence
  chemically synthesized
catcagaattgctctctgtaag

SEQ ID NO: 16232 - DNA, 22 bp, Artificial Sequence
  chemically synthesized
ctctctgtaaggatgtatatag

SEQ ID NO: 16233 - DNA, 22 bp, Artificial Sequence
  chemically synthesized
tctgtaaggatgtatatagctt

SEQ ID NO: 16234 - DNA, 22 bp, Artificial Sequence
  chemically synthesized
tgtaaggatgtatatagcttca

SEQ ID NO: 16235 - DNA, 22 bp, Artificial Sequence
  chemically synthesized
taaggatgtatatagcttcaga

SEQ ID NO: 16236 - DNA, 22 bp, Artificial Sequence
  chemically synthesized
cagatgcttgttctgtatcctc

SEQ ID NO: 16237 - DNA, 22 bp, Artificial Sequence
  chemically synthesized
agatgcttgttctgtatcctct

SEQ ID NO: 16238 - DNA, 22 bp, Artificial Sequence
  chemically synthesized
gttctgtatcctctctactttg

SEQ ID NO: 16239 - DNA, 22 bp, Artificial Sequence
  chemically synthesized
ttctgtatcctctctactttga

SEQ ID NO: 16240 - DNA, 22 bp, Artificial Sequence
  chemically synthesized
tgtatcctctctactttgaaac

SEQ ID NO: 16241 - DNA, 22 bp, Artificial Sequence
  chemically synthesized
tatcctctctactttgaaacag

SEQ ID NO: 16242 - DNA, 22 bp, Artificial Sequence
  chemically synthesized
tctactttgaaacagagtatct

SEQ ID NO: 16243 - DNA, 22 bp, Artificial Sequence
  chemically synthesized
tactttgaaacagagtatctca

SEQ ID NO: 16244 - DNA, 22 bp, Artificial Sequence
  chemically synthesized
ctttgaaacagagtatctcaga

SEQ ID NO: 16245 - DNA, 22 bp, Artificial Sequence
  chemically synthesized
tgaaacagagtatctcagacaa

SEQ ID NO: 16246 - DNA, 22 bp, Artificial Sequence
  chemically synthesized
gaaacagagtatctcagacaaa

SEQ ID NO: 16247 - DNA, 22 bp, Artificial Sequence
  chemically synthesized
aaacagagtatctcagacaaac

SEQ ID NO: 16248 - DNA, 22 bp, Artificial Sequence
  chemically synthesized
agacaaaccacttcccctttaa

SEQ ID NO: 16249 - DNA, 22 bp, Artificial Sequence
  chemically synthesized
cccctttaaaagtactagatat

SEQ ID NO: 16250 - DNA, 22 bp, Artificial Sequence
  chemically synthesized
ccctttaaaagtactagatata

SEQ ID NO: 16251 - DNA, 22 bp, Artificial Sequence
  chemically synthesized
taaaagtactagatatatcttt

SEQ ID NO: 16252 - DNA, 22 bp, Artificial Sequence
  chemically synthesized
aaaagtactagatatatctttc

SEQ ID NO: 16253 - DNA, 22 bp, Artificial Sequence
  chemically synthesized
aaagtactagatatatctttca

SEQ ID NO: 16254 - DNA, 22 bp, Artificial Sequence
  chemically synthesized
gatatatctttcactgtggaaa

SEQ ID NO: 16255 - DNA, 22 bp, Artificial Sequence
  chemically synthesized
tcactgtggaaataggtgtcaa

SEQ ID NO: 16256 - DNA, 22 bp, Artificial Sequence
  chemically synthesized
cactgtggaaataggtgtcaac

SEQ ID NO: 16257 - DNA, 22 bp, Artificial Sequence
  chemically synthesized
actgtggaaataggtgtcaacc

SEQ ID NO: 16258 - DNA, 22 bp, Artificial Sequence
  chemically synthesized
tggaaataggtgtcaaccgcca

SEQ ID NO: 16259 - DNA, 22 bp, Artificial Sequence
  chemically synthesized
ttatcccgtgatggtggaatag

SEQ ID NO: 16260 - DNA, 22 bp, Artificial Sequence
  chemically synthesized
tatcccgtgatggtggaatagt

SEQ ID NO: 16261 - DNA, 22 bp, Artificial Sequence
  chemically synthesized
atcccgtgatggtggaatagtg

SEQ ID NO: 16262 - DNA, 22 bp, Artificial Sequence
  chemically synthesized
tcccgtgatggtggaatagtga

SEQ ID NO: 16263 - DNA, 22 bp, Artificial Sequence
  chemically synthesized
ctcaccgaaatcagggagagcc

SEQ ID NO: 16264 - DNA, 22 bp, Artificial Sequence
  chemically synthesized
tcaccgaaatcagggagagcca

SEQ ID NO: 16265 - DNA, 22 bp, Artificial Sequence
  chemically synthesized
accgaaatcagggagagccact

SEQ ID NO: 16266 - DNA, 22 bp, Artificial Sequence
  chemically synthesized
actctggcctctatcaacccag

SEQ ID NO: 16267 - DNA, 22 bp, Artificial Sequence
  chemically synthesized
tggcctctatcaacccagagag

SEQ ID NO: 16268 - DNA, 22 bp, Artificial Sequence
  chemically synthesized
gcctctatcaacccagagagat

SEQ ID NO: 16269 - DNA, 22 bp, Artificial Sequence
  chemically synthesized
tatcaacccagagagattgcat

SEQ ID NO: 16270 - DNA, 22 bp, Artificial Sequence
  chemically synthesized
tcaacccagagagattgcatgg

SEQ ID NO: 16271 - DNA, 22 bp, Artificial Sequence
  chemically synthesized
catggttcttcaatggagatca

SEQ ID NO: 16272 - DNA, 22 bp, Artificial Sequence
  chemically synthesized
ttcaatggagatcagatgtttg

SEQ ID NO: 16273 - DNA, 22 bp, Artificial Sequence
  chemically synthesized
caatggagatcagatgtttgga

SEQ ID NO: 16274 - DNA, 22 bp, Artificial Sequence
  chemically synthesized
aatggagatcagatgtttggaa

SEQ ID NO: 16275 - DNA, 22 bp, Artificial Sequence
  chemically synthesized
ggaataacacttcatcttttta

SEQ ID NO: 16276 - DNA, 22 bp, Artificial Sequence
  chemically synthesized
gaataacacttcatctttttat

SEQ ID NO: 16277 - DNA, 22 bp, Artificial Sequence
  chemically synthesized
catctttttattttttagaatc

SEQ ID NO: 16278 - DNA, 22 bp, Artificial Sequence
  chemically synthesized
atctttttattttttagaatca

SEQ ID NO: 16279 - DNA, 22 bp, Artificial Sequence
  chemically synthesized
tttattttttagaatcatgcgg

SEQ ID NO: 16280 - DNA, 22 bp, Artificial Sequence
  chemically synthesized
ttattttttagaatcatgcggc

SEQ ID NO: 16281 - DNA, 22 bp, Artificial Sequence
  chemically synthesized
tattttttagaatcatgcggct

SEQ ID NO: 16282 - DNA, 22 bp, Artificial Sequence
  chemically synthesized
attttttagaatcatgcggctg

SEQ ID NO: 16283 - DNA, 22 bp, Artificial Sequence
  chemically synthesized
ttttttagaatcatgcggctgg

SEQ ID NO: 16284 - DNA, 22 bp, Artificial Sequence
  chemically synthesized
tttagaatcatgcggctgggtg

SEQ ID NO: 16285 - DNA, 22 bp, Artificial Sequence
  chemically synthesized
ttagaatcatgcggctgggtgt

SEQ ID NO: 16286 - DNA, 22 bp, Artificial Sequence
  chemically synthesized
tagaatcatgcggctgggtgta

SEQ ID NO: 16287 - DNA, 22 bp, Artificial Sequence
  chemically synthesized
agaatcatgcggctgggtgtag

SEQ ID NO: 16288 - DNA, 22 bp, Artificial Sequence
  chemically synthesized
gaatcatgcggctgggtgtagt

SEQ ID NO: 16289 - DNA, 22 bp, Artificial Sequence
  chemically synthesized
ggtgtagtggctcacgcctgta

SEQ ID NO: 16290 - DNA, 22 bp, Artificial Sequence
  chemically synthesized
acgcctgtaatcctagcactta

SEQ ID NO: 16291 - DNA, 22 bp, Artificial Sequence
  chemically synthesized
taatcctagcacttagggaggc

SEQ ID NO: 16292 - DNA, 22 bp, Artificial Sequence
  chemically synthesized
gcacttagggaggccaaggcag

SEQ ID NO: 16293 - DNA, 22 bp, Artificial Sequence
  chemically synthesized
agggaggccaaggcaggcagat

SEQ ID NO: 16294 - DNA, 22 bp, Artificial Sequence
  chemically synthesized
gggaggccaaggcaggcagatc

SEQ ID NO: 16295 - DNA, 22 bp, Artificial Sequence
  chemically synthesized
gagaccagcctagtcaacatag

SEQ ID NO: 16296 - DNA, 22 bp, Artificial Sequence
  chemically synthesized
gtcaacatagtgaaaccatgtc

SEQ ID NO: 16297 - DNA, 22 bp, Artificial Sequence
  chemically synthesized
tactaaaaatacaaaaaaaatt

SEQ ID NO: 16298 - DNA, 22 bp, Artificial Sequence
  chemically synthesized
ctaaaaatacaaaaaaaattag

SEQ ID NO: 16299 - DNA, 22 bp, Artificial Sequence
  chemically synthesized
aaaatacaaaaaaaattagctg

SEQ ID NO: 16300 - DNA, 22 bp, Artificial Sequence
  chemically synthesized
gctgggcatggtggcgggcacc

SEQ ID NO: 16301 - DNA, 22 bp, Artificial Sequence
  chemically synthesized
ggcatggtggcgggcacctgta

SEQ ID NO: 16302 - DNA, 22 bp, Artificial Sequence
  chemically synthesized
taatcccagctacttgggaggc

SEQ ID NO: 16303 - DNA, 22 bp, Artificial Sequence
  chemically synthesized
cttgggaggctgaggcaggaga

SEQ ID NO: 16304 - DNA, 22 bp, Artificial Sequence
  chemically synthesized
gggaggctgaggcaggagaatc

SEQ ID NO: 16305 - DNA, 22 bp, Artificial Sequence
  chemically synthesized
ggaggctgaggcaggagaatca

SEQ ID NO: 16306 - DNA, 22 bp, Artificial Sequence
  chemically synthesized
aggcaggagaatcacttgaacc

SEQ ID NO: 16307 - DNA, 22 bp, Artificial Sequence
  chemically synthesized
gaaccggagaggcagaggttgc

SEQ ID NO: 16308 - DNA, 22 bp, Artificial Sequence
  chemically synthesized
aaccggagaggcagaggttgca

SEQ ID NO: 16309 - DNA, 22 bp, Artificial Sequence
  chemically synthesized
cagtgagctgagattgcaccat

SEQ ID NO: 16310 - DNA, 22 bp, Artificial Sequence
  chemically synthesized
agattgcaccattgcactccag

SEQ ID NO: 16311 - DNA, 22 bp, Artificial Sequence
  chemically synthesized
caccattgcactccagccaggc

SEQ ID NO: 16312 - DNA, 22 bp, Artificial Sequence
  chemically synthesized
cactccagccaggcaacagtgc

SEQ ID NO: 16313 - DNA, 22 bp, Artificial Sequence
  chemically synthesized
cagccaggcaacagtgcgagac

SEQ ID NO: 16314 - DNA, 22 bp, Artificial Sequence
  chemically synthesized
catctcaaacaaacaaacaaaa

SEQ ID NO: 16315 - DNA, 22 bp, Artificial Sequence
  chemically synthesized
aaacaaacaaacaaaagaaaga

SEQ ID NO: 16316 - DNA, 22 bp, Artificial Sequence
  chemically synthesized
acgtgatagaaattggcaaatg

SEQ ID NO: 16317 - DNA, 22 bp, Artificial Sequence
  chemically synthesized
cgtgatagaaattggcaaatgc

SEQ ID NO: 16318 - DNA, 22 bp, Artificial Sequence
  chemically synthesized
gcaaatgctaaactcagggctt

SEQ ID NO: 16319 - DNA, 22 bp, Artificial Sequence
  chemically synthesized
aactcagggctttcccctgctc

SEQ ID NO: 16320 - DNA, 22 bp, Artificial Sequence
  chemically synthesized
agggctttcccctgctccccag

SEQ ID NO: 16321 - DNA, 22 bp, Artificial Sequence
  chemically synthesized
tcccctgctccccagagagtca

SEQ ID NO: 16322 - DNA, 22 bp, Artificial Sequence
  chemically synthesized
cccctgctccccagagagtcag

SEQ ID NO: 16323 - DNA, 22 bp, Artificial Sequence
  chemically synthesized
ccctgctccccagagagtcagt

SEQ ID NO: 16324 - DNA, 22 bp, Artificial Sequence
  chemically synthesized
ctccccagagagtcagtttatc

SEQ ID NO: 16325 - DNA, 22 bp, Artificial Sequence
  chemically synthesized
cccagagagtcagtttatcagc

SEQ ID NO: 16326 - DNA, 22 bp, Artificial Sequence
  chemically synthesized
atcagcactggacgtaacatag

SEQ ID NO: 16327 - DNA, 22 bp, Artificial Sequence
  chemically synthesized
tcagcactggacgtaacatagt

SEQ ID NO: 16328 - DNA, 22 bp, Artificial Sequence
  chemically synthesized
gacgtaacatagttcataagag

SEQ ID NO: 16329 - DNA, 22 bp, Artificial Sequence
  chemically synthesized
ataagagcattgccgcggaagc

SEQ ID NO: 16330 - DNA, 22 bp, Artificial Sequence
  chemically synthesized
ccgcggaagccagcctgcctac

SEQ ID NO: 16331 - DNA, 22 bp, Artificial Sequence
  chemically synthesized
cctacctgggcttccatcctgg

SEQ ID NO: 16332 - DNA, 22 bp, Artificial Sequence
  chemically synthesized
cctgggcttccatcctggctcg

SEQ ID NO: 16333 - DNA, 22 bp, Artificial Sequence
  chemically synthesized
ggcttccatcctggctcggcat

SEQ ID NO: 16334 - DNA, 22 bp, Artificial Sequence
  chemically synthesized
ccatcctggctcggcatgtact

SEQ ID NO: 16335 - DNA, 22 bp, Artificial Sequence
  chemically synthesized
catcctggctcggcatgtacta

SEQ ID NO: 16336 - DNA, 22 bp, Artificial Sequence
  chemically synthesized
gctcggcatgtactaaccttgt

SEQ ID NO: 16337 - DNA, 22 bp, Artificial Sequence
  chemically synthesized
ggcatgtactaaccttgttggc

SEQ ID NO: 16338 - DNA, 22 bp, Artificial Sequence
  chemically synthesized
accttgttggcctaatcattta

SEQ ID NO: 16339 - DNA, 22 bp, Artificial Sequence
  chemically synthesized
gttggcctaatcatttaactca

SEQ ID NO: 16340 - DNA, 22 bp, Artificial Sequence
  chemically synthesized
ttggcctaatcatttaactcag

SEQ ID NO: 16341 - DNA, 22 bp, Artificial Sequence
  chemically synthesized
gcctaatcatttaactcagcac

SEQ ID NO: 16342 - DNA, 22 bp, Artificial Sequence
  chemically synthesized
atcatttaactcagcaccttgg

SEQ ID NO: 16343 - DNA, 22 bp, Artificial Sequence
  chemically synthesized
aactcagcaccttggtctctgc

SEQ ID NO: 16344 - DNA, 22 bp, Artificial Sequence
  chemically synthesized
actcagcaccttggtctctgca

SEQ ID NO: 16345 - DNA, 22 bp, Artificial Sequence
  chemically synthesized
agcaccttggtctctgcatcta

SEQ ID NO: 16346 - DNA, 22 bp, Artificial Sequence
  chemically synthesized
ggtctctgcatctactgtttct

SEQ ID NO: 16347 - DNA, 22 bp, Artificial Sequence
  chemically synthesized
gtctctgcatctactgtttctg

SEQ ID NO: 16348 - DNA, 22 bp, Artificial Sequence
  chemically synthesized
tgcatctactgtttctgtaaat

SEQ ID NO: 16349 - DNA, 22 bp, Artificial Sequence
  chemically synthesized
catctactgtttctgtaaatag

SEQ ID NO: 16350 - DNA, 22 bp, Artificial Sequence
  chemically synthesized
ctgtttctgtaaatagcagtaa

SEQ ID NO: 16351 - DNA, 22 bp, Artificial Sequence
  chemically synthesized
tttctgtaaatagcagtaacta

SEQ ID NO: 16352 - DNA, 22 bp, Artificial Sequence
  chemically synthesized
ctgtaaatagcagtaactacct

SEQ ID NO: 16353 - DNA, 22 bp, Artificial Sequence
  chemically synthesized
tgtaaatagcagtaactacctc

SEQ ID NO: 16354 - DNA, 22 bp, Artificial Sequence
  chemically synthesized
taaatagcagtaactacctcac

SEQ ID NO: 16355 - DNA, 22 bp, Artificial Sequence
  chemically synthesized
cctcacagaaaagcacatagca

SEQ ID NO: 16356 - DNA, 22 bp, Artificial Sequence
  chemically synthesized
acagaaaagcacatagcacatg

SEQ ID NO: 16357 - DNA, 22 bp, Artificial Sequence
  chemically synthesized
gcacacactgtttaataaatgt

SEQ ID NO: 16358 - DNA, 22 bp, Artificial Sequence
  chemically synthesized
tttaataaatgttaaccctgat

SEQ ID NO: 16359 - DNA, 22 bp, Artificial Sequence
  chemically synthesized
aataaatgttaaccctgattat

SEQ ID NO: 16360 - DNA, 22 bp, Artificial Sequence
  chemically synthesized
ataaatgttaaccctgattatt

SEQ ID NO: 16361 - DNA, 22 bp, Artificial Sequence
  chemically synthesized
accctgattattattaagctgc

SEQ ID NO: 16362 - DNA, 22 bp, Artificial Sequence
  chemically synthesized
attattattaagctgccagaga

SEQ ID NO: 16363 - DNA, 22 bp, Artificial Sequence
  chemically synthesized
ttattaagctgccagagataac

SEQ ID NO: 16364 - DNA, 22 bp, Artificial Sequence
  chemically synthesized
ttaagctgccagagataaccta

SEQ ID NO: 16365 - DNA, 22 bp, Artificial Sequence
  chemically synthesized
agctgccagagataacctattt

SEQ ID NO: 16366 - DNA, 22 bp, Artificial Sequence
  chemically synthesized
ccagagataacctatttgtaga

SEQ ID NO: 16367 - DNA, 22 bp, Artificial Sequence
  chemically synthesized
tttgtagattataaaacagaaa

SEQ ID NO: 16368 - DNA, 22 bp, Artificial Sequence
  chemically synthesized
gtagattataaaacagaaactc

SEQ ID NO: 16369 - DNA, 22 bp, Artificial Sequence
  chemically synthesized
tagattataaaacagaaactca

SEQ ID NO: 16370 - DNA, 22 bp, Artificial Sequence
  chemically synthesized
taaaacagaaactcagataatt

SEQ ID NO: 16371 - DNA, 22 bp, Artificial Sequence
  chemically synthesized
agataattgatatgacttgcca

SEQ ID NO: 16372 - DNA, 22 bp, Artificial Sequence
  chemically synthesized
atatgacttgccaaggacatgt

SEQ ID NO: 16373 - DNA, 22 bp, Artificial Sequence
  chemically synthesized
gccaaggacatgtagttggtgg

SEQ ID NO: 16374 - DNA, 22 bp, Artificial Sequence
  chemically synthesized
ccaaggacatgtagttggtggg

SEQ ID NO: 16375 - DNA, 22 bp, Artificial Sequence
  chemically synthesized
gtgggtggcagaacgagggctg

SEQ ID NO: 16376 - DNA, 22 bp, Artificial Sequence
  chemically synthesized
gagcccagttcccagggtgact

SEQ ID NO: 16377 - DNA, 22 bp, Artificial Sequence
  chemically synthesized
ccagggtgacttttcattaccc

SEQ ID NO: 16378 - DNA, 22 bp, Artificial Sequence
  chemically synthesized
ttcattaccccacaaaacaggc

SEQ ID NO: 16379 - DNA, 22 bp, Artificial Sequence
  chemically synthesized
tcattaccccacaaaacaggct

SEQ ID NO: 16380 - DNA, 22 bp, Artificial Sequence
  chemically synthesized
cattaccccacaaaacaggctg

SEQ ID NO: 16381 - DNA, 22 bp, Artificial Sequence
  chemically synthesized
attaccccacaaaacaggctgt

SEQ ID NO: 16382 - DNA, 22 bp, Artificial Sequence
  chemically synthesized
ccccacaaaacaggctgttgaa

SEQ ID NO: 16383 - DNA, 22 bp, Artificial Sequence
  chemically synthesized
ttgaatcatctgtgtgtttcct

SEQ ID NO: 16384 - DNA, 22 bp, Artificial Sequence
  chemically synthesized
aatcatctgtgtgtttcctttt

SEQ ID NO: 16385 - DNA, 22 bp, Artificial Sequence
  chemically synthesized
tgtgtttccttttttcatacag

SEQ ID NO: 16386 - DNA, 22 bp, Artificial Sequence
  chemically synthesized
ccttttttcatacagcatacat

SEQ ID NO: 16387 - DNA, 22 bp, Artificial Sequence
  chemically synthesized
cttttttcatacagcatacatc

SEQ ID NO: 16388 - DNA, 22 bp, Artificial Sequence
  chemically synthesized
ttttcatacagcatacatcatc

SEQ ID NO: 16389 - DNA, 22 bp, Artificial Sequence
  chemically synthesized
tttcatacagcatacatcatct

SEQ ID NO: 16390 - DNA, 22 bp, Artificial Sequence
  chemically synthesized
ttcatacagcatacatcatcta

SEQ ID NO: 16391 - DNA, 22 bp, Artificial Sequence
  chemically synthesized
tcatacagcatacatcatctat

SEQ ID NO: 16392 - DNA, 22 bp, Artificial Sequence
  chemically synthesized
catacagcatacatcatctatc

SEQ ID NO: 16393 - DNA, 22 bp, Artificial Sequence
  chemically synthesized
atacagcatacatcatctatct

SEQ ID NO: 16394 - DNA, 22 bp, Artificial Sequence
  chemically synthesized
tcttttttttttttttgagaca

SEQ ID NO: 16395 - DNA, 22 bp, Artificial Sequence
  chemically synthesized
ttttttttttttgagacagggt

SEQ ID NO: 16396 - DNA, 22 bp, Artificial Sequence
  chemically synthesized
tttttttttttgagacagggtc

SEQ ID NO: 16397 - DNA, 22 bp, Artificial Sequence
  chemically synthesized
ttttttttttgagacagggtct

SEQ ID NO: 16398 - DNA, 22 bp, Artificial Sequence
  chemically synthesized
tttttttttgagacagggtctt

SEQ ID NO: 16399 - DNA, 22 bp, Artificial Sequence
  chemically synthesized
ttttttttgagacagggtctta

SEQ ID NO: 16400 - DNA, 22 bp, Artificial Sequence
  chemically synthesized
tttttttgagacagggtcttac

SEQ ID NO: 16401 - DNA, 22 bp, Artificial Sequence
  chemically synthesized
ttttttgagacagggtcttact

SEQ ID NO: 16402 - DNA, 22 bp, Artificial Sequence
  chemically synthesized
tttttgagacagggtcttactc

SEQ ID NO: 16403 - DNA, 22 bp, Artificial Sequence
  chemically synthesized
ttttgagacagggtcttactct

SEQ ID NO: 16404 - DNA, 22 bp, Artificial Sequence
  chemically synthesized
tttgagacagggtcttactctg

SEQ ID NO: 16405 - DNA, 22 bp, Artificial Sequence
  chemically synthesized
ttgagacagggtcttactctgt

SEQ ID NO: 16406 - DNA, 22 bp, Artificial Sequence
  chemically synthesized
tgagacagggtcttactctgtt

SEQ ID NO: 16407 - DNA, 22 bp, Artificial Sequence
  chemically synthesized
gagacagggtcttactctgttg

SEQ ID NO: 16408 - DNA, 22 bp, Artificial Sequence
  chemically synthesized
agacagggtcttactctgttgc

SEQ ID NO: 16409 - DNA, 22 bp, Artificial Sequence
  chemically synthesized
actctgttgcccaggctggagt

SEQ ID NO: 16410 - DNA, 22 bp, Artificial Sequence
  chemically synthesized
ctctgttgcccaggctggagtg

SEQ ID NO: 16411 - DNA, 22 bp, Artificial Sequence
  chemically synthesized
tgttgcccaggctggagtgcag

SEQ ID NO: 16412 - DNA, 22 bp, Artificial Sequence
  chemically synthesized
ttgcccaggctggagtgcagtg

SEQ ID NO: 16413 - DNA, 22 bp, Artificial Sequence
  chemically synthesized
cccaggctggagtgcagtggca

SEQ ID NO: 16414 - DNA, 22 bp, Artificial Sequence
  chemically synthesized
gagtgcagtggcatgatcttga

SEQ ID NO: 16415 - DNA, 22 bp, Artificial Sequence
  chemically synthesized
gactcactgcaacctcctccgc

SEQ ID NO: 16416 - DNA, 22 bp, Artificial Sequence
  chemically synthesized
actcactgcaacctcctccgcc

SEQ ID NO: 16417 - DNA, 22 bp, Artificial Sequence
  chemically synthesized
actgcaacctcctccgcctctc

SEQ ID NO: 16418 - DNA, 22 bp, Artificial Sequence
  chemically synthesized
caacctcctccgcctctcacct

SEQ ID NO: 16419 - DNA, 22 bp, Artificial Sequence
  chemically synthesized
ctccgcctctcacctcagcctc

SEQ ID NO: 16420 - DNA, 22 bp, Artificial Sequence
  chemically synthesized
cgcctctcacctcagcctcctg

SEQ ID NO: 16421 - DNA, 22 bp, Artificial Sequence
  chemically synthesized
tcacctcagcctcctgagtagc

SEQ ID NO: 16422 - DNA, 22 bp, Artificial Sequence
  chemically synthesized
acctcagcctcctgagtagctg

SEQ ID NO: 16423 - DNA, 22 bp, Artificial Sequence
  chemically synthesized
agcctcctgagtagctgggact

SEQ ID NO: 16424 - DNA, 22 bp, Artificial Sequence
  chemically synthesized
ctgagtagctgggactacagca

SEQ ID NO: 16425 - DNA, 22 bp, Artificial Sequence
  chemically synthesized
agtagctgggactacagcacca

SEQ ID NO: 16426 - DNA, 22 bp, Artificial Sequence
  chemically synthesized
ggactacagcaccaacacgccc

SEQ ID NO: 16427 - DNA, 22 bp, Artificial Sequence
  chemically synthesized
cagcaccaacacgcccagctaa

SEQ ID NO: 16428 - DNA, 22 bp, Artificial Sequence
  chemically synthesized
attttcgtaatgtttttgtaga

SEQ ID NO: 16429 - DNA, 22 bp, Artificial Sequence
  chemically synthesized
tcgtaatgtttttgtagagatg

SEQ ID NO: 16430 - DNA, 22 bp, Artificial Sequence
  chemically synthesized
cgtaatgtttttgtagagatgg

SEQ ID NO: 16431 - DNA, 22 bp, Artificial Sequence
  chemically synthesized
gtaatgtttttgtagagatgga

SEQ ID NO: 16432 - DNA, 22 bp, Artificial Sequence
  chemically synthesized
ttgtagagatggagtttcgcca

SEQ ID NO: 16433 - DNA, 22 bp, Artificial Sequence
  chemically synthesized
tgtagagatggagtttcgccat

SEQ ID NO: 16434 - DNA, 22 bp, Artificial Sequence
  chemically synthesized
gtagagatggagtttcgccatg

SEQ ID NO: 16435 - DNA, 22 bp, Artificial Sequence
  chemically synthesized
tagagatggagtttcgccatgt

SEQ ID NO: 16436 - DNA, 22 bp, Artificial Sequence
  chemically synthesized
cgccatgttgcccaggctggtc

SEQ ID NO: 16437 - DNA, 22 bp, Artificial Sequence
  chemically synthesized
gccatgttgcccaggctggtct

SEQ ID NO: 16438 - DNA, 22 bp, Artificial Sequence
  chemically synthesized
cccaggctggtcttgaactcct

SEQ ID NO: 16439 - DNA, 22 bp, Artificial Sequence
  chemically synthesized
gtcttgaactcctgagttcacc

SEQ ID NO: 16440 - DNA, 22 bp, Artificial Sequence
  chemically synthesized
gaactcctgagttcacccagga

SEQ ID NO: 16441 - DNA, 22 bp, Artificial Sequence
  chemically synthesized
aactcctgagttcacccaggag

SEQ ID NO: 16442 - DNA, 22 bp, Artificial Sequence
  chemically synthesized
ctgagttcacccaggagtgatt

SEQ ID NO: 16443 - DNA, 22 bp, Artificial Sequence
  chemically synthesized
agttcacccaggagtgattcgc

SEQ ID NO: 16444 - DNA, 22 bp, Artificial Sequence
  chemically synthesized
acccaggagtgattcgcccacc

SEQ ID NO: 16445 - DNA, 22 bp, Artificial Sequence
  chemically synthesized
gcccacctcggcctcccaaagt

SEQ ID NO: 16446 - DNA, 22 bp, Artificial Sequence
  chemically synthesized
ggcctcccaaagtgctgggatt

SEQ ID NO: 16447 - DNA, 22 bp, Artificial Sequence
  chemically synthesized
ccaaagtgctgggattacaggt

SEQ ID NO: 16448 - DNA, 22 bp, Artificial Sequence
  chemically synthesized
ggattacaggtgtgagccacca

SEQ ID NO: 16449 - DNA, 22 bp, Artificial Sequence
  chemically synthesized
caggtgtgagccaccatgcctg

SEQ ID NO: 16450 - DNA, 22 bp, Artificial Sequence
  chemically synthesized
gccccatacatctttctttatg

SEQ ID NO: 16451 - DNA, 22 bp, Artificial Sequence
  chemically synthesized
tctttatgttacctcttctgct

SEQ ID NO: 16452 - DNA, 22 bp, Artificial Sequence
  chemically synthesized
ctttatgttacctcttctgctt

SEQ ID NO: 16453 - DNA, 22 bp, Artificial Sequence
  chemically synthesized
tttatgttacctcttctgcttc

SEQ ID NO: 16454 - DNA, 22 bp, Artificial Sequence
  chemically synthesized
tatgttacctcttctgcttcat

SEQ ID NO: 16455 - DNA, 22 bp, Artificial Sequence
  chemically synthesized
atgttacctcttctgcttcata

SEQ ID NO: 16456 - DNA, 22 bp, Artificial Sequence
  chemically synthesized
tgttacctcttctgcttcatac

SEQ ID NO: 16457 - DNA, 22 bp, Artificial Sequence
  chemically synthesized
cctcttctgcttcatactaata

SEQ ID NO: 16458 - DNA, 22 bp, Artificial Sequence
  chemically synthesized
ttctgcttcatactaataaaac

SEQ ID NO: 16459 - DNA, 22 bp, Artificial Sequence
  chemically synthesized
ctgcttcatactaataaaactc

SEQ ID NO: 16460 - DNA, 22 bp, Artificial Sequence
  chemically synthesized
tgcttcatactaataaaactct

SEQ ID NO: 16461 - DNA, 22 bp, Artificial Sequence
  chemically synthesized
cttcatactaataaaactcttt

SEQ ID NO: 16462 - DNA, 22 bp, Artificial Sequence
  chemically synthesized
catactaataaaactctttgct

SEQ ID NO: 16463 - DNA, 22 bp, Artificial Sequence
  chemically synthesized
atactaataaaactctttgctc

SEQ ID NO: 16464 - DNA, 22 bp, Artificial Sequence
  chemically synthesized
ataaaactctttgctcaaagcc

SEQ ID NO: 16465 - DNA, 22 bp, Artificial Sequence
  chemically synthesized
tttgctcaaagcctatataact

SEQ ID NO: 16466 - DNA, 22 bp, Artificial Sequence
  chemically synthesized
tgctcaaagcctatataactca

SEQ ID NO: 16467 - DNA, 22 bp, Artificial Sequence
  chemically synthesized
gctcaaagcctatataactcag

SEQ ID NO: 16468 - DNA, 22 bp, Artificial Sequence
  chemically synthesized
ctcaaagcctatataactcaga

SEQ ID NO: 16469 - DNA, 22 bp, Artificial Sequence
  chemically synthesized
aaagcctatataactcagactt

SEQ ID NO: 16470 - DNA, 22 bp, Artificial Sequence
  chemically synthesized
tataactcagacttttcacgaa

SEQ ID NO: 16471 - DNA, 22 bp, Artificial Sequence
  chemically synthesized
agacttttcacgaaattcaact

SEQ ID NO: 16472 - DNA, 22 bp, Artificial Sequence
  chemically synthesized
ttcacgaaattcaactgtccta

SEQ ID NO: 16473 - DNA, 22 bp, Artificial Sequence
  chemically synthesized
tcacgaaattcaactgtcctac

SEQ ID NO: 16474 - DNA, 22 bp, Artificial Sequence
  chemically synthesized
cacgaaattcaactgtcctacc

SEQ ID NO: 16475 - DNA, 22 bp, Artificial Sequence
  chemically synthesized
acgaaattcaactgtcctaccc

SEQ ID NO: 16476 - DNA, 22 bp, Artificial Sequence
  chemically synthesized
aactgtcctaccctttaaccca

SEQ ID NO: 16477 - DNA, 22 bp, Artificial Sequence
  chemically synthesized
tcctaccctttaacccatatga

SEQ ID NO: 16478 - DNA, 22 bp, Artificial Sequence
  chemically synthesized
ccctttaacccatatgaaatag

SEQ ID NO: 16479 - DNA, 22 bp, Artificial Sequence
  chemically synthesized
taacccatatgaaataggcttt

SEQ ID NO: 16480 - DNA, 22 bp, Artificial Sequence
  chemically synthesized
aacccatatgaaataggctttc

SEQ ID NO: 16481 - DNA, 22 bp, Artificial Sequence
  chemically synthesized
acccatatgaaataggctttcc

SEQ ID NO: 16482 - DNA, 22 bp, Artificial Sequence
  chemically synthesized
tcctgtattttcaactcactgg

SEQ ID NO: 16483 - DNA, 22 bp, Artificial Sequence
  chemically synthesized
cctgtattttcaactcactggt

SEQ ID NO: 16484 - DNA, 22 bp, Artificial Sequence
  chemically synthesized
ctgtattttcaactcactggta

SEQ ID NO: 16485 - DNA, 22 bp, Artificial Sequence
  chemically synthesized
tattttcaactcactggtagga

SEQ ID NO: 16486 - DNA, 22 bp, Artificial Sequence
  chemically synthesized
tcaactcactggtaggattttt

SEQ ID NO: 16487 - DNA, 22 bp, Artificial Sequence
  chemically synthesized
caactcactggtaggatttttt

SEQ ID NO: 16488 - DNA, 22 bp, Artificial Sequence
  chemically synthesized
aactcactggtaggattttttc

SEQ ID NO: 16489 - DNA, 22 bp, Artificial Sequence
  chemically synthesized
actggtaggattttttctgtct

SEQ ID NO: 16490 - DNA, 22 bp, Artificial Sequence
  chemically synthesized
gtaggattttttctgtcttccc

SEQ ID NO: 16491 - DNA, 22 bp, Artificial Sequence
  chemically synthesized
tttctgtcttccccctttatgt

SEQ ID NO: 16492 - DNA, 22 bp, Artificial Sequence
  chemically synthesized
ttctgtcttccccctttatgta

SEQ ID NO: 16493 - DNA, 22 bp, Artificial Sequence
  chemically synthesized
tctgtcttccccctttatgtag

SEQ ID NO: 16494 - DNA, 22 bp, Artificial Sequence
  chemically synthesized
ctgtcttccccctttatgtaga

SEQ ID NO: 16495 - DNA, 22 bp, Artificial Sequence
  chemically synthesized
tgtcttccccctttatgtagat

SEQ ID NO: 16496 - DNA, 22 bp, Artificial Sequence
  chemically synthesized
tcttccccctttatgtagatga

SEQ ID NO: 16497 - DNA, 22 bp, Artificial Sequence
  chemically synthesized
ccccctttatgtagatgatcca

SEQ ID NO: 16498 - DNA, 22 bp, Artificial Sequence
  chemically synthesized
cccctttatgtagatgatccaa

SEQ ID NO: 16499 - DNA, 22 bp, Artificial Sequence
  chemically synthesized
tatgtagatgatccaaagtcag

SEQ ID NO: 16500 - DNA, 22 bp, Artificial Sequence
  chemically synthesized
atgtagatgatccaaagtcaga

SEQ ID NO: 16501 - DNA, 22 bp, Artificial Sequence
  chemically synthesized
tgtagatgatccaaagtcagag

SEQ ID NO: 16502 - DNA, 22 bp, Artificial Sequence
  chemically synthesized
gaagcatgagtagcccgtggct

SEQ ID NO: 16503 - DNA, 22 bp, Artificial Sequence
  chemically synthesized
cctgaatagcctggggaaagca

SEQ ID NO: 16504 - DNA, 22 bp, Artificial Sequence
  chemically synthesized
ctgaatagcctggggaaagcaa

SEQ ID NO: 16505 - DNA, 22 bp, Artificial Sequence
  chemically synthesized
aatagcctggggaaagcaactt

SEQ ID NO: 16506 - DNA, 22 bp, Artificial Sequence
  chemically synthesized
gggaaagcaacttctgatggac

SEQ ID NO: 16507 - DNA, 22 bp, Artificial Sequence
  chemically synthesized
ctgatggacagacattgcgaga

SEQ ID NO: 16508 - DNA, 22 bp, Artificial Sequence
  chemically synthesized
tgatggacagacattgcgagag

SEQ ID NO: 16509 - DNA, 22 bp, Artificial Sequence
  chemically synthesized
atggacagacattgcgagagcg

SEQ ID NO: 16510 - DNA, 22 bp, Artificial Sequence
  chemically synthesized
cgagagcgaatgccagcctctt

SEQ ID NO: 16511 - DNA, 22 bp, Artificial Sequence
  chemically synthesized
ttttcttgctgatctcctctct

SEQ ID NO: 16512 - DNA, 22 bp, Artificial Sequence
  chemically synthesized
ttcttgctgatctcctctctat

SEQ ID NO: 16513 - DNA, 22 bp, Artificial Sequence
  chemically synthesized
tcttgctgatctcctctctata

SEQ ID NO: 16514 - DNA, 22 bp, Artificial Sequence
  chemically synthesized
cttgctgatctcctctctatat

SEQ ID NO: 16515 - DNA, 22 bp, Artificial Sequence
  chemically synthesized
ttgctgatctcctctctatatg

SEQ ID NO: 16516 - DNA, 22 bp, Artificial Sequence
  chemically synthesized
gctgatctcctctctatatggt

SEQ ID NO: 16517 - DNA, 22 bp, Artificial Sequence
  chemically synthesized
ctgatctcctctctatatggtt

SEQ ID NO: 16518 - DNA, 22 bp, Artificial Sequence
  chemically synthesized
atctcctctctatatggttctt

SEQ ID NO: 16519 - DNA, 22 bp, Artificial Sequence
  chemically synthesized
ctctctatatggttcttaccac

SEQ ID NO: 16520 - DNA, 22 bp, Artificial Sequence
  chemically synthesized
tctatatggttcttaccactta

SEQ ID NO: 16521 - DNA, 22 bp, Artificial Sequence
  chemically synthesized
tatatggttcttaccacttaaa

SEQ ID NO: 16522 - DNA, 22 bp, Artificial Sequence
  chemically synthesized
tatggttcttaccacttaaaga

SEQ ID NO: 16523 - DNA, 22 bp, Artificial Sequence
  chemically synthesized
ttaccacttaaagacgaggttg

SEQ ID NO: 16524 - DNA, 22 bp, Artificial Sequence
  chemically synthesized
accacttaaagacgaggttgag

SEQ ID NO: 16525 - DNA, 22 bp, Artificial Sequence
  chemically synthesized
ccacttaaagacgaggttgagc

SEQ ID NO: 16526 - DNA, 22 bp, Artificial Sequence
  chemically synthesized
aaagacgaggttgagccagtct

SEQ ID NO: 16527 - DNA, 22 bp, Artificial Sequence
  chemically synthesized
aagacgaggttgagccagtctc

SEQ ID NO: 16528 - DNA, 22 bp, Artificial Sequence
  chemically synthesized
agccagtctccaatcacagcta

SEQ ID NO: 16529 - DNA, 22 bp, Artificial Sequence
  chemically synthesized
caatcacagctacccaaaggag

SEQ ID NO: 16530 - DNA, 22 bp, Artificial Sequence
  chemically synthesized
cccaaaggagtttaatgcccac

SEQ ID NO: 16531 - DNA, 22 bp, Artificial Sequence
  chemically synthesized
aatgcccacagcttcctgaaga

SEQ ID NO: 16532 - DNA, 22 bp, Artificial Sequence
  chemically synthesized
atgcccacagcttcctgaagat

SEQ ID NO: 16533 - DNA, 22 bp, Artificial Sequence
  chemically synthesized
cctgaagatggaaccagatggg

SEQ ID NO: 16534 - DNA, 22 bp, Artificial Sequence
  chemically synthesized
ctgaagatggaaccagatgggg

SEQ ID NO: 16535 - DNA, 22 bp, Artificial Sequence
  chemically synthesized
aagatggaaccagatggggaag

SEQ ID NO: 16536 - DNA, 22 bp, Artificial Sequence
  chemically synthesized
ctgaggtctgcgatcacggaca

SEQ ID NO: 16537 - DNA, 22 bp, Artificial Sequence
  chemically synthesized
aggtctgcgatcacggacacca

SEQ ID NO: 16538 - DNA, 22 bp, Artificial Sequence
  chemically synthesized
cgatcacggacaccaagatgaa

SEQ ID NO: 16539 - DNA, 22 bp, Artificial Sequence
  chemically synthesized
ggagtcttggtaattcacctgg

SEQ ID NO: 16540 - DNA, 22 bp, Artificial Sequence
  chemically synthesized
ggtaattcacctggaggtaatg

SEQ ID NO: 16541 - DNA, 22 bp, Artificial Sequence
  chemically synthesized
gtaattcacctggaggtaatgt

SEQ ID NO: 16542 - DNA, 22 bp, Artificial Sequence
  chemically synthesized
acctggaggtaatgtgttgact

SEQ ID NO: 16543 - DNA, 22 bp, Artificial Sequence
  chemically synthesized
gaggtaatgtgttgactggatc

SEQ ID NO: 16544 - DNA, 22 bp, Artificial Sequence
  chemically synthesized
actggatcccaaagtcatggag

SEQ ID NO: 16545 - DNA, 22 bp, Artificial Sequence
  chemically synthesized
gatcccaaagtcatggagaaca

SEQ ID NO: 16546 - DNA, 22 bp, Artificial Sequence
  chemically synthesized
attccttcctccatcctcattt

SEQ ID NO: 16547 - DNA, 22 bp, Artificial Sequence
  chemically synthesized
cttcctccatcctcatttcctt

SEQ ID NO: 16548 - DNA, 22 bp, Artificial Sequence
  chemically synthesized
cctccatcctcatttccttggc

SEQ ID NO: 16549 - DNA, 22 bp, Artificial Sequence
  chemically synthesized
ctccatcctcatttccttggca

SEQ ID NO: 16550 - DNA, 22 bp, Artificial Sequence
  chemically synthesized
catcctcatttccttggcacct

SEQ ID NO: 16551 - DNA, 22 bp, Artificial Sequence
  chemically synthesized
atttccttggcacctcaggaag

SEQ ID NO: 16552 - DNA, 22 bp, Artificial Sequence
  chemically synthesized
ccttggcacctcaggaagatgt

SEQ ID NO: 16553 - DNA, 22 bp, Artificial Sequence
  chemically synthesized
cttggcacctcaggaagatgtc

SEQ ID NO: 16554 - DNA, 22 bp, Artificial Sequence
  chemically synthesized
ggcacctcaggaagatgtcagc

SEQ ID NO: 16555 - DNA, 22 bp, Artificial Sequence
  chemically synthesized
gcacctcaggaagatgtcagca

SEQ ID NO: 16556 - DNA, 22 bp, Artificial Sequence
  chemically synthesized
aggaagatgtcagcagagccct

SEQ ID NO: 16557 - DNA, 22 bp, Artificial Sequence
  chemically synthesized
gcagttattccaggcttggtgg

SEQ ID NO: 16558 - DNA, 22 bp, Artificial Sequence
  chemically synthesized
cagttattccaggcttggtggt

SEQ ID NO: 16559 - DNA, 22 bp, Artificial Sequence
  chemically synthesized
ttccaggcttggtggtgattgc

SEQ ID NO: 16560 - DNA, 22 bp, Artificial Sequence
  chemically synthesized
caggcttggtggtgattgctct

SEQ ID NO: 16561 - DNA, 22 bp, Artificial Sequence
  chemically synthesized
ggtggtgattgctctgctatga

SEQ ID NO: 16562 - DNA, 22 bp, Artificial Sequence
  chemically synthesized
gtggtgattgctctgctatgag

SEQ ID NO: 16563 - DNA, 22 bp, Artificial Sequence
  chemically synthesized
ctctgctatgagtctgtgcctt

SEQ ID NO: 16564 - DNA, 22 bp, Artificial Sequence
  chemically synthesized
tgctatgagtctgtgccttgcc

SEQ ID NO: 16565 - DNA, 22 bp, Artificial Sequence
  chemically synthesized
ctatgagtctgtgccttgcccc

SEQ ID NO: 16566 - DNA, 22 bp, Artificial Sequence
  chemically synthesized
tgagtctgtgccttgcccctgt

SEQ ID NO: 16567 - DNA, 22 bp, Artificial Sequence
  chemically synthesized
tgccttgcccctgttttatatg

SEQ ID NO: 16568 - DNA, 22 bp, Artificial Sequence
  chemically synthesized
gcccctgttttatatgccctgt

SEQ ID NO: 16569 - DNA, 22 bp, Artificial Sequence
  chemically synthesized
cccctgttttatatgccctgta

SEQ ID NO: 16570 - DNA, 22 bp, Artificial Sequence
  chemically synthesized
ttttatatgccctgtatccagt

SEQ ID NO: 16571 - DNA, 22 bp, Artificial Sequence
  chemically synthesized
tatatgccctgtatccagtatt

SEQ ID NO: 16572 - DNA, 22 bp, Artificial Sequence
  chemically synthesized
atatgccctgtatccagtattc

SEQ ID NO: 16573 - DNA, 22 bp, Artificial Sequence
  chemically synthesized
tatgccctgtatccagtattca

SEQ ID NO: 16574 - DNA, 22 bp, Artificial Sequence
  chemically synthesized
tatccagtattcaggtcaaccc

SEQ ID NO: 16575 - DNA, 22 bp, Artificial Sequence
  chemically synthesized
aggtcaacccagccctgatctt

SEQ ID NO: 16576 - DNA, 22 bp, Artificial Sequence
  chemically synthesized
atctttggactcaaaaaccacg

SEQ ID NO: 16577 - DNA, 22 bp, Artificial Sequence
  chemically synthesized
tggactcaaaaaccacgtttgt

SEQ ID NO: 16578 - DNA, 22 bp, Artificial Sequence
  chemically synthesized
ggactcaaaaaccacgtttgtc

SEQ ID NO: 16579 - DNA, 22 bp, Artificial Sequence
  chemically synthesized
gactcaaaaaccacgtttgtct

SEQ ID NO: 16580 - DNA, 22 bp, Artificial Sequence
  chemically synthesized
aaaaaccacgtttgtctaaaat

SEQ ID NO: 16581 - DNA, 20 bp, Artificial Sequence
  chemically synthesized
tgcgtccactgctcttctga

SEQ ID NO: 16582 - DNA, 20 bp, Artificial Sequence
  chemically synthesized
tcttctgacagcatcattta

SEQ ID NO: 16583 - DNA, 20 bp, Artificial Sequence
  chemically synthesized
cttctgacagcatcatttac

SEQ ID NO: 16584 - DNA, 20 bp, Artificial Sequence
  chemically synthesized
aggttcacactgttccacct

SEQ ID NO: 16585 - DNA, 20 bp, Artificial Sequence
  chemically synthesized
ttcatattatgctcaaaata

SEQ ID NO: 16586 - DNA, 20 bp, Artificial Sequence
  chemically synthesized
tgctcaaaatatggacctat

SEQ ID NO: 16587 - DNA, 20 bp, Artificial Sequence
  chemically synthesized
aatatggacctatcagaaaa

SEQ ID NO: 16588 - DNA, 20 bp, Artificial Sequence
  chemically synthesized
ccattcatctgctgttgttt

SEQ ID NO: 16589 - DNA, 20 bp, Artificial Sequence
  chemically synthesized
tttggcctttgtctgaatca

SEQ ID NO: 16590 - DNA, 20 bp, Artificial Sequence
  chemically synthesized
cctttgtctgaatcacagta

SEQ ID NO: 16591 - DNA, 20 bp, Artificial Sequence
  chemically synthesized
tagatgcctccaactgttaa

SEQ ID NO: 16592 - DNA, 20 bp, Artificial Sequence
  chemically synthesized
agatgcctccaactgttaaa

SEQ ID NO: 16593 - DNA, 20 bp, Artificial Sequence
  chemically synthesized
tccaactgttaaaaggaaaa

SEQ ID NO: 16594 - DNA, 20 bp, Artificial Sequence
  chemically synthesized
aaaaagtttctattatcatt

SEQ ID NO: 16595 - DNA, 20 bp, Artificial Sequence
  chemically synthesized
aaaagtttctattatcattc

SEQ ID NO: 16596 - DNA, 20 bp, Artificial Sequence
  chemically synthesized
gtttctattatcattcaggt

SEQ ID NO: 16597 - DNA, 20 bp, Artificial Sequence
  chemically synthesized
tcaggttagcaatttgttta

SEQ ID NO: 16598 - DNA, 20 bp, Artificial Sequence
  chemically synthesized
agcaatttgtttaaagtaat

SEQ ID NO: 16599 - DNA, 20 bp, Artificial Sequence
  chemically synthesized
gcaatttgtttaaagtaata

SEQ ID NO: 16600 - DNA, 20 bp, Artificial Sequence
  chemically synthesized
caatttgtttaaagtaataa

SEQ ID NO: 16601 - DNA, 20 bp, Artificial Sequence
  chemically synthesized
ttgtttaaagtaataaggga

SEQ ID NO: 16602 - DNA, 20 bp, Artificial Sequence
  chemically synthesized
aagtaataagggatggaaat

SEQ ID NO: 16603 - DNA, 20 bp, Artificial Sequence
  chemically synthesized
ataagggatggaaatgagtt

SEQ ID NO: 16604 - DNA, 20 bp, Artificial Sequence
  chemically synthesized
atgagttcagatttttaaat

SEQ ID NO: 16605 - DNA, 20 bp, Artificial Sequence
  chemically synthesized
cagatttttaaattagcatt

SEQ ID NO: 16606 - DNA, 20 bp, Artificial Sequence
  chemically synthesized
agatttttaaattagcattt

SEQ ID NO: 16607 - DNA, 20 bp, Artificial Sequence
  chemically synthesized
attagcatttaggatccact

SEQ ID NO: 16608 - DNA, 20 bp, Artificial Sequence
  chemically synthesized
atttaggatccactaagccc

SEQ ID NO: 16609 - DNA, 20 bp, Artificial Sequence
  chemically synthesized
tttaggatccactaagccca

SEQ ID NO: 16610 - DNA, 20 bp, Artificial Sequence
  chemically synthesized
tatttacctttcaaaaataa

SEQ ID NO: 16611 - DNA, 20 bp, Artificial Sequence
  chemically synthesized
atagtatttgacatattgtt

SEQ ID NO: 16612 - DNA, 20 bp, Artificial Sequence
  chemically synthesized
tagtatttgacatattgtta

SEQ ID NO: 16613 - DNA, 20 bp, Artificial Sequence
  chemically synthesized
agtatttgacatattgttaa

SEQ ID NO: 16614 - DNA, 20 bp, Artificial Sequence
  chemically synthesized
tgttaagggacaccaacgaa

SEQ ID NO: 16615 - DNA, 20 bp, Artificial Sequence
  chemically synthesized
tcaattctgtgcatgtttta

SEQ ID NO: 16616 - DNA, 20 bp, Artificial Sequence
  chemically synthesized
gcatgttttaaagtcccttc

SEQ ID NO: 16617 - DNA, 20 bp, Artificial Sequence
  chemically synthesized
catgttttaaagtcccttct

SEQ ID NO: 16618 - DNA, 20 bp, Artificial Sequence
  chemically synthesized
ccttctaggtgcatgtgaaa

SEQ ID NO: 16619 - DNA, 20 bp, Artificial Sequence
  chemically synthesized
tctaggtgcatgtgaaatag

SEQ ID NO: 16620 - DNA, 20 bp, Artificial Sequence
  chemically synthesized
aggtgcatgtgaaatagcag

SEQ ID NO: 16621 - DNA, 20 bp, Artificial Sequence
  chemically synthesized
ggtgcatgtgaaatagcagc

SEQ ID NO: 16622 - DNA, 20 bp, Artificial Sequence
  chemically synthesized
agcagcaggctgatgccgca

SEQ ID NO: 16623 - DNA, 20 bp, Artificial Sequence
  chemically synthesized
cagcaggctgatgccgcaaa

SEQ ID NO: 16624 - DNA, 20 bp, Artificial Sequence
  chemically synthesized
agcaggctgatgccgcaaag

SEQ ID NO: 16625 - DNA, 20 bp, Artificial Sequence
  chemically synthesized
aagaggtcaaatacctcaaa

SEQ ID NO: 16626 - DNA, 20 bp, Artificial Sequence
  chemically synthesized
ggtcaaatacctcaaaaaga

SEQ ID NO: 16627 - DNA, 20 bp, Artificial Sequence
  chemically synthesized
tcaaatacctcaaaaagaaa

SEQ ID NO: 16628 - DNA, 20 bp, Artificial Sequence
  chemically synthesized
tcaaaaagaaagagtctgaa

SEQ ID NO: 16629 - DNA, 20 bp, Artificial Sequence
  chemically synthesized
aaagagtctgaaaagacaat

SEQ ID NO: 16630 - DNA, 20 bp, Artificial Sequence
  chemically synthesized
agagtctgaaaagacaattg

SEQ ID NO: 16631 - DNA, 20 bp, Artificial Sequence
  chemically synthesized
ttggagtaactacttgccta

SEQ ID NO: 16632 - DNA, 20 bp, Artificial Sequence
  chemically synthesized
taactacttgcctaaagctc

SEQ ID NO: 16633 - DNA, 20 bp, Artificial Sequence
  chemically synthesized
ctaaagctccagtcactttg

SEQ ID NO: 16634 - DNA, 20 bp, Artificial Sequence
  chemically synthesized
ccagtcactttgtagtgtca

SEQ ID NO: 16635 - DNA, 20 bp, Artificial Sequence
  chemically synthesized
tcactttgtagtgtcaaagt

SEQ ID NO: 16636 - DNA, 20 bp, Artificial Sequence
  chemically synthesized
cactttgtagtgtcaaagtt

SEQ ID NO: 16637 - DNA, 20 bp, Artificial Sequence
  chemically synthesized
attgtcatcatacatgccct

SEQ ID NO: 16638 - DNA, 20 bp, Artificial Sequence
  chemically synthesized
gtcatcatacatgccctcag

SEQ ID NO: 16639 - DNA, 20 bp, Artificial Sequence
  chemically synthesized
atcatacatgccctcagcag

SEQ ID NO: 16640 - DNA, 20 bp, Artificial Sequence
  chemically synthesized
ctctcttcctccttctccta

SEQ ID NO: 16641 - DNA, 20 bp, Artificial Sequence
  chemically synthesized
tcttcctccttctcctacag

SEQ ID NO: 16642 - DNA, 20 bp, Artificial Sequence
  chemically synthesized
ctccttctcctacagtggtc

SEQ ID NO: 16643 - DNA, 20 bp, Artificial Sequence
  chemically synthesized
cttctcctacagtggtccag

SEQ ID NO: 16644 - DNA, 20 bp, Artificial Sequence
  chemically synthesized
ttctcctacagtggtccaga

SEQ ID NO: 16645 - DNA, 20 bp, Artificial Sequence
  chemically synthesized
tctcctacagtggtccagaa

SEQ ID NO: 16646 - DNA, 20 bp, Artificial Sequence
  chemically synthesized
ctcctacagtggtccagaag

SEQ ID NO: 16647 - DNA, 20 bp, Artificial Sequence
  chemically synthesized
acagtggtccagaaggggct

SEQ ID NO: 16648 - DNA, 20 bp, Artificial Sequence
  chemically synthesized
cagtggtccagaaggggctc

SEQ ID NO: 16649 - DNA, 20 bp, Artificial Sequence
  chemically synthesized
gctcaggtatgttcaaataa

SEQ ID NO: 16650 - DNA, 20 bp, Artificial Sequence
  chemically synthesized
tgttcaaataacagctgctg

SEQ ID NO: 16651 - DNA, 20 bp, Artificial Sequence
  chemically synthesized
tgctgtggttttcaattatg

SEQ ID NO: 16652 - DNA, 20 bp, Artificial Sequence
  chemically synthesized
caattatgaagaaatctcct

SEQ ID NO: 16653 - DNA, 20 bp, Artificial Sequence
  chemically synthesized
aagaaatctcctaagctaca

SEQ ID NO: 16654 - DNA, 20 bp, Artificial Sequence
  chemically synthesized
acatagtcatttatctttta

SEQ ID NO: 16655 - DNA, 20 bp, Artificial Sequence
  chemically synthesized
catttatcttttaaagcacc

SEQ ID NO: 16656 - DNA, 20 bp, Artificial Sequence
  chemically synthesized
atcttttaaagcaccaagca

SEQ ID NO: 16657 - DNA, 20 bp, Artificial Sequence
  chemically synthesized
caagcaaagtaccttttgat

SEQ ID NO: 16658 - DNA, 20 bp, Artificial Sequence
  chemically synthesized
aagcaaagtaccttttgata

SEQ ID NO: 16659 - DNA, 20 bp, Artificial Sequence
  chemically synthesized
gcaaagtaccttttgataag

SEQ ID NO: 16660 - DNA, 20 bp, Artificial Sequence
  chemically synthesized
tgataaggagaacgtgctta

SEQ ID NO: 16661 - DNA, 20 bp, Artificial Sequence
  chemically synthesized
aacgtgcttatagatgttca

SEQ ID NO: 16662 - DNA, 20 bp, Artificial Sequence
  chemically synthesized
gtgcttatagatgttcatag

SEQ ID NO: 16663 - DNA, 20 bp, Artificial Sequence
  chemically synthesized
agatgttcatagaagatgct

SEQ ID NO: 16664 - DNA, 20 bp, Artificial Sequence
  chemically synthesized
atacgtatttcattctcaca

SEQ ID NO: 16665 - DNA, 20 bp, Artificial Sequence
  chemically synthesized
acatggtatttctctcttcc

SEQ ID NO: 16666 - DNA, 20 bp, Artificial Sequence
  chemically synthesized
ggtatttctctcttcctagt

SEQ ID NO: 16667 - DNA, 20 bp, Artificial Sequence
  chemically synthesized
gtatttctctcttcctagta

SEQ ID NO: 16668 - DNA, 20 bp, Artificial Sequence
  chemically synthesized
tatttctctcttcctagtaa

SEQ ID NO: 16669 - DNA, 20 bp, Artificial Sequence
  chemically synthesized
tttctctcttcctagtaagg

SEQ ID NO: 16670 - DNA, 20 bp, Artificial Sequence
  chemically synthesized
ttctctcttcctagtaaggg

SEQ ID NO: 16671 - DNA, 20 bp, Artificial Sequence
  chemically synthesized
ctctcttcctagtaagggag

SEQ ID NO: 16672 - DNA, 20 bp, Artificial Sequence
  chemically synthesized
atgcccaatttctgcctcca

SEQ ID NO: 16673 - DNA, 20 bp, Artificial Sequence
  chemically synthesized
ccaatttctgcctccaaaga

SEQ ID NO: 16674 - DNA, 20 bp, Artificial Sequence
  chemically synthesized
atttctgcctccaaagaaag

SEQ ID NO: 16675 - DNA, 20 bp, Artificial Sequence
  chemically synthesized
tctgcctccaaagaaagaag

SEQ ID NO: 16676 - DNA, 20 bp, Artificial Sequence
  chemically synthesized
aaagaagaagtaaaaactaa

SEQ ID NO: 16677 - DNA, 20 bp, Artificial Sequence
  chemically synthesized
aagaagaagtaaaaactaaa

SEQ ID NO: 16678 - DNA, 20 bp, Artificial Sequence
  chemically synthesized
aagaagtaaaaactaaaagg

SEQ ID NO: 16679 - DNA, 20 bp, Artificial Sequence
  chemically synthesized
aaaggcagaaatgaaatcca

SEQ ID NO: 16680 - DNA, 20 bp, Artificial Sequence
  chemically synthesized
aaggcagaaatgaaatccac

SEQ ID NO: 16681 - DNA, 20 bp, Artificial Sequence
  chemically synthesized
aaatgaaatccacaggcaaa

SEQ ID NO: 16682 - DNA, 20 bp, Artificial Sequence
  chemically synthesized
aatccacaggcaaacagcct

SEQ ID NO: 16683 - DNA, 20 bp, Artificial Sequence
  chemically synthesized
aacagcctgagaccacatcc

SEQ ID NO: 16684 - DNA, 20 bp, Artificial Sequence
  chemically synthesized
acagcctgagaccacatcct

SEQ ID NO: 16685 - DNA, 20 bp, Artificial Sequence
  chemically synthesized
ctgagaccacatcctgggcc

SEQ ID NO: 16686 - DNA, 20 bp, Artificial Sequence
  chemically synthesized
ccacatcctgggcctggtta

SEQ ID NO: 16687 - DNA, 20 bp, Artificial Sequence
  chemically synthesized
atcctgggcctggttaaaga

SEQ ID NO: 16688 - DNA, 20 bp, Artificial Sequence
  chemically synthesized
ttaaagatagacccctgacc

SEQ ID NO: 16689 - DNA, 20 bp, Artificial Sequence
  chemically synthesized
agatagacccctgacctggc

SEQ ID NO: 16690 - DNA, 20 bp, Artificial Sequence
  chemically synthesized
ctggccagttatgttatcta

SEQ ID NO: 16691 - DNA, 20 bp, Artificial Sequence
  chemically synthesized
gttatgttatctatagattc

SEQ ID NO: 16692 - DNA, 20 bp, Artificial Sequence
  chemically synthesized
tatagattccagacactgta

SEQ ID NO: 16693 - DNA, 20 bp, Artificial Sequence
  chemically synthesized
attccagacactgtatggaa

SEQ ID NO: 16694 - DNA, 20 bp, Artificial Sequence
  chemically synthesized
ccagacactgtatggaaaag

SEQ ID NO: 16695 - DNA, 20 bp, Artificial Sequence
  chemically synthesized
ttctgttccattctgatgac

SEQ ID NO: 16696 - DNA, 20 bp, Artificial Sequence
  chemically synthesized
attctgatgaccagtgcatg

SEQ ID NO: 16697 - DNA, 20 bp, Artificial Sequence
  chemically synthesized
tgaccagtgcatgcagcccc

SEQ ID NO: 16698 - DNA, 20 bp, Artificial Sequence
  chemically synthesized
cccccagtcatgtaccccct

SEQ ID NO: 16699 - DNA, 20 bp, Artificial Sequence
  chemically synthesized
cccagtcatgtaccccctta

SEQ ID NO: 16700 - DNA, 20 bp, Artificial Sequence
  chemically synthesized
atgtacccccttagagttgt

SEQ ID NO: 16701 - DNA, 20 bp, Artificial Sequence
  chemically synthesized
ttagagttgtaagcccttaa

SEQ ID NO: 16702 - DNA, 20 bp, Artificial Sequence
  chemically synthesized
tagagttgtaagcccttaaa

SEQ ID NO: 16703 - DNA, 20 bp, Artificial Sequence
  chemically synthesized
agagttgtaagcccttaaaa

SEQ ID NO: 16704 - DNA, 20 bp, Artificial Sequence
  chemically synthesized
ttgtaagcccttaaaaggga

SEQ ID NO: 16705 - DNA, 20 bp, Artificial Sequence
  chemically synthesized
tgtaagcccttaaaagggac

SEQ ID NO: 16706 - DNA, 20 bp, Artificial Sequence
  chemically synthesized
ggacaggaattgctcactct

SEQ ID NO: 16707 - DNA, 20 bp, Artificial Sequence
  chemically synthesized
acaggaattgctcactctga

SEQ ID NO: 16708 - DNA, 20 bp, Artificial Sequence
  chemically synthesized
aattgctcactctgagagct

SEQ ID NO: 16709 - DNA, 20 bp, Artificial Sequence
  chemically synthesized
cactctgagagcttggttgt

SEQ ID NO: 16710 - DNA, 20 bp, Artificial Sequence
  chemically synthesized
ctctgagagcttggttgttg

SEQ ID NO: 16711 - DNA, 20 bp, Artificial Sequence
  chemically synthesized
agcttggttgttggagatgt

SEQ ID NO: 16712 - DNA, 20 bp, Artificial Sequence
  chemically synthesized
tggagatgtgagtcttgccc

SEQ ID NO: 16713 - DNA, 20 bp, Artificial Sequence
  chemically synthesized
gtgagtcttgcccaagctcc

SEQ ID NO: 16714 - DNA, 20 bp, Artificial Sequence
  chemically synthesized
cccaagctcccagccgaata

SEQ ID NO: 16715 - DNA, 20 bp, Artificial Sequence
  chemically synthesized
aagcccttccttctttaact

SEQ ID NO: 16716 - DNA, 20 bp, Artificial Sequence
  chemically synthesized
ccttctttaactcggtgtct

SEQ ID NO: 16717 - DNA, 20 bp, Artificial Sequence
  chemically synthesized
cttctttaactcggtgtctg

SEQ ID NO: 16718 - DNA, 20 bp, Artificial Sequence
  chemically synthesized
ttctttaactcggtgtctga

SEQ ID NO: 16719 - DNA, 20 bp, Artificial Sequence
  chemically synthesized
tctttaactcggtgtctgag

SEQ ID NO: 16720 - DNA, 20 bp, Artificial Sequence
  chemically synthesized
tgtctgaggggttttgtatg

SEQ ID NO: 16721 - DNA, 20 bp, Artificial Sequence
  chemically synthesized
tgcagcttgtcctgctacac

SEQ ID NO: 16722 - DNA, 20 bp, Artificial Sequence
  chemically synthesized
gctacctctattaaaacaca

SEQ ID NO: 16723 - DNA, 20 bp, Artificial Sequence
  chemically synthesized
aaacacaaagccacaatata

SEQ ID NO: 16724 - DNA, 20 bp, Artificial Sequence
  chemically synthesized
ccacaatatatggatacatt

SEQ ID NO: 16725 - DNA, 20 bp, Artificial Sequence
  chemically synthesized
tttggaaaatatgcacactt

SEQ ID NO: 16726 - DNA, 20 bp, Artificial Sequence
  chemically synthesized
aaatatgcacactttggatc

SEQ ID NO: 16727 - DNA, 20 bp, Artificial Sequence
  chemically synthesized
atgcacactttggatccagc

SEQ ID NO: 16728 - DNA, 20 bp, Artificial Sequence
  chemically synthesized
ggatccagcaagtccacatc

SEQ ID NO: 16729 - DNA, 20 bp, Artificial Sequence
  chemically synthesized
ccacatctagaaaaccatcc

SEQ ID NO: 16730 - DNA, 20 bp, Artificial Sequence
  chemically synthesized
cacatctagaaaaccatcct

SEQ ID NO: 16731 - DNA, 20 bp, Artificial Sequence
  chemically synthesized
acatctagaaaaccatcctg

SEQ ID NO: 16732 - DNA, 20 bp, Artificial Sequence
  chemically synthesized
catctagaaaaccatcctgg

SEQ ID NO: 16733 - DNA, 20 bp, Artificial Sequence
  chemically synthesized
aaccatcctgggggaaaatt

SEQ ID NO: 16734 - DNA, 20 bp, Artificial Sequence
  chemically synthesized
accatcctgggggaaaatta

SEQ ID NO: 16735 - DNA, 20 bp, Artificial Sequence
  chemically synthesized
catcctgggggaaaattaag

SEQ ID NO: 16736 - DNA, 20 bp, Artificial Sequence
  chemically synthesized
tcctgggggaaaattaagga

SEQ ID NO: 16737 - DNA, 20 bp, Artificial Sequence
  chemically synthesized
aaaattaaggagagtatgaa

SEQ ID NO: 16738 - DNA, 20 bp, Artificial Sequence
  chemically synthesized
aaattaaggagagtatgaaa

SEQ ID NO: 16739 - DNA, 20 bp, Artificial Sequence
  chemically synthesized
tatgaaaaggatgtttacta

SEQ ID NO: 16740 - DNA, 20 bp, Artificial Sequence
  chemically synthesized
tgtttactaaagcattatga

SEQ ID NO: 16741 - DNA, 20 bp, Artificial Sequence
  chemically synthesized
gcattatgatggcaaaaaat

SEQ ID NO: 16742 - DNA, 20 bp, Artificial Sequence
  chemically synthesized
agaaacaacttacactgaac

SEQ ID NO: 16743 - DNA, 20 bp, Artificial Sequence
  chemically synthesized
gaactagtcaacttacttaa

SEQ ID NO: 16744 - DNA, 20 bp, Artificial Sequence
  chemically synthesized
tagtcaacttacttaacaga

SEQ ID NO: 16745 - DNA, 20 bp, Artificial Sequence
  chemically synthesized
tcaacttacttaacagacag

SEQ ID NO: 16746 - DNA, 20 bp, Artificial Sequence
  chemically synthesized
caacttacttaacagacaga

SEQ ID NO: 16747 - DNA, 20 bp, Artificial Sequence
  chemically synthesized
taacagacagaaggctcaat

SEQ ID NO: 16748 - DNA, 20 bp, Artificial Sequence
  chemically synthesized
caattagctcatgtgtcaaa

SEQ ID NO: 16749 - DNA, 20 bp, Artificial Sequence
  chemically synthesized
aattagctcatgtgtcaaat

SEQ ID NO: 16750 - DNA, 20 bp, Artificial Sequence
  chemically synthesized
attagctcatgtgtcaaatg

SEQ ID NO: 16751 - DNA, 20 bp, Artificial Sequence
  chemically synthesized
ttagctcatgtgtcaaatgg

SEQ ID NO: 16752 - DNA, 20 bp, Artificial Sequence
  chemically synthesized
aatgggggtaaaataatatt

SEQ ID NO: 16753 - DNA, 20 bp, Artificial Sequence
  chemically synthesized
gggtaaaataatatttagtt

SEQ ID NO: 16754 - DNA, 20 bp, Artificial Sequence
  chemically synthesized
gtaaaataatatttagtttg

SEQ ID NO: 16755 - DNA, 20 bp, Artificial Sequence
  chemically synthesized
taaaataatatttagtttgg

SEQ ID NO: 16756 - DNA, 20 bp, Artificial Sequence
  chemically synthesized
aaaataatatttagtttgga

SEQ ID NO: 16757 - DNA, 20 bp, Artificial Sequence
  chemically synthesized
taatatttagtttggaggga

SEQ ID NO: 16758 - DNA, 20 bp, Artificial Sequence
  chemically synthesized
atttagtttggagggaaaga

SEQ ID NO: 16759 - DNA, 20 bp, Artificial Sequence
  chemically synthesized
tttagtttggagggaaagac

SEQ ID NO: 16760 - DNA, 20 bp, Artificial Sequence
  chemically synthesized
gagggaaagacaggctctaa

SEQ ID NO: 16761 - DNA, 20 bp, Artificial Sequence
  chemically synthesized
gggaaagacaggctctaaaa

SEQ ID NO: 16762 - DNA, 20 bp, Artificial Sequence
  chemically synthesized
ggaaagacaggctctaaaag

SEQ ID NO: 16763 - DNA, 20 bp, Artificial Sequence
  chemically synthesized
tctaaaagaggattaaaaat

SEQ ID NO: 16764 - DNA, 20 bp, Artificial Sequence
  chemically synthesized
agaggattaaaaattagatg

SEQ ID NO: 16765 - DNA, 20 bp, Artificial Sequence
  chemically synthesized
attaaaaattagatgtggcc

SEQ ID NO: 16766 - DNA, 20 bp, Artificial Sequence
  chemically synthesized
ttaaaaattagatgtggcct

SEQ ID NO: 16767 - DNA, 20 bp, Artificial Sequence
  chemically synthesized
aattagatgtggcctaggca

SEQ ID NO: 16768 - DNA, 20 bp, Artificial Sequence
  chemically synthesized
taggcaaagaatttatgacc

SEQ ID NO: 16769 - DNA, 20 bp, Artificial Sequence
  chemically synthesized
aaacacaacaaaaacaaaaa

SEQ ID NO: 16770 - DNA, 20 bp, Artificial Sequence
  chemically synthesized
caaaaacaaaaacagacaaa

SEQ ID NO: 16771 - DNA, 20 bp, Artificial Sequence
  chemically synthesized
aaaaacaaaaacagacaaat

SEQ ID NO: 16772 - DNA, 20 bp, Artificial Sequence
  chemically synthesized
aaaatgcttctgcaccgcaa

SEQ ID NO: 16773 - DNA, 20 bp, Artificial Sequence
  chemically synthesized
accgcaaaagaccgaatcaa

SEQ ID NO: 16774 - DNA, 20 bp, Artificial Sequence
  chemically synthesized
cgcaaaagaccgaatcaaca

SEQ ID NO: 16775 - DNA, 20 bp, Artificial Sequence
  chemically synthesized
gaccgaatcaacagagtaaa

SEQ ID NO: 16776 - DNA, 20 bp, Artificial Sequence
  chemically synthesized
cagagtaaacggataaccta

SEQ ID NO: 16777 - DNA, 20 bp, Artificial Sequence
  chemically synthesized
aaacggataacctacagaat

SEQ ID NO: 16778 - DNA, 20 bp, Artificial Sequence
  chemically synthesized
gcaaactatgaatgcaacaa

SEQ ID NO: 16779 - DNA, 20 bp, Artificial Sequence
  chemically synthesized
caaactatgaatgcaacaaa

SEQ ID NO: 16780 - DNA, 20 bp, Artificial Sequence
  chemically synthesized
tgcaacaaaaggctaatata

SEQ ID NO: 16781 - DNA, 20 bp, Artificial Sequence
  chemically synthesized
ggctaatatacagaatctac

SEQ ID NO: 16782 - DNA, 20 bp, Artificial Sequence
  chemically synthesized
gctaatatacagaatctaca

SEQ ID NO: 16783 - DNA, 20 bp, Artificial Sequence
  chemically synthesized
aacaaaaaaaccaacctcat

SEQ ID NO: 16784 - DNA, 20 bp, Artificial Sequence
  chemically synthesized
aaaaaaccaacctcattaga

SEQ ID NO: 16785 - DNA, 20 bp, Artificial Sequence
  chemically synthesized
tcattagaaagtgactgtga

SEQ ID NO: 16786 - DNA, 20 bp, Artificial Sequence
  chemically synthesized
tgactgtgatggttaatact

SEQ ID NO: 16787 - DNA, 20 bp, Artificial Sequence
  chemically synthesized
atactgagtgtcaacttgat

SEQ ID NO: 16788 - DNA, 20 bp, Artificial Sequence
  chemically synthesized
gtgtcaacttgattggactg

SEQ ID NO: 16789 - DNA, 20 bp, Artificial Sequence
  chemically synthesized
tgtcaacttgattggactga

SEQ ID NO: 16790 - DNA, 20 bp, Artificial Sequence
  chemically synthesized
tgattggactgaaggatgca

SEQ ID NO: 16791 - DNA, 20 bp, Artificial Sequence
  chemically synthesized
aggatgcaaagtaatgatct

SEQ ID NO: 16792 - DNA, 20 bp, Artificial Sequence
  chemically synthesized
ggatgcaaagtaatgatctt

SEQ ID NO: 16793 - DNA, 20 bp, Artificial Sequence
  chemically synthesized
atgatcttgggtgtgtctgt

SEQ ID NO: 16794 - DNA, 20 bp, Artificial Sequence
  chemically synthesized
tgatcttgggtgtgtctgtg

SEQ ID NO: 16795 - DNA, 20 bp, Artificial Sequence
  chemically synthesized
gatcttgggtgtgtctgtga

SEQ ID NO: 16796 - DNA, 20 bp, Artificial Sequence
  chemically synthesized
tgtctgtgagggtgttacca

SEQ ID NO: 16797 - DNA, 20 bp, Artificial Sequence
  chemically synthesized
gtctgtgagggtgttaccaa

SEQ ID NO: 16798 - DNA, 20 bp, Artificial Sequence
  chemically synthesized
ctgtgagggtgttaccaaag

SEQ ID NO: 16799 - DNA, 20 bp, Artificial Sequence
  chemically synthesized
accaaaggagattaatattt

SEQ ID NO: 16800 - DNA, 20 bp, Artificial Sequence
  chemically synthesized
aaggagattaatatttcagt

SEQ ID NO: 16801 - DNA, 20 bp, Artificial Sequence
  chemically synthesized
gagattaatatttcagtcag

SEQ ID NO: 16802 - DNA, 20 bp, Artificial Sequence
  chemically synthesized
agattaatatttcagtcagt

SEQ ID NO: 16803 - DNA, 20 bp, Artificial Sequence
  chemically synthesized
taatatttcagtcagtgggc

SEQ ID NO: 16804 - DNA, 20 bp, Artificial Sequence
  chemically synthesized
aatatttcagtcagtgggct

SEQ ID NO: 16805 - DNA, 20 bp, Artificial Sequence
  chemically synthesized
atatttcagtcagtgggctg

SEQ ID NO: 16806 - DNA, 20 bp, Artificial Sequence
  chemically synthesized
tttcagtcagtgggctgggg

SEQ ID NO: 16807 - DNA, 20 bp, Artificial Sequence
  chemically synthesized
ttcagtcagtgggctgggga

SEQ ID NO: 16808 - DNA, 20 bp, Artificial Sequence
  chemically synthesized
agtcagtgggctggggaagg

SEQ ID NO: 16809 - DNA, 20 bp, Artificial Sequence
  chemically synthesized
aggcagacccacccttaatc

SEQ ID NO: 16810 - DNA, 20 bp, Artificial Sequence
  chemically synthesized
ggcagacccacccttaatct

SEQ ID NO: 16811 - DNA, 20 bp, Artificial Sequence
  chemically synthesized
agacccacccttaatctggg

SEQ ID NO: 16812 - DNA, 20 bp, Artificial Sequence
  chemically synthesized
gacccacccttaatctgggt

SEQ ID NO: 16813 - DNA, 20 bp, Artificial Sequence
  chemically synthesized
ctgggtgggcaccatctaat

SEQ ID NO: 16814 - DNA, 20 bp, Artificial Sequence
  chemically synthesized
ggcaccatctaatcagttgc

SEQ ID NO: 16815 - DNA, 20 bp, Artificial Sequence
  chemically synthesized
catctaatcagttgccagca

SEQ ID NO: 16816 - DNA, 20 bp, Artificial Sequence
  chemically synthesized
taatcagttgccagcacagc

SEQ ID NO: 16817 - DNA, 20 bp, Artificial Sequence
  chemically synthesized
aatcagttgccagcacagcc

SEQ ID NO: 16818 - DNA, 20 bp, Artificial Sequence
  chemically synthesized
gccagcacagccaggatata

SEQ ID NO: 16819 - DNA, 20 bp, Artificial Sequence
  chemically synthesized
agcacagccaggatataaag

SEQ ID NO: 16820 - DNA, 20 bp, Artificial Sequence
  chemically synthesized
gcacagccaggatataaagc

SEQ ID NO: 16821 - DNA, 20 bp, Artificial Sequence
  chemically synthesized
cagccaggatataaagcagg

SEQ ID NO: 16822 - DNA, 20 bp, Artificial Sequence
  chemically synthesized
agcaggcagaaaaatgtgaa

SEQ ID NO: 16823 - DNA, 20 bp, Artificial Sequence
  chemically synthesized
gcaggcagaaaaatgtgaaa

SEQ ID NO: 16824 - DNA, 20 bp, Artificial Sequence
  chemically synthesized
gcagaaaaatgtgaaaaggc

SEQ ID NO: 16825 - DNA, 20 bp, Artificial Sequence
  chemically synthesized
aaaatgtgaaaaggctagat

SEQ ID NO: 16826 - DNA, 20 bp, Artificial Sequence
  chemically synthesized
gtgaaaaggctagattggct

SEQ ID NO: 16827 - DNA, 20 bp, Artificial Sequence
  chemically synthesized
gctagattggcttggcatcc

SEQ ID NO: 16828 - DNA, 20 bp, Artificial Sequence
  chemically synthesized
cctacatttttctcccatgc

SEQ ID NO: 16829 - DNA, 20 bp, Artificial Sequence
  chemically synthesized
atgctggattcttcctgccc

SEQ ID NO: 16830 - DNA, 20 bp, Artificial Sequence
  chemically synthesized
tgccctggaacattgaactc

SEQ ID NO: 16831 - DNA, 20 bp, Artificial Sequence
  chemically synthesized
gccctggaacattgaactcc

SEQ ID NO: 16832 - DNA, 20 bp, Artificial Sequence
  chemically synthesized
acattgaactccaggttctt

SEQ ID NO: 16833 - DNA, 20 bp, Artificial Sequence
  chemically synthesized
aactccaggttcttcagctt

SEQ ID NO: 16834 - DNA, 20 bp, Artificial Sequence
  chemically synthesized
actccaggttcttcagcttt

SEQ ID NO: 16835 - DNA, 20 bp, Artificial Sequence
  chemically synthesized
ttcagctttgggactccgac

SEQ ID NO: 16836 - DNA, 20 bp, Artificial Sequence
  chemically synthesized
cgactagcttccttgttcct

SEQ ID NO: 16837 - DNA, 20 bp, Artificial Sequence
  chemically synthesized
tagcttccttgttcctcagc

SEQ ID NO: 16838 - DNA, 20 bp, Artificial Sequence
  chemically synthesized
cttccttgttcctcagctgg

SEQ ID NO: 16839 - DNA, 20 bp, Artificial Sequence
  chemically synthesized
cttgttcctcagctggcaga

SEQ ID NO: 16840 - DNA, 20 bp, Artificial Sequence
  chemically synthesized
agctggcagatggcctgttt

SEQ ID NO: 16841 - DNA, 20 bp, Artificial Sequence
  chemically synthesized
gctggcagatggcctgtttt

SEQ ID NO: 16842 - DNA, 20 bp, Artificial Sequence
  chemically synthesized
ttgggaccttgtgaacatgt

SEQ ID NO: 16843 - DNA, 20 bp, Artificial Sequence
  chemically synthesized
ctacataataaactctcata

SEQ ID NO: 16844 - DNA, 20 bp, Artificial Sequence
  chemically synthesized
aataaactctcatatagata

SEQ ID NO: 16845 - DNA, 20 bp, Artificial Sequence
  chemically synthesized
ctctcatatagatatagata

SEQ ID NO: 16846 - DNA, 20 bp, Artificial Sequence
  chemically synthesized
ctcatatagatatagatata

SEQ ID NO: 16847 - DNA, 20 bp, Artificial Sequence
  chemically synthesized
tatagatatagatatagaga

SEQ ID NO: 16848 - DNA, 20 bp, Artificial Sequence
  chemically synthesized
tatagatatagagatagata

SEQ ID NO: 16849 - DNA, 20 bp, Artificial Sequence
  chemically synthesized
tagatatagagatagatata

SEQ ID NO: 16850 - DNA, 20 bp, Artificial Sequence
  chemically synthesized
tatagagatagatatagaga

SEQ ID NO: 16851 - DNA, 20 bp, Artificial Sequence
  chemically synthesized
gatagatatagagatagata

SEQ ID NO: 16852 - DNA, 20 bp, Artificial Sequence
  chemically synthesized
tatagagatagatatagata

SEQ ID NO: 16853 - DNA, 20 bp, Artificial Sequence
  chemically synthesized
gatagatatagatatagata

SEQ ID NO: 16854 - DNA, 20 bp, Artificial Sequence
  chemically synthesized
tatagatatagatatagata

SEQ ID NO: 16855 - DNA, 20 bp, Artificial Sequence
  chemically synthesized
tatagatatagatatagata

SEQ ID NO: 16856 - DNA, 20 bp, Artificial Sequence
  chemically synthesized
tatagatatagatatagata

SEQ ID NO: 16857 - DNA, 20 bp, Artificial Sequence
  chemically synthesized
ctattaattctgtttctctg

SEQ ID NO: 16858 - DNA, 20 bp, Artificial Sequence
  chemically synthesized
ttctctgtagaaccctaata

SEQ ID NO: 16859 - DNA, 20 bp, Artificial Sequence
  chemically synthesized
tagaaccctaatacagattt

SEQ ID NO: 16860 - DNA, 20 bp, Artificial Sequence
  chemically synthesized
cctaatacagattttggtac

SEQ ID NO: 16861 - DNA, 20 bp, Artificial Sequence
  chemically synthesized
ctaatacagattttggtacc

SEQ ID NO: 16862 - DNA, 20 bp, Artificial Sequence
  chemically synthesized
aatacagattttggtaccag

SEQ ID NO: 16863 - DNA, 20 bp, Artificial Sequence
  chemically synthesized
acagattttggtaccaggag

SEQ ID NO: 16864 - DNA, 20 bp, Artificial Sequence
  chemically synthesized
tttggtaccaggagtggttc

SEQ ID NO: 16865 - DNA, 20 bp, Artificial Sequence
  chemically synthesized
tggtaccaggagtggttcta

SEQ ID NO: 16866 - DNA, 20 bp, Artificial Sequence
  chemically synthesized
ggtaccaggagtggttctag

SEQ ID NO: 16867 - DNA, 20 bp, Artificial Sequence
  chemically synthesized
caggagtggttctagaggaa

SEQ ID NO: 16868 - DNA, 20 bp, Artificial Sequence
  chemically synthesized
ttctagaggaacagaatatt

SEQ ID NO: 16869 - DNA, 20 bp, Artificial Sequence
  chemically synthesized
tctagaggaacagaatatta

SEQ ID NO: 16870 - DNA, 20 bp, Artificial Sequence
  chemically synthesized
gaggaacagaatattaagga

SEQ ID NO: 16871 - DNA, 20 bp, Artificial Sequence
  chemically synthesized
ggaacagaatattaaggatg

SEQ ID NO: 16872 - DNA, 20 bp, Artificial Sequence
  chemically synthesized
taaggatggagttctttcat

SEQ ID NO: 16873 - DNA, 20 bp, Artificial Sequence
  chemically synthesized
tggagttctttcattggttt

SEQ ID NO: 16874 - DNA, 20 bp, Artificial Sequence
  chemically synthesized
ggagttctttcattggtttt

SEQ ID NO: 16875 - DNA, 20 bp, Artificial Sequence
  chemically synthesized
gagttctttcattggttttg

SEQ ID NO: 16876 - DNA, 20 bp, Artificial Sequence
  chemically synthesized
ttcattggttttggggtttc

SEQ ID NO: 16877 - DNA, 20 bp, Artificial Sequence
  chemically synthesized
cattggttttggggtttctg

SEQ ID NO: 16878 - DNA, 20 bp, Artificial Sequence
  chemically synthesized
ggttttggggtttctggagt

SEQ ID NO: 16879 - DNA, 20 bp, Artificial Sequence
  chemically synthesized
agttggctgcttaatatgat

SEQ ID NO: 16880 - DNA, 20 bp, Artificial Sequence
  chemically synthesized
tgattagacccaaatatgct

SEQ ID NO: 16881 - DNA, 20 bp, Artificial Sequence
  chemically synthesized
gattagacccaaatatgcta

SEQ ID NO: 16882 - DNA, 20 bp, Artificial Sequence
  chemically synthesized
gctaaggactcttcttctaa

SEQ ID NO: 16883 - DNA, 20 bp, Artificial Sequence
  chemically synthesized
ggactcttcttctaatggta

SEQ ID NO: 16884 - DNA, 20 bp, Artificial Sequence
  chemically synthesized
actcttcttctaatggtatg

SEQ ID NO: 16885 - DNA, 20 bp, Artificial Sequence
  chemically synthesized
tggagaacactgataatcct

SEQ ID NO: 16886 - DNA, 20 bp, Artificial Sequence
  chemically synthesized
aatccttggcatcaattgtt

SEQ ID NO: 16887 - DNA, 20 bp, Artificial Sequence
  chemically synthesized
tccttggcatcaattgttta

SEQ ID NO: 16888 - DNA, 20 bp, Artificial Sequence
  chemically synthesized
cttggcatcaattgtttaga

SEQ ID NO: 16889 - DNA, 20 bp, Artificial Sequence
  chemically synthesized
actcttgattcaacgcttgt

SEQ ID NO: 16890 - DNA, 20 bp, Artificial Sequence
  chemically synthesized
tcttgattcaacgcttgtga

SEQ ID NO: 16891 - DNA, 20 bp, Artificial Sequence
  chemically synthesized
cttgattcaacgcttgtgag

SEQ ID NO: 16892 - DNA, 20 bp, Artificial Sequence
  chemically synthesized
attcaacgcttgtgagaggc

SEQ ID NO: 16893 - DNA, 20 bp, Artificial Sequence
  chemically synthesized
ttcaacgcttgtgagaggca

SEQ ID NO: 16894 - DNA, 20 bp, Artificial Sequence
  chemically synthesized
cttgtgagaggcaaggaatt

SEQ ID NO: 16895 - DNA, 20 bp, Artificial Sequence
  chemically synthesized
ataatacttttgactatatg

SEQ ID NO: 16896 - DNA, 20 bp, Artificial Sequence
  chemically synthesized
aatacttttgactatatgtg

SEQ ID NO: 16897 - DNA, 20 bp, Artificial Sequence
  chemically synthesized
ttgactatatgtggagaatc

SEQ ID NO: 16898 - DNA, 20 bp, Artificial Sequence
  chemically synthesized
tgactatatgtggagaatca

SEQ ID NO: 16899 - DNA, 20 bp, Artificial Sequence
  chemically synthesized
atgtggagaatcaaggaaca

SEQ ID NO: 16900 - DNA, 20 bp, Artificial Sequence
  chemically synthesized
gagaatcaaggaacatagtg

SEQ ID NO: 16901 - DNA, 20 bp, Artificial Sequence
  chemically synthesized
atcaaggaacatagtgaagt

SEQ ID NO: 16902 - DNA, 20 bp, Artificial Sequence
  chemically synthesized
aggaacatagtgaagttggt

SEQ ID NO: 16903 - DNA, 20 bp, Artificial Sequence
  chemically synthesized
gaagttggttggttgcttgt

SEQ ID NO: 16904 - DNA, 20 bp, Artificial Sequence
  chemically synthesized
ttggttgcttgtaagttcgc

SEQ ID NO: 16905 - DNA, 20 bp, Artificial Sequence
  chemically synthesized
gcttgtaagttcgctggaca

SEQ ID NO: 16906 - DNA, 20 bp, Artificial Sequence
  chemically synthesized
ttcgctggacaaagtgatga

SEQ ID NO: 16907 - DNA, 20 bp, Artificial Sequence
  chemically synthesized
atgaaagaaaatgatgaact

SEQ ID NO: 16908 - DNA, 20 bp, Artificial Sequence
  chemically synthesized
tgaaagaaaatgatgaactc

SEQ ID NO: 16909 - DNA, 20 bp, Artificial Sequence
  chemically synthesized
aaagaaaatgatgaactcag

SEQ ID NO: 16910 - DNA, 20 bp, Artificial Sequence
  chemically synthesized
tcaggagtatatcaactctc

SEQ ID NO: 16911 - DNA, 20 bp, Artificial Sequence
  chemically synthesized
ctttgtgccataatcttatt

SEQ ID NO: 16912 - DNA, 20 bp, Artificial Sequence
  chemically synthesized
ttgtgccataatcttatttg

SEQ ID NO: 16913 - DNA, 20 bp, Artificial Sequence
  chemically synthesized
gtgccataatcttatttgga

SEQ ID NO: 16914 - DNA, 20 bp, Artificial Sequence
  chemically synthesized
tgctcacctttcacttccac

SEQ ID NO: 16915 - DNA, 20 bp, Artificial Sequence
  chemically synthesized
ttcacttccacaagatatca

SEQ ID NO: 16916 - DNA, 20 bp, Artificial Sequence
  chemically synthesized
acttccacaagatatcacag

SEQ ID NO: 16917 - DNA, 20 bp, Artificial Sequence
  chemically synthesized
tacattgatgacatgctgac

SEQ ID NO: 16918 - DNA, 20 bp, Artificial Sequence
  chemically synthesized
gatgacatgctgactggaac

SEQ ID NO: 16919 - DNA, 20 bp, Artificial Sequence
  chemically synthesized
acatgctgactggaactagt

SEQ ID NO: 16920 - DNA, 20 bp, Artificial Sequence
  chemically synthesized
gctgactggaactagtgagc

SEQ ID NO: 16921 - DNA, 20 bp, Artificial Sequence
  chemically synthesized
gactggaactagtgagcaag

SEQ ID NO: 16922 - DNA, 20 bp, Artificial Sequence
  chemically synthesized
tggaactagtgagcaagaag

SEQ ID NO: 16923 - DNA, 20 bp, Artificial Sequence
  chemically synthesized
gcaagaagtagcaaacacac

SEQ ID NO: 16924 - DNA, 20 bp, Artificial Sequence
  chemically synthesized
aacacactggatttattgat

SEQ ID NO: 16925 - DNA, 20 bp, Artificial Sequence
  chemically synthesized
atttattgatgagacatttg

SEQ ID NO: 16926 - DNA, 20 bp, Artificial Sequence
  chemically synthesized
tttattgatgagacatttgt

SEQ ID NO: 16927 - DNA, 20 bp, Artificial Sequence
  chemically synthesized
ttgatgagacatttgtggga

SEQ ID NO: 16928 - DNA, 20 bp, Artificial Sequence
  chemically synthesized
gatgagacatttgtgggaca

SEQ ID NO: 16929 - DNA, 20 bp, Artificial Sequence
  chemically synthesized
atgagacatttgtgggacag

SEQ ID NO: 16930 - DNA, 20 bp, Artificial Sequence
  chemically synthesized
gacatttgtgggacagagga

SEQ ID NO: 16931 - DNA, 20 bp, Artificial Sequence
  chemically synthesized
acatttgtgggacagaggat

SEQ ID NO: 16932 - DNA, 20 bp, Artificial Sequence
  chemically synthesized
gaaataaatctgattaaatt

SEQ ID NO: 16933 - DNA, 20 bp, Artificial Sequence
  chemically synthesized
aaataaatctgattaaattc

SEQ ID NO: 16934 - DNA, 20 bp, Artificial Sequence
  chemically synthesized
aataaatctgattaaattca

SEQ ID NO: 16935 - DNA, 20 bp, Artificial Sequence
  chemically synthesized
aattcagggaccttctacct

SEQ ID NO: 16936 - DNA, 20 bp, Artificial Sequence
  chemically synthesized
ttctacctcagtaaaattta

SEQ ID NO: 16937 - DNA, 20 bp, Artificial Sequence
  chemically synthesized
tctacctcagtaaaatttat

SEQ ID NO: 16938 - DNA, 20 bp, Artificial Sequence
  chemically synthesized
ctacctcagtaaaatttata

SEQ ID NO: 16939 - DNA, 20 bp, Artificial Sequence
  chemically synthesized
tacctcagtaaaatttatag

SEQ ID NO: 16940 - DNA, 20 bp, Artificial Sequence
  chemically synthesized
taaaatttataggggtccaa

SEQ ID NO: 16941 - DNA, 20 bp, Artificial Sequence
  chemically synthesized
tttataggggtccaatggtt

SEQ ID NO: 16942 - DNA, 20 bp, Artificial Sequence
  chemically synthesized
ttataggggtccaatggttt

SEQ ID NO: 16943 - DNA, 20 bp, Artificial Sequence
  chemically synthesized
tataggggtccaatggtttg

SEQ ID NO: 16944 - DNA, 20 bp, Artificial Sequence
  chemically synthesized
ccaatggtttggggctcttt

SEQ ID NO: 16945 - DNA, 20 bp, Artificial Sequence
  chemically synthesized
tctttgagatattccttcta

SEQ ID NO: 16946 - DNA, 20 bp, Artificial Sequence
  chemically synthesized
gagatattccttctaaagtg

SEQ ID NO: 16947 - DNA, 20 bp, Artificial Sequence
  chemically synthesized
agatattccttctaaagtga

SEQ ID NO: 16948 - DNA, 20 bp, Artificial Sequence
  chemically synthesized
gaaggataatttgctgcatt

SEQ ID NO: 16949 - DNA, 20 bp, Artificial Sequence
  chemically synthesized
atttggccactcttacaacc

SEQ ID NO: 16950 - DNA, 20 bp, Artificial Sequence
  chemically synthesized
ccactcttacaaccaagaaa

SEQ ID NO: 16951 - DNA, 20 bp, Artificial Sequence
  chemically synthesized
cactcttacaaccaagaaat

SEQ ID NO: 16952 - DNA, 20 bp, Artificial Sequence
  chemically synthesized
caagaaataggcacaacgcc

SEQ ID NO: 16953 - DNA, 20 bp, Artificial Sequence
  chemically synthesized
gaaataggcacaacgcctag

SEQ ID NO: 16954 - DNA, 20 bp, Artificial Sequence
  chemically synthesized
aaataggcacaacgcctagt

SEQ ID NO: 16955 - DNA, 20 bp, Artificial Sequence
  chemically synthesized
caacgcctagtgggcctatt

SEQ ID NO: 16956 - DNA, 20 bp, Artificial Sequence
  chemically synthesized
tagtgggcctatttggattt

SEQ ID NO: 16957 - DNA, 20 bp, Artificial Sequence
  chemically synthesized
gtgggcctatttggattttg

SEQ ID NO: 16958 - DNA, 20 bp, Artificial Sequence
  chemically synthesized
tgggcctatttggattttgg

SEQ ID NO: 16959 - DNA, 20 bp, Artificial Sequence
  chemically synthesized
gaggcaacatattcctgatt

SEQ ID NO: 16960 - DNA, 20 bp, Artificial Sequence
  chemically synthesized
aggcaacatattcctgattt

SEQ ID NO: 16961 - DNA, 20 bp, Artificial Sequence
  chemically synthesized
ctgatttgggtgtgttactc

SEQ ID NO: 16962 - DNA, 20 bp, Artificial Sequence
  chemically synthesized
gttactctggcccatttatc

SEQ ID NO: 16963 - DNA, 20 bp, Artificial Sequence
  chemically synthesized
ccatttatcgagtgatccaa

SEQ ID NO: 16964 - DNA, 20 bp, Artificial Sequence
  chemically synthesized
catttatcgagtgatccaaa

SEQ ID NO: 16965 - DNA, 20 bp, Artificial Sequence
  chemically synthesized
cgagtgatccaaaaggctgc

SEQ ID NO: 16966 - DNA, 20 bp, Artificial Sequence
  chemically synthesized
tccaaaaggctgccagtttt

SEQ ID NO: 16967 - DNA, 20 bp, Artificial Sequence
  chemically synthesized
aaaaggctgccagttttgag

SEQ ID NO: 16968 - DNA, 20 bp, Artificial Sequence
  chemically synthesized
aaggctgccagttttgagtg

SEQ ID NO: 16969 - DNA, 20 bp, Artificial Sequence
  chemically synthesized
tgccagttttgagtggagtc

SEQ ID NO: 16970 - DNA, 20 bp, Artificial Sequence
  chemically synthesized
gttttgagtggagtccagaa

SEQ ID NO: 16971 - DNA, 20 bp, Artificial Sequence
  chemically synthesized
ttgagtggagtccagaacag

SEQ ID NO: 16972 - DNA, 20 bp, Artificial Sequence
  chemically synthesized
tgagtggagtccagaacaga

SEQ ID NO: 16973 - DNA, 20 bp, Artificial Sequence
  chemically synthesized
cagaacagaaggctctgcca

SEQ ID NO: 16974 - DNA, 20 bp, Artificial Sequence
  chemically synthesized
agaacagaaggctctgccac

SEQ ID NO: 16975 - DNA, 20 bp, Artificial Sequence
  chemically synthesized
agaaggctctgccacaggtc

SEQ ID NO: 16976 - DNA, 20 bp, Artificial Sequence
  chemically synthesized
gaaggctctgccacaggtcc

SEQ ID NO: 16977 - DNA, 20 bp, Artificial Sequence
  chemically synthesized
acaggtccaggctgctgtgc

SEQ ID NO: 16978 - DNA, 20 bp, Artificial Sequence
  chemically synthesized
gtgcaagctgctatgccact

SEQ ID NO: 16979 - DNA, 20 bp, Artificial Sequence
  chemically synthesized
tgcaagctgctatgccactt

SEQ ID NO: 16980 - DNA, 20 bp, Artificial Sequence
  chemically synthesized
gccacttgggccatatgacc

SEQ ID NO: 16981 - DNA, 20 bp, Artificial Sequence
  chemically synthesized
acttgggccatatgacctag

SEQ ID NO: 16982 - DNA, 20 bp, Artificial Sequence
  chemically synthesized
tagcagatccaatgatgctt

SEQ ID NO: 16983 - DNA, 20 bp, Artificial Sequence
  chemically synthesized
agcagatccaatgatgcttg

SEQ ID NO: 16984 - DNA, 20 bp, Artificial Sequence
  chemically synthesized
tccaatgatgcttgaggtgt

SEQ ID NO: 16985 - DNA, 20 bp, Artificial Sequence
  chemically synthesized
gatgcttgaggtgtcagtgc

SEQ ID NO: 16986 - DNA, 20 bp, Artificial Sequence
  chemically synthesized
cttgaggtgtcagtgccaga

SEQ ID NO: 16987 - DNA, 20 bp, Artificial Sequence
  chemically synthesized
ttgaggtgtcagtgccagat

SEQ ID NO: 16988 - DNA, 20 bp, Artificial Sequence
  chemically synthesized
tgaggtgtcagtgccagata

SEQ ID NO: 16989 - DNA, 20 bp, Artificial Sequence
  chemically synthesized
tgccagatagggatgctgtt

SEQ ID NO: 16990 - DNA, 20 bp, Artificial Sequence
  chemically synthesized
ccagatagggatgctgtttg

SEQ ID NO: 16991 - DNA, 20 bp, Artificial Sequence
  chemically synthesized
gggatgctgtttggagcatt

SEQ ID NO: 16992 - DNA, 20 bp, Artificial Sequence
  chemically synthesized
atgctgtttggagcatttgg

SEQ ID NO: 16993 - DNA, 20 bp, Artificial Sequence
  chemically synthesized
tgctgtttggagcatttggc

SEQ ID NO: 16994 - DNA, 20 bp, Artificial Sequence
  chemically synthesized
gcatttggcaggctgaatca

SEQ ID NO: 16995 - DNA, 20 bp, Artificial Sequence
  chemically synthesized
tttggcaggctgaatcacag

SEQ ID NO: 16996 - DNA, 20 bp, Artificial Sequence
  chemically synthesized
tggcaggctgaatcacagcg

SEQ ID NO: 16997 - DNA, 20 bp, Artificial Sequence
  chemically synthesized
ggcaggctgaatcacagcgg

SEQ ID NO: 16998 - DNA, 20 bp, Artificial Sequence
  chemically synthesized
tgaatcacagcggaggcctc

SEQ ID NO: 16999 - DNA, 20 bp, Artificial Sequence
  chemically synthesized
gaatcacagcggaggcctct

SEQ ID NO: 17000 - DNA, 20 bp, Artificial Sequence
  chemically synthesized
agcggaggcctctaggattt

SEQ ID NO: 17001 - DNA, 20 bp, Artificial Sequence
  chemically synthesized
cggaggcctctaggattttg

SEQ ID NO: 17002 - DNA, 20 bp, Artificial Sequence
  chemically synthesized
ggcctctaggattttggagc

SEQ ID NO: 17003 - DNA, 20 bp, Artificial Sequence
  chemically synthesized
gcctctaggattttggagca

SEQ ID NO: 17004 - DNA, 20 bp, Artificial Sequence
  chemically synthesized
caaggccctgccatcttctg

SEQ ID NO: 17005 - DNA, 20 bp, Artificial Sequence
  chemically synthesized
tgcagataactactctcttt

SEQ ID NO: 17006 - DNA, 20 bp, Artificial Sequence
  chemically synthesized
gcagataactactctctttt

SEQ ID NO: 17007 - DNA, 20 bp, Artificial Sequence
  chemically synthesized
cagataactactctctttta

SEQ ID NO: 17008 - DNA, 20 bp, Artificial Sequence
  chemically synthesized
gataactactctcttttagg

SEQ ID NO: 17009 - DNA, 20 bp, Artificial Sequence
  chemically synthesized
actactctcttttagggaga

SEQ ID NO: 17010 - DNA, 20 bp, Artificial Sequence
  chemically synthesized
tcttttagggagaaagctct

SEQ ID NO: 17011 - DNA, 20 bp, Artificial Sequence
  chemically synthesized
gaaagctcttggcctgttac

SEQ ID NO: 17012 - DNA, 20 bp, Artificial Sequence
  chemically synthesized
aaagctcttggcctgttact

SEQ ID NO: 17013 - DNA, 20 bp, Artificial Sequence
  chemically synthesized
cttggcctgttactgggctt

SEQ ID NO: 17014 - DNA, 20 bp, Artificial Sequence
  chemically synthesized
ggcctgttactgggctttgg

SEQ ID NO: 17015 - DNA, 20 bp, Artificial Sequence
  chemically synthesized
gaaacgaaatatttgactat

SEQ ID NO: 17016 - DNA, 20 bp, Artificial Sequence
  chemically synthesized
atatttgactatgagtcatc

SEQ ID NO: 17017 - DNA, 20 bp, Artificial Sequence
  chemically synthesized
ctgaactgcctatcatgaac

SEQ ID NO: 17018 - DNA, 20 bp, Artificial Sequence
  chemically synthesized
tgaactgcctatcatgaact

SEQ ID NO: 17019 - DNA, 20 bp, Artificial Sequence
  chemically synthesized
tgggtgctttctgatccatc

SEQ ID NO: 17020 - DNA, 20 bp, Artificial Sequence
  chemically synthesized
ttctgatccatctagccata

SEQ ID NO: 17021 - DNA, 20 bp, Artificial Sequence
  chemically synthesized
tgatccatctagccataaag

SEQ ID NO: 17022 - DNA, 20 bp, Artificial Sequence
  chemically synthesized
gatccatctagccataaagt

SEQ ID NO: 17023 - DNA, 20 bp, Artificial Sequence
  chemically synthesized
gccataaagtgggctgtgca

SEQ ID NO: 17024 - DNA, 20 bp, Artificial Sequence
  chemically synthesized
ataaagtgggctgtgcacag

SEQ ID NO: 17025 - DNA, 20 bp, Artificial Sequence
  chemically synthesized
tgtgcacagcagcattgcat

SEQ ID NO: 17026 - DNA, 20 bp, Artificial Sequence
  chemically synthesized
agcagcattgcatcagcaaa

SEQ ID NO: 17027 - DNA, 20 bp, Artificial Sequence
  chemically synthesized
agcattgcatcagcaaatgg

SEQ ID NO: 17028 - DNA, 20 bp, Artificial Sequence
  chemically synthesized
attgcatcagcaaatggaag

SEQ ID NO: 17029 - DNA, 20 bp, Artificial Sequence
  chemically synthesized
ggaagtggtatatatgcgat

SEQ ID NO: 17030 - DNA, 20 bp, Artificial Sequence
  chemically synthesized
gaagtggtatatatgcgatt

SEQ ID NO: 17031 - DNA, 20 bp, Artificial Sequence
  chemically synthesized
gtatatatgcgattgggctt

SEQ ID NO: 17032 - DNA, 20 bp, Artificial Sequence
  chemically synthesized
tatatgcgattgggcttgag

SEQ ID NO: 17033 - DNA, 20 bp, Artificial Sequence
  chemically synthesized
ttgggcttgagcagatcctg

SEQ ID NO: 17034 - DNA, 20 bp, Artificial Sequence
  chemically synthesized
tgggcttgagcagatcctga

SEQ ID NO: 17035 - DNA, 20 bp, Artificial Sequence
  chemically synthesized
tgagcagatcctgaaggcac

SEQ ID NO: 17036 - DNA, 20 bp, Artificial Sequence
  chemically synthesized
cagatcctgaaggcactagt

SEQ ID NO: 17037 - DNA, 20 bp, Artificial Sequence
  chemically synthesized
aaggcactagtaagttacat

SEQ ID NO: 17038 - DNA, 20 bp, Artificial Sequence
  chemically synthesized
cactagtaagttacatgaga

SEQ ID NO: 17039 - DNA, 20 bp, Artificial Sequence
  chemically synthesized
actagtaagttacatgagaa

SEQ ID NO: 17040 - DNA, 20 bp, Artificial Sequence
  chemically synthesized
ctagtaagttacatgagaaa

SEQ ID NO: 17041 - DNA, 20 bp, Artificial Sequence
  chemically synthesized
tagtaagttacatgagaaag

SEQ ID NO: 17042 - DNA, 20 bp, Artificial Sequence
  chemically synthesized
gaaaggggctcaaatgccca

SEQ ID NO: 17043 - DNA, 20 bp, Artificial Sequence
  chemically synthesized
acacactgctttctctccct

SEQ ID NO: 17044 - DNA, 20 bp, Artificial Sequence
  chemically synthesized
tctccctgagactgcaccga

SEQ ID NO: 17045 - DNA, 20 bp, Artificial Sequence
  chemically synthesized
agactgcaccgatggtctca

SEQ ID NO: 17046 - DNA, 20 bp, Artificial Sequence
  chemically synthesized
gactgcaccgatggtctcat

SEQ ID NO: 17047 - DNA, 20 bp, Artificial Sequence
  chemically synthesized
actgcaccgatggtctcatg

SEQ ID NO: 17048 - DNA, 20 bp, Artificial Sequence
  chemically synthesized
tgcaccgatggtctcatggg

SEQ ID NO: 17049 - DNA, 20 bp, Artificial Sequence
  chemically synthesized
catggggagttccctatgat

SEQ ID NO: 17050 - DNA, 20 bp, Artificial Sequence
  chemically synthesized
agttccctatgatcagctga

SEQ ID NO: 17051 - DNA, 20 bp, Artificial Sequence
  chemically synthesized
ttccctatgatcagctgaca

SEQ ID NO: 17052 - DNA, 20 bp, Artificial Sequence
  chemically synthesized
tccctatgatcagctgacag

SEQ ID NO: 17053 - DNA, 20 bp, Artificial Sequence
  chemically synthesized
ctatgatcagctgacagagg

SEQ ID NO: 17054 - DNA, 20 bp, Artificial Sequence
  chemically synthesized
atgatcagctgacagaggaa

SEQ ID NO: 17055 - DNA, 20 bp, Artificial Sequence
  chemically synthesized
atcagctgacagaggaagag

SEQ ID NO: 17056 - DNA, 20 bp, Artificial Sequence
  chemically synthesized
ctgacagaggaagagaagac

SEQ ID NO: 17057 - DNA, 20 bp, Artificial Sequence
  chemically synthesized
tgacagaggaagagaagact

SEQ ID NO: 17058 - DNA, 20 bp, Artificial Sequence
  chemically synthesized
aggaagagaagactaggtcc

SEQ ID NO: 17059 - DNA, 20 bp, Artificial Sequence
  chemically synthesized
gaagactaggtcctggttca

SEQ ID NO: 17060 - DNA, 20 bp, Artificial Sequence
  chemically synthesized
actaggtcctggttcacaga

SEQ ID NO: 17061 - DNA, 20 bp, Artificial Sequence
  chemically synthesized
agatagttctgcacgatatg

SEQ ID NO: 17062 - DNA, 20 bp, Artificial Sequence
  chemically synthesized
gatagttctgcacgatatgc

SEQ ID NO: 17063 - DNA, 20 bp, Artificial Sequence
  chemically synthesized
gatatgcaggcaccacccaa

SEQ ID NO: 17064 - DNA, 20 bp, Artificial Sequence
  chemically synthesized
atgcaggcaccacccaaaag

SEQ ID NO: 17065 - DNA, 20 bp, Artificial Sequence
  chemically synthesized
aggcaccacccaaaagtgga

SEQ ID NO: 17066 - DNA, 20 bp, Artificial Sequence
  chemically synthesized
cacccaaaagtggacagccg

SEQ ID NO: 17067 - DNA, 20 bp, Artificial Sequence
  chemically synthesized
agtggacagccgcagcacta

SEQ ID NO: 17068 - DNA, 20 bp, Artificial Sequence
  chemically synthesized
gcagcactacagcccctttc

SEQ ID NO: 17069 - DNA, 20 bp, Artificial Sequence
  chemically synthesized
cagcactacagcccctttct

SEQ ID NO: 17070 - DNA, 20 bp, Artificial Sequence
  chemically synthesized
ccctttctaggacatccctg

SEQ ID NO: 17071 - DNA, 20 bp, Artificial Sequence
  chemically synthesized
cctttctaggacatccctga

SEQ ID NO: 17072 - DNA, 20 bp, Artificial Sequence
  chemically synthesized
aggacatccctgaaggacaa

SEQ ID NO: 17073 - DNA, 20 bp, Artificial Sequence
  chemically synthesized
atccctgaaggacaacggtg

SEQ ID NO: 17074 - DNA, 20 bp, Artificial Sequence
  chemically synthesized
tccctgaaggacaacggtga

SEQ ID NO: 17075 - DNA, 20 bp, Artificial Sequence
  chemically synthesized
ccctgaaggacaacggtgaa

SEQ ID NO: 17076 - DNA, 20 bp, Artificial Sequence
  chemically synthesized
acggtgaagggaaatcttcc

SEQ ID NO: 17077 - DNA, 20 bp, Artificial Sequence
  chemically synthesized
tgaagggaaatcttcctagt

SEQ ID NO: 17078 - DNA, 20 bp, Artificial Sequence
  chemically synthesized
agggaaatcttcctagttgg

SEQ ID NO: 17079 - DNA, 20 bp, Artificial Sequence
  chemically synthesized
ttcctagttggcagaacttt

SEQ ID NO: 17080 - DNA, 20 bp, Artificial Sequence
  chemically synthesized
ctagttggcagaactttgag

SEQ ID NO: 17081 - DNA, 20 bp, Artificial Sequence
  chemically synthesized
agaactttgagcagtgtgcc

SEQ ID NO: 17082 - DNA, 20 bp, Artificial Sequence
  chemically synthesized
gcctggttgtgcactttgca

SEQ ID NO: 17083 - DNA, 20 bp, Artificial Sequence
  chemically synthesized
tggttgtgcactttgcacag

SEQ ID NO: 17084 - DNA, 20 bp, Artificial Sequence
  chemically synthesized
ggttgtgcactttgcacaga

SEQ ID NO: 17085 - DNA, 20 bp, Artificial Sequence
  chemically synthesized
ttgtgcactttgcacagaag

SEQ ID NO: 17086 - DNA, 20 bp, Artificial Sequence
  chemically synthesized
actttgcacagaaggagaaa

SEQ ID NO: 17087 - DNA, 20 bp, Artificial Sequence
  chemically synthesized
tgcacagaaggagaaatggc

SEQ ID NO: 17088 - DNA, 20 bp, Artificial Sequence
  chemically synthesized
tgcgattatatacttattca

SEQ ID NO: 17089 - DNA, 20 bp, Artificial Sequence
  chemically synthesized
gcgattatatacttattcat

SEQ ID NO: 17090 - DNA, 20 bp, Artificial Sequence
  chemically synthesized
atatacttattcatgggctg

SEQ ID NO: 17091 - DNA, 20 bp, Artificial Sequence
  chemically synthesized
ttattcatgggctgtagcca

SEQ ID NO: 17092 - DNA, 20 bp, Artificial Sequence
  chemically synthesized
tattcatgggctgtagccaa

SEQ ID NO: 17093 - DNA, 20 bp, Artificial Sequence
  chemically synthesized
atgggctgtagccaaaggtt

SEQ ID NO: 17094 - DNA, 20 bp, Artificial Sequence
  chemically synthesized
gctgtagccaaaggtttggc

SEQ ID NO: 17095 - DNA, 20 bp, Artificial Sequence
  chemically synthesized
tagccaaaggtttggctaga

SEQ ID NO: 17096 - DNA, 20 bp, Artificial Sequence
  chemically synthesized
caaaggtttggctagatggt

SEQ ID NO: 17097 - DNA, 20 bp, Artificial Sequence
  chemically synthesized
aaaggtttggctagatggtc

SEQ ID NO: 17098 - DNA, 20 bp, Artificial Sequence
  chemically synthesized
aaggtttggctagatggtca

SEQ ID NO: 17099 - DNA, 20 bp, Artificial Sequence
  chemically synthesized
tggctagatggtcagggact

SEQ ID NO: 17100 - DNA, 20 bp, Artificial Sequence
  chemically synthesized
gatggtcagggacttggaaa

SEQ ID NO: 17101 - DNA, 20 bp, Artificial Sequence
  chemically synthesized
ggacttggaaaaagcatgac

SEQ ID NO: 17102 - DNA, 20 bp, Artificial Sequence
  chemically synthesized
tgactggaaaattgatgaca

SEQ ID NO: 17103 - DNA, 20 bp, Artificial Sequence
  chemically synthesized
aaattgatgacaaagaaatt

SEQ ID NO: 17104 - DNA, 20 bp, Artificial Sequence
  chemically synthesized
aattgatgacaaagaaattt

SEQ ID NO: 17105 - DNA, 20 bp, Artificial Sequence
  chemically synthesized
attgatgacaaagaaatttg

SEQ ID NO: 17106 - DNA, 20 bp, Artificial Sequence
  chemically synthesized
gatgacaaagaaatttgggg

SEQ ID NO: 17107 - DNA, 20 bp, Artificial Sequence
  chemically synthesized
tgacaaagaaatttggggaa

SEQ ID NO: 17108 - DNA, 20 bp, Artificial Sequence
  chemically synthesized
gacaaagaaatttggggaag

SEQ ID NO: 17109 - DNA, 20 bp, Artificial Sequence
  chemically synthesized
aaatttggggaagaggtatg

SEQ ID NO: 17110 - DNA, 20 bp, Artificial Sequence
  chemically synthesized
ttggggaagaggtatgtgga

SEQ ID NO: 17111 - DNA, 20 bp, Artificial Sequence
  chemically synthesized
tgtggatggacctctatgat

SEQ ID NO: 17112 - DNA, 20 bp, Artificial Sequence
  chemically synthesized
atgattagtcaaaaactaca

SEQ ID NO: 17113 - DNA, 20 bp, Artificial Sequence
  chemically synthesized
aagatattttcatcccatgt

SEQ ID NO: 17114 - DNA, 20 bp, Artificial Sequence
  chemically synthesized
cccatgtgagtgctcaccaa

SEQ ID NO: 17115 - DNA, 20 bp, Artificial Sequence
  chemically synthesized
ccatgtgagtgctcaccaat

SEQ ID NO: 17116 - DNA, 20 bp, Artificial Sequence
  chemically synthesized
tgctcaccaatgggtgacct

SEQ ID NO: 17117 - DNA, 20 bp, Artificial Sequence
  chemically synthesized
tcaccaatgggtgacctcag

SEQ ID NO: 17118 - DNA, 20 bp, Artificial Sequence
  chemically synthesized
ccaatgggtgacctcagcag

SEQ ID NO: 17119 - DNA, 20 bp, Artificial Sequence
  chemically synthesized
aatgggtgacctcagcagaa

SEQ ID NO: 17120 - DNA, 20 bp, Artificial Sequence
  chemically synthesized
atgggtgacctcagcagaag

SEQ ID NO: 17121 - DNA, 20 bp, Artificial Sequence
  chemically synthesized
agaagaggattttaataatc

SEQ ID NO: 17122 - DNA, 20 bp, Artificial Sequence
  chemically synthesized
agaggattttaataatcaag

SEQ ID NO: 17123 - DNA, 20 bp, Artificial Sequence
  chemically synthesized
gattttaataatcaagtgga

SEQ ID NO: 17124 - DNA, 20 bp, Artificial Sequence
  chemically synthesized
attttaataatcaagtggat

SEQ ID NO: 17125 - DNA, 20 bp, Artificial Sequence
  chemically synthesized
ggataggatgatcaattctg

SEQ ID NO: 17126 - DNA, 20 bp, Artificial Sequence
  chemically synthesized
tcaattctgtggacaccact

SEQ ID NO: 17127 - DNA, 20 bp, Artificial Sequence
  chemically synthesized
gacaccactcagccttttcc

SEQ ID NO: 17128 - DNA, 20 bp, Artificial Sequence
  chemically synthesized
acaccactcagccttttccc

SEQ ID NO: 17129 - DNA, 20 bp, Artificial Sequence
  chemically synthesized
ccactcatgtcatcgtccaa

SEQ ID NO: 17130 - DNA, 20 bp, Artificial Sequence
  chemically synthesized
gtccaatggacccatgaaca

SEQ ID NO: 17131 - DNA, 20 bp, Artificial Sequence
  chemically synthesized
caatggacccatgaacaaag

SEQ ID NO: 17132 - DNA, 20 bp, Artificial Sequence
  chemically synthesized
acccatgaacaaagtggcca

SEQ ID NO: 17133 - DNA, 20 bp, Artificial Sequence
  chemically synthesized
gaacaaagtggccacagttg

SEQ ID NO: 17134 - DNA, 20 bp, Artificial Sequence
  chemically synthesized
aacaaagtggccacagttgc

SEQ ID NO: 17135 - DNA, 20 bp, Artificial Sequence
  chemically synthesized
acaaagtggccacagttgca

SEQ ID NO: 17136 - DNA, 20 bp, Artificial Sequence
  chemically synthesized
agtggccacagttgcaggga

SEQ ID NO: 17137 - DNA, 20 bp, Artificial Sequence
  chemically synthesized
ggccacagttgcagggatgg

SEQ ID NO: 17138 - DNA, 20 bp, Artificial Sequence
  chemically synthesized
gcagggatggaagttatgct

SEQ ID NO: 17139 - DNA, 20 bp, Artificial Sequence
  chemically synthesized
cagggatggaagttatgctt

SEQ ID NO: 17140 - DNA, 20 bp, Artificial Sequence
  chemically synthesized
atggaagttatgcttgggct

SEQ ID NO: 17141 - DNA, 20 bp, Artificial Sequence
  chemically synthesized
tatgcttgggctcagcaaca

SEQ ID NO: 17142 - DNA, 20 bp, Artificial Sequence
  chemically synthesized
acatggacttccactcacca

SEQ ID NO: 17143 - DNA, 20 bp, Artificial Sequence
  chemically synthesized
tccactcaccaaagctgacc

SEQ ID NO: 17144 - DNA, 20 bp, Artificial Sequence
  chemically synthesized
caccaaagctgacctggcca

SEQ ID NO: 17145 - DNA, 20 bp, Artificial Sequence
  chemically synthesized
tggccacagccactgcttgc

SEQ ID NO: 17146 - DNA, 20 bp, Artificial Sequence
  chemically synthesized
cagccactgcttgccagcat

SEQ ID NO: 17147 - DNA, 20 bp, Artificial Sequence
  chemically synthesized
gccactgcttgccagcatca

SEQ ID NO: 17148 - DNA, 20 bp, Artificial Sequence
  chemically synthesized
cagcatcagagaccaacact

SEQ ID NO: 17149 - DNA, 20 bp, Artificial Sequence
  chemically synthesized
ccaacactaagcccttgata

SEQ ID NO: 17150 - DNA, 20 bp, Artificial Sequence
  chemically synthesized
cttgatatggcaccattcct

SEQ ID NO: 17151 - DNA, 20 bp, Artificial Sequence
  chemically synthesized
ttgatatggcaccattcctc

SEQ ID NO: 17152 - DNA, 20 bp, Artificial Sequence
  chemically synthesized
tgatatggcaccattcctcg

SEQ ID NO: 17153 - DNA, 20 bp, Artificial Sequence
  chemically synthesized
gcaccattcctcggggtgat

SEQ ID NO: 17154 - DNA, 20 bp, Artificial Sequence
  chemically synthesized
cattcctcggggtgatcagc

SEQ ID NO: 17155 - DNA, 20 bp, Artificial Sequence
  chemically synthesized
ggggtgatcagccagctacc

SEQ ID NO: 17156 - DNA, 20 bp, Artificial Sequence
  chemically synthesized
gtgatcagccagctacctgg

SEQ ID NO: 17157 - DNA, 20 bp, Artificial Sequence
  chemically synthesized
atcagccagctacctggtgg

SEQ ID NO: 17158 - DNA, 20 bp, Artificial Sequence
  chemically synthesized
tcagccagctacctggtggc

SEQ ID NO: 17159 - DNA, 20 bp, Artificial Sequence
  chemically synthesized
tggtggcaggttgattatat

SEQ ID NO: 17160 - DNA, 20 bp, Artificial Sequence
  chemically synthesized
atattggacctcttccatca

SEQ ID NO: 17161 - DNA, 20 bp, Artificial Sequence
  chemically synthesized
tggacctcttccatcatgga

SEQ ID NO: 17162 - DNA, 20 bp, Artificial Sequence
  chemically synthesized
ggacctcttccatcatggaa

SEQ ID NO: 17163 - DNA, 20 bp, Artificial Sequence
  chemically synthesized
gacctcttccatcatggaaa

SEQ ID NO: 17164 - DNA, 20 bp, Artificial Sequence
  chemically synthesized
ctcttccatcatggaaaggg

SEQ ID NO: 17165 - DNA, 20 bp, Artificial Sequence
  chemically synthesized
cttccatcatggaaagggca

SEQ ID NO: 17166 - DNA, 20 bp, Artificial Sequence
  chemically synthesized
ttccatcatggaaagggcag

SEQ ID NO: 17167 - DNA, 20 bp, Artificial Sequence
  chemically synthesized
gggcagaggcttgtcctcac

SEQ ID NO: 17168 - DNA, 20 bp, Artificial Sequence
  chemically synthesized
gaggcttgtcctcactggaa

SEQ ID NO: 17169 - DNA, 20 bp, Artificial Sequence
  chemically synthesized
actggaatagacacttactc

SEQ ID NO: 17170 - DNA, 20 bp, Artificial Sequence
  chemically synthesized
atagacacttactctggata

SEQ ID NO: 17171 - DNA, 20 bp, Artificial Sequence
  chemically synthesized
tagacacttactctggatat

SEQ ID NO: 17172 - DNA, 20 bp, Artificial Sequence
  chemically synthesized
ctgaactcaatgcttatgcc

SEQ ID NO: 17173 - DNA, 20 bp, Artificial Sequence
  chemically synthesized
tatgccaagactaccatcca

SEQ ID NO: 17174 - DNA, 20 bp, Artificial Sequence
  chemically synthesized
gactaccatccatggaatca

SEQ ID NO: 17175 - DNA, 20 bp, Artificial Sequence
  chemically synthesized
gaatgccgtatccactgtca

SEQ ID NO: 17176 - DNA, 20 bp, Artificial Sequence
  chemically synthesized
cactgtcatggtattccaca

SEQ ID NO: 17177 - DNA, 20 bp, Artificial Sequence
  chemically synthesized
acacagcattgcttctgacc

SEQ ID NO: 17178 - DNA, 20 bp, Artificial Sequence
  chemically synthesized
tgaccaagccactcacttta

SEQ ID NO: 17179 - DNA, 20 bp, Artificial Sequence
  chemically synthesized
agccactcactttatggcta

SEQ ID NO: 17180 - DNA, 20 bp, Artificial Sequence
  chemically synthesized
cactcactttatggctaaag

SEQ ID NO: 17181 - DNA, 20 bp, Artificial Sequence
  chemically synthesized
ttatggctaaagaagtgtga

SEQ ID NO: 17182 - DNA, 20 bp, Artificial Sequence
  chemically synthesized
tggctaaagaagtgtgacag

SEQ ID NO: 17183 - DNA, 20 bp, Artificial Sequence
  chemically synthesized
ggctaaagaagtgtgacagt

SEQ ID NO: 17184 - DNA, 20 bp, Artificial Sequence
  chemically synthesized
tgacagtgggctcatgctca

SEQ ID NO: 17185 - DNA, 20 bp, Artificial Sequence
  chemically synthesized
ctcatgctcatggaatttac

SEQ ID NO: 17186 - DNA, 20 bp, Artificial Sequence
  chemically synthesized
ccatgatccctatcatcctg

SEQ ID NO: 17187 - DNA, 20 bp, Artificial Sequence
  chemically synthesized
tgatccctatcatcctgaag

SEQ ID NO: 17188 - DNA, 20 bp, Artificial Sequence
  chemically synthesized
atcctgaagcagcttttgaa

SEQ ID NO: 17189 - DNA, 20 bp, Artificial Sequence
  chemically synthesized
agcttttgaatggccttttg

SEQ ID NO: 17190 - DNA, 20 bp, Artificial Sequence
  chemically synthesized
gtcacgattacaatgccaac

SEQ ID NO: 17191 - DNA, 20 bp, Artificial Sequence
  chemically synthesized
tcacgattacaatgccaact

SEQ ID NO: 17192 - DNA, 20 bp, Artificial Sequence
  chemically synthesized
aactaggtgacaatactttg

SEQ ID NO: 17193 - DNA, 20 bp, Artificial Sequence
  chemically synthesized
actaggtgacaatactttgc

SEQ ID NO: 17194 - DNA, 20 bp, Artificial Sequence
  chemically synthesized
gtgacaatactttgcaggcc

SEQ ID NO: 17195 - DNA, 20 bp, Artificial Sequence
  chemically synthesized
tgacaatactttgcaggcct

SEQ ID NO: 17196 - DNA, 20 bp, Artificial Sequence
  chemically synthesized
gacaatactttgcaggcctg

SEQ ID NO: 17197 - DNA, 20 bp, Artificial Sequence
  chemically synthesized
tactttgcaggcctggggca

SEQ ID NO: 17198 - DNA, 20 bp, Artificial Sequence
  chemically synthesized
aggcctggggcaaagttctc

SEQ ID NO: 17199 - DNA, 20 bp, Artificial Sequence
  chemically synthesized
cctggggcaaagttctccag

SEQ ID NO: 17200 - DNA, 20 bp, Artificial Sequence
  chemically synthesized
ctggggcaaagttctccaga

SEQ ID NO: 17201 - DNA, 20 bp, Artificial Sequence
  chemically synthesized
aggctgtgtatgctctgaat

SEQ ID NO: 17202 - DNA, 20 bp, Artificial Sequence
  chemically synthesized
ctgaatcagtgtccaatata

SEQ ID NO: 17203 - DNA, 20 bp, Artificial Sequence
  chemically synthesized
atatggtactgtttctccca

SEQ ID NO: 17204 - DNA, 20 bp, Artificial Sequence
  chemically synthesized
ggtactgtttctcccataga

SEQ ID NO: 17205 - DNA, 20 bp, Artificial Sequence
  chemically synthesized
gtactgtttctcccatagac

SEQ ID NO: 17206 - DNA, 20 bp, Artificial Sequence
  chemically synthesized
tctcccatagacaggattca

SEQ ID NO: 17207 - DNA, 20 bp, Artificial Sequence
  chemically synthesized
ctcccatagacaggattcac

SEQ ID NO: 17208 - DNA, 20 bp, Artificial Sequence
  chemically synthesized
atagacaggattcacgggtc

SEQ ID NO: 17209 - DNA, 20 bp, Artificial Sequence
  chemically synthesized
tagacaggattcacgggtcc

SEQ ID NO: 17210 - DNA, 20 bp, Artificial Sequence
  chemically synthesized
attcacgggtccaggaatca

SEQ ID NO: 17211 - DNA, 20 bp, Artificial Sequence
  chemically synthesized
ttcacgggtccaggaatcaa

SEQ ID NO: 17212 - DNA, 20 bp, Artificial Sequence
  chemically synthesized
tcacgggtccaggaatcaaa

SEQ ID NO: 17213 - DNA, 20 bp, Artificial Sequence
  chemically synthesized
cgggtccaggaatcaaaggg

SEQ ID NO: 17214 - DNA, 20 bp, Artificial Sequence
  chemically synthesized
gtccaggaatcaaagggtgg

SEQ ID NO: 17215 - DNA, 20 bp, Artificial Sequence
  chemically synthesized
caggaatcaaagggtggaag

SEQ ID NO: 17216 - DNA, 20 bp, Artificial Sequence
  chemically synthesized
gaatcaaagggtggaagtgg

SEQ ID NO: 17217 - DNA, 20 bp, Artificial Sequence
  chemically synthesized
tcaaagggtggaagtggaag

SEQ ID NO: 17218 - DNA, 20 bp, Artificial Sequence
  chemically synthesized
aagggtggaagtggaagtgg

SEQ ID NO: 17219 - DNA, 20 bp, Artificial Sequence
  chemically synthesized
ggtggaagtggaagtggaag

SEQ ID NO: 17220 - DNA, 20 bp, Artificial Sequence
  chemically synthesized
gcaccactcaccatcacccc

SEQ ID NO: 17221 - DNA, 20 bp, Artificial Sequence
  chemically synthesized
catcacccctagtgttccac

SEQ ID NO: 17222 - DNA, 20 bp, Artificial Sequence
  chemically synthesized
atttttgcttcctgttccca

SEQ ID NO: 17223 - DNA, 20 bp, Artificial Sequence
  chemically synthesized
cccatggcattatgttctgc

SEQ ID NO: 17224 - DNA, 20 bp, Artificial Sequence
  chemically synthesized
ggcattatgttctgctggct

SEQ ID NO: 17225 - DNA, 20 bp, Artificial Sequence
  chemically synthesized
cattatgttctgctggctta

SEQ ID NO: 17226 - DNA, 20 bp, Artificial Sequence
  chemically synthesized
attatgttctgctggcttag

SEQ ID NO: 17227 - DNA, 20 bp, Artificial Sequence
  chemically synthesized
ttctgctggcttagaggtct

SEQ ID NO: 17228 - DNA, 20 bp, Artificial Sequence
  chemically synthesized
tggcttagaggtcttagttc

SEQ ID NO: 17229 - DNA, 20 bp, Artificial Sequence
  chemically synthesized
gcttagaggtcttagttcca

SEQ ID NO: 17230 - DNA, 20 bp, Artificial Sequence
  chemically synthesized
cttagaggtcttagttccag

SEQ ID NO: 17231 - DNA, 20 bp, Artificial Sequence
  chemically synthesized
ttagaggtcttagttccaga

SEQ ID NO: 17232 - DNA, 20 bp, Artificial Sequence
  chemically synthesized
agaggtcttagttccagagg

SEQ ID NO: 17233 - DNA, 20 bp, Artificial Sequence
  chemically synthesized
gaggtcttagttccagaggg

SEQ ID NO: 17234 - DNA, 20 bp, Artificial Sequence
  chemically synthesized
agagggaggaacactgccgc

SEQ ID NO: 17235 - DNA, 20 bp, Artificial Sequence
  chemically synthesized
gagggaggaacactgccgcc

SEQ ID NO: 17236 - DNA, 20 bp, Artificial Sequence
  chemically synthesized
attccattaaactgcaaatt

SEQ ID NO: 17237 - DNA, 20 bp, Artificial Sequence
  chemically synthesized
tgcaaattaagattgccacc

SEQ ID NO: 17238 - DNA, 20 bp, Artificial Sequence
  chemically synthesized
agattgccacctggacactt

SEQ ID NO: 17239 - DNA, 20 bp, Artificial Sequence
  chemically synthesized
gattgccacctggacacttt

SEQ ID NO: 17240 - DNA, 20 bp, Artificial Sequence
  chemically synthesized
tttgggctcctcccaccttt

SEQ ID NO: 17241 - DNA, 20 bp, Artificial Sequence
  chemically synthesized
tcctcccacctttaagtcaa

SEQ ID NO: 17242 - DNA, 20 bp, Artificial Sequence
  chemically synthesized
cctcccacctttaagtcaac

SEQ ID NO: 17243 - DNA, 20 bp, Artificial Sequence
  chemically synthesized
cacctttaagtcaacaggct

SEQ ID NO: 17244 - DNA, 20 bp, Artificial Sequence
  chemically synthesized
ctttaagtcaacaggctaag

SEQ ID NO: 17245 - DNA, 20 bp, Artificial Sequence
  chemically synthesized
ttaagtcaacaggctaagaa

SEQ ID NO: 17246 - DNA, 20 bp, Artificial Sequence
  chemically synthesized
aagtcaacaggctaagaaga

SEQ ID NO: 17247 - DNA, 20 bp, Artificial Sequence
  chemically synthesized
acaggctaagaagagagtta

SEQ ID NO: 17248 - DNA, 20 bp, Artificial Sequence
  chemically synthesized
taagaagagagttacagtgt

SEQ ID NO: 17249 - DNA, 20 bp, Artificial Sequence
  chemically synthesized
gagagttacagtgttggctg

SEQ ID NO: 17250 - DNA, 20 bp, Artificial Sequence
  chemically synthesized
gttggctgcggtgattaacc

SEQ ID NO: 17251 - DNA, 20 bp, Artificial Sequence
  chemically synthesized
ggtgattaacccagactatc

SEQ ID NO: 17252 - DNA, 20 bp, Artificial Sequence
  chemically synthesized
ccagactatcaagatgaaat

SEQ ID NO: 17253 - DNA, 20 bp, Artificial Sequence
  chemically synthesized
atcagtctacaactccacaa

SEQ ID NO: 17254 - DNA, 20 bp, Artificial Sequence
  chemically synthesized
cagtctacaactccacaatg

SEQ ID NO: 17255 - DNA, 20 bp, Artificial Sequence
  chemically synthesized
agtctacaactccacaatgg

SEQ ID NO: 17256 - DNA, 20 bp, Artificial Sequence
  chemically synthesized
tacaactccacaatggaggt

SEQ ID NO: 17257 - DNA, 20 bp, Artificial Sequence
  chemically synthesized
acaactccacaatggaggta

SEQ ID NO: 17258 - DNA, 20 bp, Artificial Sequence
  chemically synthesized
actccacaatggaggtaagg

SEQ ID NO: 17259 - DNA, 20 bp, Artificial Sequence
  chemically synthesized
gaggtaaggaagcgtatgca

SEQ ID NO: 17260 - DNA, 20 bp, Artificial Sequence
  chemically synthesized
ggaagcgtatgcatggaata

SEQ ID NO: 17261 - DNA, 20 bp, Artificial Sequence
  chemically synthesized
gaagcgtatgcatggaatat

SEQ ID NO: 17262 - DNA, 20 bp, Artificial Sequence
  chemically synthesized
agcgtatgcatggaatatag

SEQ ID NO: 17263 - DNA, 20 bp, Artificial Sequence
  chemically synthesized
atggaatataggagatccat

SEQ ID NO: 17264 - DNA, 20 bp, Artificial Sequence
  chemically synthesized
tggaatataggagatccatt

SEQ ID NO: 17265 - DNA, 20 bp, Artificial Sequence
  chemically synthesized
ggaatataggagatccatta

SEQ ID NO: 17266 - DNA, 20 bp, Artificial Sequence
  chemically synthesized
agatccattagggtgtctct

SEQ ID NO: 17267 - DNA, 20 bp, Artificial Sequence
  chemically synthesized
ctcttagttttaccatgtcc

SEQ ID NO: 17268 - DNA, 20 bp, Artificial Sequence
  chemically synthesized
ttttaccatgtcctggaatt

SEQ ID NO: 17269 - DNA, 20 bp, Artificial Sequence
  chemically synthesized
tttaccatgtcctggaatta

SEQ ID NO: 17270 - DNA, 20 bp, Artificial Sequence
  chemically synthesized
ccatgtcctggaattaaggt

SEQ ID NO: 17271 - DNA, 20 bp, Artificial Sequence
  chemically synthesized
tgtcctggaattaaggtcag

SEQ ID NO: 17272 - DNA, 20 bp, Artificial Sequence
  chemically synthesized
gtcctggaattaaggtcagt

SEQ ID NO: 17273 - DNA, 20 bp, Artificial Sequence
  chemically synthesized
aggtcagtgggaaactacta

SEQ ID NO: 17274 - DNA, 20 bp, Artificial Sequence
  chemically synthesized
ggtcagtgggaaactactac

SEQ ID NO: 17275 - DNA, 20 bp, Artificial Sequence
  chemically synthesized
gaaactactacaggccattc

SEQ ID NO: 17276 - DNA, 20 bp, Artificial Sequence
  chemically synthesized
aaactactacaggccattcc

SEQ ID NO: 17277 - DNA, 20 bp, Artificial Sequence
  chemically synthesized
ctactacaggccattccagg

SEQ ID NO: 17278 - DNA, 20 bp, Artificial Sequence
  chemically synthesized
tactacaggccattccaggc

SEQ ID NO: 17279 - DNA, 20 bp, Artificial Sequence
  chemically synthesized
tccaggcaggactacaaata

SEQ ID NO: 17280 - DNA, 20 bp, Artificial Sequence
  chemically synthesized
ccaggcaggactacaaataa

SEQ ID NO: 17281 - DNA, 20 bp, Artificial Sequence
  chemically synthesized
caggactacaaataaaggtt

SEQ ID NO: 17282 - DNA, 20 bp, Artificial Sequence
  chemically synthesized
aggactacaaataaaggttt

SEQ ID NO: 17283 - DNA, 20 bp, Artificial Sequence
  chemically synthesized
aaaggtttgggtcactccac

SEQ ID NO: 17284 - DNA, 20 bp, Artificial Sequence
  chemically synthesized
aaggtttgggtcactccacc

SEQ ID NO: 17285 - DNA, 20 bp, Artificial Sequence
  chemically synthesized
caggaaaaaaaaaaaaaaaa

SEQ ID NO: 17286 - DNA, 20 bp, Artificial Sequence
  chemically synthesized
aaaaaaaaaaaaaaaaagac

SEQ ID NO: 17287 - DNA, 20 bp, Artificial Sequence
  chemically synthesized
aaaaaaagacaagacctgct

SEQ ID NO: 17288 - DNA, 20 bp, Artificial Sequence
  chemically synthesized
aaaaaagacaagacctgctg

SEQ ID NO: 17289 - DNA, 20 bp, Artificial Sequence
  chemically synthesized
gacctgctgaggtgcttgct

SEQ ID NO: 17290 - DNA, 20 bp, Artificial Sequence
  chemically synthesized
acctgctgaggtgcttgctg

SEQ ID NO: 17291 - DNA, 20 bp, Artificial Sequence
  chemically synthesized
cctgctgaggtgcttgctga

SEQ ID NO: 17292 - DNA, 20 bp, Artificial Sequence
  chemically synthesized
tgaggtgcttgctgagggca

SEQ ID NO: 17293 - DNA, 20 bp, Artificial Sequence
  chemically synthesized
gaggtgcttgctgagggcaa

SEQ ID NO: 17294 - DNA, 20 bp, Artificial Sequence
  chemically synthesized
aggtgcttgctgagggcaaa

SEQ ID NO: 17295 - DNA, 20 bp, Artificial Sequence
  chemically synthesized
tgctgagggcaaagggaata

SEQ ID NO: 17296 - DNA, 20 bp, Artificial Sequence
  chemically synthesized
caaagggaatacagaatatg

SEQ ID NO: 17297 - DNA, 20 bp, Artificial Sequence
  chemically synthesized
agggaatacagaatatgtag

SEQ ID NO: 17298 - DNA, 20 bp, Artificial Sequence
  chemically synthesized
gaatacagaatatgtagcag

SEQ ID NO: 17299 - DNA, 20 bp, Artificial Sequence
  chemically synthesized
tacagaatatgtagcagaag

SEQ ID NO: 17300 - DNA, 20 bp, Artificial Sequence
  chemically synthesized
acagaatatgtagcagaaga

SEQ ID NO: 17301 - DNA, 20 bp, Artificial Sequence
  chemically synthesized
gaatatgtagcagaagaagg

SEQ ID NO: 17302 - DNA, 20 bp, Artificial Sequence
  chemically synthesized
aagaaggtagtcatcaatac

SEQ ID NO: 17303 - DNA, 20 bp, Artificial Sequence
  chemically synthesized
tacgatcacgtgaccaattg

SEQ ID NO: 17304 - DNA, 20 bp, Artificial Sequence
  chemically synthesized
acgtgaccaattgcagatac

SEQ ID NO: 17305 - DNA, 20 bp, Artificial Sequence
  chemically synthesized
cgtgaccaattgcagataca

SEQ ID NO: 17306 - DNA, 20 bp, Artificial Sequence
  chemically synthesized
acaaggactgtaattgtcat

SEQ ID NO: 17307 - DNA, 20 bp, Artificial Sequence
  chemically synthesized
tgtctgtatacacttgtact

SEQ ID NO: 17308 - DNA, 20 bp, Artificial Sequence
  chemically synthesized
tttcctttatcatgtgacat

SEQ ID NO: 17309 - DNA, 20 bp, Artificial Sequence
  chemically synthesized
aagatttattgacttcatat

SEQ ID NO: 17310 - DNA, 20 bp, Artificial Sequence
  chemically synthesized
ttgacttcatatcagcattt

SEQ ID NO: 17311 - DNA, 20 bp, Artificial Sequence
  chemically synthesized
atcagcatttaagtattgtt

SEQ ID NO: 17312 - DNA, 20 bp, Artificial Sequence
  chemically synthesized
gtattgttaagtttatgtaa

SEQ ID NO: 17313 - DNA, 20 bp, Artificial Sequence
  chemically synthesized
ttatgtaatagcatttgcaa

SEQ ID NO: 17314 - DNA, 20 bp, Artificial Sequence
  chemically synthesized
tatgtaatagcatttgcaat

SEQ ID NO: 17315 - DNA, 20 bp, Artificial Sequence
  chemically synthesized
atgtaatagcatttgcaatg

SEQ ID NO: 17316 - DNA, 20 bp, Artificial Sequence
  chemically synthesized
atagcatttgcaatggggat

SEQ ID NO: 17317 - DNA, 20 bp, Artificial Sequence
  chemically synthesized
ggtgcattttcaattgcacg

SEQ ID NO: 17318 - DNA, 20 bp, Artificial Sequence
  chemically synthesized
gtgcattttcaattgcacga

SEQ ID NO: 17319 - DNA, 20 bp, Artificial Sequence
  chemically synthesized
attttcaattgcacgaagga

SEQ ID NO: 17320 - DNA, 20 bp, Artificial Sequence
  chemically synthesized
aattgcacgaaggatagttt

SEQ ID NO: 17321 - DNA, 20 bp, Artificial Sequence
  chemically synthesized
gaaggatagttttagtatgt

SEQ ID NO: 17322 - DNA, 20 bp, Artificial Sequence
  chemically synthesized
aaggatagttttagtatgtt

SEQ ID NO: 17323 - DNA, 20 bp, Artificial Sequence
  chemically synthesized
cttattgttgtctttatttg

SEQ ID NO: 17324 - DNA, 20 bp, Artificial Sequence
  chemically synthesized
ttgaagataatgtatgacct

SEQ ID NO: 17325 - DNA, 20 bp, Artificial Sequence
  chemically synthesized
tgaagataatgtatgacctc

SEQ ID NO: 17326 - DNA, 20 bp, Artificial Sequence
  chemically synthesized
gaagataatgtatgacctca

SEQ ID NO: 17327 - DNA, 20 bp, Artificial Sequence
  chemically synthesized
aagataatgtatgacctcag

SEQ ID NO: 17328 - DNA, 20 bp, Artificial Sequence
  chemically synthesized
atgacctcaggggatgtgta

SEQ ID NO: 17329 - DNA, 20 bp, Artificial Sequence
  chemically synthesized
tgacctcaggggatgtgtat

SEQ ID NO: 17330 - DNA, 20 bp, Artificial Sequence
  chemically synthesized
caggggatgtgtataggctc

SEQ ID NO: 17331 - DNA, 20 bp, Artificial Sequence
  chemically synthesized
gtgtataggctcaagttgac

SEQ ID NO: 17332 - DNA, 20 bp, Artificial Sequence
  chemically synthesized
aggctcaagttgacaagcga

SEQ ID NO: 17333 - DNA, 20 bp, Artificial Sequence
  chemically synthesized
gacaagcgatggacttgtga

SEQ ID NO: 17334 - DNA, 20 bp, Artificial Sequence
  chemically synthesized
gacttgtgatggttaatact

SEQ ID NO: 17335 - DNA, 20 bp, Artificial Sequence
  chemically synthesized
atactgagtgtcaacttgat

SEQ ID NO: 17336 - DNA, 20 bp, Artificial Sequence
  chemically synthesized
gtgtcaacttgattggattg

SEQ ID NO: 17337 - DNA, 20 bp, Artificial Sequence
  chemically synthesized
tgattggattgaagtgtgca

SEQ ID NO: 17338 - DNA, 20 bp, Artificial Sequence
  chemically synthesized
gtgtgcaaagtattgatcct

SEQ ID NO: 17339 - DNA, 20 bp, Artificial Sequence
  chemically synthesized
ttgatcctgagtgtgtctgt

SEQ ID NO: 17340 - DNA, 20 bp, Artificial Sequence
  chemically synthesized
tgatcctgagtgtgtctgtg

SEQ ID NO: 17341 - DNA, 20 bp, Artificial Sequence
  chemically synthesized
gatcctgagtgtgtctgtga

SEQ ID NO: 17342 - DNA, 20 bp, Artificial Sequence
  chemically synthesized
tgtctgtgagggtattgcca

SEQ ID NO: 17343 - DNA, 20 bp, Artificial Sequence
  chemically synthesized
gtctgtgagggtattgccaa

SEQ ID NO: 17344 - DNA, 20 bp, Artificial Sequence
  chemically synthesized
ctgtgagggtattgccaaag

SEQ ID NO: 17345 - DNA, 20 bp, Artificial Sequence
  chemically synthesized
gccaaaggagattaacattt

SEQ ID NO: 17346 - DNA, 20 bp, Artificial Sequence
  chemically synthesized
aaggagattaacattttagt

SEQ ID NO: 17347 - DNA, 20 bp, Artificial Sequence
  chemically synthesized
gagattaacattttagtcag

SEQ ID NO: 17348 - DNA, 20 bp, Artificial Sequence
  chemically synthesized
agattaacattttagtcagt

SEQ ID NO: 17349 - DNA, 20 bp, Artificial Sequence
  chemically synthesized
taacattttagtcagtgggc

SEQ ID NO: 17350 - DNA, 20 bp, Artificial Sequence
  chemically synthesized
aacattttagtcagtgggct

SEQ ID NO: 17351 - DNA, 20 bp, Artificial Sequence
  chemically synthesized
ttttagtcagtgggctggga

SEQ ID NO: 17352 - DNA, 20 bp, Artificial Sequence
  chemically synthesized
tttagtcagtgggctgggaa

SEQ ID NO: 17353 - DNA, 20 bp, Artificial Sequence
  chemically synthesized
agtcagtgggctgggaaagg

SEQ ID NO: 17354 - DNA, 20 bp, Artificial Sequence
  chemically synthesized
aggcagacccacccttaatc

SEQ ID NO: 17355 - DNA, 20 bp, Artificial Sequence
  chemically synthesized
ggcagacccacccttaatct

SEQ ID NO: 17356 - DNA, 20 bp, Artificial Sequence
  chemically synthesized
agacccacccttaatctggg

SEQ ID NO: 17357 - DNA, 20 bp, Artificial Sequence
  chemically synthesized
gacccacccttaatctgggt

SEQ ID NO: 17358 - DNA, 20 bp, Artificial Sequence
  chemically synthesized
ctgggtgggcaccatctaat

SEQ ID NO: 17359 - DNA, 20 bp, Artificial Sequence
  chemically synthesized
ggcaccatctaatcagttgc

SEQ ID NO: 17360 - DNA, 20 bp, Artificial Sequence
  chemically synthesized
catctaatcagttgccagtg

SEQ ID NO: 17361 - DNA, 20 bp, Artificial Sequence
  chemically synthesized
taatcagttgccagtgtggc

SEQ ID NO: 17362 - DNA, 20 bp, Artificial Sequence
  chemically synthesized
aatcagttgccagtgtggcc

SEQ ID NO: 17363 - DNA, 20 bp, Artificial Sequence
  chemically synthesized
gccagtgtggccaggatata

SEQ ID NO: 17364 - DNA, 20 bp, Artificial Sequence
  chemically synthesized
agtgtggccaggatataaag

SEQ ID NO: 17365 - DNA, 20 bp, Artificial Sequence
  chemically synthesized
gtgtggccaggatataaagc

SEQ ID NO: 17366 - DNA, 20 bp, Artificial Sequence
  chemically synthesized
tggccaggatataaagcagg

SEQ ID NO: 17367 - DNA, 20 bp, Artificial Sequence
  chemically synthesized
aaaaaaacatgtgaaaatcc

SEQ ID NO: 17368 - DNA, 20 bp, Artificial Sequence
  chemically synthesized
aacatgtgaaaatcctggac

SEQ ID NO: 17369 - DNA, 20 bp, Artificial Sequence
  chemically synthesized
gtgaaaatcctggactggct

SEQ ID NO: 17370 - DNA, 20 bp, Artificial Sequence
  chemically synthesized
cctggactggcttagcctcc

SEQ ID NO: 17371 - DNA, 20 bp, Artificial Sequence
  chemically synthesized
cctacatctttctcccatgc

SEQ ID NO: 17372 - DNA, 20 bp, Artificial Sequence
  chemically synthesized
tgcttcctgccctcaaacat

SEQ ID NO: 17373 - DNA, 20 bp, Artificial Sequence
  chemically synthesized
gccctcaaacattggactcc

SEQ ID NO: 17374 - DNA, 20 bp, Artificial Sequence
  chemically synthesized
acattggactccaagtcctt

SEQ ID NO: 17375 - DNA, 20 bp, Artificial Sequence
  chemically synthesized
gactccaagtccttcagctt

SEQ ID NO: 17376 - DNA, 20 bp, Artificial Sequence
  chemically synthesized
actccaagtccttcagcttt

SEQ ID NO: 17377 - DNA, 20 bp, Artificial Sequence
  chemically synthesized
agtccttcagctttgggact

SEQ ID NO: 17378 - DNA, 20 bp, Artificial Sequence
  chemically synthesized
ttcagctttgggacttggac

SEQ ID NO: 17379 - DNA, 20 bp, Artificial Sequence
  chemically synthesized
cttccttgctcctctgcttg

SEQ ID NO: 17380 - DNA, 20 bp, Artificial Sequence
  chemically synthesized
cttgctcctctgcttgcaga

SEQ ID NO: 17381 - DNA, 20 bp, Artificial Sequence
  chemically synthesized
tgcttgcagatggcctattg

SEQ ID NO: 17382 - DNA, 20 bp, Artificial Sequence
  chemically synthesized
gcttgcagatggcctattgt

SEQ ID NO: 17383 - DNA, 20 bp, Artificial Sequence
  chemically synthesized
gtgggaccttgtgattgtgt

SEQ ID NO: 17384 - DNA, 20 bp, Artificial Sequence
  chemically synthesized
tctatctatctatctcctat

SEQ ID NO: 17385 - DNA, 20 bp, Artificial Sequence
  chemically synthesized
tcctattagttctgtctctc

SEQ ID NO: 17386 - DNA, 20 bp, Artificial Sequence
  chemically synthesized
cctattagttctgtctctct

SEQ ID NO: 17387 - DNA, 20 bp, Artificial Sequence
  chemically synthesized
ctattagttctgtctctcta

SEQ ID NO: 17388 - DNA, 20 bp, Artificial Sequence
  chemically synthesized
ctagggaaccctgacaaata

SEQ ID NO: 17389 - DNA, 20 bp, Artificial Sequence
  chemically synthesized
ggaaccctgacaaatacagt

SEQ ID NO: 17390 - DNA, 20 bp, Artificial Sequence
  chemically synthesized
cctgacaaatacagtgagct

SEQ ID NO: 17391 - DNA, 20 bp, Artificial Sequence
  chemically synthesized
ctgacaaatacagtgagctc

SEQ ID NO: 17392 - DNA, 20 bp, Artificial Sequence
  chemically synthesized
atacagtgagctcaggtcct

SEQ ID NO: 17393 - DNA, 20 bp, Artificial Sequence
  chemically synthesized
cagtgagctcaggtcctgag

SEQ ID NO: 17394 - DNA, 20 bp, Artificial Sequence
  chemically synthesized
cctgagcagacattttccaa

SEQ ID NO: 17395 - DNA, 20 bp, Artificial Sequence
  chemically synthesized
gagcagacattttccaaaag

SEQ ID NO: 17396 - DNA, 20 bp, Artificial Sequence
  chemically synthesized
ttttccaaaagaagacatac

SEQ ID NO: 17397 - DNA, 20 bp, Artificial Sequence
  chemically synthesized
tccaaaagaagacatacaag

SEQ ID NO: 17398 - DNA, 20 bp, Artificial Sequence
  chemically synthesized
ggccaataaacgtcaaaaaa

SEQ ID NO: 17399 - DNA, 20 bp, Artificial Sequence
  chemically synthesized
agttcaacatcactaataat

SEQ ID NO: 17400 - DNA, 20 bp, Artificial Sequence
  chemically synthesized
ttcaacatcactaataatca

SEQ ID NO: 17401 - DNA, 20 bp, Artificial Sequence
  chemically synthesized
catatgatacctccttatgc

SEQ ID NO: 17402 - DNA, 20 bp, Artificial Sequence
  chemically synthesized
tgatacctccttatgccagt

SEQ ID NO: 17403 - DNA, 20 bp, Artificial Sequence
  chemically synthesized
cctccttatgccagtcagaa

SEQ ID NO: 17404 - DNA, 20 bp, Artificial Sequence
  chemically synthesized
tcagaatggctatcattata

SEQ ID NO: 17405 - DNA, 20 bp, Artificial Sequence
  chemically synthesized
atcattataaagttcaaaaa

SEQ ID NO: 17406 - DNA, 20 bp, Artificial Sequence
  chemically synthesized
attataaagttcaaaaacag

SEQ ID NO: 17407 - DNA, 20 bp, Artificial Sequence
  chemically synthesized
agttcaaaaacagcagatgt

SEQ ID NO: 17408 - DNA, 20 bp, Artificial Sequence
  chemically synthesized
caaaaacagcagatgttggt

SEQ ID NO: 17409 - DNA, 20 bp, Artificial Sequence
  chemically synthesized
aaaaacagcagatgttggtg

SEQ ID NO: 17410 - DNA, 20 bp, Artificial Sequence
  chemically synthesized
agcagatgttggtgaggatg

SEQ ID NO: 17411 - DNA, 20 bp, Artificial Sequence
  chemically synthesized
cagatgttggtgaggatgtg

SEQ ID NO: 17412 - DNA, 20 bp, Artificial Sequence
  chemically synthesized
gttggtgaggatgtggagac

SEQ ID NO: 17413 - DNA, 20 bp, Artificial Sequence
  chemically synthesized
agaaaatgcttatacactgt

SEQ ID NO: 17414 - DNA, 20 bp, Artificial Sequence
  chemically synthesized
aatgcttatacactgttggt

SEQ ID NO: 17415 - DNA, 20 bp, Artificial Sequence
  chemically synthesized
ctgttggtaagaatgtaaat

SEQ ID NO: 17416 - DNA, 20 bp, Artificial Sequence
  chemically synthesized
gtaaattagtacaaacttta

SEQ ID NO: 17417 - DNA, 20 bp, Artificial Sequence
  chemically synthesized
aattagtacaaactttatgg

SEQ ID NO: 17418 - DNA, 20 bp, Artificial Sequence
  chemically synthesized
agtacaaactttatggaaga

SEQ ID NO: 17419 - DNA, 20 bp, Artificial Sequence
  chemically synthesized
actttatggaagacagcatg

SEQ ID NO: 17420 - DNA, 20 bp, Artificial Sequence
  chemically synthesized
gacagcatgaagatttctta

SEQ ID NO: 17421 - DNA, 20 bp, Artificial Sequence
  chemically synthesized
atgaagatttcttaaagaac

SEQ ID NO: 17422 - DNA, 20 bp, Artificial Sequence
  chemically synthesized
atttcttaaagaactagaaa

SEQ ID NO: 17423 - DNA, 20 bp, Artificial Sequence
  chemically synthesized
caatcctgcaatcccactac

SEQ ID NO: 17424 - DNA, 20 bp, Artificial Sequence
  chemically synthesized
aatcctgcaatcccactact

SEQ ID NO: 17425 - DNA, 20 bp, Artificial Sequence
  chemically synthesized
tgcaatcccactactgggta

SEQ ID NO: 17426 - DNA, 20 bp, Artificial Sequence
  chemically synthesized
cactactgggtatggaccca

SEQ ID NO: 17427 - DNA, 20 bp, Artificial Sequence
  chemically synthesized
tgggtatggacccaaagtga

SEQ ID NO: 17428 - DNA, 20 bp, Artificial Sequence
  chemically synthesized
ggtatggacccaaagtgaaa

SEQ ID NO: 17429 - DNA, 20 bp, Artificial Sequence
  chemically synthesized
tgaaagagatcatattaaaa

SEQ ID NO: 17430 - DNA, 20 bp, Artificial Sequence
  chemically synthesized
attaaaaaagatatctgcat

SEQ ID NO: 17431 - DNA, 20 bp, Artificial Sequence
  chemically synthesized
tatctgcattagtatgttca

SEQ ID NO: 17432 - DNA, 20 bp, Artificial Sequence
  chemically synthesized
ctgcattagtatgttcaaag

SEQ ID NO: 17433 - DNA, 20 bp, Artificial Sequence
  chemically synthesized
caaagtagcactgttcccaa

SEQ ID NO: 17434 - DNA, 20 bp, Artificial Sequence
  chemically synthesized
tagcactgttcccaatagca

SEQ ID NO: 17435 - DNA, 20 bp, Artificial Sequence
  chemically synthesized
tgttcccaatagcaaagata

SEQ ID NO: 17436 - DNA, 20 bp, Artificial Sequence
  chemically synthesized
tcaacctaaatgtctaccaa

SEQ ID NO: 17437 - DNA, 20 bp, Artificial Sequence
  chemically synthesized
aatgtctaccaatggacgat

SEQ ID NO: 17438 - DNA, 20 bp, Artificial Sequence
  chemically synthesized
taccaatggacgattggata

SEQ ID NO: 17439 - DNA, 20 bp, Artificial Sequence
  chemically synthesized
acgattggataaagaaaatg

SEQ ID NO: 17440 - DNA, 20 bp, Artificial Sequence
  chemically synthesized
ttatatacatatatattact

SEQ ID NO: 17441 - DNA, 20 bp, Artificial Sequence
  chemically synthesized
tatattactcagccataaaa

SEQ ID NO: 17442 - DNA, 20 bp, Artificial Sequence
  chemically synthesized
gaatgaaatcatgtcttctc

SEQ ID NO: 17443 - DNA, 20 bp, Artificial Sequence
  chemically synthesized
tcatgtcttctctagaaaca

SEQ ID NO: 17444 - DNA, 20 bp, Artificial Sequence
  chemically synthesized
gtcttctctagaaacatggt

SEQ ID NO: 17445 - DNA, 20 bp, Artificial Sequence
  chemically synthesized
tctagaaacatggttagaac

SEQ ID NO: 17446 - DNA, 20 bp, Artificial Sequence
  chemically synthesized
tagaaacatggttagaactg

SEQ ID NO: 17447 - DNA, 20 bp, Artificial Sequence
  chemically synthesized
agaaacatggttagaactgg

SEQ ID NO: 17448 - DNA, 20 bp, Artificial Sequence
  chemically synthesized
gaactggaggacattatcct

SEQ ID NO: 17449 - DNA, 20 bp, Artificial Sequence
  chemically synthesized
ttatcctcagtgaaataact

SEQ ID NO: 17450 - DNA, 20 bp, Artificial Sequence
  chemically synthesized
tcagtgaaataactcagaaa

SEQ ID NO: 17451 - DNA, 20 bp, Artificial Sequence
  chemically synthesized
tgaaataactcagaaacaga

SEQ ID NO: 17452 - DNA, 20 bp, Artificial Sequence
  chemically synthesized
cagaaacagaaagtcaaaca

SEQ ID NO: 17453 - DNA, 20 bp, Artificial Sequence
  chemically synthesized
aaacacagtatgttctcatt

SEQ ID NO: 17454 - DNA, 20 bp, Artificial Sequence
  chemically synthesized
acagtatgttctcatttagt

SEQ ID NO: 17455 - DNA, 20 bp, Artificial Sequence
  chemically synthesized
agtatgttctcatttagtga

SEQ ID NO: 17456 - DNA, 20 bp, Artificial Sequence
  chemically synthesized
gttctcatttagtgagagcc

SEQ ID NO: 17457 - DNA, 20 bp, Artificial Sequence
  chemically synthesized
ctcatttagtgagagccaag

SEQ ID NO: 17458 - DNA, 20 bp, Artificial Sequence
  chemically synthesized
tcatttagtgagagccaagt

SEQ ID NO: 17459 - DNA, 20 bp, Artificial Sequence
  chemically synthesized
atttagtgagagccaagtgg

SEQ ID NO: 17460 - DNA, 20 bp, Artificial Sequence
  chemically synthesized
ccaagtgggagctaaacgat

SEQ ID NO: 17461 - DNA, 20 bp, Artificial Sequence
  chemically synthesized
gtgggagctaaacgatgagt

SEQ ID NO: 17462 - DNA, 20 bp, Artificial Sequence
  chemically synthesized
agctaaacgatgagtaagca

SEQ ID NO: 17463 - DNA, 20 bp, Artificial Sequence
  chemically synthesized
gatgagtaagcatagacata

SEQ ID NO: 17464 - DNA, 20 bp, Artificial Sequence
  chemically synthesized
agacatatagaatgaaataa

SEQ ID NO: 17465 - DNA, 20 bp, Artificial Sequence
  chemically synthesized
gaatgaaataatagacactt

SEQ ID NO: 17466 - DNA, 20 bp, Artificial Sequence
  chemically synthesized
aaataatagacacttgagac

SEQ ID NO: 17467 - DNA, 20 bp, Artificial Sequence
  chemically synthesized
ataatagacacttgagacta

SEQ ID NO: 17468 - DNA, 20 bp, Artificial Sequence
  chemically synthesized
tagacacttgagactagaga

SEQ ID NO: 17469 - DNA, 20 bp, Artificial Sequence
  chemically synthesized
agacacttgagactagagaa

SEQ ID NO: 17470 - DNA, 20 bp, Artificial Sequence
  chemically synthesized
cacttgagactagagaaagg

SEQ ID NO: 17471 - DNA, 20 bp, Artificial Sequence
  chemically synthesized
acttgagactagagaaaggt

SEQ ID NO: 17472 - DNA, 20 bp, Artificial Sequence
  chemically synthesized
ttgagactagagaaaggtgg

SEQ ID NO: 17473 - DNA, 20 bp, Artificial Sequence
  chemically synthesized
tgagactagagaaaggtggg

SEQ ID NO: 17474 - DNA, 20 bp, Artificial Sequence
  chemically synthesized
actagagaaaggtgggagga

SEQ ID NO: 17475 - DNA, 20 bp, Artificial Sequence
  chemically synthesized
ctagagaaaggtgggaggat

SEQ ID NO: 17476 - DNA, 20 bp, Artificial Sequence
  chemically synthesized
agagaaaggtgggaggatag

SEQ ID NO: 17477 - DNA, 20 bp, Artificial Sequence
  chemically synthesized
aaggtgggaggataggagta

SEQ ID NO: 17478 - DNA, 20 bp, Artificial Sequence
  chemically synthesized
tgggaggataggagtatggt

SEQ ID NO: 17479 - DNA, 20 bp, Artificial Sequence
  chemically synthesized
gggaggataggagtatggtg

SEQ ID NO: 17480 - DNA, 20 bp, Artificial Sequence
  chemically synthesized
tggtgaggactgaaaaacta

SEQ ID NO: 17481 - DNA, 20 bp, Artificial Sequence
  chemically synthesized
aggactgaaaaactacggat

SEQ ID NO: 17482 - DNA, 20 bp, Artificial Sequence
  chemically synthesized
tggatacaacattcactttt

SEQ ID NO: 17483 - DNA, 20 bp, Artificial Sequence
  chemically synthesized
ggatacaacattcacttttc

SEQ ID NO: 17484 - DNA, 20 bp, Artificial Sequence
  chemically synthesized
aacattcacttttcaggtga

SEQ ID NO: 17485 - DNA, 20 bp, Artificial Sequence
  chemically synthesized
ttcaggtgatggtccactaa

SEQ ID NO: 17486 - DNA, 20 bp, Artificial Sequence
  chemically synthesized
gtgatggtccactaaaagct

SEQ ID NO: 17487 - DNA, 20 bp, Artificial Sequence
  chemically synthesized
actatgcaacatacatatgt

SEQ ID NO: 17488 - DNA, 20 bp, Artificial Sequence
  chemically synthesized
ctatgcaacatacatatgta

SEQ ID NO: 17489 - DNA, 20 bp, Artificial Sequence
  chemically synthesized
catacatatgtaaggaaccc

SEQ ID NO: 17490 - DNA, 20 bp, Artificial Sequence
  chemically synthesized
cccgagcttgtaccctgata

SEQ ID NO: 17491 - DNA, 20 bp, Artificial Sequence
  chemically synthesized
ccaaatctcatcttgaattg

SEQ ID NO: 17492 - DNA, 20 bp, Artificial Sequence
  chemically synthesized
cccataatcctcacgtgttg

SEQ ID NO: 17493 - DNA, 20 bp, Artificial Sequence
  chemically synthesized
ccataatcctcacgtgttgt

SEQ ID NO: 17494 - DNA, 20 bp, Artificial Sequence
  chemically synthesized
ataatcctcacgtgttgtgg

SEQ ID NO: 17495 - DNA, 20 bp, Artificial Sequence
  chemically synthesized
taatcctcacgtgttgtggg

SEQ ID NO: 17496 - DNA, 20 bp, Artificial Sequence
  chemically synthesized
aatcctcacgtgttgtggga

SEQ ID NO: 17497 - DNA, 20 bp, Artificial Sequence
  chemically synthesized
cacgtgttgtgggagggatt

SEQ ID NO: 17498 - DNA, 20 bp, Artificial Sequence
  chemically synthesized
cgtgttgtgggagggatttg

SEQ ID NO: 17499 - DNA, 20 bp, Artificial Sequence
  chemically synthesized
gtgttgtgggagggatttgg

SEQ ID NO: 17500 - DNA, 20 bp, Artificial Sequence
  chemically synthesized
tgttgtgggagggatttgga

SEQ ID NO: 17501 - DNA, 20 bp, Artificial Sequence
  chemically synthesized
ttgtgggagggatttggagg

SEQ ID NO: 17502 - DNA, 20 bp, Artificial Sequence
  chemically synthesized
tgtgggagggatttggaggg

SEQ ID NO: 17503 - DNA, 20 bp, Artificial Sequence
  chemically synthesized
ggagggaggtaattgaatca

SEQ ID NO: 17504 - DNA, 20 bp, Artificial Sequence
  chemically synthesized
agggaggtaattgaatcata

SEQ ID NO: 17505 - DNA, 20 bp, Artificial Sequence
  chemically synthesized
gggaggtaattgaatcatag

SEQ ID NO: 17506 - DNA, 20 bp, Artificial Sequence
  chemically synthesized
gaggtaattgaatcatagag

SEQ ID NO: 17507 - DNA, 20 bp, Artificial Sequence
  chemically synthesized
aggtaattgaatcatagagg

SEQ ID NO: 17508 - DNA, 20 bp, Artificial Sequence
  chemically synthesized
ctctcatgctcttctcgtga

SEQ ID NO: 17509 - DNA, 20 bp, Artificial Sequence
  chemically synthesized
catgctcttctcgtgatagt

SEQ ID NO: 17510 - DNA, 20 bp, Artificial Sequence
  chemically synthesized
tcgtgatagtgagttcttac

SEQ ID NO: 17511 - DNA, 20 bp, Artificial Sequence
  chemically synthesized
tgagttcttacaagatctga

SEQ ID NO: 17512 - DNA, 20 bp, Artificial Sequence
  chemically synthesized
acaagatctgatggttttat

SEQ ID NO: 17513 - DNA, 20 bp, Artificial Sequence
  chemically synthesized
agatctgatggttttataag

SEQ ID NO: 17514 - DNA, 20 bp, Artificial Sequence
  chemically synthesized
cggcttttcccccttttgct

SEQ ID NO: 17515 - DNA, 20 bp, Artificial Sequence
  chemically synthesized
ctacttgctgctgccatgtg

SEQ ID NO: 17516 - DNA, 20 bp, Artificial Sequence
  chemically synthesized
cttgctgctgccatgtgaag

SEQ ID NO: 17517 - DNA, 20 bp, Artificial Sequence
  chemically synthesized
ttgctgctgccatgtgaaga

SEQ ID NO: 17518 - DNA, 20 bp, Artificial Sequence
  chemically synthesized
tcttcttctgccatgattgt

SEQ ID NO: 17519 - DNA, 20 bp, Artificial Sequence
  chemically synthesized
gccatgattgtaagtttccc

SEQ ID NO: 17520 - DNA, 20 bp, Artificial Sequence
  chemically synthesized
ccatgattgtaagtttcccg

SEQ ID NO: 17521 - DNA, 20 bp, Artificial Sequence
  chemically synthesized
taagtttcccgaggcctccc

SEQ ID NO: 17522 - DNA, 20 bp, Artificial Sequence
  chemically synthesized
ccgaggcctccccagccctg

SEQ ID NO: 17523 - DNA, 20 bp, Artificial Sequence
  chemically synthesized
ccccagccctgtggaactgt

SEQ ID NO: 17524 - DNA, 20 bp, Artificial Sequence
  chemically synthesized
ttttttccttataaattacc

SEQ ID NO: 17525 - DNA, 20 bp, Artificial Sequence
  chemically synthesized
ccttataaattacccagtct

SEQ ID NO: 17526 - DNA, 20 bp, Artificial Sequence
  chemically synthesized
cttataaattacccagtctc

SEQ ID NO: 17527 - DNA, 20 bp, Artificial Sequence
  chemically synthesized
agtctcaggtatgtctttat

SEQ ID NO: 17528 - DNA, 20 bp, Artificial Sequence
  chemically synthesized
ctcaggtatgtctttataag

SEQ ID NO: 17529 - DNA, 20 bp, Artificial Sequence
  chemically synthesized
taagcagcatgataacgaac

SEQ ID NO: 17530 - DNA, 20 bp, Artificial Sequence
  chemically synthesized
tttaaaaatataaaataaat

SEQ ID NO: 17531 - DNA, 20 bp, Artificial Sequence
  chemically synthesized
ataaattagatctgattgaa

SEQ ID NO: 17532 - DNA, 20 bp, Artificial Sequence
  chemically synthesized
taaattagatctgattgaaa

SEQ ID NO: 17533 - DNA, 20 bp, Artificial Sequence
  chemically synthesized
tgattgaaaaggcaaaaatt

SEQ ID NO: 17534 - DNA, 20 bp, Artificial Sequence
  chemically synthesized
tgaaaaggcaaaaattgagc

SEQ ID NO: 17535 - DNA, 20 bp, Artificial Sequence
  chemically synthesized
gcaagcaaaatatcacttaa

SEQ ID NO: 17536 - DNA, 20 bp, Artificial Sequence
  chemically synthesized
caagcaaaatatcacttaat

SEQ ID NO: 17537 - DNA, 20 bp, Artificial Sequence
  chemically synthesized
aagcaaaatatcacttaatg

SEQ ID NO: 17538 - DNA, 20 bp, Artificial Sequence
  chemically synthesized
tcacttaatggggtaattaa

SEQ ID NO: 17539 - DNA, 20 bp, Artificial Sequence
  chemically synthesized
cacttaatggggtaattaaa

SEQ ID NO: 17540 - DNA, 20 bp, Artificial Sequence
  chemically synthesized
acttaatggggtaattaaaa

SEQ ID NO: 17541 - DNA, 20 bp, Artificial Sequence
  chemically synthesized
atggggtaattaaaagggtg

SEQ ID NO: 17542 - DNA, 20 bp, Artificial Sequence
  chemically synthesized
aattaaaagggtgaagaaat

SEQ ID NO: 17543 - DNA, 20 bp, Artificial Sequence
  chemically synthesized
attaaaagggtgaagaaatt

SEQ ID NO: 17544 - DNA, 20 bp, Artificial Sequence
  chemically synthesized
gggtgaagaaattgggcaaa

SEQ ID NO: 17545 - DNA, 20 bp, Artificial Sequence
  chemically synthesized
attgggcaaatggatgtcat

SEQ ID NO: 17546 - DNA, 20 bp, Artificial Sequence
  chemically synthesized
ttgggcaaatggatgtcatg

SEQ ID NO: 17547 - DNA, 20 bp, Artificial Sequence
  chemically synthesized
gggcaaatggatgtcatgag

SEQ ID NO: 17548 - DNA, 20 bp, Artificial Sequence
  chemically synthesized
ggcaaatggatgtcatgagg

SEQ ID NO: 17549 - DNA, 20 bp, Artificial Sequence
  chemically synthesized
atgtcatgaggaggaatttt

SEQ ID NO: 17550 - DNA, 20 bp, Artificial Sequence
  chemically synthesized
tgtcatgaggaggaattttt

SEQ ID NO: 17551 - DNA, 20 bp, Artificial Sequence
  chemically synthesized
catgaggaggaatttttagg

SEQ ID NO: 17552 - DNA, 20 bp, Artificial Sequence
  chemically synthesized
tgaggaggaatttttaggca

SEQ ID NO: 17553 - DNA, 20 bp, Artificial Sequence
  chemically synthesized
gaggaggaatttttaggcag

SEQ ID NO: 17554 - DNA, 20 bp, Artificial Sequence
  chemically synthesized
gaatttttaggcagaggtaa

SEQ ID NO: 17555 - DNA, 20 bp, Artificial Sequence
  chemically synthesized
ttttaggcagaggtaatggt

SEQ ID NO: 17556 - DNA, 20 bp, Artificial Sequence
  chemically synthesized
ttaggcagaggtaatggtca

SEQ ID NO: 17557 - DNA, 20 bp, Artificial Sequence
  chemically synthesized
cagaggtaatggtcagagcc

SEQ ID NO: 17558 - DNA, 20 bp, Artificial Sequence
  chemically synthesized
agaggtaatggtcagagccc

SEQ ID NO: 17559 - DNA, 20 bp, Artificial Sequence
  chemically synthesized
atggtcagagcccaggccct

SEQ ID NO: 17560 - DNA, 20 bp, Artificial Sequence
  chemically synthesized
tcagagcccaggccctaagc

SEQ ID NO: 17561 - DNA, 20 bp, Artificial Sequence
  chemically synthesized
agagcccaggccctaagctg

SEQ ID NO: 17562 - DNA, 20 bp, Artificial Sequence
  chemically synthesized
gcccaggccctaagctggag

SEQ ID NO: 17563 - DNA, 20 bp, Artificial Sequence
  chemically synthesized
ccaggccctaagctggagta

SEQ ID NO: 17564 - DNA, 20 bp, Artificial Sequence
  chemically synthesized
taagctggagtagagtgtgc

SEQ ID NO: 17565 - DNA, 20 bp, Artificial Sequence
  chemically synthesized
aagctggagtagagtgtgca

SEQ ID NO: 17566 - DNA, 20 bp, Artificial Sequence
  chemically synthesized
tggagtagagtgtgcaagga

SEQ ID NO: 17567 - DNA, 20 bp, Artificial Sequence
  chemically synthesized
gagtagagtgtgcaaggaaa

SEQ ID NO: 17568 - DNA, 20 bp, Artificial Sequence
  chemically synthesized
agtgtgcaaggaaagagtaa

SEQ ID NO: 17569 - DNA, 20 bp, Artificial Sequence
  chemically synthesized
gtgtgcaaggaaagagtaat

SEQ ID NO: 17570 - DNA, 20 bp, Artificial Sequence
  chemically synthesized
gaaagagtaataggattgaa

SEQ ID NO: 17571 - DNA, 20 bp, Artificial Sequence
  chemically synthesized
aaagagtaataggattgaaa

SEQ ID NO: 17572 - DNA, 20 bp, Artificial Sequence
  chemically synthesized
ataggattgaaaaggataac

SEQ ID NO: 17573 - DNA, 20 bp, Artificial Sequence
  chemically synthesized
taggattgaaaaggataacc

SEQ ID NO: 17574 - DNA, 20 bp, Artificial Sequence
  chemically synthesized
gattgaaaaggataaccagg

SEQ ID NO: 17575 - DNA, 20 bp, Artificial Sequence
  chemically synthesized
attgaaaaggataaccaggt

SEQ ID NO: 17576 - DNA, 20 bp, Artificial Sequence
  chemically synthesized
tgaaaaggataaccaggtag

SEQ ID NO: 17577 - DNA, 20 bp, Artificial Sequence
  chemically synthesized
gaaaaggataaccaggtagg

SEQ ID NO: 17578 - DNA, 20 bp, Artificial Sequence
  chemically synthesized
gataaccaggtaggaggaca

SEQ ID NO: 17579 - DNA, 20 bp, Artificial Sequence
  chemically synthesized
ataaccaggtaggaggacat

SEQ ID NO: 17580 - DNA, 20 bp, Artificial Sequence
  chemically synthesized
taaccaggtaggaggacata

SEQ ID NO: 17581 - DNA, 20 bp, Artificial Sequence
  chemically synthesized
accaggtaggaggacatagg

SEQ ID NO: 17582 - DNA, 20 bp, Artificial Sequence
  chemically synthesized
ccaggtaggaggacataggg

SEQ ID NO: 17583 - DNA, 20 bp, Artificial Sequence
  chemically synthesized
caggtaggaggacataggga

SEQ ID NO: 17584 - DNA, 20 bp, Artificial Sequence
  chemically synthesized
aggtaggaggacatagggag

SEQ ID NO: 17585 - DNA, 20 bp, Artificial Sequence
  chemically synthesized
aggaggacatagggaggggt

SEQ ID NO: 17586 - DNA, 20 bp, Artificial Sequence
  chemically synthesized
ggaggacatagggaggggta

SEQ ID NO: 17587 - DNA, 20 bp, Artificial Sequence
  chemically synthesized
gaggacatagggaggggtaa

SEQ ID NO: 17588 - DNA, 20 bp, Artificial Sequence
  chemically synthesized
aggacatagggaggggtaag

SEQ ID NO: 17589 - DNA, 20 bp, Artificial Sequence
  chemically synthesized
gacatagggaggggtaaggg

SEQ ID NO: 17590 - DNA, 20 bp, Artificial Sequence
  chemically synthesized
acatagggaggggtaagggg

SEQ ID NO: 17591 - DNA, 20 bp, Artificial Sequence
  chemically synthesized
tagggaggggtaaggggagg

SEQ ID NO: 17592 - DNA, 20 bp, Artificial Sequence
  chemically synthesized
ggtaaggggaggaagacctc

SEQ ID NO: 17593 - DNA, 20 bp, Artificial Sequence
  chemically synthesized
aggaagacctccagtaaact

SEQ ID NO: 17594 - DNA, 20 bp, Artificial Sequence
  chemically synthesized
ggaagacctccagtaaactt

SEQ ID NO: 17595 - DNA, 20 bp, Artificial Sequence
  chemically synthesized
agacctccagtaaacttagg

SEQ ID NO: 17596 - DNA, 20 bp, Artificial Sequence
  chemically synthesized
gacctccagtaaacttaggc

SEQ ID NO: 17597 - DNA, 20 bp, Artificial Sequence
  chemically synthesized
aggcaggatatttcccgtga

SEQ ID NO: 17598 - DNA, 20 bp, Artificial Sequence
  chemically synthesized
actaaataataatcacatgt

SEQ ID NO: 17599 - DNA, 20 bp, Artificial Sequence
  chemically synthesized
aaataatctgtcgattactt

SEQ ID NO: 17600 - DNA, 20 bp, Artificial Sequence
  chemically synthesized
ttgagcaatactttgttcat

SEQ ID NO: 17601 - DNA, 20 bp, Artificial Sequence
  chemically synthesized
gcaatactttgttcatgagc

SEQ ID NO: 17602 - DNA, 20 bp, Artificial Sequence
  chemically synthesized
aatactttgttcatgagcta

SEQ ID NO: 17603 - DNA, 20 bp, Artificial Sequence
  chemically synthesized
ctttgttcatgagctagagc

SEQ ID NO: 17604 - DNA, 20 bp, Artificial Sequence
  chemically synthesized
tttgttcatgagctagagca

SEQ ID NO: 17605 - DNA, 20 bp, Artificial Sequence
  chemically synthesized
ttgttcatgagctagagcaa

SEQ ID NO: 17606 - DNA, 20 bp, Artificial Sequence
  chemically synthesized
tgttcatgagctagagcaag

SEQ ID NO: 17607 - DNA, 20 bp, Artificial Sequence
  chemically synthesized
ctagagcaaggggatgactc

SEQ ID NO: 17608 - DNA, 20 bp, Artificial Sequence
  chemically synthesized
agaaatcctttgtgaaatcc

SEQ ID NO: 17609 - DNA, 20 bp, Artificial Sequence
  chemically synthesized
aaatcctttgtgaaatcctg

SEQ ID NO: 17610 - DNA, 20 bp, Artificial Sequence
  chemically synthesized
aatcctttgtgaaatcctgg

SEQ ID NO: 17611 - DNA, 20 bp, Artificial Sequence
  chemically synthesized
tgtgaaatcctggaggtaat

SEQ ID NO: 17612 - DNA, 20 bp, Artificial Sequence
  chemically synthesized
tcctggaggtaataagatcc

SEQ ID NO: 17613 - DNA, 20 bp, Artificial Sequence
  chemically synthesized
atcttcaactcaattgcaaa

SEQ ID NO: 17614 - DNA, 20 bp, Artificial Sequence
  chemically synthesized
caaaacatattccatttcat

SEQ ID NO: 17615 - DNA, 20 bp, Artificial Sequence
  chemically synthesized
tattccatttcatcagacta

SEQ ID NO: 17616 - DNA, 20 bp, Artificial Sequence
  chemically synthesized
attccatttcatcagactac

SEQ ID NO: 17617 - DNA, 20 bp, Artificial Sequence
  chemically synthesized
catcagactacaggttttaa

SEQ ID NO: 17618 - DNA, 20 bp, Artificial Sequence
  chemically synthesized
atttcttaaatgtattattc

SEQ ID NO: 17619 - DNA, 20 bp, Artificial Sequence
  chemically synthesized
ccagtaacttatactttaca

SEQ ID NO: 17620 - DNA, 20 bp, Artificial Sequence
  chemically synthesized
tacatagtaaatcttatcaa

SEQ ID NO: 17621 - DNA, 20 bp, Artificial Sequence
  chemically synthesized
ttatcaatagtcacaatcaa

SEQ ID NO: 17622 - DNA, 20 bp, Artificial Sequence
  chemically synthesized
agtcacaatcaatggtcaca

SEQ ID NO: 17623 - DNA, 20 bp, Artificial Sequence
  chemically synthesized
cacaatcaatggtcacaaag

SEQ ID NO: 17624 - DNA, 20 bp, Artificial Sequence
  chemically synthesized
tcacaaagtagaacttcatc

SEQ ID NO: 17625 - DNA, 20 bp, Artificial Sequence
  chemically synthesized
acaaagtagaacttcatctg

SEQ ID NO: 17626 - DNA, 20 bp, Artificial Sequence
  chemically synthesized
tcatctggagacattacttt

SEQ ID NO: 17627 - DNA, 20 bp, Artificial Sequence
  chemically synthesized
ggagacattacttttagcct

SEQ ID NO: 17628 - DNA, 20 bp, Artificial Sequence
  chemically synthesized
gccatgcaaaatatactttt

SEQ ID NO: 17629 - DNA, 20 bp, Artificial Sequence
  chemically synthesized
tttggaaaattgccctttga

SEQ ID NO: 17630 - DNA, 20 bp, Artificial Sequence
  chemically synthesized
ttggaaaattgccctttgaa

SEQ ID NO: 17631 - DNA, 20 bp, Artificial Sequence
  chemically synthesized
aaaattgccctttgaaaggc

SEQ ID NO: 17632 - DNA, 20 bp, Artificial Sequence
  chemically synthesized
ctttgaaaggcgagacacaa

SEQ ID NO: 17633 - DNA, 20 bp, Artificial Sequence
  chemically synthesized
tttgaaaggcgagacacaaa

SEQ ID NO: 17634 - DNA, 20 bp, Artificial Sequence
  chemically synthesized
caaatgttgatgctattata

SEQ ID NO: 17635 - DNA, 20 bp, Artificial Sequence
  chemically synthesized
atgctattatatggtaccaa

SEQ ID NO: 17636 - DNA, 20 bp, Artificial Sequence
  chemically synthesized
tgctattatatggtaccaat

SEQ ID NO: 17637 - DNA, 20 bp, Artificial Sequence
  chemically synthesized
ataggattcattaatttata

SEQ ID NO: 17638 - DNA, 20 bp, Artificial Sequence
  chemically synthesized
taggattcattaatttataa

SEQ ID NO: 17639 - DNA, 20 bp, Artificial Sequence
  chemically synthesized
ggattcattaatttataaag

SEQ ID NO: 17640 - DNA, 20 bp, Artificial Sequence
  chemically synthesized
ttcattaatttataaaggag

SEQ ID NO: 17641 - DNA, 20 bp, Artificial Sequence
  chemically synthesized
cattaatttataaaggagaa

SEQ ID NO: 17642 - DNA, 20 bp, Artificial Sequence
  chemically synthesized
ctaatgtaactccaaaatgc

SEQ ID NO: 17643 - DNA, 20 bp, Artificial Sequence
  chemically synthesized
aatgcaagcaattttcatat

SEQ ID NO: 17644 - DNA, 20 bp, Artificial Sequence
  chemically synthesized
attttcatatgagtctacac

SEQ ID NO: 17645 - DNA, 20 bp, Artificial Sequence
  chemically synthesized
tacacaagctaattgtcctt

SEQ ID NO: 17646 - DNA, 20 bp, Artificial Sequence
  chemically synthesized
tccttaagaatttcatcttt

SEQ ID NO: 17647 - DNA, 20 bp, Artificial Sequence
  chemically synthesized
ccttaagaatttcatcttta

SEQ ID NO: 17648 - DNA, 20 bp, Artificial Sequence
  chemically synthesized
agaatttcatctttaaggaa

SEQ ID NO: 17649 - DNA, 20 bp, Artificial Sequence
  chemically synthesized
aagttttttactgtatcaaa

SEQ ID NO: 17650 - DNA, 20 bp, Artificial Sequence
  chemically synthesized
ttttttactgtatcaaaaag

SEQ ID NO: 17651 - DNA, 20 bp, Artificial Sequence
  chemically synthesized
aagaagtttaaactgtcatt

SEQ ID NO: 17652 - DNA, 20 bp, Artificial Sequence
  chemically synthesized
aagtttaaactgtcattgag

SEQ ID NO: 17653 - DNA, 20 bp, Artificial Sequence
  chemically synthesized
gtttaaactgtcattgagca

SEQ ID NO: 17654 - DNA, 20 bp, Artificial Sequence
  chemically synthesized
attgagcagagtctgataat

SEQ ID NO: 17655 - DNA, 20 bp, Artificial Sequence
  chemically synthesized
ttgagcagagtctgataata

SEQ ID NO: 17656 - DNA, 20 bp, Artificial Sequence
  chemically synthesized
ataaggacactgtcaaatca

SEQ ID NO: 17657 - DNA, 20 bp, Artificial Sequence
  chemically synthesized
gacactgtcaaatcacagtt

SEQ ID NO: 17658 - DNA, 20 bp, Artificial Sequence
  chemically synthesized
cagttcagatgttatgtgat

SEQ ID NO: 17659 - DNA, 20 bp, Artificial Sequence
  chemically synthesized
agttcagatgttatgtgatg

SEQ ID NO: 17660 - DNA, 20 bp, Artificial Sequence
  chemically synthesized
cagatgttatgtgatgagga

SEQ ID NO: 17661 - DNA, 20 bp, Artificial Sequence
  chemically synthesized
gttatgtgatgaggacagaa

SEQ ID NO: 17662 - DNA, 20 bp, Artificial Sequence
  chemically synthesized
gaggacagaatagaacacat

SEQ ID NO: 17663 - DNA, 20 bp, Artificial Sequence
  chemically synthesized
aggacagaatagaacacatg

SEQ ID NO: 17664 - DNA, 20 bp, Artificial Sequence
  chemically synthesized
gacagaatagaacacatgag

SEQ ID NO: 17665 - DNA, 20 bp, Artificial Sequence
  chemically synthesized
acagaatagaacacatgagg

SEQ ID NO: 17666 - DNA, 20 bp, Artificial Sequence
  chemically synthesized
gaatagaacacatgaggagg

SEQ ID NO: 17667 - DNA, 20 bp, Artificial Sequence
  chemically synthesized
tagaacacatgaggaggaag

SEQ ID NO: 17668 - DNA, 20 bp, Artificial Sequence
  chemically synthesized
gaggaggaagcagaaacttc

SEQ ID NO: 17669 - DNA, 20 bp, Artificial Sequence
  chemically synthesized
ggaagcagaaacttctagac

SEQ ID NO: 17670 - DNA, 20 bp, Artificial Sequence
  chemically synthesized
cagaaacttctagactggac

SEQ ID NO: 17671 - DNA, 20 bp, Artificial Sequence
  chemically synthesized
acttctagactggacaagaa

SEQ ID NO: 17672 - DNA, 20 bp, Artificial Sequence
  chemically synthesized
aaccatccaacaataaatct

SEQ ID NO: 17673 - DNA, 20 bp, Artificial Sequence
  chemically synthesized
tgatgtcatctactacatct

SEQ ID NO: 17674 - DNA, 20 bp, Artificial Sequence
  chemically synthesized
ctaagtatttcctcaaattc

SEQ ID NO: 17675 - DNA, 20 bp, Artificial Sequence
  chemically synthesized
cctcaaattctggacaattt

SEQ ID NO: 17676 - DNA, 20 bp, Artificial Sequence
  chemically synthesized
aaccatcaaaattatttgtt

SEQ ID NO: 17677 - DNA, 20 bp, Artificial Sequence
  chemically synthesized
accatcaaaattatttgttg

SEQ ID NO: 17678 - DNA, 20 bp, Artificial Sequence
  chemically synthesized
ttgttgaggaaaaataaact

SEQ ID NO: 17679 - DNA, 20 bp, Artificial Sequence
  chemically synthesized
aataaacttagccaatttgc

SEQ ID NO: 17680 - DNA, 20 bp, Artificial Sequence
  chemically synthesized
ataaacttagccaatttgca

SEQ ID NO: 17681 - DNA, 20 bp, Artificial Sequence
  chemically synthesized
taaacttagccaatttgcaa

SEQ ID NO: 17682 - DNA, 20 bp, Artificial Sequence
  chemically synthesized
ttgcaagggcaactaaaatg

SEQ ID NO: 17683 - DNA, 20 bp, Artificial Sequence
  chemically synthesized
aaatgaagaacttttcttta

SEQ ID NO: 17684 - DNA, 20 bp, Artificial Sequence
  chemically synthesized
aagaacttttctttaaagtg

SEQ ID NO: 17685 - DNA, 20 bp, Artificial Sequence
  chemically synthesized
agaacttttctttaaagtgt

SEQ ID NO: 17686 - DNA, 20 bp, Artificial Sequence
  chemically synthesized
aacttttctttaaagtgtgg

SEQ ID NO: 17687 - DNA, 20 bp, Artificial Sequence
  chemically synthesized
aaagtgtgggagtcacatct

SEQ ID NO: 17688 - DNA, 20 bp, Artificial Sequence
  chemically synthesized
caacatatttaaatatatct

SEQ ID NO: 17689 - DNA, 20 bp, Artificial Sequence
  chemically synthesized
acaaaaatgcaaaatttcca

SEQ ID NO: 17690 - DNA, 20 bp, Artificial Sequence
  chemically synthesized
aaagaatttctcctcttctg

SEQ ID NO: 17691 - DNA, 20 bp, Artificial Sequence
  chemically synthesized
ttcttcatcttcatcttttc

SEQ ID NO: 17692 - DNA, 20 bp, Artificial Sequence
  chemically synthesized
tcttcatcttcatcttttcc

SEQ ID NO: 17693 - DNA, 20 bp, Artificial Sequence
  chemically synthesized
ttcatcttcatcttttccag

SEQ ID NO: 17694 - DNA, 20 bp, Artificial Sequence
  chemically synthesized
tttccaggagaatataccat

SEQ ID NO: 17695 - DNA, 20 bp, Artificial Sequence
  chemically synthesized
aatataccataagtttctga

SEQ ID NO: 17696 - DNA, 20 bp, Artificial Sequence
  chemically synthesized
ttctgatggtacacatttat

SEQ ID NO: 17697 - DNA, 20 bp, Artificial Sequence
  chemically synthesized
ttgcaactatgcatcttact

SEQ ID NO: 17698 - DNA, 20 bp, Artificial Sequence
  chemically synthesized
gcaactatgcatcttactca

SEQ ID NO: 17699 - DNA, 20 bp, Artificial Sequence
  chemically synthesized
cttaaaacatccttgtttgt

SEQ ID NO: 17700 - DNA, 20 bp, Artificial Sequence
  chemically synthesized
tttcaaattcatatacactt

SEQ ID NO: 17701 - DNA, 20 bp, Artificial Sequence
  chemically synthesized
caaattcatatacactttgg

SEQ ID NO: 17702 - DNA, 20 bp, Artificial Sequence
  chemically synthesized
gcaaacatttttatttgctg

SEQ ID NO: 17703 - DNA, 20 bp, Artificial Sequence
  chemically synthesized
ttttatttgctgaagaacat

SEQ ID NO: 17704 - DNA, 20 bp, Artificial Sequence
  chemically synthesized
tttatttgctgaagaacata

SEQ ID NO: 17705 - DNA, 20 bp, Artificial Sequence
  chemically synthesized
ttatttgctgaagaacataa

SEQ ID NO: 17706 - DNA, 20 bp, Artificial Sequence
  chemically synthesized
tatttgctgaagaacataag

SEQ ID NO: 17707 - DNA, 20 bp, Artificial Sequence
  chemically synthesized
atttgctgaagaacataagg

SEQ ID NO: 17708 - DNA, 20 bp, Artificial Sequence
  chemically synthesized
tgaagaacataagggggaaa

SEQ ID NO: 17709 - DNA, 20 bp, Artificial Sequence
  chemically synthesized
aagaacataagggggaaata

SEQ ID NO: 17710 - DNA, 20 bp, Artificial Sequence
  chemically synthesized
aaatagagattctttatttg

SEQ ID NO: 17711 - DNA, 20 bp, Artificial Sequence
  chemically synthesized
aagaaacaaatgatttgatt

SEQ ID NO: 17712 - DNA, 20 bp, Artificial Sequence
  chemically synthesized
agaaacaaatgatttgattt

SEQ ID NO: 17713 - DNA, 20 bp, Artificial Sequence
  chemically synthesized
gatttgggaaatgaaatgaa

SEQ ID NO: 17714 - DNA, 20 bp, Artificial Sequence
  chemically synthesized
atgaaatgaaaagaaaaaca

SEQ ID NO: 17715 - DNA, 20 bp, Artificial Sequence
  chemically synthesized
gctacttcttttactcatct

SEQ ID NO: 17716 - DNA, 20 bp, Artificial Sequence
  chemically synthesized
ctacttcttttactcatctg

SEQ ID NO: 17717 - DNA, 20 bp, Artificial Sequence
  chemically synthesized
ttttactcatctgaggcctt

SEQ ID NO: 17718 - DNA, 20 bp, Artificial Sequence
  chemically synthesized
actcatctgaggccttcaga

SEQ ID NO: 17719 - DNA, 20 bp, Artificial Sequence
  chemically synthesized
ccttcagatagtcccccata

SEQ ID NO: 17720 - DNA, 20 bp, Artificial Sequence
  chemically synthesized
gatagtcccccatatagcct

SEQ ID NO: 17721 - DNA, 20 bp, Artificial Sequence
  chemically synthesized
tagtcccccatatagcctta

SEQ ID NO: 17722 - DNA, 20 bp, Artificial Sequence
  chemically synthesized
aaaatatgattatgctcttt

SEQ ID NO: 17723 - DNA, 20 bp, Artificial Sequence
  chemically synthesized
attatgctctttcagtctat

SEQ ID NO: 17724 - DNA, 20 bp, Artificial Sequence
  chemically synthesized
ctattagaaataaaaacata

SEQ ID NO: 17725 - DNA, 20 bp, Artificial Sequence
  chemically synthesized
cataaagcttaaaaaatttc

SEQ ID NO: 17726 - DNA, 20 bp, Artificial Sequence
  chemically synthesized
ataaagcttaaaaaatttca

SEQ ID NO: 17727 - DNA, 20 bp, Artificial Sequence
  chemically synthesized
taaagcttaaaaaatttcaa

SEQ ID NO: 17728 - DNA, 20 bp, Artificial Sequence
  chemically synthesized
agcttaaaaaatttcaaggg

SEQ ID NO: 17729 - DNA, 20 bp, Artificial Sequence
  chemically synthesized
gcttaaaaaatttcaaggga

SEQ ID NO: 17730 - DNA, 20 bp, Artificial Sequence
  chemically synthesized
cttaaaaaatttcaagggaa

SEQ ID NO: 17731 - DNA, 20 bp, Artificial Sequence
  chemically synthesized
ttaaaaaatttcaagggaag

SEQ ID NO: 17732 - DNA, 20 bp, Artificial Sequence
  chemically synthesized
atttcaagggaaggggcttg

SEQ ID NO: 17733 - DNA, 20 bp, Artificial Sequence
  chemically synthesized
gggcttgaagattactgact

SEQ ID NO: 17734 - DNA, 20 bp, Artificial Sequence
  chemically synthesized
ggcttgaagattactgacta

SEQ ID NO: 17735 - DNA, 20 bp, Artificial Sequence
  chemically synthesized
gcttgaagattactgactaa

SEQ ID NO: 17736 - DNA, 20 bp, Artificial Sequence
  chemically synthesized
tgaagattactgactaaggg

SEQ ID NO: 17737 - DNA, 20 bp, Artificial Sequence
  chemically synthesized
tgacactcacctcctccaca

SEQ ID NO: 17738 - DNA, 20 bp, Artificial Sequence
  chemically synthesized
tcctccacaaagaaccaaaa

SEQ ID NO: 17739 - DNA, 20 bp, Artificial Sequence
  chemically synthesized
ccacaaagaaccaaaatagt

SEQ ID NO: 17740 - DNA, 20 bp, Artificial Sequence
  chemically synthesized
caaagaaccaaaatagtaag

SEQ ID NO: 17741 - DNA, 20 bp, Artificial Sequence
  chemically synthesized
gtaagtagaaaatcccacat

SEQ ID NO: 17742 - DNA, 20 bp, Artificial Sequence
  chemically synthesized
aagtagaaaatcccacataa

SEQ ID NO: 17743 - DNA, 20 bp, Artificial Sequence
  chemically synthesized
gtagaaaatcccacataaga

SEQ ID NO: 17744 - DNA, 20 bp, Artificial Sequence
  chemically synthesized
tcccacataagagagaattc

SEQ ID NO: 17745 - DNA, 20 bp, Artificial Sequence
  chemically synthesized
gagagaattctggaattcaa

SEQ ID NO: 17746 - DNA, 20 bp, Artificial Sequence
  chemically synthesized
gagaattctggaattcaaca

SEQ ID NO: 17747 - DNA, 20 bp, Artificial Sequence
  chemically synthesized
aattctggaattcaacagag

SEQ ID NO: 17748 - DNA, 20 bp, Artificial Sequence
  chemically synthesized
ggaattcaacagagaagtga

SEQ ID NO: 17749 - DNA, 20 bp, Artificial Sequence
  chemically synthesized
gaattcaacagagaagtgac

SEQ ID NO: 17750 - DNA, 20 bp, Artificial Sequence
  chemically synthesized
ttcaacagagaagtgacagg

SEQ ID NO: 17751 - DNA, 20 bp, Artificial Sequence
  chemically synthesized
agaagtgacaggaagcatct

SEQ ID NO: 17752 - DNA, 20 bp, Artificial Sequence
  chemically synthesized
gaagtgacaggaagcatcta

SEQ ID NO: 17753 - DNA, 20 bp, Artificial Sequence
  chemically synthesized
aggaagcatctaaggcaatg

SEQ ID NO: 17754 - DNA, 20 bp, Artificial Sequence
  chemically synthesized
ggaagcatctaaggcaatga

SEQ ID NO: 17755 - DNA, 20 bp, Artificial Sequence
  chemically synthesized
gaagcatctaaggcaatgaa

SEQ ID NO: 17756 - DNA, 20 bp, Artificial Sequence
  chemically synthesized
aagcatctaaggcaatgaag

SEQ ID NO: 17757 - DNA, 20 bp, Artificial Sequence
  chemically synthesized
gcatctaaggcaatgaaggg

SEQ ID NO: 17758 - DNA, 20 bp, Artificial Sequence
  chemically synthesized
catctaaggcaatgaagggg

SEQ ID NO: 17759 - DNA, 20 bp, Artificial Sequence
  chemically synthesized
atctaaggcaatgaagggga

SEQ ID NO: 17760 - DNA, 20 bp, Artificial Sequence
  chemically synthesized
taaggcaatgaaggggaggg

SEQ ID NO: 17761 - DNA, 20 bp, Artificial Sequence
  chemically synthesized
gcaatgaaggggagggaagc

SEQ ID NO: 17762 - DNA, 20 bp, Artificial Sequence
  chemically synthesized
caatgaaggggagggaagca

SEQ ID NO: 17763 - DNA, 20 bp, Artificial Sequence
  chemically synthesized
tgaaggggagggaagcaagg

SEQ ID NO: 17764 - DNA, 20 bp, Artificial Sequence
  chemically synthesized
gggaagcaaggaagcctacc

SEQ ID NO: 17765 - DNA, 20 bp, Artificial Sequence
  chemically synthesized
aagcaaggaagcctacccag

SEQ ID NO: 17766 - DNA, 20 bp, Artificial Sequence
  chemically synthesized
agcaaggaagcctacccagt

SEQ ID NO: 17767 - DNA, 20 bp, Artificial Sequence
  chemically synthesized
gcaaggaagcctacccagta

SEQ ID NO: 17768 - DNA, 20 bp, Artificial Sequence
  chemically synthesized
acccagtagggatcctctgt

SEQ ID NO: 17769 - DNA, 20 bp, Artificial Sequence
  chemically synthesized
cccagtagggatcctctgtg

SEQ ID NO: 17770 - DNA, 20 bp, Artificial Sequence
  chemically synthesized
gtagggatcctctgtgaggc

SEQ ID NO: 17771 - DNA, 20 bp, Artificial Sequence
  chemically synthesized
agggatcctctgtgaggcca

SEQ ID NO: 17772 - DNA, 20 bp, Artificial Sequence
  chemically synthesized
ggatcctctgtgaggccaga

SEQ ID NO: 17773 - DNA, 20 bp, Artificial Sequence
  chemically synthesized
gatcctctgtgaggccagag

SEQ ID NO: 17774 - DNA, 20 bp, Artificial Sequence
  chemically synthesized
gtgaggccagagaggctccc

SEQ ID NO: 17775 - DNA, 20 bp, Artificial Sequence
  chemically synthesized
gaggctccccagtgcatcga

SEQ ID NO: 17776 - DNA, 20 bp, Artificial Sequence
  chemically synthesized
tccccagtgcatcgaaagtt

SEQ ID NO: 17777 - DNA, 20 bp, Artificial Sequence
  chemically synthesized
aaagttaagtgactgactcc

SEQ ID NO: 17778 - DNA, 20 bp, Artificial Sequence
  chemically synthesized
gttaagtgactgactcccag

SEQ ID NO: 17779 - DNA, 20 bp, Artificial Sequence
  chemically synthesized
agtggtccacatctgcatta

SEQ ID NO: 17780 - DNA, 20 bp, Artificial Sequence
  chemically synthesized
cacatctgcattatggactc

SEQ ID NO: 17781 - DNA, 20 bp, Artificial Sequence
  chemically synthesized
acatctgcattatggactcc

SEQ ID NO: 17782 - DNA, 20 bp, Artificial Sequence
  chemically synthesized
attatggactccaggaatcc

SEQ ID NO: 17783 - DNA, 20 bp, Artificial Sequence
  chemically synthesized
gactccaggaatcctagcca

SEQ ID NO: 17784 - DNA, 20 bp, Artificial Sequence
  chemically synthesized
actccaggaatcctagccac

SEQ ID NO: 17785 - DNA, 20 bp, Artificial Sequence
  chemically synthesized
tccaggaatcctagccacag

SEQ ID NO: 17786 - DNA, 20 bp, Artificial Sequence
  chemically synthesized
caggaatcctagccacagga

SEQ ID NO: 17787 - DNA, 20 bp, Artificial Sequence
  chemically synthesized
aggagagtcccttgaccatg

SEQ ID NO: 17788 - DNA, 20 bp, Artificial Sequence
  chemically synthesized
ggagagtcccttgaccatgc

SEQ ID NO: 17789 - DNA, 20 bp, Artificial Sequence
  chemically synthesized
cccttgaccatgcaggcctt

SEQ ID NO: 17790 - DNA, 20 bp, Artificial Sequence
  chemically synthesized
gcaggccttgagactatcat

SEQ ID NO: 17791 - DNA, 20 bp, Artificial Sequence
  chemically synthesized
caggccttgagactatcata

SEQ ID NO: 17792 - DNA, 20 bp, Artificial Sequence
  chemically synthesized
gactatcataaggaactgcc

SEQ ID NO: 17793 - DNA, 20 bp, Artificial Sequence
  chemically synthesized
aactgcccagcaatcgcaca

SEQ ID NO: 17794 - DNA, 20 bp, Artificial Sequence
  chemically synthesized
actgcccagcaatcgcacaa

SEQ ID NO: 17795 - DNA, 20 bp, Artificial Sequence
  chemically synthesized
atcgcacaaaggcattgctc

SEQ ID NO: 17796 - DNA, 20 bp, Artificial Sequence
  chemically synthesized
cgcacaaaggcattgctcca

SEQ ID NO: 17797 - DNA, 20 bp, Artificial Sequence
  chemically synthesized
acaaaggcattgctccagag

SEQ ID NO: 17798 - DNA, 20 bp, Artificial Sequence
  chemically synthesized
caaaggcattgctccagaga

SEQ ID NO: 17799 - DNA, 20 bp, Artificial Sequence
  chemically synthesized
aaggcattgctccagagaag

SEQ ID NO: 17800 - DNA, 20 bp, Artificial Sequence
  chemically synthesized
tccagagaaggagctctcac

SEQ ID NO: 17801 - DNA, 20 bp, Artificial Sequence
  chemically synthesized
ccagagaaggagctctcact

SEQ ID NO: 17802 - DNA, 20 bp, Artificial Sequence
  chemically synthesized
cccctgccatccccattact

SEQ ID NO: 17803 - DNA, 20 bp, Artificial Sequence
  chemically synthesized
ctgccatccccattactgag

SEQ ID NO: 17804 - DNA, 20 bp, Artificial Sequence
  chemically synthesized
catccccattactgagcagc

SEQ ID NO: 17805 - DNA, 20 bp, Artificial Sequence
  chemically synthesized
atccccattactgagcagca

SEQ ID NO: 17806 - DNA, 20 bp, Artificial Sequence
  chemically synthesized
gagcagcaaggtgccatttt

SEQ ID NO: 17807 - DNA, 20 bp, Artificial Sequence
  chemically synthesized
gcagcaaggtgccattttga

SEQ ID NO: 17808 - DNA, 20 bp, Artificial Sequence
  chemically synthesized
tttgagagcccaacacccac

SEQ ID NO: 17809 - DNA, 20 bp, Artificial Sequence
  chemically synthesized
caccagatgacatcgttcct

SEQ ID NO: 17810 - DNA, 20 bp, Artificial Sequence
  chemically synthesized
tctgcatctctacatccctg

SEQ ID NO: 17811 - DNA, 20 bp, Artificial Sequence
  chemically synthesized
ctgctgacatcccccaccca

SEQ ID NO: 17812 - DNA, 20 bp, Artificial Sequence
  chemically synthesized
gacatcccccacccacagct

SEQ ID NO: 17813 - DNA, 20 bp, Artificial Sequence
  chemically synthesized
ccacagctgagtgctactgc

SEQ ID NO: 17814 - DNA, 20 bp, Artificial Sequence
  chemically synthesized
ctactgctggctgctgtcac

SEQ ID NO: 17815 - DNA, 20 bp, Artificial Sequence
  chemically synthesized
tactgctggctgctgtcacc

SEQ ID NO: 17816 - DNA, 20 bp, Artificial Sequence
  chemically synthesized
actgctggctgctgtcacca

SEQ ID NO: 17817 - DNA, 20 bp, Artificial Sequence
  chemically synthesized
ggctgctgtcaccagggata

SEQ ID NO: 17818 - DNA, 20 bp, Artificial Sequence
  chemically synthesized
ccagggataaagtgtgtcat

SEQ ID NO: 17819 - DNA, 20 bp, Artificial Sequence
  chemically synthesized
gggataaagtgtgtcattag

SEQ ID NO: 17820 - DNA, 20 bp, Artificial Sequence
  chemically synthesized
ataaagtgtgtcattagaag

SEQ ID NO: 17821 - DNA, 20 bp, Artificial Sequence
  chemically synthesized
gaagtggactcccccacccc

SEQ ID NO: 17822 - DNA, 20 bp, Artificial Sequence
  chemically synthesized
gtggactcccccacccccag

SEQ ID NO: 17823 - DNA, 20 bp, Artificial Sequence
  chemically synthesized
gactcccccacccccagtag

SEQ ID NO: 17824 - DNA, 20 bp, Artificial Sequence
  chemically synthesized
actcccccacccccagtagc

SEQ ID NO: 17825 - DNA, 20 bp, Artificial Sequence
  chemically synthesized
ctcccccacccccagtagca

SEQ ID NO: 17826 - DNA, 20 bp, Artificial Sequence
  chemically synthesized
cagggctgctacacatttat

SEQ ID NO: 17827 - DNA, 20 bp, Artificial Sequence
  chemically synthesized
tacacatttataagctccct

SEQ ID NO: 17828 - DNA, 20 bp, Artificial Sequence
  chemically synthesized
agaaaatgctaccccacttg

SEQ ID NO: 17829 - DNA, 20 bp, Artificial Sequence
  chemically synthesized
ccccacttgcagccaccatc

SEQ ID NO: 17830 - DNA, 20 bp, Artificial Sequence
  chemically synthesized
cccacttgcagccaccatct

SEQ ID NO: 17831 - DNA, 20 bp, Artificial Sequence
  chemically synthesized
ccacttgcagccaccatctg

SEQ ID NO: 17832 - DNA, 20 bp, Artificial Sequence
  chemically synthesized
gggctgaaacacatgcccac

SEQ ID NO: 17833 - DNA, 20 bp, Artificial Sequence
  chemically synthesized
gcccaccagcaacccattta

SEQ ID NO: 17834 - DNA, 20 bp, Artificial Sequence
  chemically synthesized
tttatagctgctgccactga

SEQ ID NO: 17835 - DNA, 20 bp, Artificial Sequence
  chemically synthesized
aacacaccccgcaccccttc

SEQ ID NO: 17836 - DNA, 20 bp, Artificial Sequence
  chemically synthesized
cacaccccgcaccccttcaa

SEQ ID NO: 17837 - DNA, 20 bp, Artificial Sequence
  chemically synthesized
accccgcaccccttcaagag

SEQ ID NO: 17838 - DNA, 20 bp, Artificial Sequence
  chemically synthesized
ccccgcaccccttcaagagc

SEQ ID NO: 17839 - DNA, 20 bp, Artificial Sequence
  chemically synthesized
cccgcaccccttcaagagca

SEQ ID NO: 17840 - DNA, 20 bp, Artificial Sequence
  chemically synthesized
tcaagagcagggcaacaatg

SEQ ID NO: 17841 - DNA, 20 bp, Artificial Sequence
  chemically synthesized
agagcagggcaacaatgcag

SEQ ID NO: 17842 - DNA, 20 bp, Artificial Sequence
  chemically synthesized
gcagtagctgctaattcact

SEQ ID NO: 17843 - DNA, 20 bp, Artificial Sequence
  chemically synthesized
cagtagctgctaattcactc

SEQ ID NO: 17844 - DNA, 20 bp, Artificial Sequence
  chemically synthesized
aattcactcaggcattctgc

SEQ ID NO: 17845 - DNA, 20 bp, Artificial Sequence
  chemically synthesized
attcactcaggcattctgct

SEQ ID NO: 17846 - DNA, 20 bp, Artificial Sequence
  chemically synthesized
ttcactcaggcattctgctg

SEQ ID NO: 17847 - DNA, 20 bp, Artificial Sequence
  chemically synthesized
tcactcaggcattctgctgg

SEQ ID NO: 17848 - DNA, 20 bp, Artificial Sequence
  chemically synthesized
aggcattctgctgggggcct

SEQ ID NO: 17849 - DNA, 20 bp, Artificial Sequence
  chemically synthesized
ggcattctgctgggggcctg

SEQ ID NO: 17850 - DNA, 20 bp, Artificial Sequence
  chemically synthesized
gcctgaggatcactccactc

SEQ ID NO: 17851 - DNA, 20 bp, Artificial Sequence
  chemically synthesized
cactccactccagcctatga

SEQ ID NO: 17852 - DNA, 20 bp, Artificial Sequence
  chemically synthesized
ccactccagcctatgatagc

SEQ ID NO: 17853 - DNA, 20 bp, Artificial Sequence
  chemically synthesized
cggtgtccacacacaccact

SEQ ID NO: 17854 - DNA, 20 bp, Artificial Sequence
  chemically synthesized
tgtccacacacaccactgag

SEQ ID NO: 17855 - DNA, 20 bp, Artificial Sequence
  chemically synthesized
cacacaccactgagtggcct

SEQ ID NO: 17856 - DNA, 20 bp, Artificial Sequence
  chemically synthesized
acacaccactgagtggcctg

SEQ ID NO: 17857 - DNA, 20 bp, Artificial Sequence
  chemically synthesized
accactgagtggcctgaggt

SEQ ID NO: 17858 - DNA, 20 bp, Artificial Sequence
  chemically synthesized
ccactgagtggcctgaggtc

SEQ ID NO: 17859 - DNA, 20 bp, Artificial Sequence
  chemically synthesized
ggcctgaggtcaggaacacc

SEQ ID NO: 17860 - DNA, 20 bp, Artificial Sequence
  chemically synthesized
gaggtcaggaacacccagcc

SEQ ID NO: 17861 - DNA, 20 bp, Artificial Sequence
  chemically synthesized
ctttgccttcctcaatgcct

SEQ ID NO: 17862 - DNA, 20 bp, Artificial Sequence
  chemically synthesized
gccttcctcaatgcctaagc

SEQ ID NO: 17863 - DNA, 20 bp, Artificial Sequence
  chemically synthesized
caatgcctaagcaagttgtc

SEQ ID NO: 17864 - DNA, 20 bp, Artificial Sequence
  chemically synthesized
aatgcctaagcaagttgtct

SEQ ID NO: 17865 - DNA, 20 bp, Artificial Sequence
  chemically synthesized
aagcaagttgtctgggaacc

SEQ ID NO: 17866 - DNA, 20 bp, Artificial Sequence
  chemically synthesized
gcaagttgtctgggaaccca

SEQ ID NO: 17867 - DNA, 20 bp, Artificial Sequence
  chemically synthesized
gttgtctgggaacccagaga

SEQ ID NO: 17868 - DNA, 20 bp, Artificial Sequence
  chemically synthesized
cttgtgccatccaccatgac

SEQ ID NO: 17869 - DNA, 20 bp, Artificial Sequence
  chemically synthesized
atccaccatgactggtacct

SEQ ID NO: 17870 - DNA, 20 bp, Artificial Sequence
  chemically synthesized
tggtacctaagcaaccctcc

SEQ ID NO: 17871 - DNA, 20 bp, Artificial Sequence
  chemically synthesized
tacctaagcaaccctcccag

SEQ ID NO: 17872 - DNA, 20 bp, Artificial Sequence
  chemically synthesized
ccctcccagaagcctgatga

SEQ ID NO: 17873 - DNA, 20 bp, Artificial Sequence
  chemically synthesized
cctcccagaagcctgatgat

SEQ ID NO: 17874 - DNA, 20 bp, Artificial Sequence
  chemically synthesized
tctgccactgccatcacaac

SEQ ID NO: 17875 - DNA, 20 bp, Artificial Sequence
  chemically synthesized
cctcctgcatgtgccacctg

SEQ ID NO: 17876 - DNA, 20 bp, Artificial Sequence
  chemically synthesized
ctcctgcatgtgccacctgt

SEQ ID NO: 17877 - DNA, 20 bp, Artificial Sequence
  chemically synthesized
atgtgccacctgtgggtctg

SEQ ID NO: 17878 - DNA, 20 bp, Artificial Sequence
  chemically synthesized
ccacctgtgggtctgaagac

SEQ ID NO: 17879 - DNA, 20 bp, Artificial Sequence
  chemically synthesized
ggtctgaagactggctcatt

SEQ ID NO: 17880 - DNA, 20 bp, Artificial Sequence
  chemically synthesized
actggctcattcagcccttg

SEQ ID NO: 17881 - DNA, 20 bp, Artificial Sequence
  chemically synthesized
cttgcagccaccaccaacac

SEQ ID NO: 17882 - DNA, 20 bp, Artificial Sequence
  chemically synthesized
agccaccaccaacaccagtg

SEQ ID NO: 17883 - DNA, 20 bp, Artificial Sequence
  chemically synthesized
caacaccagtgcagactgct

SEQ ID NO: 17884 - DNA, 20 bp, Artificial Sequence
  chemically synthesized
aacaccagtgcagactgctt

SEQ ID NO: 17885 - DNA, 20 bp, Artificial Sequence
  chemically synthesized
caccagtgcagactgcttgg

SEQ ID NO: 17886 - DNA, 20 bp, Artificial Sequence
  chemically synthesized
agtgcagactgcttgggagc

SEQ ID NO: 17887 - DNA, 20 bp, Artificial Sequence
  chemically synthesized
tgcagactgcttgggagcca

SEQ ID NO: 17888 - DNA, 20 bp, Artificial Sequence
  chemically synthesized
gcagactgcttgggagccag

SEQ ID NO: 17889 - DNA, 20 bp, Artificial Sequence
  chemically synthesized
cagactgcttgggagccaga

SEQ ID NO: 17890 - DNA, 20 bp, Artificial Sequence
  chemically synthesized
ggagccagagggttgtcctg

SEQ ID NO: 17891 - DNA, 20 bp, Artificial Sequence
  chemically synthesized
gggttgtcctgcagttgcta

SEQ ID NO: 17892 - DNA, 20 bp, Artificial Sequence
  chemically synthesized
cccacaccacacccactgtc

SEQ ID NO: 17893 - DNA, 20 bp, Artificial Sequence
  chemically synthesized
acaccacacccactgtccag

SEQ ID NO: 17894 - DNA, 20 bp, Artificial Sequence
  chemically synthesized
cacccactgtccagaagcct

SEQ ID NO: 17895 - DNA, 20 bp, Artificial Sequence
  chemically synthesized
acccactgtccagaagcctg

SEQ ID NO: 17896 - DNA, 20 bp, Artificial Sequence
  chemically synthesized
aagcctgaggacccacacac

SEQ ID NO: 17897 - DNA, 20 bp, Artificial Sequence
  chemically synthesized
tgaggacccacacaccagcc

SEQ ID NO: 17898 - DNA, 20 bp, Artificial Sequence
  chemically synthesized
cacaccagcccagtctacta

SEQ ID NO: 17899 - DNA, 20 bp, Artificial Sequence
  chemically synthesized
tatggccactactgacaccc

SEQ ID NO: 17900 - DNA, 20 bp, Artificial Sequence
  chemically synthesized
acacccaagcaaactgcctg

SEQ ID NO: 17901 - DNA, 20 bp, Artificial Sequence
  chemically synthesized
cacccaagcaaactgcctga

SEQ ID NO: 17902 - DNA, 20 bp, Artificial Sequence
  chemically synthesized
agcaaactgcctgaaggcca

SEQ ID NO: 17903 - DNA, 20 bp, Artificial Sequence
  chemically synthesized
ggccaaagaatcaacccaac

SEQ ID NO: 17904 - DNA, 20 bp, Artificial Sequence
  chemically synthesized
ccaactagactcattaccat

SEQ ID NO: 17905 - DNA, 20 bp, Artificial Sequence
  chemically synthesized
accatcagtgccaatgtaca

SEQ ID NO: 17906 - DNA, 20 bp, Artificial Sequence
  chemically synthesized
agtgccaatgtacacagcca

SEQ ID NO: 17907 - DNA, 20 bp, Artificial Sequence
  chemically synthesized
gtgccaatgtacacagccat

SEQ ID NO: 17908 - DNA, 20 bp, Artificial Sequence
  chemically synthesized
tgccaatgtacacagccatg

SEQ ID NO: 17909 - DNA, 20 bp, Artificial Sequence
  chemically synthesized
tgtacacagccatggggccc

SEQ ID NO: 17910 - DNA, 20 bp, Artificial Sequence
  chemically synthesized
gtacacagccatggggccca

SEQ ID NO: 17911 - DNA, 20 bp, Artificial Sequence
  chemically synthesized
acagccatggggcccaagga

SEQ ID NO: 17912 - DNA, 20 bp, Artificial Sequence
  chemically synthesized
cagccatggggcccaaggac

SEQ ID NO: 17913 - DNA, 20 bp, Artificial Sequence
  chemically synthesized
gggcccaaggacaggaatgc

SEQ ID NO: 17914 - DNA, 20 bp, Artificial Sequence
  chemically synthesized
ggcccaaggacaggaatgct

SEQ ID NO: 17915 - DNA, 20 bp, Artificial Sequence
  chemically synthesized
gctaggcccaccaccaccac

SEQ ID NO: 17916 - DNA, 20 bp, Artificial Sequence
  chemically synthesized
ctaggcccaccaccaccact

SEQ ID NO: 17917 - DNA, 20 bp, Artificial Sequence
  chemically synthesized
taggcccaccaccaccactg

SEQ ID NO: 17918 - DNA, 20 bp, Artificial Sequence
  chemically synthesized
ccaccaccaccactggggcc

SEQ ID NO: 17919 - DNA, 20 bp, Artificial Sequence
  chemically synthesized
caccaccaccactggggcca

SEQ ID NO: 17920 - DNA, 20 bp, Artificial Sequence
  chemically synthesized
ccaccactggggccaaggac

SEQ ID NO: 17921 - DNA, 20 bp, Artificial Sequence
  chemically synthesized
ccacttgatattcttgtctc

SEQ ID NO: 17922 - DNA, 20 bp, Artificial Sequence
  chemically synthesized
ttcactaacaaatgcaccct

SEQ ID NO: 17923 - DNA, 20 bp, Artificial Sequence
  chemically synthesized
ctaagccactgaaaaaatca

SEQ ID NO: 17924 - DNA, 20 bp, Artificial Sequence
  chemically synthesized
acagacactgatgatactgt

SEQ ID NO: 17925 - DNA, 20 bp, Artificial Sequence
  chemically synthesized
gacactgatgatactgttgg

SEQ ID NO: 17926 - DNA, 20 bp, Artificial Sequence
  chemically synthesized
agctgaaaaaaaataatatg

SEQ ID NO: 17927 - DNA, 20 bp, Artificial Sequence
  chemically synthesized
actatgctgctgtatgcacc

SEQ ID NO: 17928 - DNA, 20 bp, Artificial Sequence
  chemically synthesized
gcacctagaaatcaaaatca

SEQ ID NO: 17929 - DNA, 20 bp, Artificial Sequence
  chemically synthesized
tgccctactcaatcaacacc

SEQ ID NO: 17930 - DNA, 20 bp, Artificial Sequence
  chemically synthesized
tcaacaccaagatacatctt

SEQ ID NO: 17931 - DNA, 20 bp, Artificial Sequence
  chemically synthesized
caagatacatcttcagaaaa

SEQ ID NO: 17932 - DNA, 20 bp, Artificial Sequence
  chemically synthesized
caaaaacaaatttacaaaac

SEQ ID NO: 17933 - DNA, 20 bp, Artificial Sequence
  chemically synthesized
aaacaaatttacaaaactgg

SEQ ID NO: 17934 - DNA, 20 bp, Artificial Sequence
  chemically synthesized
caaatttacaaaactggaag

SEQ ID NO: 17935 - DNA, 20 bp, Artificial Sequence
  chemically synthesized
ggaagcagcaatcattacac

SEQ ID NO: 17936 - DNA, 20 bp, Artificial Sequence
  chemically synthesized
agcaatcattacaccagatg

SEQ ID NO: 17937 - DNA, 20 bp, Artificial Sequence
  chemically synthesized
caatcattacaccagatgca

SEQ ID NO: 17938 - DNA, 20 bp, Artificial Sequence
  chemically synthesized
agatgcagagatatcaatgc

SEQ ID NO: 17939 - DNA, 20 bp, Artificial Sequence
  chemically synthesized
aagaacaaaataaacataaa

SEQ ID NO: 17940 - DNA, 20 bp, Artificial Sequence
  chemically synthesized
agaacaaaataaacataaaa

SEQ ID NO: 17941 - DNA, 20 bp, Artificial Sequence
  chemically synthesized
aaaataaacataaaaaggtg

SEQ ID NO: 17942 - DNA, 20 bp, Artificial Sequence
  chemically synthesized
gaagaaatatgacacttcca

SEQ ID NO: 17943 - DNA, 20 bp, Artificial Sequence
  chemically synthesized
aagaaatatgacacttccaa

SEQ ID NO: 17944 - DNA, 20 bp, Artificial Sequence
  chemically synthesized
aaaggaatttaataattctt

SEQ ID NO: 17945 - DNA, 20 bp, Artificial Sequence
  chemically synthesized
taataattcttcagcaacat

SEQ ID NO: 17946 - DNA, 20 bp, Artificial Sequence
  chemically synthesized
aattcttcagcaacataagc

SEQ ID NO: 17947 - DNA, 20 bp, Artificial Sequence
  chemically synthesized
tcttcagcaacataagccag

SEQ ID NO: 17948 - DNA, 20 bp, Artificial Sequence
  chemically synthesized
acataagccagtggaaaaaa

SEQ ID NO: 17949 - DNA, 20 bp, Artificial Sequence
  chemically synthesized
aaaagacatttataaaattc

SEQ ID NO: 17950 - DNA, 20 bp, Artificial Sequence
  chemically synthesized
atttataaaattctggaaaa

SEQ ID NO: 17951 - DNA, 20 bp, Artificial Sequence
  chemically synthesized
gaatccaaaatgttgatatt

SEQ ID NO: 17952 - DNA, 20 bp, Artificial Sequence
  chemically synthesized
aatccaaaatgttgatatta

SEQ ID NO: 17953 - DNA, 20 bp, Artificial Sequence
  chemically synthesized
ccaaaatgttgatattaagg

SEQ ID NO: 17954 - DNA, 20 bp, Artificial Sequence
  chemically synthesized
atgttgatattaaggaagct

SEQ ID NO: 17955 - DNA, 20 bp, Artificial Sequence
  chemically synthesized
tgatattaaggaagctcagt

SEQ ID NO: 17956 - DNA, 20 bp, Artificial Sequence
  chemically synthesized
aaggaagctcagtgagacac

SEQ ID NO: 17957 - DNA, 20 bp, Artificial Sequence
  chemically synthesized
ggaagctcagtgagacacaa

SEQ ID NO: 17958 - DNA, 20 bp, Artificial Sequence
  chemically synthesized
cagtgagacacaagagaact

SEQ ID NO: 17959 - DNA, 20 bp, Artificial Sequence
  chemically synthesized
gaactcagataaacaataaa

SEQ ID NO: 17960 - DNA, 20 bp, Artificial Sequence
  chemically synthesized
gataaacaataaaaagaaat

SEQ ID NO: 17961 - DNA, 20 bp, Artificial Sequence
  chemically synthesized
aagaaatcagaaaaacaatt

SEQ ID NO: 17962 - DNA, 20 bp, Artificial Sequence
  chemically synthesized
agaaatcagaaaaacaattc

SEQ ID NO: 17963 - DNA, 20 bp, Artificial Sequence
  chemically synthesized
aaacaattcaggatatgaat

SEQ ID NO: 17964 - DNA, 20 bp, Artificial Sequence
  chemically synthesized
tatgaatgagaaatttaccc

SEQ ID NO: 17965 - DNA, 20 bp, Artificial Sequence
  chemically synthesized
tgaatgagaaatttacccaa

SEQ ID NO: 17966 - DNA, 20 bp, Artificial Sequence
  chemically synthesized
tgagaaatttacccaagaga

SEQ ID NO: 17967 - DNA, 20 bp, Artificial Sequence
  chemically synthesized
acccaagagatagatacaac

SEQ ID NO: 17968 - DNA, 20 bp, Artificial Sequence
  chemically synthesized
tacaacaagaatgaaccaaa

SEQ ID NO: 17969 - DNA, 20 bp, Artificial Sequence
  chemically synthesized
aaacagaaattctgtaactg

SEQ ID NO: 17970 - DNA, 20 bp, Artificial Sequence
  chemically synthesized
acagaaattctgtaactgaa

SEQ ID NO: 17971 - DNA, 20 bp, Artificial Sequence
  chemically synthesized
gtaactgaagagtttattga

SEQ ID NO: 17972 - DNA, 20 bp, Artificial Sequence
  chemically synthesized
acattcaaaaacttcaacaa

SEQ ID NO: 17973 - DNA, 20 bp, Artificial Sequence
  chemically synthesized
caaaaacttcaacaatagat

SEQ ID NO: 17974 - DNA, 20 bp, Artificial Sequence
  chemically synthesized
cttcaacaatagatcagatc

SEQ ID NO: 17975 - DNA, 20 bp, Artificial Sequence
  chemically synthesized
caacaatagatcagatcaag

SEQ ID NO: 17976 - DNA, 20 bp, Artificial Sequence
  chemically synthesized
caatagatcagatcaagcag

SEQ ID NO: 17977 - DNA, 20 bp, Artificial Sequence
  chemically synthesized
atcaagcagaagaaaaattt

SEQ ID NO: 17978 - DNA, 20 bp, Artificial Sequence
  chemically synthesized
aagaaaaatttcagaacttg

SEQ ID NO: 17979 - DNA, 20 bp, Artificial Sequence
  chemically synthesized
aaaatttcagaacttgaaga

SEQ ID NO: 17980 - DNA, 20 bp, Artificial Sequence
  chemically synthesized
aaatttcagaacttgaagac

SEQ ID NO: 17981 - DNA, 20 bp, Artificial Sequence
  chemically synthesized
gaagacaggtcttttaaaat

SEQ ID NO: 17982 - DNA, 20 bp, Artificial Sequence
  chemically synthesized
acaggtcttttaaaattagc

SEQ ID NO: 17983 - DNA, 20 bp, Artificial Sequence
  chemically synthesized
aaaattagctggtcaaatga

SEQ ID NO: 17984 - DNA, 20 bp, Artificial Sequence
  chemically synthesized
ttagctggtcaaatgataga

SEQ ID NO: 17985 - DNA, 20 bp, Artificial Sequence
  chemically synthesized
tagctggtcaaatgatagaa

SEQ ID NO: 17986 - DNA, 20 bp, Artificial Sequence
  chemically synthesized
aatgatagaaaggaaaaaaa

SEQ ID NO: 17987 - DNA, 20 bp, Artificial Sequence
  chemically synthesized
ggaaaaaaaaagaatgaaca

SEQ ID NO: 17988 - DNA, 20 bp, Artificial Sequence
  chemically synthesized
acaaagtgtatgtgacatat

SEQ ID NO: 17989 - DNA, 20 bp, Artificial Sequence
  chemically synthesized
caaagtgtatgtgacatatg

SEQ ID NO: 17990 - DNA, 20 bp, Artificial Sequence
  chemically synthesized
gtgacatatgaggcactata

SEQ ID NO: 17991 - DNA, 20 bp, Artificial Sequence
  chemically synthesized
tgaacaaatattcaaatttg

SEQ ID NO: 17992 - DNA, 20 bp, Artificial Sequence
  chemically synthesized
tattcaaatttgcagtttcc

SEQ ID NO: 17993 - DNA, 20 bp, Artificial Sequence
  chemically synthesized
tcaaatttgcagtttcccag

SEQ ID NO: 17994 - DNA, 20 bp, Artificial Sequence
  chemically synthesized
caaatttgcagtttcccaga

SEQ ID NO: 17995 - DNA, 20 bp, Artificial Sequence
  chemically synthesized
ttgcagtttcccagaaggta

SEQ ID NO: 17996 - DNA, 20 bp, Artificial Sequence
  chemically synthesized
gcagtttcccagaaggtaaa

SEQ ID NO: 17997 - DNA, 20 bp, Artificial Sequence
  chemically synthesized
agaaggtaaagagaacatga

SEQ ID NO: 17998 - DNA, 20 bp, Artificial Sequence
  chemically synthesized
gaaggtaaagagaacatgaa

SEQ ID NO: 17999 - DNA, 20 bp, Artificial Sequence
  chemically synthesized
taaagagaacatgaaaggtg

SEQ ID NO: 18000 - DNA, 20 bp, Artificial Sequence
  chemically synthesized
aaagagaacatgaaaggtgt

SEQ ID NO: 18001 - DNA, 20 bp, Artificial Sequence
  chemically synthesized
aaacctacgtaacaacacaa

SEQ ID NO: 18002 - DNA, 20 bp, Artificial Sequence
  chemically synthesized
acaatagctgaaaacttgtc

SEQ ID NO: 18003 - DNA, 20 bp, Artificial Sequence
  chemically synthesized
agctgaaaacttgtcaagtc

SEQ ID NO: 18004 - DNA, 20 bp, Artificial Sequence
  chemically synthesized
gaaaacttgtcaagtctagc

SEQ ID NO: 18005 - DNA, 20 bp, Artificial Sequence
  chemically synthesized
gtcaagtctagcaagaaatg

SEQ ID NO: 18006 - DNA, 20 bp, Artificial Sequence
  chemically synthesized
tagcaagaaatgtagacatc

SEQ ID NO: 18007 - DNA, 20 bp, Artificial Sequence
  chemically synthesized
acatccagacaaatgaaaat

SEQ ID NO: 18008 - DNA, 20 bp, Artificial Sequence
  chemically synthesized
cccaaataatataatgcaaa

SEQ ID NO: 18009 - DNA, 20 bp, Artificial Sequence
  chemically synthesized
atgcaaaaagctcttctcca

SEQ ID NO: 18010 - DNA, 20 bp, Artificial Sequence
  chemically synthesized
ctcttctccacagcacatta

SEQ ID NO: 18011 - DNA, 20 bp, Artificial Sequence
  chemically synthesized
cattatagtcaaactgtcaa

SEQ ID NO: 18012 - DNA, 20 bp, Artificial Sequence
  chemically synthesized
agtcaaactgtcaaaagcca

SEQ ID NO: 18013 - DNA, 20 bp, Artificial Sequence
  chemically synthesized
tcaaactgtcaaaagccaaa

SEQ ID NO: 18014 - DNA, 20 bp, Artificial Sequence
  chemically synthesized
actgtcaaaagccaaagagt

SEQ ID NO: 18015 - DNA, 20 bp, Artificial Sequence
  chemically synthesized
aaagagtaagaactctaaaa

SEQ ID NO: 18016 - DNA, 20 bp, Artificial Sequence
  chemically synthesized
agtaagaactctaaaacagc

SEQ ID NO: 18017 - DNA, 20 bp, Artificial Sequence
  chemically synthesized
aaaacagcaagcaaaatgtc

SEQ ID NO: 18018 - DNA, 20 bp, Artificial Sequence
  chemically synthesized
caaaatgtctagtcacttat

SEQ ID NO: 18019 - DNA, 20 bp, Artificial Sequence
  chemically synthesized
aaaatgtctagtcacttata

SEQ ID NO: 18020 - DNA, 20 bp, Artificial Sequence
  chemically synthesized
aaatgtctagtcacttataa

SEQ ID NO: 18021 - DNA, 20 bp, Artificial Sequence
  chemically synthesized
acttataagggaacttccac

SEQ ID NO: 18022 - DNA, 20 bp, Artificial Sequence
  chemically synthesized
gggaacttccacaagattaa

SEQ ID NO: 18023 - DNA, 20 bp, Artificial Sequence
  chemically synthesized
ccacaagattaacagattaa

SEQ ID NO: 18024 - DNA, 20 bp, Artificial Sequence
  chemically synthesized
caagattaacagattaacag

SEQ ID NO: 18025 - DNA, 20 bp, Artificial Sequence
  chemically synthesized
cagattaacagcagatttct

SEQ ID NO: 18026 - DNA, 20 bp, Artificial Sequence
  chemically synthesized
attaacagcagatttctcag

SEQ ID NO: 18027 - DNA, 20 bp, Artificial Sequence
  chemically synthesized
atttctcagcagaaacctca

SEQ ID NO: 18028 - DNA, 20 bp, Artificial Sequence
  chemically synthesized
tttctcagcagaaacctcac

SEQ ID NO: 18029 - DNA, 20 bp, Artificial Sequence
  chemically synthesized
tcagcagaaacctcacaggc

SEQ ID NO: 18030 - DNA, 20 bp, Artificial Sequence
  chemically synthesized
cagcagaaacctcacaggcc

SEQ ID NO: 18031 - DNA, 20 bp, Artificial Sequence
  chemically synthesized
gcagaaacctcacaggccag

SEQ ID NO: 18032 - DNA, 20 bp, Artificial Sequence
  chemically synthesized
gaaacctcacaggccaggag

SEQ ID NO: 18033 - DNA, 20 bp, Artificial Sequence
  chemically synthesized
cctcacaggccaggagaaga

SEQ ID NO: 18034 - DNA, 20 bp, Artificial Sequence
  chemically synthesized
ctcacaggccaggagaagat

SEQ ID NO: 18035 - DNA, 20 bp, Artificial Sequence
  chemically synthesized
atgggatgatatattcaaaa

SEQ ID NO: 18036 - DNA, 20 bp, Artificial Sequence
  chemically synthesized
tgatatattcaaaatagtga

SEQ ID NO: 18037 - DNA, 20 bp, Artificial Sequence
  chemically synthesized
tgaaagaaaaaaatgacacc

SEQ ID NO: 18038 - DNA, 20 bp, Artificial Sequence
  chemically synthesized
gaaagaaaaaaatgacacca

SEQ ID NO: 18039 - DNA, 20 bp, Artificial Sequence
  chemically synthesized
gacaccaaggatgttatacc

SEQ ID NO: 18040 - DNA, 20 bp, Artificial Sequence
  chemically synthesized
aacattgttcttcaaaaatg

SEQ ID NO: 18041 - DNA, 20 bp, Artificial Sequence
  chemically synthesized
acattgttcttcaaaaatga

SEQ ID NO: 18042 - DNA, 20 bp, Artificial Sequence
  chemically synthesized
aggataaataaaatcttttc

SEQ ID NO: 18043 - DNA, 20 bp, Artificial Sequence
  chemically synthesized
ggataaataaaatcttttct

SEQ ID NO: 18044 - DNA, 20 bp, Artificial Sequence
  chemically synthesized
aaataaaatcttttctgggc

SEQ ID NO: 18045 - DNA, 20 bp, Artificial Sequence
  chemically synthesized
ttctgggcaagaaaaatttg

SEQ ID NO: 18046 - DNA, 20 bp, Artificial Sequence
  chemically synthesized
tctgggcaagaaaaatttga

SEQ ID NO: 18047 - DNA, 20 bp, Artificial Sequence
  chemically synthesized
ttgaaggaattcactatcac

SEQ ID NO: 18048 - DNA, 20 bp, Artificial Sequence
  chemically synthesized
ggaattcactatcactagac

SEQ ID NO: 18049 - DNA, 20 bp, Artificial Sequence
  chemically synthesized
tatcactagactggctttac

SEQ ID NO: 18050 - DNA, 20 bp, Artificial Sequence
  chemically synthesized
tggctttacaagaaatattt

SEQ ID NO: 18051 - DNA, 20 bp, Artificial Sequence
  chemically synthesized
ggctttacaagaaatattta

SEQ ID NO: 18052 - DNA, 20 bp, Artificial Sequence
  chemically synthesized
gctttacaagaaatatttaa

SEQ ID NO: 18053 - DNA, 20 bp, Artificial Sequence
  chemically synthesized
tttacaagaaatatttaagg

SEQ ID NO: 18054 - DNA, 20 bp, Artificial Sequence
  chemically synthesized
taagggagtcctacacatga

SEQ ID NO: 18055 - DNA, 20 bp, Artificial Sequence
  chemically synthesized
agtcctacacatgaaagtga

SEQ ID NO: 18056 - DNA, 20 bp, Artificial Sequence
  chemically synthesized
gtcctacacatgaaagtgac

SEQ ID NO: 18057 - DNA, 20 bp, Artificial Sequence
  chemically synthesized
gacaggacactgccattatg

SEQ ID NO: 18058 - DNA, 20 bp, Artificial Sequence
  chemically synthesized
tgccattatgaagacacaca

SEQ ID NO: 18059 - DNA, 20 bp, Artificial Sequence
  chemically synthesized
gccattatgaagacacacaa

SEQ ID NO: 18060 - DNA, 20 bp, Artificial Sequence
  chemically synthesized
cacaaaggtatacaactaac

SEQ ID NO: 18061 - DNA, 20 bp, Artificial Sequence
  chemically synthesized
aaaggtatacaactaactgg

SEQ ID NO: 18062 - DNA, 20 bp, Artificial Sequence
  chemically synthesized
aggtatacaactaactggta

SEQ ID NO: 18063 - DNA, 20 bp, Artificial Sequence
  chemically synthesized
ggtagagcaaaacacaaata

SEQ ID NO: 18064 - DNA, 20 bp, Artificial Sequence
  chemically synthesized
agagcaaaacacaaataaag

SEQ ID NO: 18065 - DNA, 20 bp, Artificial Sequence
  chemically synthesized
agcaaaacacaaataaagaa

SEQ ID NO: 18066 - DNA, 20 bp, Artificial Sequence
  chemically synthesized
aaacacaaataaagaagaga

SEQ ID NO: 18067 - DNA, 20 bp, Artificial Sequence
  chemically synthesized
gaactcaaacgttaccacta

SEQ ID NO: 18068 - DNA, 20 bp, Artificial Sequence
  chemically synthesized
aaaccacaatcataaataat

SEQ ID NO: 18069 - DNA, 20 bp, Artificial Sequence
  chemically synthesized
cacaatcataaataataaga

SEQ ID NO: 18070 - DNA, 20 bp, Artificial Sequence
  chemically synthesized
atcataaataataagaaaga

SEQ ID NO: 18071 - DNA, 20 bp, Artificial Sequence
  chemically synthesized
taaataataagaaagaaaga

SEQ ID NO: 18072 - DNA, 20 bp, Artificial Sequence
  chemically synthesized
taataagaaagaaagaaaga

SEQ ID NO: 18073 - DNA, 20 bp, Artificial Sequence
  chemically synthesized
aagaaagaaagaaagaaaga

SEQ ID NO: 18074 - DNA, 20 bp, Artificial Sequence
  chemically synthesized
gaaagaaagaaagaaagaaa

SEQ ID NO: 18075 - DNA, 20 bp, Artificial Sequence
  chemically synthesized
aagaaagaaagaaagaaaga

SEQ ID NO: 18076 - DNA, 20 bp, Artificial Sequence
  chemically synthesized
gaaagaaagaaagaaagaga

SEQ ID NO: 18077 - DNA, 20 bp, Artificial Sequence
  chemically synthesized
aagaaagaaagaaagagaga

SEQ ID NO: 18078 - DNA, 20 bp, Artificial Sequence
  chemically synthesized
gaaagaaagaaagagagaga

SEQ ID NO: 18079 - DNA, 20 bp, Artificial Sequence
  chemically synthesized
aagaaagaaagagagagaga

SEQ ID NO: 18080 - DNA, 20 bp, Artificial Sequence
  chemically synthesized
gaaagaaagagagagagaga

SEQ ID NO: 18081 - DNA, 20 bp, Artificial Sequence
  chemically synthesized
gagagagagagagagaatga

SEQ ID NO: 18082 - DNA, 20 bp, Artificial Sequence
  chemically synthesized
gagagagagagaatgaaaga

SEQ ID NO: 18083 - DNA, 20 bp, Artificial Sequence
  chemically synthesized
agagagaatgaaagaaagaa

SEQ ID NO: 18084 - DNA, 20 bp, Artificial Sequence
  chemically synthesized
gagagaatgaaagaaagaaa

SEQ ID NO: 18085 - DNA, 20 bp, Artificial Sequence
  chemically synthesized
agaatgaaagaaagaaaagg

SEQ ID NO: 18086 - DNA, 20 bp, Artificial Sequence
  chemically synthesized
gaatgaaagaaagaaaagga

SEQ ID NO: 18087 - DNA, 20 bp, Artificial Sequence
  chemically synthesized
tgaaagaaagaaaaggaagg

SEQ ID NO: 18088 - DNA, 20 bp, Artificial Sequence
  chemically synthesized
gaaagaaagaaaaggaagga

SEQ ID NO: 18089 - DNA, 20 bp, Artificial Sequence
  chemically synthesized
agaaagaaaaggaaggaagg

SEQ ID NO: 18090 - DNA, 20 bp, Artificial Sequence
  chemically synthesized
taaaaaaaaaacaaaacaac

SEQ ID NO: 18091 - DNA, 20 bp, Artificial Sequence
  chemically synthesized
aaaaaaaaaacaaaacaacc

SEQ ID NO: 18092 - DNA, 20 bp, Artificial Sequence
  chemically synthesized
ccaggaatcaattaacaaaa

SEQ ID NO: 18093 - DNA, 20 bp, Artificial Sequence
  chemically synthesized
ggaatcaattaacaaaatgg

SEQ ID NO: 18094 - DNA, 20 bp, Artificial Sequence
  chemically synthesized
gaatcaattaacaaaatggc

SEQ ID NO: 18095 - DNA, 20 bp, Artificial Sequence
  chemically synthesized
attaacaaaatggcaggaat

SEQ ID NO: 18096 - DNA, 20 bp, Artificial Sequence
  chemically synthesized
aagctctcacatgtcaataa

SEQ ID NO: 18097 - DNA, 20 bp, Artificial Sequence
  chemically synthesized
ataatagccttgcatgtaaa

SEQ ID NO: 18098 - DNA, 20 bp, Artificial Sequence
  chemically synthesized
tggattaaattgttacttga

SEQ ID NO: 18099 - DNA, 20 bp, Artificial Sequence
  chemically synthesized
aaattgttacttgaaagata

SEQ ID NO: 18100 - DNA, 20 bp, Artificial Sequence
  chemically synthesized
gttacttgaaagatatagac

SEQ ID NO: 18101 - DNA, 20 bp, Artificial Sequence
  chemically synthesized
aaagatatagactggctaaa

SEQ ID NO: 18102 - DNA, 20 bp, Artificial Sequence
  chemically synthesized
tttaaaacaaaaatatgacc

SEQ ID NO: 18103 - DNA, 20 bp, Artificial Sequence
  chemically synthesized
caaaaatatgacccagttgt

SEQ ID NO: 18104 - DNA, 20 bp, Artificial Sequence
  chemically synthesized
cccagttgtaagctgcctat

SEQ ID NO: 18105 - DNA, 20 bp, Artificial Sequence
  chemically synthesized
agaaacttatctcacttgta

SEQ ID NO: 18106 - DNA, 20 bp, Artificial Sequence
  chemically synthesized
ctcacttgtaaagataaata

SEQ ID NO: 18107 - DNA, 20 bp, Artificial Sequence
  chemically synthesized
taaagataaatatagactga

SEQ ID NO: 18108 - DNA, 20 bp, Artificial Sequence
  chemically synthesized
aaatatagactgaaagtaaa

SEQ ID NO: 18109 - DNA, 20 bp, Artificial Sequence
  chemically synthesized
gactgaaagtaaaaagatga

SEQ ID NO: 18110 - DNA, 20 bp, Artificial Sequence
  chemically synthesized
gatgaaagatcttccataca

SEQ ID NO: 18111 - DNA, 20 bp, Artificial Sequence
  chemically synthesized
tgaaagatcttccatacaaa

SEQ ID NO: 18112 - DNA, 20 bp, Artificial Sequence
  chemically synthesized
tacaaagagaaaccaaaaat

SEQ ID NO: 18113 - DNA, 20 bp, Artificial Sequence
  chemically synthesized
gagaaaccaaaaatgagcaa

SEQ ID NO: 18114 - DNA, 20 bp, Artificial Sequence
  chemically synthesized
aaaccaaaaatgagcaaaag

SEQ ID NO: 18115 - DNA, 20 bp, Artificial Sequence
  chemically synthesized
aaaagtagttatacctataa

SEQ ID NO: 18116 - DNA, 20 bp, Artificial Sequence
  chemically synthesized
gactttaaataaaaaacact

SEQ ID NO: 18117 - DNA, 20 bp, Artificial Sequence
  chemically synthesized
ctttaaataaaaaacactaa

SEQ ID NO: 18118 - DNA, 20 bp, Artificial Sequence
  chemically synthesized
taaaaaacactaagagacaa

SEQ ID NO: 18119 - DNA, 20 bp, Artificial Sequence
  chemically synthesized
aagtcattacataatgataa

SEQ ID NO: 18120 - DNA, 20 bp, Artificial Sequence
  chemically synthesized
agtcattacataatgataaa

SEQ ID NO: 18121 - DNA, 20 bp, Artificial Sequence
  chemically synthesized
taatgataaaaggaacaatt

SEQ ID NO: 18122 - DNA, 20 bp, Artificial Sequence
  chemically synthesized
gataaaaggaacaattcagc

SEQ ID NO: 18123 - DNA, 20 bp, Artificial Sequence
  chemically synthesized
taaaaggaacaattcagcaa

SEQ ID NO: 18124 - DNA, 20 bp, Artificial Sequence
  chemically synthesized
taaacattcacactcaacac

SEQ ID NO: 18125 - DNA, 20 bp, Artificial Sequence
  chemically synthesized
aacattcacactcaacacca

SEQ ID NO: 18126 - DNA, 20 bp, Artificial Sequence
  chemically synthesized
acactcaacaccagagcatc

SEQ ID NO: 18127 - DNA, 20 bp, Artificial Sequence
  chemically synthesized
ccagagcatccagatatgta

SEQ ID NO: 18128 - DNA, 20 bp, Artificial Sequence
  chemically synthesized
atatgtaaagcaaatgttat

SEQ ID NO: 18129 - DNA, 20 bp, Artificial Sequence
  chemically synthesized
agcaaatgttattagatata

SEQ ID NO: 18130 - DNA, 20 bp, Artificial Sequence
  chemically synthesized
gcaaatgttattagatataa

SEQ ID NO: 18131 - DNA, 20 bp, Artificial Sequence
  chemically synthesized
caaatgttattagatataaa

SEQ ID NO: 18132 - DNA, 20 bp, Artificial Sequence
  chemically synthesized
attagatataaagggtgaaa

SEQ ID NO: 18133 - DNA, 20 bp, Artificial Sequence
  chemically synthesized
aatagaatccaatacaataa

SEQ ID NO: 18134 - DNA, 20 bp, Artificial Sequence
  chemically synthesized
gaatccaatacaataatagt

SEQ ID NO: 18135 - DNA, 20 bp, Artificial Sequence
  chemically synthesized
aatccaatacaataatagtt

SEQ ID NO: 18136 - DNA, 20 bp, Artificial Sequence
  chemically synthesized
atccaatacaataatagttg

SEQ ID NO: 18137 - DNA, 20 bp, Artificial Sequence
  chemically synthesized
ggatttcaacattctaatct

SEQ ID NO: 18138 - DNA, 20 bp, Artificial Sequence
  chemically synthesized
caacattctaatctcagcat

SEQ ID NO: 18139 - DNA, 20 bp, Artificial Sequence
  chemically synthesized
attctaatctcagcatcaga

SEQ ID NO: 18140 - DNA, 20 bp, Artificial Sequence
  chemically synthesized
tcagcatcagatagatcatc

SEQ ID NO: 18141 - DNA, 20 bp, Artificial Sequence
  chemically synthesized
catcagatagatcatctaga

SEQ ID NO: 18142 - DNA, 20 bp, Artificial Sequence
  chemically synthesized
atctagacagaaaattaaca

SEQ ID NO: 18143 - DNA, 20 bp, Artificial Sequence
  chemically synthesized
gaaaattaacaaagaaacat

SEQ ID NO: 18144 - DNA, 20 bp, Artificial Sequence
  chemically synthesized
attggatttaaacttgactt

SEQ ID NO: 18145 - DNA, 20 bp, Artificial Sequence
  chemically synthesized
aaacttgactttagaccaaa

SEQ ID NO: 18146 - DNA, 20 bp, Artificial Sequence
  chemically synthesized
ttacacaatatttcatccaa

SEQ ID NO: 18147 - DNA, 20 bp, Artificial Sequence
  chemically synthesized
aatatttcatccaacagcta

SEQ ID NO: 18148 - DNA, 20 bp, Artificial Sequence
  chemically synthesized
acagaatatatttatctcat

SEQ ID NO: 18149 - DNA, 20 bp, Artificial Sequence
  chemically synthesized
tcagcacatgacgcattccc

SEQ ID NO: 18150 - DNA, 20 bp, Artificial Sequence
  chemically synthesized
cagcacatgacgcattcccc

SEQ ID NO: 18151 - DNA, 20 bp, Artificial Sequence
  chemically synthesized
ccccaggatacaccatatgt

SEQ ID NO: 18152 - DNA, 20 bp, Artificial Sequence
  chemically synthesized
caccatatgttagaacacaa

SEQ ID NO: 18153 - DNA, 20 bp, Artificial Sequence
  chemically synthesized
catatgttagaacacaaaag

SEQ ID NO: 18154 - DNA, 20 bp, Artificial Sequence
  chemically synthesized
gaaatatttgaaatcatatt

SEQ ID NO: 18155 - DNA, 20 bp, Artificial Sequence
  chemically synthesized
aatcatattaagcatcttct

SEQ ID NO: 18156 - DNA, 20 bp, Artificial Sequence
  chemically synthesized
agcatcttctcagaccacaa

SEQ ID NO: 18157 - DNA, 20 bp, Artificial Sequence
  chemically synthesized
agaccacaatggaataaaac

SEQ ID NO: 18158 - DNA, 20 bp, Artificial Sequence
  chemically synthesized
taaaactagaaatcaataac

SEQ ID NO: 18159 - DNA, 20 bp, Artificial Sequence
  chemically synthesized
ttaaaacctatacaaataca

SEQ ID NO: 18160 - DNA, 20 bp, Artificial Sequence
  chemically synthesized
tcctgaatgaacgttatgtc

SEQ ID NO: 18161 - DNA, 20 bp, Artificial Sequence
  chemically synthesized
tgaatgaacgttatgtcaag

SEQ ID NO: 18162 - DNA, 20 bp, Artificial Sequence
  chemically synthesized
gttatgtcaagaagaaaatt

SEQ ID NO: 18163 - DNA, 20 bp, Artificial Sequence
  chemically synthesized
atgtcaagaagaaaattaag

SEQ ID NO: 18164 - DNA, 20 bp, Artificial Sequence
  chemically synthesized
tgtcaagaagaaaattaaga

SEQ ID NO: 18165 - DNA, 20 bp, Artificial Sequence
  chemically synthesized
atgaaaattgaaatacaaca

SEQ ID NO: 18166 - DNA, 20 bp, Artificial Sequence
  chemically synthesized
tgaaaattgaaatacaacat

SEQ ID NO: 18167 - DNA, 20 bp, Artificial Sequence
  chemically synthesized
attgaaatacaacataggaa

SEQ ID NO: 18168 - DNA, 20 bp, Artificial Sequence
  chemically synthesized
atacaacataggaaaagcca

SEQ ID NO: 18169 - DNA, 20 bp, Artificial Sequence
  chemically synthesized
tacaacataggaaaagccat

SEQ ID NO: 18170 - DNA, 20 bp, Artificial Sequence
  chemically synthesized
ataggaaaagccatgggata

SEQ ID NO: 18171 - DNA, 20 bp, Artificial Sequence
  chemically synthesized
aaagccatgggatacagcaa

SEQ ID NO: 18172 - DNA, 20 bp, Artificial Sequence
  chemically synthesized
gccatgggatacagcaaaag

SEQ ID NO: 18173 - DNA, 20 bp, Artificial Sequence
  chemically synthesized
gatacagcaaaagcagtgct

SEQ ID NO: 18174 - DNA, 20 bp, Artificial Sequence
  chemically synthesized
tacagcaaaagcagtgctaa

SEQ ID NO: 18175 - DNA, 20 bp, Artificial Sequence
  chemically synthesized
cagcaaaagcagtgctaaga

SEQ ID NO: 18176 - DNA, 20 bp, Artificial Sequence
  chemically synthesized
caaaagcagtgctaagagag

SEQ ID NO: 18177 - DNA, 20 bp, Artificial Sequence
  chemically synthesized
aaacacttaaattaaaaaca

SEQ ID NO: 18178 - DNA, 20 bp, Artificial Sequence
  chemically synthesized
acttaaattaaaaacataga

SEQ ID NO: 18179 - DNA, 20 bp, Artificial Sequence
  chemically synthesized
atctaatcatgtacctcaac

SEQ ID NO: 18180 - DNA, 20 bp, Artificial Sequence
  chemically synthesized
aatcatgtacctcaacaagc

SEQ ID NO: 18181 - DNA, 20 bp, Artificial Sequence
  chemically synthesized
tgtacctcaacaagctagaa

SEQ ID NO: 18182 - DNA, 20 bp, Artificial Sequence
  chemically synthesized
cctcaacaagctagaaaagc

SEQ ID NO: 18183 - DNA, 20 bp, Artificial Sequence
  chemically synthesized
gcaagaacaaaacccaaaac

SEQ ID NO: 18184 - DNA, 20 bp, Artificial Sequence
  chemically synthesized
agaacaaaacccaaaactag

SEQ ID NO: 18185 - DNA, 20 bp, Artificial Sequence
  chemically synthesized
acaaaacccaaaactagcag

SEQ ID NO: 18186 - DNA, 20 bp, Artificial Sequence
  chemically synthesized
caaaacccaaaactagcaga

SEQ ID NO: 18187 - DNA, 20 bp, Artificial Sequence
  chemically synthesized
acccaaaactagcagaagga

SEQ ID NO: 18188 - DNA, 20 bp, Artificial Sequence
  chemically synthesized
gcagaaggaaagaaaaaatg

SEQ ID NO: 18189 - DNA, 20 bp, Artificial Sequence
  chemically synthesized
aggaaagaaaaaatgaagaa

SEQ ID NO: 18190 - DNA, 20 bp, Artificial Sequence
  chemically synthesized
aaagaaaaaatgaagaacag

SEQ ID NO: 18191 - DNA, 20 bp, Artificial Sequence
  chemically synthesized
aacagaagaacttaatgaaa

SEQ ID NO: 18192 - DNA, 20 bp, Artificial Sequence
  chemically synthesized
cagaagaacttaatgaaata

SEQ ID NO: 18193 - DNA, 20 bp, Artificial Sequence
  chemically synthesized
aaatagagaaaaacaacaac

SEQ ID NO: 18194 - DNA, 20 bp, Artificial Sequence
  chemically synthesized
aatagagaaaaacaacaaca

SEQ ID NO: 18195 - DNA, 20 bp, Artificial Sequence
  chemically synthesized
atagagaaaaacaacaacaa

SEQ ID NO: 18196 - DNA, 20 bp, Artificial Sequence
  chemically synthesized
gaaaaacaacaacaagggat

SEQ ID NO: 18197 - DNA, 20 bp, Artificial Sequence
  chemically synthesized
caagggattagcaaaatgaa

SEQ ID NO: 18198 - DNA, 20 bp, Artificial Sequence
  chemically synthesized
tgaaaagttgttatttaaaa

SEQ ID NO: 18199 - DNA, 20 bp, Artificial Sequence
  chemically synthesized
gttatttaaaaaagataaaa

SEQ ID NO: 18200 - DNA, 20 bp, Artificial Sequence
  chemically synthesized
taaaaaagataaaatggata

SEQ ID NO: 18201 - DNA, 20 bp, Artificial Sequence
  chemically synthesized
agataaaatggatatagctc

SEQ ID NO: 18202 - DNA, 20 bp, Artificial Sequence
  chemically synthesized
aaaatggatatagctctagc

SEQ ID NO: 18203 - DNA, 20 bp, Artificial Sequence
  chemically synthesized
tagctctagctagactaacc

SEQ ID NO: 18204 - DNA, 20 bp, Artificial Sequence
  chemically synthesized
tagctagactaaccaagaaa

SEQ ID NO: 18205 - DNA, 20 bp, Artificial Sequence
  chemically synthesized
gctagactaaccaagaaaaa

SEQ ID NO: 18206 - DNA, 20 bp, Artificial Sequence
  chemically synthesized
agactaaccaagaaaaagag

SEQ ID NO: 18207 - DNA, 20 bp, Artificial Sequence
  chemically synthesized
actaaccaagaaaaagagaa

SEQ ID NO: 18208 - DNA, 20 bp, Artificial Sequence
  chemically synthesized
aaagagaagagactgaaata

SEQ ID NO: 18209 - DNA, 20 bp, Artificial Sequence
  chemically synthesized
gagactgaaataaagaaaat

SEQ ID NO: 18210 - DNA, 20 bp, Artificial Sequence
  chemically synthesized
aaagaaaatcagaaataaaa

SEQ ID NO: 18211 - DNA, 20 bp, Artificial Sequence
  chemically synthesized
atatattacaaccgatacca

SEQ ID NO: 18212 - DNA, 20 bp, Artificial Sequence
  chemically synthesized
tacaaccgataccacagaaa

SEQ ID NO: 18213 - DNA, 20 bp, Artificial Sequence
  chemically synthesized
ccgataccacagaaatagaa

SEQ ID NO: 18214 - DNA, 20 bp, Artificial Sequence
  chemically synthesized
acagaaatagaaaagattat

SEQ ID NO: 18215 - DNA, 20 bp, Artificial Sequence
  chemically synthesized
agaaatagaaaagattatca

SEQ ID NO: 18216 - DNA, 20 bp, Artificial Sequence
  chemically synthesized
cactaaaaaactgaaaaatc

SEQ ID NO: 18217 - DNA, 20 bp, Artificial Sequence
  chemically synthesized
ctaaaaaactgaaaaatcta

SEQ ID NO: 18218 - DNA, 20 bp, Artificial Sequence
  chemically synthesized
taaaaaactgaaaaatctag

SEQ ID NO: 18219 - DNA, 20 bp, Artificial Sequence
  chemically synthesized
agaggaaattaataaatttc

SEQ ID NO: 18220 - DNA, 20 bp, Artificial Sequence
  chemically synthesized
ctggacacataccacctacc

SEQ ID NO: 18221 - DNA, 20 bp, Artificial Sequence
  chemically synthesized
ccacctaccaagattgaatt

SEQ ID NO: 18222 - DNA, 20 bp, Artificial Sequence
  chemically synthesized
ctaccaagattgaattaaga

SEQ ID NO: 18223 - DNA, 20 bp, Artificial Sequence
  chemically synthesized
aagattgaattaagaaagaa

SEQ ID NO: 18224 - DNA, 20 bp, Artificial Sequence
  chemically synthesized
gaaagaatagaaaacctgaa

SEQ ID NO: 18225 - DNA, 20 bp, Artificial Sequence
  chemically synthesized
aatagaaaacctgaacagac

SEQ ID NO: 18226 - DNA, 20 bp, Artificial Sequence
  chemically synthesized
aatgaataatgaaattgaat

SEQ ID NO: 18227 - DNA, 20 bp, Artificial Sequence
  chemically synthesized
gaataatgaaattgaatcag

SEQ ID NO: 18228 - DNA, 20 bp, Artificial Sequence
  chemically synthesized
gaaattgaatcagtagtaaa

SEQ ID NO: 18229 - DNA, 20 bp, Artificial Sequence
  chemically synthesized
tagtaaaaagtctcccaaaa

SEQ ID NO: 18230 - DNA, 20 bp, Artificial Sequence
  chemically synthesized
ctcccaaaaaagaaaatttc

SEQ ID NO: 18231 - DNA, 20 bp, Artificial Sequence
  chemically synthesized
aaaaaagaaaatttcaagac

SEQ ID NO: 18232 - DNA, 20 bp, Artificial Sequence
  chemically synthesized
aagaaaatttcaagaccaga

SEQ ID NO: 18233 - DNA, 20 bp, Artificial Sequence
  chemically synthesized
caaattttaccaaactttca

SEQ ID NO: 18234 - DNA, 20 bp, Artificial Sequence
  chemically synthesized
aactttcaaagaaaactaac

SEQ ID NO: 18235 - DNA, 20 bp, Artificial Sequence
  chemically synthesized
aaattcttttaaaaattaaa

SEQ ID NO: 18236 - DNA, 20 bp, Artificial Sequence
  chemically synthesized
aattcttttaaaaattaaac

SEQ ID NO: 18237 - DNA, 20 bp, Artificial Sequence
  chemically synthesized
tcttttaaaaattaaacagg

SEQ ID NO: 18238 - DNA, 20 bp, Artificial Sequence
  chemically synthesized
cttttaaaaattaaacagga

SEQ ID NO: 18239 - DNA, 20 bp, Artificial Sequence
  chemically synthesized
ttctccctaactcattctct

SEQ ID NO: 18240 - DNA, 20 bp, Artificial Sequence
  chemically synthesized
tctccctaactcattctctg

SEQ ID NO: 18241 - DNA, 20 bp, Artificial Sequence
  chemically synthesized
cctaactcattctctgaggc

SEQ ID NO: 18242 - DNA, 20 bp, Artificial Sequence
  chemically synthesized
tattatcctgattccataac

SEQ ID NO: 18243 - DNA, 20 bp, Artificial Sequence
  chemically synthesized
tcctgattccataaccagac

SEQ ID NO: 18244 - DNA, 20 bp, Artificial Sequence
  chemically synthesized
cctgattccataaccagaca

SEQ ID NO: 18245 - DNA, 20 bp, Artificial Sequence
  chemically synthesized
ccataaccagacaaggatgc

SEQ ID NO: 18246 - DNA, 20 bp, Artificial Sequence
  chemically synthesized
tgcaagtaaaaataaaactg

SEQ ID NO: 18247 - DNA, 20 bp, Artificial Sequence
  chemically synthesized
gcaagtaaaaataaaactgc

SEQ ID NO: 18248 - DNA, 20 bp, Artificial Sequence
  chemically synthesized
ctgcaggtcaatatccctga

SEQ ID NO: 18249 - DNA, 20 bp, Artificial Sequence
  chemically synthesized
tcaatatccctgatggaaca

SEQ ID NO: 18250 - DNA, 20 bp, Artificial Sequence
  chemically synthesized
caatatccctgatggaacat

SEQ ID NO: 18251 - DNA, 20 bp, Artificial Sequence
  chemically synthesized
gaaaatcctcaacaaaatac

SEQ ID NO: 18252 - DNA, 20 bp, Artificial Sequence
  chemically synthesized
tactagcaaactgaatccaa

SEQ ID NO: 18253 - DNA, 20 bp, Artificial Sequence
  chemically synthesized
gaatccaacagtacatccaa

SEQ ID NO: 18254 - DNA, 20 bp, Artificial Sequence
  chemically synthesized
aaagataatacaccatgatc

SEQ ID NO: 18255 - DNA, 20 bp, Artificial Sequence
  chemically synthesized
gataatacaccatgatcaag

SEQ ID NO: 18256 - DNA, 20 bp, Artificial Sequence
  chemically synthesized
ataatacaccatgatcaagt

SEQ ID NO: 18257 - DNA, 20 bp, Artificial Sequence
  chemically synthesized
tgatcaagtgggatttatac

SEQ ID NO: 18258 - DNA, 20 bp, Artificial Sequence
  chemically synthesized
gatcaagtgggatttatact

SEQ ID NO: 18259 - DNA, 20 bp, Artificial Sequence
  chemically synthesized
atcaagtgggatttatacta

SEQ ID NO: 18260 - DNA, 20 bp, Artificial Sequence
  chemically synthesized
gggatttatactagggttgc

SEQ ID NO: 18261 - DNA, 20 bp, Artificial Sequence
  chemically synthesized
ttatactagggttgcaagaa

SEQ ID NO: 18262 - DNA, 20 bp, Artificial Sequence
  chemically synthesized
tgatacatcacatcaacaaa

SEQ ID NO: 18263 - DNA, 20 bp, Artificial Sequence
  chemically synthesized
aaaccatatgatcatctcaa

SEQ ID NO: 18264 - DNA, 20 bp, Artificial Sequence
  chemically synthesized
tatgatcatctcaatagata

SEQ ID NO: 18265 - DNA, 20 bp, Artificial Sequence
  chemically synthesized
catctcaatagatacagaaa

SEQ ID NO: 18266 - DNA, 20 bp, Artificial Sequence
  chemically synthesized
ttcatgataaaaactatctg

SEQ ID NO: 18267 - DNA, 20 bp, Artificial Sequence
  chemically synthesized
aaactatctgcagccaatca

SEQ ID NO: 18268 - DNA, 20 bp, Artificial Sequence
  chemically synthesized
ctatctgcagccaatcatag

SEQ ID NO: 18269 - DNA, 20 bp, Artificial Sequence
  chemically synthesized
tatctgcagccaatcataga

SEQ ID NO: 18270 - DNA, 20 bp, Artificial Sequence
  chemically synthesized
aacatatctcaatataataa

SEQ ID NO: 18271 - DNA, 20 bp, Artificial Sequence
  chemically synthesized
agtcatatatgacaaaccca

SEQ ID NO: 18272 - DNA, 20 bp, Artificial Sequence
  chemically synthesized
cagctaacatcatactgaat

SEQ ID NO: 18273 - DNA, 20 bp, Artificial Sequence
  chemically synthesized
agctaacatcatactgaatt

SEQ ID NO: 18274 - DNA, 20 bp, Artificial Sequence
  chemically synthesized
acatcatactgaattgggaa

SEQ ID NO: 18275 - DNA, 20 bp, Artificial Sequence
  chemically synthesized
catactgaattgggaaaagc

SEQ ID NO: 18276 - DNA, 20 bp, Artificial Sequence
  chemically synthesized
actgaattgggaaaagctgg

SEQ ID NO: 18277 - DNA, 20 bp, Artificial Sequence
  chemically synthesized
aagctggaagcctttcctct

SEQ ID NO: 18278 - DNA, 20 bp, Artificial Sequence
  chemically synthesized
tctaagaactgaaacaaaat

SEQ ID NO: 18279 - DNA, 20 bp, Artificial Sequence
  chemically synthesized
ctaagaactgaaacaaaata

SEQ ID NO: 18280 - DNA, 20 bp, Artificial Sequence
  chemically synthesized
actcctattcaatataatac

SEQ ID NO: 18281 - DNA, 20 bp, Artificial Sequence
  chemically synthesized
cctattcaatataatactgg

SEQ ID NO: 18282 - DNA, 20 bp, Artificial Sequence
  chemically synthesized
caatataatactggaagtcc

SEQ ID NO: 18283 - DNA, 20 bp, Artificial Sequence
  chemically synthesized
aatactggaagtcctagcca

SEQ ID NO: 18284 - DNA, 20 bp, Artificial Sequence
  chemically synthesized
gaagtcctagccacagcttt

SEQ ID NO: 18285 - DNA, 20 bp, Artificial Sequence
  chemically synthesized
aagtcctagccacagctttc

SEQ ID NO: 18286 - DNA, 20 bp, Artificial Sequence
  chemically synthesized
cctagccacagctttcaggt

SEQ ID NO: 18287 - DNA, 20 bp, Artificial Sequence
  chemically synthesized
tagccacagctttcaggtca

SEQ ID NO: 18288 - DNA, 20 bp, Artificial Sequence
  chemically synthesized
cacagctttcaggtcagaga

SEQ ID NO: 18289 - DNA, 20 bp, Artificial Sequence
  chemically synthesized
gctttcaggtcagagaaaga

SEQ ID NO: 18290 - DNA, 20 bp, Artificial Sequence
  chemically synthesized
tcaggtcagagaaagaaaga

SEQ ID NO: 18291 - DNA, 20 bp, Artificial Sequence
  chemically synthesized
tcagagaaagaaagaaagaa

SEQ ID NO: 18292 - DNA, 20 bp, Artificial Sequence
  chemically synthesized
cagagaaagaaagaaagaaa

SEQ ID NO: 18293 - DNA, 20 bp, Artificial Sequence
  chemically synthesized
agaaagaaaaggcatgcaaa

SEQ ID NO: 18294 - DNA, 20 bp, Artificial Sequence
  chemically synthesized
gaaagaaaaggcatgcaaat

SEQ ID NO: 18295 - DNA, 20 bp, Artificial Sequence
  chemically synthesized
aaaaggcatgcaaataggaa

SEQ ID NO: 18296 - DNA, 20 bp, Artificial Sequence
  chemically synthesized
catgcaaataggaaaagatg

SEQ ID NO: 18297 - DNA, 20 bp, Artificial Sequence
  chemically synthesized
agtcaaactgtccatctttc

SEQ ID NO: 18298 - DNA, 20 bp, Artificial Sequence
  chemically synthesized
agatgacatgattttatacc

SEQ ID NO: 18299 - DNA, 20 bp, Artificial Sequence
  chemically synthesized
attttatacctagaaaaacc

SEQ ID NO: 18300 - DNA, 20 bp, Artificial Sequence
  chemically synthesized
gaaaaaccaagactccacca

SEQ ID NO: 18301 - DNA, 20 bp, Artificial Sequence
  chemically synthesized
agactccaccaaagcactct

SEQ ID NO: 18302 - DNA, 20 bp, Artificial Sequence
  chemically synthesized
ttagcgctgaaaaataaatt

SEQ ID NO: 18303 - DNA, 20 bp, Artificial Sequence
  chemically synthesized
gctgaaaaataaattcagta

SEQ ID NO: 18304 - DNA, 20 bp, Artificial Sequence
  chemically synthesized
aaataaattcagtaaagtta

SEQ ID NO: 18305 - DNA, 20 bp, Artificial Sequence
  chemically synthesized
aataaattcagtaaagttac

SEQ ID NO: 18306 - DNA, 20 bp, Artificial Sequence
  chemically synthesized
taaattcagtaaagttacag

SEQ ID NO: 18307 - DNA, 20 bp, Artificial Sequence
  chemically synthesized
aaagttacaggagacaaaat

SEQ ID NO: 18308 - DNA, 20 bp, Artificial Sequence
  chemically synthesized
acaaaatcagcatatgaaac

SEQ ID NO: 18309 - DNA, 20 bp, Artificial Sequence
  chemically synthesized
tctacacaccaataataaac

SEQ ID NO: 18310 - DNA, 20 bp, Artificial Sequence
  chemically synthesized
acaccaataataaactagct

SEQ ID NO: 18311 - DNA, 20 bp, Artificial Sequence
  chemically synthesized
ccaataataaactagctgag

SEQ ID NO: 18312 - DNA, 20 bp, Artificial Sequence
  chemically synthesized
caataataaactagctgaga

SEQ ID NO: 18313 - DNA, 20 bp, Artificial Sequence
  chemically synthesized
aactagctgagaaggaaatt

SEQ ID NO: 18314 - DNA, 20 bp, Artificial Sequence
  chemically synthesized
tagctgagaaggaaattaag

SEQ ID NO: 18315 - DNA, 20 bp, Artificial Sequence
  chemically synthesized
agctgagaaggaaattaaga

SEQ ID NO: 18316 - DNA, 20 bp, Artificial Sequence
  chemically synthesized
gaaggcaatcccatttacaa

SEQ ID NO: 18317 - DNA, 20 bp, Artificial Sequence
  chemically synthesized
tagctaaaaaataaaatatt

SEQ ID NO: 18318 - DNA, 20 bp, Artificial Sequence
  chemically synthesized
agctaaaaaataaaatattt

SEQ ID NO: 18319 - DNA, 20 bp, Artificial Sequence
  chemically synthesized
gctaaaaaataaaatattta

SEQ ID NO: 18320 - DNA, 20 bp, Artificial Sequence
  chemically synthesized
atttagggataaatttaacc

SEQ ID NO: 18321 - DNA, 20 bp, Artificial Sequence
  chemically synthesized
tttagggataaatttaacca

SEQ ID NO: 18322 - DNA, 20 bp, Artificial Sequence
  chemically synthesized
ggaaccgaaaaacctctatt

SEQ ID NO: 18323 - DNA, 20 bp, Artificial Sequence
  chemically synthesized
aaactacaaaacactgataa

SEQ ID NO: 18324 - DNA, 20 bp, Artificial Sequence
  chemically synthesized
acactgataaaagaattgaa

SEQ ID NO: 18325 - DNA, 20 bp, Artificial Sequence
  chemically synthesized
cactgataaaagaattgaaa

SEQ ID NO: 18326 - DNA, 20 bp, Artificial Sequence
  chemically synthesized
gataaaagaattgaaaagga

SEQ ID NO: 18327 - DNA, 20 bp, Artificial Sequence
  chemically synthesized
ttgaaaaggacagaaacaaa

SEQ ID NO: 18328 - DNA, 20 bp, Artificial Sequence
  chemically synthesized
gaaaaggacagaaacaaatg

SEQ ID NO: 18329 - DNA, 20 bp, Artificial Sequence
  chemically synthesized
aaaggacagaaacaaatgga

SEQ ID NO: 18330 - DNA, 20 bp, Artificial Sequence
  chemically synthesized
ggagagatatcctatgttca

SEQ ID NO: 18331 - DNA, 20 bp, Artificial Sequence
  chemically synthesized
gatatcctatgttcatggat

SEQ ID NO: 18332 - DNA, 20 bp, Artificial Sequence
  chemically synthesized
aaaaattaatattgttaaaa

SEQ ID NO: 18333 - DNA, 20 bp, Artificial Sequence
  chemically synthesized
taaaatggccatactaccca

SEQ ID NO: 18334 - DNA, 20 bp, Artificial Sequence
  chemically synthesized
atactacccaaagcaatcta

SEQ ID NO: 18335 - DNA, 20 bp, Artificial Sequence
  chemically synthesized
ctatatgaccgctatcaaaa

SEQ ID NO: 18336 - DNA, 20 bp, Artificial Sequence
  chemically synthesized
aatagcaatgtcatttttca

SEQ ID NO: 18337 - DNA, 20 bp, Artificial Sequence
  chemically synthesized
aatgtcatttttcacagaaa

SEQ ID NO: 18338 - DNA, 20 bp, Artificial Sequence
  chemically synthesized
atttgtatgaaattaaaaaa

SEQ ID NO: 18339 - DNA, 20 bp, Artificial Sequence
  chemically synthesized
atgaaattaaaaaatagctc

SEQ ID NO: 18340 - DNA, 20 bp, Artificial Sequence
  chemically synthesized
aaattaaaaaatagctccag

SEQ ID NO: 18341 - DNA, 20 bp, Artificial Sequence
  chemically synthesized
aaaaatagctccagtagcca

SEQ ID NO: 18342 - DNA, 20 bp, Artificial Sequence
  chemically synthesized
ccaaagtcatcctgtgaaaa

SEQ ID NO: 18343 - DNA, 20 bp, Artificial Sequence
  chemically synthesized
ctgtgaaaaaagaacaatgc

SEQ ID NO: 18344 - DNA, 20 bp, Artificial Sequence
  chemically synthesized
gtgaaaaaagaacaatgcta

SEQ ID NO: 18345 - DNA, 20 bp, Artificial Sequence
  chemically synthesized
tgaaaaaagaacaatgctag

SEQ ID NO: 18346 - DNA, 20 bp, Artificial Sequence
  chemically synthesized
tatcatactacctgatttca

SEQ ID NO: 18347 - DNA, 20 bp, Artificial Sequence
  chemically synthesized
gatttcaaagtatattacaa

SEQ ID NO: 18348 - DNA, 20 bp, Artificial Sequence
  chemically synthesized
caaagtatattacaaaagta

SEQ ID NO: 18349 - DNA, 20 bp, Artificial Sequence
  chemically synthesized
aaagtatattacaaaagtat

SEQ ID NO: 18350 - DNA, 20 bp, Artificial Sequence
  chemically synthesized
caaaagtataggaacctaaa

SEQ ID NO: 18351 - DNA, 20 bp, Artificial Sequence
  chemically synthesized
aaacagcatgatactgacat

SEQ ID NO: 18352 - DNA, 20 bp, Artificial Sequence
  chemically synthesized
gcatgatactgacattagaa

SEQ ID NO: 18353 - DNA, 20 bp, Artificial Sequence
  chemically synthesized
ctgacattagaacagacact

SEQ ID NO: 18354 - DNA, 20 bp, Artificial Sequence
  chemically synthesized
agaacagacacttagaccaa

SEQ ID NO: 18355 - DNA, 20 bp, Artificial Sequence
  chemically synthesized
acagacacttagaccaatgg

SEQ ID NO: 18356 - DNA, 20 bp, Artificial Sequence
  chemically synthesized
agacacttagaccaatggaa

SEQ ID NO: 18357 - DNA, 20 bp, Artificial Sequence
  chemically synthesized
cttagaccaatggaagagaa

SEQ ID NO: 18358 - DNA, 20 bp, Artificial Sequence
  chemically synthesized
tagaccaatggaagagaata

SEQ ID NO: 18359 - DNA, 20 bp, Artificial Sequence
  chemically synthesized
atggaagagaatagagaacc

SEQ ID NO: 18360 - DNA, 20 bp, Artificial Sequence
  chemically synthesized
gaaatgcatccacatattta

SEQ ID NO: 18361 - DNA, 20 bp, Artificial Sequence
  chemically synthesized
atccacatatttatagccaa

SEQ ID NO: 18362 - DNA, 20 bp, Artificial Sequence
  chemically synthesized
tagccaacagattttcaaca

SEQ ID NO: 18363 - DNA, 20 bp, Artificial Sequence
  chemically synthesized
agccaacagattttcaacaa

SEQ ID NO: 18364 - DNA, 20 bp, Artificial Sequence
  chemically synthesized
agattttcaacaaaggtgac

SEQ ID NO: 18365 - DNA, 20 bp, Artificial Sequence
  chemically synthesized
aggtgacaagaatatacatt

SEQ ID NO: 18366 - DNA, 20 bp, Artificial Sequence
  chemically synthesized
ggtgacaagaatatacattg

SEQ ID NO: 18367 - DNA, 20 bp, Artificial Sequence
  chemically synthesized
acaagaatatacattgagga

SEQ ID NO: 18368 - DNA, 20 bp, Artificial Sequence
  chemically synthesized
caagaatatacattgaggaa

SEQ ID NO: 18369 - DNA, 20 bp, Artificial Sequence
  chemically synthesized
tatacattgaggaaaggaca

SEQ ID NO: 18370 - DNA, 20 bp, Artificial Sequence
  chemically synthesized
gaggaaaggacacagtgttc

SEQ ID NO: 18371 - DNA, 20 bp, Artificial Sequence
  chemically synthesized
aggacacagtgttcaagaaa

SEQ ID NO: 18372 - DNA, 20 bp, Artificial Sequence
  chemically synthesized
agaaatggtgctgaaaaaat

SEQ ID NO: 18373 - DNA, 20 bp, Artificial Sequence
  chemically synthesized
tgaaaaaattggatatccat

SEQ ID NO: 18374 - DNA, 20 bp, Artificial Sequence
  chemically synthesized
cattggatatccatgtgcaa

SEQ ID NO: 18375 - DNA, 20 bp, Artificial Sequence
  chemically synthesized
catgtgcaaaagaataaaac

SEQ ID NO: 18376 - DNA, 20 bp, Artificial Sequence
  chemically synthesized
ataaaactggactgctgata

SEQ ID NO: 18377 - DNA, 20 bp, Artificial Sequence
  chemically synthesized
actggactgctgatatggtt

SEQ ID NO: 18378 - DNA, 20 bp, Artificial Sequence
  chemically synthesized
aaatataatccccaacttct

SEQ ID NO: 18379 - DNA, 20 bp, Artificial Sequence
  chemically synthesized
aatataatccccaacttctc

SEQ ID NO: 18380 - DNA, 20 bp, Artificial Sequence
  chemically synthesized
tccccaacttctcaggatct

SEQ ID NO: 18381 - DNA, 20 bp, Artificial Sequence
  chemically synthesized
ccaacttctcaggatcttgg

SEQ ID NO: 18382 - DNA, 20 bp, Artificial Sequence
  chemically synthesized
cttctcaggatcttggcgga

SEQ ID NO: 18383 - DNA, 20 bp, Artificial Sequence
  chemically synthesized
ttctcaggatcttggcggat

SEQ ID NO: 18384 - DNA, 20 bp, Artificial Sequence
  chemically synthesized
ctcaggatcttggcggatgg

SEQ ID NO: 18385 - DNA, 20 bp, Artificial Sequence
  chemically synthesized
tcaggatcttggcggatggg

SEQ ID NO: 18386 - DNA, 20 bp, Artificial Sequence
  chemically synthesized
ggatcttggcggatgggagg

SEQ ID NO: 18387 - DNA, 20 bp, Artificial Sequence
  chemically synthesized
gatcttggcggatgggaggt

SEQ ID NO: 18388 - DNA, 20 bp, Artificial Sequence
  chemically synthesized
tggcggatgggaggtaggcc

SEQ ID NO: 18389 - DNA, 20 bp, Artificial Sequence
  chemically synthesized
tgggaggtaggcctagattg

SEQ ID NO: 18390 - DNA, 20 bp, Artificial Sequence
  chemically synthesized
cctagattgcagctccaact

SEQ ID NO: 18391 - DNA, 20 bp, Artificial Sequence
  chemically synthesized
gattgcagctccaactcaga

SEQ ID NO: 18392 - DNA, 20 bp, Artificial Sequence
  chemically synthesized
gcagctccaactcagatgga

SEQ ID NO: 18393 - DNA, 20 bp, Artificial Sequence
  chemically synthesized
agctccaactcagatggaca

SEQ ID NO: 18394 - DNA, 20 bp, Artificial Sequence
  chemically synthesized
tccaactcagatggacagag

SEQ ID NO: 18395 - DNA, 20 bp, Artificial Sequence
  chemically synthesized
cagatggacagagcagcatg

SEQ ID NO: 18396 - DNA, 20 bp, Artificial Sequence
  chemically synthesized
gatggacagagcagcatgtg

SEQ ID NO: 18397 - DNA, 20 bp, Artificial Sequence
  chemically synthesized
atggacagagcagcatgtgg

SEQ ID NO: 18398 - DNA, 20 bp, Artificial Sequence
  chemically synthesized
gaggctcgcattgtgaattt

SEQ ID NO: 18399 - DNA, 20 bp, Artificial Sequence
  chemically synthesized
cgcattgtgaattttagctg

SEQ ID NO: 18400 - DNA, 20 bp, Artificial Sequence
  chemically synthesized
ttgtgaattttagctgcaga

SEQ ID NO: 18401 - DNA, 20 bp, Artificial Sequence
  chemically synthesized
tttagctgcagatagactgc

SEQ ID NO: 18402 - DNA, 20 bp, Artificial Sequence
  chemically synthesized
gatagactgcaagaacaaac

SEQ ID NO: 18403 - DNA, 20 bp, Artificial Sequence
  chemically synthesized
aagaacaaaccagcaatcct

SEQ ID NO: 18404 - DNA, 20 bp, Artificial Sequence
  chemically synthesized
gaacaaaccagcaatcctga

SEQ ID NO: 18405 - DNA, 20 bp, Artificial Sequence
  chemically synthesized
aacaaaccagcaatcctgag

SEQ ID NO: 18406 - DNA, 20 bp, Artificial Sequence
  chemically synthesized
agcaatcctgagaggaccca

SEQ ID NO: 18407 - DNA, 20 bp, Artificial Sequence
  chemically synthesized
gaggacccacagaccctctg

SEQ ID NO: 18408 - DNA, 20 bp, Artificial Sequence
  chemically synthesized
aggacccacagaccctctga

SEQ ID NO: 18409 - DNA, 20 bp, Artificial Sequence
  chemically synthesized
acccacagaccctctgaagg

SEQ ID NO: 18410 - DNA, 20 bp, Artificial Sequence
  chemically synthesized
cacagaccctctgaaggaag

SEQ ID NO: 18411 - DNA, 20 bp, Artificial Sequence
  chemically synthesized
aaggaagtagattgctcctg

SEQ ID NO: 18412 - DNA, 20 bp, Artificial Sequence
  chemically synthesized
aggaagtagattgctcctgc

SEQ ID NO: 18413 - DNA, 20 bp, Artificial Sequence
  chemically synthesized
tagattgctcctgcaggacc

SEQ ID NO: 18414 - DNA, 20 bp, Artificial Sequence
  chemically synthesized
agattgctcctgcaggaccc

SEQ ID NO: 18415 - DNA, 20 bp, Artificial Sequence
  chemically synthesized
attgctcctgcaggacccag

SEQ ID NO: 18416 - DNA, 20 bp, Artificial Sequence
  chemically synthesized
ggagacaccccaaatactgt

SEQ ID NO: 18417 - DNA, 20 bp, Artificial Sequence
  chemically synthesized
tactgtgagtgccccaactg

SEQ ID NO: 18418 - DNA, 20 bp, Artificial Sequence
  chemically synthesized
tgtgagtgccccaactgcgg

SEQ ID NO: 18419 - DNA, 20 bp, Artificial Sequence
  chemically synthesized
gagtgccccaactgcggaag

SEQ ID NO: 18420 - DNA, 20 bp, Artificial Sequence
  chemically synthesized
agtgccccaactgcggaagt

SEQ ID NO: 18421 - DNA, 20 bp, Artificial Sequence
  chemically synthesized
ccccaactgcggaagtggga

SEQ ID NO: 18422 - DNA, 20 bp, Artificial Sequence
  chemically synthesized
cccaactgcggaagtgggaa

SEQ ID NO: 18423 - DNA, 20 bp, Artificial Sequence
  chemically synthesized
ccaactgcggaagtgggaaa

SEQ ID NO: 18424 - DNA, 20 bp, Artificial Sequence
  chemically synthesized
aactgcggaagtgggaaagg

SEQ ID NO: 18425 - DNA, 20 bp, Artificial Sequence
  chemically synthesized
tcctaaacacacactcccac

SEQ ID NO: 18426 - DNA, 20 bp, Artificial Sequence
  chemically synthesized
ctaaacacacactcccactg

SEQ ID NO: 18427 - DNA, 20 bp, Artificial Sequence
  chemically synthesized
cactcccactggagaaactg

SEQ ID NO: 18428 - DNA, 20 bp, Artificial Sequence
  chemically synthesized
actcccactggagaaactga

SEQ ID NO: 18429 - DNA, 20 bp, Artificial Sequence
  chemically synthesized
agaaactgaaggtctgtttg

SEQ ID NO: 18430 - DNA, 20 bp, Artificial Sequence
  chemically synthesized
gaaactgaaggtctgtttgt

SEQ ID NO: 18431 - DNA, 20 bp, Artificial Sequence
  chemically synthesized
aactgaaggtctgtttgtgg

SEQ ID NO: 18432 - DNA, 20 bp, Artificial Sequence
  chemically synthesized
tgaaggtctgtttgtgggag

SEQ ID NO: 18433 - DNA, 20 bp, Artificial Sequence
  chemically synthesized
gagaagtttctgaccttacc

SEQ ID NO: 18434 - DNA, 20 bp, Artificial Sequence
  chemically synthesized
gaagtttctgaccttacctg

SEQ ID NO: 18435 - DNA, 20 bp, Artificial Sequence
  chemically synthesized
ttctgaccttacctggagtt

SEQ ID NO: 18436 - DNA, 20 bp, Artificial Sequence
  chemically synthesized
tacctggagttgagttaact

SEQ ID NO: 18437 - DNA, 20 bp, Artificial Sequence
  chemically synthesized
cctggagttgagttaactta

SEQ ID NO: 18438 - DNA, 20 bp, Artificial Sequence
  chemically synthesized
tggagttgagttaacttaga

SEQ ID NO: 18439 - DNA, 20 bp, Artificial Sequence
  chemically synthesized
ttgagttaacttagagagct

SEQ ID NO: 18440 - DNA, 20 bp, Artificial Sequence
  chemically synthesized
ttagagagctgagcaaaata

SEQ ID NO: 18441 - DNA, 20 bp, Artificial Sequence
  chemically synthesized
tagagagctgagcaaaatac

SEQ ID NO: 18442 - DNA, 20 bp, Artificial Sequence
  chemically synthesized
agctgagcaaaatacaggtg

SEQ ID NO: 18443 - DNA, 20 bp, Artificial Sequence
  chemically synthesized
ctgagcaaaatacaggtgta

SEQ ID NO: 18444 - DNA, 20 bp, Artificial Sequence
  chemically synthesized
tgagcaaaatacaggtgtag

SEQ ID NO: 18445 - DNA, 20 bp, Artificial Sequence
  chemically synthesized
gcaaaatacaggtgtagagg

SEQ ID NO: 18446 - DNA, 20 bp, Artificial Sequence
  chemically synthesized
aaatacaggtgtagaggaag

SEQ ID NO: 18447 - DNA, 20 bp, Artificial Sequence
  chemically synthesized
acaggtgtagaggaagcagt

SEQ ID NO: 18448 - DNA, 20 bp, Artificial Sequence
  chemically synthesized
gtgtagaggaagcagtgaga

SEQ ID NO: 18449 - DNA, 20 bp, Artificial Sequence
  chemically synthesized
tgtagaggaagcagtgagaa

SEQ ID NO: 18450 - DNA, 20 bp, Artificial Sequence
  chemically synthesized
ggaagcagtgagaaaggccc

SEQ ID NO: 18451 - DNA, 20 bp, Artificial Sequence
  chemically synthesized
gaagcagtgagaaaggccct

SEQ ID NO: 18452 - DNA, 20 bp, Artificial Sequence
  chemically synthesized
agcagtgagaaaggccctgg

SEQ ID NO: 18453 - DNA, 20 bp, Artificial Sequence
  chemically synthesized
gaaaggccctgggagctcac

SEQ ID NO: 18454 - DNA, 20 bp, Artificial Sequence
  chemically synthesized
aaaggccctgggagctcact

SEQ ID NO: 18455 - DNA, 20 bp, Artificial Sequence
  chemically synthesized
tgggagctcactgggtccct

SEQ ID NO: 18456 - DNA, 20 bp, Artificial Sequence
  chemically synthesized
gagctcactgggtccctgag

SEQ ID NO: 18457 - DNA, 20 bp, Artificial Sequence
  chemically synthesized
agctcactgggtccctgagc

SEQ ID NO: 18458 - DNA, 20 bp, Artificial Sequence
  chemically synthesized
ctgagcaggccattcctgcc

SEQ ID NO: 18459 - DNA, 20 bp, Artificial Sequence
  chemically synthesized
caggccattcctgcctggca

SEQ ID NO: 18460 - DNA, 20 bp, Artificial Sequence
  chemically synthesized
ccattcctgcctggcatagc

SEQ ID NO: 18461 - DNA, 20 bp, Artificial Sequence
  chemically synthesized
cattcctgcctggcatagcc

SEQ ID NO: 18462 - DNA, 20 bp, Artificial Sequence
  chemically synthesized
ttactaacattgaatgtaaa

SEQ ID NO: 18463 - DNA, 20 bp, Artificial Sequence
  chemically synthesized
ggcctaaatgctccacttaa

SEQ ID NO: 18464 - DNA, 20 bp, Artificial Sequence
  chemically synthesized
gcctaaatgctccacttaaa

SEQ ID NO: 18465 - DNA, 20 bp, Artificial Sequence
  chemically synthesized
cctaaatgctccacttaaaa

SEQ ID NO: 18466 - DNA, 20 bp, Artificial Sequence
  chemically synthesized
ctccacttaaaagggtgaaa

SEQ ID NO: 18467 - DNA, 20 bp, Artificial Sequence
  chemically synthesized
tccacttaaaagggtgaaaa

SEQ ID NO: 18468 - DNA, 20 bp, Artificial Sequence
  chemically synthesized
aaaaaggtatttcatgcaaa

SEQ ID NO: 18469 - DNA, 20 bp, Artificial Sequence
  chemically synthesized
ttcatgcaaatggccaccaa

SEQ ID NO: 18470 - DNA, 20 bp, Artificial Sequence
  chemically synthesized
tgcaaatggccaccaaaagt

SEQ ID NO: 18471 - DNA, 20 bp, Artificial Sequence
  chemically synthesized
aaatggccaccaaaagtgag

SEQ ID NO: 18472 - DNA, 20 bp, Artificial Sequence
  chemically synthesized
aatggccaccaaaagtgagt

SEQ ID NO: 18473 - DNA, 20 bp, Artificial Sequence
  chemically synthesized
agtaggcaaaacaaacttta

SEQ ID NO: 18474 - DNA, 20 bp, Artificial Sequence
  chemically synthesized
caaaacaaactttaaagcaa

SEQ ID NO: 18475 - DNA, 20 bp, Artificial Sequence
  chemically synthesized
aacaaactttaaagcaacag

SEQ ID NO: 18476 - DNA, 20 bp, Artificial Sequence
  chemically synthesized
tttaaagcaacagcagttaa

SEQ ID NO: 18477 - DNA, 20 bp, Artificial Sequence
  chemically synthesized
taaagcaacagcagttaaaa

SEQ ID NO: 18478 - DNA, 20 bp, Artificial Sequence
  chemically synthesized
aacagcagttaaaagagaca

SEQ ID NO: 18479 - DNA, 20 bp, Artificial Sequence
  chemically synthesized
cagcagttaaaagagacaaa

SEQ ID NO: 18480 - DNA, 20 bp, Artificial Sequence
  chemically synthesized
agcagttaaaagagacaaag

SEQ ID NO: 18481 - DNA, 20 bp, Artificial Sequence
  chemically synthesized
gcagttaaaagagacaaaga

SEQ ID NO: 18482 - DNA, 20 bp, Artificial Sequence
  chemically synthesized
caaagagggacattatataa

SEQ ID NO: 18483 - DNA, 20 bp, Artificial Sequence
  chemically synthesized
gggacattatataatggtaa

SEQ ID NO: 18484 - DNA, 20 bp, Artificial Sequence
  chemically synthesized
ggacattatataatggtaaa

SEQ ID NO: 18485 - DNA, 20 bp, Artificial Sequence
  chemically synthesized
tggtaaaaggccttgtccaa

SEQ ID NO: 18486 - DNA, 20 bp, Artificial Sequence
  chemically synthesized
ggtaaaaggccttgtccaac

SEQ ID NO: 18487 - DNA, 20 bp, Artificial Sequence
  chemically synthesized
aacatatatgcacctaacac

SEQ ID NO: 18488 - DNA, 20 bp, Artificial Sequence
  chemically synthesized
catatatgcacctaacactg

SEQ ID NO: 18489 - DNA, 20 bp, Artificial Sequence
  chemically synthesized
cactggagctcccaaattta

SEQ ID NO: 18490 - DNA, 20 bp, Artificial Sequence
  chemically synthesized
atttatagaacaattactaa

SEQ ID NO: 18491 - DNA, 20 bp, Artificial Sequence
  chemically synthesized
gaacaattactaatagacct

SEQ ID NO: 18492 - DNA, 20 bp, Artificial Sequence
  chemically synthesized
tactaatagacctaagaaat

SEQ ID NO: 18493 - DNA, 20 bp, Artificial Sequence
  chemically synthesized
aatagacctaagaaatgaga

SEQ ID NO: 18494 - DNA, 20 bp, Artificial Sequence
  chemically synthesized
gacctaagaaatgagataga

SEQ ID NO: 18495 - DNA, 20 bp, Artificial Sequence
  chemically synthesized
gatagacagcaacacaataa

SEQ ID NO: 18496 - DNA, 20 bp, Artificial Sequence
  chemically synthesized
agacagcaacacaataatag

SEQ ID NO: 18497 - DNA, 20 bp, Artificial Sequence
  chemically synthesized
gacagcaacacaataatagt

SEQ ID NO: 18498 - DNA, 20 bp, Artificial Sequence
  chemically synthesized
acagcaacacaataatagtg

SEQ ID NO: 18499 - DNA, 20 bp, Artificial Sequence
  chemically synthesized
cagcaacacaataatagtgg

SEQ ID NO: 18500 - DNA, 20 bp, Artificial Sequence
  chemically synthesized
ggacttcaatacttcattga

SEQ ID NO: 18501 - DNA, 20 bp, Artificial Sequence
  chemically synthesized
caatacttcattgacagcac

SEQ ID NO: 18502 - DNA, 20 bp, Artificial Sequence
  chemically synthesized
acttcattgacagcactaga

SEQ ID NO: 18503 - DNA, 20 bp, Artificial Sequence
  chemically synthesized
acagcactagacagttcatc

SEQ ID NO: 18504 - DNA, 20 bp, Artificial Sequence
  chemically synthesized
cactagacagttcatcaaga

SEQ ID NO: 18505 - DNA, 20 bp, Artificial Sequence
  chemically synthesized
agacagttcatcaagacaga

SEQ ID NO: 18506 - DNA, 20 bp, Artificial Sequence
  chemically synthesized
gaaagtcaacaaaaaaataa

SEQ ID NO: 18507 - DNA, 20 bp, Artificial Sequence
  chemically synthesized
aatggatttaaattatacct

SEQ ID NO: 18508 - DNA, 20 bp, Artificial Sequence
  chemically synthesized
aaattataccttagaacaaa

SEQ ID NO: 18509 - DNA, 20 bp, Artificial Sequence
  chemically synthesized
cttagaacaaatggacttaa

SEQ ID NO: 18510 - DNA, 20 bp, Artificial Sequence
  chemically synthesized
atggacttaacagttatata

SEQ ID NO: 18511 - DNA, 20 bp, Artificial Sequence
  chemically synthesized
aacatttcatccaataacca

SEQ ID NO: 18512 - DNA, 20 bp, Artificial Sequence
  chemically synthesized
agaacacacattctattcaa

SEQ ID NO: 18513 - DNA, 20 bp, Artificial Sequence
  chemically synthesized
acattctattcaacagcgcg

SEQ ID NO: 18514 - DNA, 20 bp, Artificial Sequence
  chemically synthesized
cagcgcgtggaaatttctcc

SEQ ID NO: 18515 - DNA, 20 bp, Artificial Sequence
  chemically synthesized
agcgcgtggaaatttctcca

SEQ ID NO: 18516 - DNA, 20 bp, Artificial Sequence
  chemically synthesized
gcgtggaaatttctccaagg

SEQ ID NO: 18517 - DNA, 20 bp, Artificial Sequence
  chemically synthesized
ctccaaggtagaccatatga

SEQ ID NO: 18518 - DNA, 20 bp, Artificial Sequence
  chemically synthesized
tccaaggtagaccatatgat

SEQ ID NO: 18519 - DNA, 20 bp, Artificial Sequence
  chemically synthesized
catatgataggccatgaaat

SEQ ID NO: 18520 - DNA, 20 bp, Artificial Sequence
  chemically synthesized
agcctcaataaatttactaa

SEQ ID NO: 18521 - DNA, 20 bp, Artificial Sequence
  chemically synthesized
tttactaacagaccaataac

SEQ ID NO: 18522 - DNA, 20 bp, Artificial Sequence
  chemically synthesized
actaacagaccaataacaag

SEQ ID NO: 18523 - DNA, 20 bp, Artificial Sequence
  chemically synthesized
acagaccaataacaagcagt

SEQ ID NO: 18524 - DNA, 20 bp, Artificial Sequence
  chemically synthesized
aacaagcagtgagatttaat

SEQ ID NO: 18525 - DNA, 20 bp, Artificial Sequence
  chemically synthesized
aaaaattaccaaccaaaaaa

SEQ ID NO: 18526 - DNA, 20 bp, Artificial Sequence
  chemically synthesized
ttaccaaccaaaaaaaagtt

SEQ ID NO: 18527 - DNA, 20 bp, Artificial Sequence
  chemically synthesized
taccaaccaaaaaaaagttc

SEQ ID NO: 18528 - DNA, 20 bp, Artificial Sequence
  chemically synthesized
accaaaaaaaagttcaggac

SEQ ID NO: 18529 - DNA, 20 bp, Artificial Sequence
  chemically synthesized
aaaaaaagttcaggaccaga

SEQ ID NO: 18530 - DNA, 20 bp, Artificial Sequence
  chemically synthesized
aggaccagatggattcacaa

SEQ ID NO: 18531 - DNA, 20 bp, Artificial Sequence
  chemically synthesized
gattcacaacagaattctac

SEQ ID NO: 18532 - DNA, 20 bp, Artificial Sequence
  chemically synthesized
agaattctactagacattca

SEQ ID NO: 18533 - DNA, 20 bp, Artificial Sequence
  chemically synthesized
aattctactagacattcaaa

SEQ ID NO: 18534 - DNA, 20 bp, Artificial Sequence
  chemically synthesized
attctactagacattcaaag

SEQ ID NO: 18535 - DNA, 20 bp, Artificial Sequence
  chemically synthesized
ctagacattcaaagaggaat

SEQ ID NO: 18536 - DNA, 20 bp, Artificial Sequence
  chemically synthesized
tctttttgacactattctac

SEQ ID NO: 18537 - DNA, 20 bp, Artificial Sequence
  chemically synthesized
tttgacactattctacaaga

SEQ ID NO: 18538 - DNA, 20 bp, Artificial Sequence
  chemically synthesized
actattctacaagacagata

SEQ ID NO: 18539 - DNA, 20 bp, Artificial Sequence
  chemically synthesized
attctacaagacagataaag

SEQ ID NO: 18540 - DNA, 20 bp, Artificial Sequence
  chemically synthesized
ttctacaagacagataaaga

SEQ ID NO: 18541 - DNA, 20 bp, Artificial Sequence
  chemically synthesized
ctgccctaattcattctatg

SEQ ID NO: 18542 - DNA, 20 bp, Artificial Sequence
  chemically synthesized
cctaattcattctatgaagc

SEQ ID NO: 18543 - DNA, 20 bp, Artificial Sequence
  chemically synthesized
agccagcatcacaccaaaac

SEQ ID NO: 18544 - DNA, 20 bp, Artificial Sequence
  chemically synthesized
gccagcatcacaccaaaacc

SEQ ID NO: 18545 - DNA, 20 bp, Artificial Sequence
  chemically synthesized
ccagcatcacaccaaaacca

SEQ ID NO: 18546 - DNA, 20 bp, Artificial Sequence
  chemically synthesized
gcatcacaccaaaaccaggg

SEQ ID NO: 18547 - DNA, 20 bp, Artificial Sequence
  chemically synthesized
catcacaccaaaaccaggga

SEQ ID NO: 18548 - DNA, 20 bp, Artificial Sequence
  chemically synthesized
agggaaggacataaccaaaa

SEQ ID NO: 18549 - DNA, 20 bp, Artificial Sequence
  chemically synthesized
ataaccaaaaaagaaaacta

SEQ ID NO: 18550 - DNA, 20 bp, Artificial Sequence
  chemically synthesized
aaaagaaaactacagactga

SEQ ID NO: 18551 - DNA, 20 bp, Artificial Sequence
  chemically synthesized
actgatagccttgatgaaca

SEQ ID NO: 18552 - DNA, 20 bp, Artificial Sequence
  chemically synthesized
taaaatccttaacaaaatac

SEQ ID NO: 18553 - DNA, 20 bp, Artificial Sequence
  chemically synthesized
aaattcaacaacataacaaa

SEQ ID NO: 18554 - DNA, 20 bp, Artificial Sequence
  chemically synthesized
aaagataatccaccatgatc

SEQ ID NO: 18555 - DNA, 20 bp, Artificial Sequence
  chemically synthesized
gataatccaccatgatcaag

SEQ ID NO: 18556 - DNA, 20 bp, Artificial Sequence
  chemically synthesized
ataatccaccatgatcaagc

SEQ ID NO: 18557 - DNA, 20 bp, Artificial Sequence
  chemically synthesized
tgatcaagcaggttccatgc

SEQ ID NO: 18558 - DNA, 20 bp, Artificial Sequence
  chemically synthesized
gatcaagcaggttccatgcc

SEQ ID NO: 18559 - DNA, 20 bp, Artificial Sequence
  chemically synthesized
atcaagcaggttccatgcca

SEQ ID NO: 18560 - DNA, 20 bp, Artificial Sequence
  chemically synthesized
caggttccatgccagggatg

SEQ ID NO: 18561 - DNA, 20 bp, Artificial Sequence
  chemically synthesized
aggttccatgccagggatgc

SEQ ID NO: 18562 - DNA, 20 bp, Artificial Sequence
  chemically synthesized
ggttccatgccagggatgca

SEQ ID NO: 18563 - DNA, 20 bp, Artificial Sequence
  chemically synthesized
ccatgccagggatgcagggt

SEQ ID NO: 18564 - DNA, 20 bp, Artificial Sequence
  chemically synthesized
agggttggtttgacatctgc

SEQ ID NO: 18565 - DNA, 20 bp, Artificial Sequence
  chemically synthesized
tttgacatctgcaagtcaat

SEQ ID NO: 18566 - DNA, 20 bp, Artificial Sequence
  chemically synthesized
agtgtgatacaccacataaa

SEQ ID NO: 18567 - DNA, 20 bp, Artificial Sequence
  chemically synthesized
aaattacatgatcatctcaa

SEQ ID NO: 18568 - DNA, 20 bp, Artificial Sequence
  chemically synthesized
catgatcatctcaatagatg

SEQ ID NO: 18569 - DNA, 20 bp, Artificial Sequence
  chemically synthesized
catctcaatagatgcagaaa

SEQ ID NO: 18570 - DNA, 20 bp, Artificial Sequence
  chemically synthesized
aaaaagcattcaacaaaatc

SEQ ID NO: 18571 - DNA, 20 bp, Artificial Sequence
  chemically synthesized
acatttatgattaaaatgct

SEQ ID NO: 18572 - DNA, 20 bp, Artificial Sequence
  chemically synthesized
attaaaatgctcagcaaaat

SEQ ID NO: 18573 - DNA, 20 bp, Artificial Sequence
  chemically synthesized
gctcagcaaaatcagcatac

SEQ ID NO: 18574 - DNA, 20 bp, Artificial Sequence
  chemically synthesized
tcagcaaaatcagcatacaa

SEQ ID NO: 18575 - DNA, 20 bp, Artificial Sequence
  chemically synthesized
agcatacaagagacatacct

SEQ ID NO: 18576 - DNA, 20 bp, Artificial Sequence
  chemically synthesized
gacatacctcagtgtaataa

SEQ ID NO: 18577 - DNA, 20 bp, Artificial Sequence
  chemically synthesized
agccatctgtgacaaaccca

SEQ ID NO: 18578 - DNA, 20 bp, Artificial Sequence
  chemically synthesized
acagccaacataatattgaa

SEQ ID NO: 18579 - DNA, 20 bp, Artificial Sequence
  chemically synthesized
cagccaacataatattgaat

SEQ ID NO: 18580 - DNA, 20 bp, Artificial Sequence
  chemically synthesized
agccaacataatattgaatg

SEQ ID NO: 18581 - DNA, 20 bp, Artificial Sequence
  chemically synthesized
acataatattgaatggggaa

SEQ ID NO: 18582 - DNA, 20 bp, Artificial Sequence
  chemically synthesized
attgaatggggaaaagttga

SEQ ID NO: 18583 - DNA, 20 bp, Artificial Sequence
  chemically synthesized
aagttgaaagcattccctct

SEQ ID NO: 18584 - DNA, 20 bp, Artificial Sequence
  chemically synthesized
aaagcattccctctgagaac

SEQ ID NO: 18585 - DNA, 20 bp, Artificial Sequence
  chemically synthesized
ttccctctgagaactggaac

SEQ ID NO: 18586 - DNA, 20 bp, Artificial Sequence
  chemically synthesized
tctgagaactggaacaagac

SEQ ID NO: 18587 - DNA, 20 bp, Artificial Sequence
  chemically synthesized
ctgagaactggaacaagaca

SEQ ID NO: 18588 - DNA, 20 bp, Artificial Sequence
  chemically synthesized
ctcaccactcctcttcaaca

SEQ ID NO: 18589 - DNA, 20 bp, Artificial Sequence
  chemically synthesized
actcctcttcaacatagtac

SEQ ID NO: 18590 - DNA, 20 bp, Artificial Sequence
  chemically synthesized
cctcttcaacatagtactgg

SEQ ID NO: 18591 - DNA, 20 bp, Artificial Sequence
  chemically synthesized
caacatagtactggaagtcc

SEQ ID NO: 18592 - DNA, 20 bp, Artificial Sequence
  chemically synthesized
atagtactggaagtcctagc

SEQ ID NO: 18593 - DNA, 20 bp, Artificial Sequence
  chemically synthesized
tagtactggaagtcctagcc

SEQ ID NO: 18594 - DNA, 20 bp, Artificial Sequence
  chemically synthesized
agtactggaagtcctagcca

SEQ ID NO: 18595 - DNA, 20 bp, Artificial Sequence
  chemically synthesized
gaagtcctagccagggcaat

SEQ ID NO: 18596 - DNA, 20 bp, Artificial Sequence
  chemically synthesized
cagggcaatcagacaaaaca

SEQ ID NO: 18597 - DNA, 20 bp, Artificial Sequence
  chemically synthesized
tcagacaaaacaaagaaata

SEQ ID NO: 18598 - DNA, 20 bp, Artificial Sequence
  chemically synthesized
cagacaaaacaaagaaataa

SEQ ID NO: 18599 - DNA, 20 bp, Artificial Sequence
  chemically synthesized
agacaaaacaaagaaataaa

SEQ ID NO: 18600 - DNA, 20 bp, Artificial Sequence
  chemically synthesized
gaaataaagggcattcaaat

SEQ ID NO: 18601 - DNA, 20 bp, Artificial Sequence
  chemically synthesized
aaagggcattcaaatcagta

SEQ ID NO: 18602 - DNA, 20 bp, Artificial Sequence
  chemically synthesized
agggcattcaaatcagtaaa

SEQ ID NO: 18603 - DNA, 20 bp, Artificial Sequence
  chemically synthesized
gggcattcaaatcagtaaag

SEQ ID NO: 18604 - DNA, 20 bp, Artificial Sequence
  chemically synthesized
cattcaaatcagtaaagagg

SEQ ID NO: 18605 - DNA, 20 bp, Artificial Sequence
  chemically synthesized
catttacctttaaaacccta

SEQ ID NO: 18606 - DNA, 20 bp, Artificial Sequence
  chemically synthesized
taaaaccctaaagactcctc

SEQ ID NO: 18607 - DNA, 20 bp, Artificial Sequence
  chemically synthesized
accctaaagactcctccaga

SEQ ID NO: 18608 - DNA, 20 bp, Artificial Sequence
  chemically synthesized
agactcctccagaaagctcc

SEQ ID NO: 18609 - DNA, 20 bp, Artificial Sequence
  chemically synthesized
ctagaactgataaaataatt

SEQ ID NO: 18610 - DNA, 20 bp, Artificial Sequence
  chemically synthesized
actgataaaataattcagca

SEQ ID NO: 18611 - DNA, 20 bp, Artificial Sequence
  chemically synthesized
aaataattcagcaaagtttc

SEQ ID NO: 18612 - DNA, 20 bp, Artificial Sequence
  chemically synthesized
tcagcaaagtttccagatac

SEQ ID NO: 18613 - DNA, 20 bp, Artificial Sequence
  chemically synthesized
caagatgaatgcacacaaat

SEQ ID NO: 18614 - DNA, 20 bp, Artificial Sequence
  chemically synthesized
gtaactcttctatacaccaa

SEQ ID NO: 18615 - DNA, 20 bp, Artificial Sequence
  chemically synthesized
atacaccaacagcaaccaaa

SEQ ID NO: 18616 - DNA, 20 bp, Artificial Sequence
  chemically synthesized
acaccaacagcaaccaaatg

SEQ ID NO: 18617 - DNA, 20 bp, Artificial Sequence
  chemically synthesized
accaaatggagaatcaaatc

SEQ ID NO: 18618 - DNA, 20 bp, Artificial Sequence
  chemically synthesized
gaactcaaccccttgtacaa

SEQ ID NO: 18619 - DNA, 20 bp, Artificial Sequence
  chemically synthesized
ttgtacaatagatgcaaaaa

SEQ ID NO: 18620 - DNA, 20 bp, Artificial Sequence
  chemically synthesized
gccatataaaacgtactctc

SEQ ID NO: 18621 - DNA, 20 bp, Artificial Sequence
  chemically synthesized
tataaaacgtactctcaaga

SEQ ID NO: 18622 - DNA, 20 bp, Artificial Sequence
  chemically synthesized
cgtactctcaagatggatta

SEQ ID NO: 18623 - DNA, 20 bp, Artificial Sequence
  chemically synthesized
taaaactataaaactactaa

SEQ ID NO: 18624 - DNA, 20 bp, Artificial Sequence
  chemically synthesized
aaactactaaaagaaaacat

SEQ ID NO: 18625 - DNA, 20 bp, Artificial Sequence
  chemically synthesized
aactactaaaagaaaacata

SEQ ID NO: 18626 - DNA, 20 bp, Artificial Sequence
  chemically synthesized
actactaaaagaaaacataa

SEQ ID NO: 18627 - DNA, 20 bp, Artificial Sequence
  chemically synthesized
tactaaaagaaaacataagg

SEQ ID NO: 18628 - DNA, 20 bp, Artificial Sequence
  chemically synthesized
aaacataagggagacacttc

SEQ ID NO: 18629 - DNA, 20 bp, Artificial Sequence
  chemically synthesized
aagggagacacttcaagaca

SEQ ID NO: 18630 - DNA, 20 bp, Artificial Sequence
  chemically synthesized
gacacttcaagacatggctt

SEQ ID NO: 18631 - DNA, 20 bp, Artificial Sequence
  chemically synthesized
acacttcaagacatggcttt

SEQ ID NO: 18632 - DNA, 20 bp, Artificial Sequence
  chemically synthesized
tcaagacatggctttgggca

SEQ ID NO: 18633 - DNA, 20 bp, Artificial Sequence
  chemically synthesized
ggctttgggcaaagatttta

SEQ ID NO: 18634 - DNA, 20 bp, Artificial Sequence
  chemically synthesized
tgggcaaagattttatggcc

SEQ ID NO: 18635 - DNA, 20 bp, Artificial Sequence
  chemically synthesized
ttttatggccaagacctcaa

SEQ ID NO: 18636 - DNA, 20 bp, Artificial Sequence
  chemically synthesized
tggccaagacctcaaaagca

SEQ ID NO: 18637 - DNA, 20 bp, Artificial Sequence
  chemically synthesized
ggccaagacctcaaaagcac

SEQ ID NO: 18638 - DNA, 20 bp, Artificial Sequence
  chemically synthesized
ctcaaaagcacaggcaacaa

SEQ ID NO: 18639 - DNA, 20 bp, Artificial Sequence
  chemically synthesized
acaggcaacaaaagcaaaaa

SEQ ID NO: 18640 - DNA, 20 bp, Artificial Sequence
  chemically synthesized
caaaagcaaaaatagacaaa

SEQ ID NO: 18641 - DNA, 20 bp, Artificial Sequence
  chemically synthesized
aaaagcaaaaatagacaaat

SEQ ID NO: 18642 - DNA, 20 bp, Artificial Sequence
  chemically synthesized
tagacaaatgggactatatt

SEQ ID NO: 18643 - DNA, 20 bp, Artificial Sequence
  chemically synthesized
taagctaaaatacatctgca

SEQ ID NO: 18644 - DNA, 20 bp, Artificial Sequence
  chemically synthesized
taaaatacatctgcacagta

SEQ ID NO: 18645 - DNA, 20 bp, Artificial Sequence
  chemically synthesized
aaaatacatctgcacagtaa

SEQ ID NO: 18646 - DNA, 20 bp, Artificial Sequence
  chemically synthesized
agtaaaggaaacaatcaaca

SEQ ID NO: 18647 - DNA, 20 bp, Artificial Sequence
  chemically synthesized
aggaaacaatcaacacagtg

SEQ ID NO: 18648 - DNA, 20 bp, Artificial Sequence
  chemically synthesized
gaaacaatcaacacagtgaa

SEQ ID NO: 18649 - DNA, 20 bp, Artificial Sequence
  chemically synthesized
aatcaacacagtgaagagac

SEQ ID NO: 18650 - DNA, 20 bp, Artificial Sequence
  chemically synthesized
agagacaagctgttgaatgc

SEQ ID NO: 18651 - DNA, 20 bp, Artificial Sequence
  chemically synthesized
aatatttgcatacatttgac

SEQ ID NO: 18652 - DNA, 20 bp, Artificial Sequence
  chemically synthesized
atatttgcatacatttgaca

SEQ ID NO: 18653 - DNA, 20 bp, Artificial Sequence
  chemically synthesized
tttgacaaggaattaatctc

SEQ ID NO: 18654 - DNA, 20 bp, Artificial Sequence
  chemically synthesized
aattaatctccagaatatat

SEQ ID NO: 18655 - DNA, 20 bp, Artificial Sequence
  chemically synthesized
aagaaactcaaacaactcaa

SEQ ID NO: 18656 - DNA, 20 bp, Artificial Sequence
  chemically synthesized
aaactcaaacaactcaacag

SEQ ID NO: 18657 - DNA, 20 bp, Artificial Sequence
  chemically synthesized
aaataatctcattaaaaaat

SEQ ID NO: 18658 - DNA, 20 bp, Artificial Sequence
  chemically synthesized
atctcattaaaaaattggca

SEQ ID NO: 18659 - DNA, 20 bp, Artificial Sequence
  chemically synthesized
tctcattaaaaaattggcaa

SEQ ID NO: 18660 - DNA, 20 bp, Artificial Sequence
  chemically synthesized
tggcaaaggatatttttcaa

SEQ ID NO: 18661 - DNA, 20 bp, Artificial Sequence
  chemically synthesized
caaaggatatttttcaaaag

SEQ ID NO: 18662 - DNA, 20 bp, Artificial Sequence
  chemically synthesized
gaagacatacaaatgcacaa

SEQ ID NO: 18663 - DNA, 20 bp, Artificial Sequence
  chemically synthesized
aagacatacaaatgcacaat

SEQ ID NO: 18664 - DNA, 20 bp, Artificial Sequence
  chemically synthesized
atacaaatgcacaatgggta

SEQ ID NO: 18665 - DNA, 20 bp, Artificial Sequence
  chemically synthesized
tacaaatgcacaatgggtat

SEQ ID NO: 18666 - DNA, 20 bp, Artificial Sequence
  chemically synthesized
acaaatgcacaatgggtatg

SEQ ID NO: 18667 - DNA, 20 bp, Artificial Sequence
  chemically synthesized
tgctcaacattactaatcat

SEQ ID NO: 18668 - DNA, 20 bp, Artificial Sequence
  chemically synthesized
ctcaacattactaatcatca

SEQ ID NO: 18669 - DNA, 20 bp, Artificial Sequence
  chemically synthesized
atgcaaatcaaaaccacaat

SEQ ID NO: 18670 - DNA, 20 bp, Artificial Sequence
  chemically synthesized
aatgagatatcatcttatgc

SEQ ID NO: 18671 - DNA, 20 bp, Artificial Sequence
  chemically synthesized
agatatcatcttatgccagt

SEQ ID NO: 18672 - DNA, 20 bp, Artificial Sequence
  chemically synthesized
aataaataaataacacatgc

SEQ ID NO: 18673 - DNA, 20 bp, Artificial Sequence
  chemically synthesized
aataaataacacatgctggc

SEQ ID NO: 18674 - DNA, 20 bp, Artificial Sequence
  chemically synthesized
ataaataacacatgctggca

SEQ ID NO: 18675 - DNA, 20 bp, Artificial Sequence
  chemically synthesized
cacatgctggcaaggatgtg

SEQ ID NO: 18676 - DNA, 20 bp, Artificial Sequence
  chemically synthesized
acatgctggcaaggatgtga

SEQ ID NO: 18677 - DNA, 20 bp, Artificial Sequence
  chemically synthesized
ctggcaaggatgtgaaggaa

SEQ ID NO: 18678 - DNA, 20 bp, Artificial Sequence
  chemically synthesized
tggcaaggatgtgaaggaaa

SEQ ID NO: 18679 - DNA, 20 bp, Artificial Sequence
  chemically synthesized
tgtgaaggaaaaggcactcg

SEQ ID NO: 18680 - DNA, 20 bp, Artificial Sequence
  chemically synthesized
gtgaaggaaaaggcactcgt

SEQ ID NO: 18681 - DNA, 20 bp, Artificial Sequence
  chemically synthesized
aaggcactcgtaggcactat

SEQ ID NO: 18682 - DNA, 20 bp, Artificial Sequence
  chemically synthesized
cactcgtaggcactattggt

SEQ ID NO: 18683 - DNA, 20 bp, Artificial Sequence
  chemically synthesized
ctattggtaagcatgcaaat

SEQ ID NO: 18684 - DNA, 20 bp, Artificial Sequence
  chemically synthesized
ggtaagcatgcaaattagta

SEQ ID NO: 18685 - DNA, 20 bp, Artificial Sequence
  chemically synthesized
gcaaattagtatagccacta

SEQ ID NO: 18686 - DNA, 20 bp, Artificial Sequence
  chemically synthesized
ccactatggaaaacaatatg

SEQ ID NO: 18687 - DNA, 20 bp, Artificial Sequence
  chemically synthesized
caatatgtagatttaccaaa

SEQ ID NO: 18688 - DNA, 20 bp, Artificial Sequence
  chemically synthesized
gctaaaaattgaactatcat

SEQ ID NO: 18689 - DNA, 20 bp, Artificial Sequence
  chemically synthesized
aattgaactatcataagatc

SEQ ID NO: 18690 - DNA, 20 bp, Artificial Sequence
  chemically synthesized
agatccagcaatcttattac

SEQ ID NO: 18691 - DNA, 20 bp, Artificial Sequence
  chemically synthesized
gatccagcaatcttattact

SEQ ID NO: 18692 - DNA, 20 bp, Artificial Sequence
  chemically synthesized
tattactgggtatttatcca

SEQ ID NO: 18693 - DNA, 20 bp, Artificial Sequence
  chemically synthesized
attactgggtatttatccaa

SEQ ID NO: 18694 - DNA, 20 bp, Artificial Sequence
  chemically synthesized
tgggtatttatccaaaggaa

SEQ ID NO: 18695 - DNA, 20 bp, Artificial Sequence
  chemically synthesized
ttatccaaaggaaaagaatt

SEQ ID NO: 18696 - DNA, 20 bp, Artificial Sequence
  chemically synthesized
aaagaattcagaataataaa

SEQ ID NO: 18697 - DNA, 20 bp, Artificial Sequence
  chemically synthesized
tcagaataataaacagatac

SEQ ID NO: 18698 - DNA, 20 bp, Artificial Sequence
  chemically synthesized
tggtaccacactgtttattg

SEQ ID NO: 18699 - DNA, 20 bp, Artificial Sequence
  chemically synthesized
tattgcagcacgattcacat

SEQ ID NO: 18700 - DNA, 20 bp, Artificial Sequence
  chemically synthesized
cagcacgattcacattagca

SEQ ID NO: 18701 - DNA, 20 bp, Artificial Sequence
  chemically synthesized
gattcacattagcaaagata

SEQ ID NO: 18702 - DNA, 20 bp, Artificial Sequence
  chemically synthesized
caaagatatggaatcaacct

SEQ ID NO: 18703 - DNA, 20 bp, Artificial Sequence
  chemically synthesized
tcaacctaagtgtccatcaa

SEQ ID NO: 18704 - DNA, 20 bp, Artificial Sequence
  chemically synthesized
tgtccatcaatggatgaatg

SEQ ID NO: 18705 - DNA, 20 bp, Artificial Sequence
  chemically synthesized
atggatgaatgaagaaaatg

SEQ ID NO: 18706 - DNA, 20 bp, Artificial Sequence
  chemically synthesized
atataaaatcatttcatttg

SEQ ID NO: 18707 - DNA, 20 bp, Artificial Sequence
  chemically synthesized
tcatttcatttgcagcaaca

SEQ ID NO: 18708 - DNA, 20 bp, Artificial Sequence
  chemically synthesized
tgcagcaacatggatgaaac

SEQ ID NO: 18709 - DNA, 20 bp, Artificial Sequence
  chemically synthesized
agcaacatggatgaaactgg

SEQ ID NO: 18710 - DNA, 20 bp, Artificial Sequence
  chemically synthesized
gtcattatgttaaacgaaat

SEQ ID NO: 18711 - DNA, 20 bp, Artificial Sequence
  chemically synthesized
ttatgttaaacgaaataagc

SEQ ID NO: 18712 - DNA, 20 bp, Artificial Sequence
  chemically synthesized
tatgttaaacgaaataagcc

SEQ ID NO: 18713 - DNA, 20 bp, Artificial Sequence
  chemically synthesized
taaacgaaataagccaggca

SEQ ID NO: 18714 - DNA, 20 bp, Artificial Sequence
  chemically synthesized
cgaaataagccaggcataga

SEQ ID NO: 18715 - DNA, 20 bp, Artificial Sequence
  chemically synthesized
tgcatgttctcactgatatg

SEQ ID NO: 18716 - DNA, 20 bp, Artificial Sequence
  chemically synthesized
gcatgttctcactgatatgt

SEQ ID NO: 18717 - DNA, 20 bp, Artificial Sequence
  chemically synthesized
atgttctcactgatatgtgg

SEQ ID NO: 18718 - DNA, 20 bp, Artificial Sequence
  chemically synthesized
ctgatatgtgggagctaaaa

SEQ ID NO: 18719 - DNA, 20 bp, Artificial Sequence
  chemically synthesized
ctaaaaaagttaatatcatg

SEQ ID NO: 18720 - DNA, 20 bp, Artificial Sequence
  chemically synthesized
taaaaaagttaatatcatgt

SEQ ID NO: 18721 - DNA, 20 bp, Artificial Sequence
  chemically synthesized
aaaagttaatatcatgtagg

SEQ ID NO: 18722 - DNA, 20 bp, Artificial Sequence
  chemically synthesized
aagttaatatcatgtaggta

SEQ ID NO: 18723 - DNA, 20 bp, Artificial Sequence
  chemically synthesized
gttaatatcatgtaggtaga

SEQ ID NO: 18724 - DNA, 20 bp, Artificial Sequence
  chemically synthesized
aatatcatgtaggtagagag

SEQ ID NO: 18725 - DNA, 20 bp, Artificial Sequence
  chemically synthesized
gtaggtagagagtagaatga

SEQ ID NO: 18726 - DNA, 20 bp, Artificial Sequence
  chemically synthesized
gagagtagaatgacagaaac

SEQ ID NO: 18727 - DNA, 20 bp, Artificial Sequence
  chemically synthesized
gagtagaatgacagaaacca

SEQ ID NO: 18728 - DNA, 20 bp, Artificial Sequence
  chemically synthesized
agtagaatgacagaaaccag

SEQ ID NO: 18729 - DNA, 20 bp, Artificial Sequence
  chemically synthesized
agaatgacagaaaccagagg

SEQ ID NO: 18730 - DNA, 20 bp, Artificial Sequence
  chemically synthesized
aatgacagaaaccagaggta

SEQ ID NO: 18731 - DNA, 20 bp, Artificial Sequence
  chemically synthesized
acagaaaccagaggtagaga

SEQ ID NO: 18732 - DNA, 20 bp, Artificial Sequence
  chemically synthesized
cagaaaccagaggtagagaa

SEQ ID NO: 18733 - DNA, 20 bp, Artificial Sequence
  chemically synthesized
agagaaaggtgtgtacgtta

SEQ ID NO: 18734 - DNA, 20 bp, Artificial Sequence
  chemically synthesized
gagaaaggtgtgtacgttat

SEQ ID NO: 18735 - DNA, 20 bp, Artificial Sequence
  chemically synthesized
gaaaggtgtgtacgttatgg

SEQ ID NO: 18736 - DNA, 20 bp, Artificial Sequence
  chemically synthesized
aaaggtgtgtacgttatggg

SEQ ID NO: 18737 - DNA, 20 bp, Artificial Sequence
  chemically synthesized
ggtgtgtacgttatgggagg

SEQ ID NO: 18738 - DNA, 20 bp, Artificial Sequence
  chemically synthesized
gtgtgtacgttatgggagga

SEQ ID NO: 18739 - DNA, 20 bp, Artificial Sequence
  chemically synthesized
tgtgtacgttatgggaggaa

SEQ ID NO: 18740 - DNA, 20 bp, Artificial Sequence
  chemically synthesized
tgtacgttatgggaggaagg

SEQ ID NO: 18741 - DNA, 20 bp, Artificial Sequence
  chemically synthesized
ttatgggaggaagggagacg

SEQ ID NO: 18742 - DNA, 20 bp, Artificial Sequence
  chemically synthesized
atgggaggaagggagacgaa

SEQ ID NO: 18743 - DNA, 20 bp, Artificial Sequence
  chemically synthesized
ggaggaagggagacgaagag

SEQ ID NO: 18744 - DNA, 20 bp, Artificial Sequence
  chemically synthesized
gaagggagacgaagagaagt

SEQ ID NO: 18745 - DNA, 20 bp, Artificial Sequence
  chemically synthesized
gacgaagagaagttggttaa

SEQ ID NO: 18746 - DNA, 20 bp, Artificial Sequence
  chemically synthesized
gagaagttggttaatggaaa

SEQ ID NO: 18747 - DNA, 20 bp, Artificial Sequence
  chemically synthesized
agaagttggttaatggaaac

SEQ ID NO: 18748 - DNA, 20 bp, Artificial Sequence
  chemically synthesized
agttggttaatggaaacagg

SEQ ID NO: 18749 - DNA, 20 bp, Artificial Sequence
  chemically synthesized
ggttaatggaaacaggcagt

SEQ ID NO: 18750 - DNA, 20 bp, Artificial Sequence
  chemically synthesized
aatggaaacaggcagttaga

SEQ ID NO: 18751 - DNA, 20 bp, Artificial Sequence
  chemically synthesized
ggaaacaggcagttagatag

SEQ ID NO: 18752 - DNA, 20 bp, Artificial Sequence
  chemically synthesized
gaaacaggcagttagataga

SEQ ID NO: 18753 - DNA, 20 bp, Artificial Sequence
  chemically synthesized
gaatatgttctgatgttcaa

SEQ ID NO: 18754 - DNA, 20 bp, Artificial Sequence
  chemically synthesized
tgttctgatgttcaatagca

SEQ ID NO: 18755 - DNA, 20 bp, Artificial Sequence
  chemically synthesized
tctgatgttcaatagcaaag

SEQ ID NO: 18756 - DNA, 20 bp, Artificial Sequence
  chemically synthesized
ctgatgttcaatagcaaagt

SEQ ID NO: 18757 - DNA, 20 bp, Artificial Sequence
  chemically synthesized
tgatgttcaatagcaaagta

SEQ ID NO: 18758 - DNA, 20 bp, Artificial Sequence
  chemically synthesized
atagcaaagtagggtgatta

SEQ ID NO: 18759 - DNA, 20 bp, Artificial Sequence
  chemically synthesized
atatattgtatatttcaaaa

SEQ ID NO: 18760 - DNA, 20 bp, Artificial Sequence
  chemically synthesized
tattgtatatttcaaaatag

SEQ ID NO: 18761 - DNA, 20 bp, Artificial Sequence
  chemically synthesized
tgtatatttcaaaatagtag

SEQ ID NO: 18762 - DNA, 20 bp, Artificial Sequence
  chemically synthesized
tatttcaaaatagtagaaga

SEQ ID NO: 18763 - DNA, 20 bp, Artificial Sequence
  chemically synthesized
atttcaaaatagtagaagaa

SEQ ID NO: 18764 - DNA, 20 bp, Artificial Sequence
  chemically synthesized
cttgaaatgttcctaacaca

SEQ ID NO: 18765 - DNA, 20 bp, Artificial Sequence
  chemically synthesized
catagaaacgataaatactt

SEQ ID NO: 18766 - DNA, 20 bp, Artificial Sequence
  chemically synthesized
atagaaacgataaatacttg

SEQ ID NO: 18767 - DNA, 20 bp, Artificial Sequence
  chemically synthesized
aacacgtcatatatcaataa

SEQ ID NO: 18768 - DNA, 20 bp, Artificial Sequence
  chemically synthesized
cgtcatatatcaataaaaga

SEQ ID NO: 18769 - DNA, 20 bp, Artificial Sequence
  chemically synthesized
aaagaaagtcgatctcatat

SEQ ID NO: 18770 - DNA, 20 bp, Artificial Sequence
  chemically synthesized
aagtcgatctcatattggtt

SEQ ID NO: 18771 - DNA, 20 bp, Artificial Sequence
  chemically synthesized
agtcgatctcatattggttg

SEQ ID NO: 18772 - DNA, 20 bp, Artificial Sequence
  chemically synthesized
attggttgaggcctgattgt

SEQ ID NO: 18773 - DNA, 20 bp, Artificial Sequence
  chemically synthesized
taagtaaatctttgtccctc

SEQ ID NO: 18774 - DNA, 20 bp, Artificial Sequence
  chemically synthesized
tccctgtactgtcttgctgt

SEQ ID NO: 18775 - DNA, 20 bp, Artificial Sequence
  chemically synthesized
ccctgtactgtcttgctgtg

SEQ ID NO: 18776 - DNA, 20 bp, Artificial Sequence
  chemically synthesized
ctgtactgtcttgctgtgag

SEQ ID NO: 18777 - DNA, 20 bp, Artificial Sequence
  chemically synthesized
cttatattccaacaccattt

SEQ ID NO: 18778 - DNA, 20 bp, Artificial Sequence
  chemically synthesized
tcctccccatatttttacct

SEQ ID NO: 18779 - DNA, 20 bp, Artificial Sequence
  chemically synthesized
ctcggtttttactgtttata

SEQ ID NO: 18780 - DNA, 20 bp, Artificial Sequence
  chemically synthesized
atatagcacactttgtgcta

SEQ ID NO: 18781 - DNA, 20 bp, Artificial Sequence
  chemically synthesized
ctttgtgctatagtttacct

SEQ ID NO: 18782 - DNA, 20 bp, Artificial Sequence
  chemically synthesized
ctcagtttttactatttata

SEQ ID NO: 18783 - DNA, 20 bp, Artificial Sequence
  chemically synthesized
ccccaaacttctctcttaac

SEQ ID NO: 18784 - DNA, 20 bp, Artificial Sequence
  chemically synthesized
aaacttctctcttaacaagc

SEQ ID NO: 18785 - DNA, 20 bp, Artificial Sequence
  chemically synthesized
ctcttaacaagctagaatat

SEQ ID NO: 18786 - DNA, 20 bp, Artificial Sequence
  chemically synthesized
gctagaatataagtgaatgc

SEQ ID NO: 18787 - DNA, 20 bp, Artificial Sequence
  chemically synthesized
tagaatataagtgaatgcaa

SEQ ID NO: 18788 - DNA, 20 bp, Artificial Sequence
  chemically synthesized
tataagtgaatgcaagagca

SEQ ID NO: 18789 - DNA, 20 bp, Artificial Sequence
  chemically synthesized
taagtgaatgcaagagcata

SEQ ID NO: 18790 - DNA, 20 bp, Artificial Sequence
  chemically synthesized
tgaatgcaagagcatagaga

SEQ ID NO: 18791 - DNA, 20 bp, Artificial Sequence
  chemically synthesized
gaatgcaagagcatagagac

SEQ ID NO: 18792 - DNA, 20 bp, Artificial Sequence
  chemically synthesized
aatgcaagagcatagagaca

SEQ ID NO: 18793 - DNA, 20 bp, Artificial Sequence
  chemically synthesized
tcattcctattttcatattt

SEQ ID NO: 18794 - DNA, 20 bp, Artificial Sequence
  chemically synthesized
cattcctattttcatatttg

SEQ ID NO: 18795 - DNA, 20 bp, Artificial Sequence
  chemically synthesized
tcatatttgaggtataaacc

SEQ ID NO: 18796 - DNA, 20 bp, Artificial Sequence
  chemically synthesized
catatttgaggtataaacca

SEQ ID NO: 18797 - DNA, 20 bp, Artificial Sequence
  chemically synthesized
tatttgaggtataaaccaag

SEQ ID NO: 18798 - DNA, 20 bp, Artificial Sequence
  chemically synthesized
tttttaaatctgcaaataaa

SEQ ID NO: 18799 - DNA, 20 bp, Artificial Sequence
  chemically synthesized
gttttattctgacattaaaa

SEQ ID NO: 18800 - DNA, 20 bp, Artificial Sequence
  chemically synthesized
aatgaatgatcgttttacca

SEQ ID NO: 18801 - DNA, 20 bp, Artificial Sequence
  chemically synthesized
atgatcgttttaccacagcg

SEQ ID NO: 18802 - DNA, 20 bp, Artificial Sequence
  chemically synthesized
tgatcgttttaccacagcgt

SEQ ID NO: 18803 - DNA, 20 bp, Artificial Sequence
  chemically synthesized
cttaaccttcactttcaaac

SEQ ID NO: 18804 - DNA, 20 bp, Artificial Sequence
  chemically synthesized
tttattgatctctattttcc

SEQ ID NO: 18805 - DNA, 20 bp, Artificial Sequence
  chemically synthesized
tctattttcctggaacaaca

SEQ ID NO: 18806 - DNA, 20 bp, Artificial Sequence
  chemically synthesized
ctattttcctggaacaacat

SEQ ID NO: 18807 - DNA, 20 bp, Artificial Sequence
  chemically synthesized
tattttcctggaacaacatg

SEQ ID NO: 18808 - DNA, 20 bp, Artificial Sequence
  chemically synthesized
attttcctggaacaacatgg

SEQ ID NO: 18809 - DNA, 20 bp, Artificial Sequence
  chemically synthesized
aacaacatgggggctatgtt

SEQ ID NO: 18810 - DNA, 20 bp, Artificial Sequence
  chemically synthesized
atgggggctatgtttagcgt

SEQ ID NO: 18811 - DNA, 20 bp, Artificial Sequence
  chemically synthesized
tgggggctatgtttagcgtg

SEQ ID NO: 18812 - DNA, 20 bp, Artificial Sequence
  chemically synthesized
ctatgtttagcgtgaggaca

SEQ ID NO: 18813 - DNA, 20 bp, Artificial Sequence
  chemically synthesized
gtatcacaactttcacctga

SEQ ID NO: 18814 - DNA, 20 bp, Artificial Sequence
  chemically synthesized
acaactttcacctgaaagaa

SEQ ID NO: 18815 - DNA, 20 bp, Artificial Sequence
  chemically synthesized
tttcacctgaaagaaaagat

SEQ ID NO: 18816 - DNA, 20 bp, Artificial Sequence
  chemically synthesized
aaagaaaagatgagctacca

SEQ ID NO: 18817 - DNA, 20 bp, Artificial Sequence
  chemically synthesized
accatggtacatataacaat

SEQ ID NO: 18818 - DNA, 20 bp, Artificial Sequence
  chemically synthesized
ccatggtacatataacaatg

SEQ ID NO: 18819 - DNA, 20 bp, Artificial Sequence
  chemically synthesized
tggtacatataacaatgagg

SEQ ID NO: 18820 - DNA, 20 bp, Artificial Sequence
  chemically synthesized
aatgaggtggttaaaactct

SEQ ID NO: 18821 - DNA, 20 bp, Artificial Sequence
  chemically synthesized
taaaactctaagtcgtcatc

SEQ ID NO: 18822 - DNA, 20 bp, Artificial Sequence
  chemically synthesized
tactaaaaatcactatttca

SEQ ID NO: 18823 - DNA, 20 bp, Artificial Sequence
  chemically synthesized
taaaaatcactatttcaaag

SEQ ID NO: 18824 - DNA, 20 bp, Artificial Sequence
  chemically synthesized
atcactatttcaaagaagta

SEQ ID NO: 18825 - DNA, 20 bp, Artificial Sequence
  chemically synthesized
tatttcaaagaagtatagaa

SEQ ID NO: 18826 - DNA, 20 bp, Artificial Sequence
  chemically synthesized
aagaagtatagaatagatat

SEQ ID NO: 18827 - DNA, 20 bp, Artificial Sequence
  chemically synthesized
gaatagatatcagccaaaat

SEQ ID NO: 18828 - DNA, 20 bp, Artificial Sequence
  chemically synthesized
aatagatatcagccaaaata

SEQ ID NO: 18829 - DNA, 20 bp, Artificial Sequence
  chemically synthesized
atatacatattatacacata

SEQ ID NO: 18830 - DNA, 20 bp, Artificial Sequence
  chemically synthesized
atacatattatacacatatg

SEQ ID NO: 18831 - DNA, 20 bp, Artificial Sequence
  chemically synthesized
ttgtatatgcttaaaaatta

SEQ ID NO: 18832 - DNA, 20 bp, Artificial Sequence
  chemically synthesized
tgcttaaaaattacagactt

SEQ ID NO: 18833 - DNA, 20 bp, Artificial Sequence
  chemically synthesized
ttaaaaattacagactttgg

SEQ ID NO: 18834 - DNA, 20 bp, Artificial Sequence
  chemically synthesized
tggaagtcatatgactattt

SEQ ID NO: 18835 - DNA, 20 bp, Artificial Sequence
  chemically synthesized
tatgactatttcagtgtgtg

SEQ ID NO: 18836 - DNA, 20 bp, Artificial Sequence
  chemically synthesized
caccctcctgttccaaaaca

SEQ ID NO: 18837 - DNA, 20 bp, Artificial Sequence
  chemically synthesized
cctgttccaaaacacagttg

SEQ ID NO: 18838 - DNA, 20 bp, Artificial Sequence
  chemically synthesized
gttccaaaacacagttgcag

SEQ ID NO: 18839 - DNA, 20 bp, Artificial Sequence
  chemically synthesized
ccaaaacacagttgcagaag

SEQ ID NO: 18840 - DNA, 20 bp, Artificial Sequence
  chemically synthesized
aaaacacagttgcagaagca

SEQ ID NO: 18841 - DNA, 20 bp, Artificial Sequence
  chemically synthesized
aaacacagttgcagaagcag

SEQ ID NO: 18842 - DNA, 20 bp, Artificial Sequence
  chemically synthesized
cacagttgcagaagcagagg

SEQ ID NO: 18843 - DNA, 20 bp, Artificial Sequence
  chemically synthesized
agaggaagtcattatacact

SEQ ID NO: 18844 - DNA, 20 bp, Artificial Sequence
  chemically synthesized
cacttagaacatcattttat

SEQ ID NO: 18845 - DNA, 20 bp, Artificial Sequence
  chemically synthesized
acttagaacatcattttata

SEQ ID NO: 18846 - DNA, 20 bp, Artificial Sequence
  chemically synthesized
tagaacatcattttataagg

SEQ ID NO: 18847 - DNA, 20 bp, Artificial Sequence
  chemically synthesized
aacatcattttataaggcag

SEQ ID NO: 18848 - DNA, 20 bp, Artificial Sequence
  chemically synthesized
acatcattttataaggcagc

SEQ ID NO: 18849 - DNA, 20 bp, Artificial Sequence
  chemically synthesized
attttataaggcagcaggtc

SEQ ID NO: 18850 - DNA, 20 bp, Artificial Sequence
  chemically synthesized
ttataaggcagcaggtctgg

SEQ ID NO: 18851 - DNA, 20 bp, Artificial Sequence
  chemically synthesized
tataaggcagcaggtctggt

SEQ ID NO: 18852 - DNA, 20 bp, Artificial Sequence
  chemically synthesized
aaggcagcaggtctggtagg

SEQ ID NO: 18853 - DNA, 20 bp, Artificial Sequence
  chemically synthesized
aggcagcaggtctggtagga

SEQ ID NO: 18854 - DNA, 20 bp, Artificial Sequence
  chemically synthesized
gcagcaggtctggtaggaag

SEQ ID NO: 18855 - DNA, 20 bp, Artificial Sequence
  chemically synthesized
aggtctggtaggaaggagat

SEQ ID NO: 18856 - DNA, 20 bp, Artificial Sequence
  chemically synthesized
ggtctggtaggaaggagatt

SEQ ID NO: 18857 - DNA, 20 bp, Artificial Sequence
  chemically synthesized
attaggtgctacttgtgaca

SEQ ID NO: 18858 - DNA, 20 bp, Artificial Sequence
  chemically synthesized
ttaggtgctacttgtgacaa

SEQ ID NO: 18859 - DNA, 20 bp, Artificial Sequence
  chemically synthesized
gtgctacttgtgacaaaggt

SEQ ID NO: 18860 - DNA, 20 bp, Artificial Sequence
  chemically synthesized
tcagcaaatatttgtgttcc

SEQ ID NO: 18861 - DNA, 20 bp, Artificial Sequence
  chemically synthesized
ttgtgttcccagcacttttc

SEQ ID NO: 18862 - DNA, 20 bp, Artificial Sequence
  chemically synthesized
ccagcacttttctagatcct

SEQ ID NO: 18863 - DNA, 20 bp, Artificial Sequence
  chemically synthesized
tagatcctcagttaaaatca

SEQ ID NO: 18864 - DNA, 20 bp, Artificial Sequence
  chemically synthesized
atcctcagttaaaatcaaag

SEQ ID NO: 18865 - DNA, 20 bp, Artificial Sequence
  chemically synthesized
agttaaaatcaaagcagctg

SEQ ID NO: 18866 - DNA, 20 bp, Artificial Sequence
  chemically synthesized
aatcaaagcagctgcagtct

SEQ ID NO: 18867 - DNA, 20 bp, Artificial Sequence
  chemically synthesized
caaagcagctgcagtcttgg

SEQ ID NO: 18868 - DNA, 20 bp, Artificial Sequence
  chemically synthesized
agcagctgcagtcttggcag

SEQ ID NO: 18869 - DNA, 20 bp, Artificial Sequence
  chemically synthesized
gcagctgcagtcttggcagt

SEQ ID NO: 18870 - DNA, 20 bp, Artificial Sequence
  chemically synthesized
agctgcagtcttggcagtgg

SEQ ID NO: 18871 - DNA, 20 bp, Artificial Sequence
  chemically synthesized
gctgcagtcttggcagtggg

SEQ ID NO: 18872 - DNA, 20 bp, Artificial Sequence
  chemically synthesized
gtgatactcacactttgaac

SEQ ID NO: 18873 - DNA, 20 bp, Artificial Sequence
  chemically synthesized
accacctgcactacctacaa

SEQ ID NO: 18874 - DNA, 20 bp, Artificial Sequence
  chemically synthesized
acctgcactacctacaatgg

SEQ ID NO: 18875 - DNA, 20 bp, Artificial Sequence
  chemically synthesized
gctccaaatattttatatga

SEQ ID NO: 18876 - DNA, 20 bp, Artificial Sequence
  chemically synthesized
ctccaaatattttatatgaa

SEQ ID NO: 18877 - DNA, 20 bp, Artificial Sequence
  chemically synthesized
tccaaatattttatatgaaa

SEQ ID NO: 18878 - DNA, 20 bp, Artificial Sequence
  chemically synthesized
ccaaatattttatatgaaag

SEQ ID NO: 18879 - DNA, 20 bp, Artificial Sequence
  chemically synthesized
tattttatatgaaaggggcc

SEQ ID NO: 18880 - DNA, 20 bp, Artificial Sequence
  chemically synthesized
atatgaaaggggcctagaca

SEQ ID NO: 18881 - DNA, 20 bp, Artificial Sequence
  chemically synthesized
gacatagcatgctgaatgaa

SEQ ID NO: 18882 - DNA, 20 bp, Artificial Sequence
  chemically synthesized
acatagcatgctgaatgaaa

SEQ ID NO: 18883 - DNA, 20 bp, Artificial Sequence
  chemically synthesized
tagcatgctgaatgaaaagg

SEQ ID NO: 18884 - DNA, 20 bp, Artificial Sequence
  chemically synthesized
atgctgaatgaaaaggaagt

SEQ ID NO: 18885 - DNA, 20 bp, Artificial Sequence
  chemically synthesized
ctgaatgaaaaggaagtgag

SEQ ID NO: 18886 - DNA, 20 bp, Artificial Sequence
  chemically synthesized
tgaaaaggaagtgagtagac

SEQ ID NO: 18887 - DNA, 20 bp, Artificial Sequence
  chemically synthesized
gtagactagtgctttccttg

SEQ ID NO: 18888 - DNA, 20 bp, Artificial Sequence
  chemically synthesized
ttccttgaagctgtgcaacc

SEQ ID NO: 18889 - DNA, 20 bp, Artificial Sequence
  chemically synthesized
tgaagctgtgcaaccaagca

SEQ ID NO: 18890 - DNA, 20 bp, Artificial Sequence
  chemically synthesized
aaccaagcatagtttttaca

SEQ ID NO: 18891 - DNA, 20 bp, Artificial Sequence
  chemically synthesized
catagatcgtgtgtttcaca

SEQ ID NO: 18892 - DNA, 20 bp, Artificial Sequence
  chemically synthesized
tgtttcacatggtgtgataa

SEQ ID NO: 18893 - DNA, 20 bp, Artificial Sequence
  chemically synthesized
acatggtgtgataacagctt

SEQ ID NO: 18894 - DNA, 20 bp, Artificial Sequence
  chemically synthesized
agcttgagatgccattgaca

SEQ ID NO: 18895 - DNA, 20 bp, Artificial Sequence
  chemically synthesized
atgccattgacatggcccac

SEQ ID NO: 18896 - DNA, 20 bp, Artificial Sequence
  chemically synthesized
gcccaccggcttatccacat

SEQ ID NO: 18897 - DNA, 20 bp, Artificial Sequence
  chemically synthesized
ggcttatccacatcagtaat

SEQ ID NO: 18898 - DNA, 20 bp, Artificial Sequence
  chemically synthesized
gcttatccacatcagtaatt

SEQ ID NO: 18899 - DNA, 20 bp, Artificial Sequence
  chemically synthesized
cttatccacatcagtaatta

SEQ ID NO: 18900 - DNA, 20 bp, Artificial Sequence
  chemically synthesized
ccacatcagtaattagggca

SEQ ID NO: 18901 - DNA, 20 bp, Artificial Sequence
  chemically synthesized
tactatgcatcccgtgattg

SEQ ID NO: 18902 - DNA, 20 bp, Artificial Sequence
  chemically synthesized
tgtgtttaaaaatgcaatta

SEQ ID NO: 18903 - DNA, 20 bp, Artificial Sequence
  chemically synthesized
tgcaattatggactcattca

SEQ ID NO: 18904 - DNA, 20 bp, Artificial Sequence
  chemically synthesized
tatggactcattcaaagtga

SEQ ID NO: 18905 - DNA, 20 bp, Artificial Sequence
  chemically synthesized
gactcattcaaagtgaaagc

SEQ ID NO: 18906 - DNA, 20 bp, Artificial Sequence
  chemically synthesized
aagctggtatgacaatacat

SEQ ID NO: 18907 - DNA, 20 bp, Artificial Sequence
  chemically synthesized
ttttatgaataaattttata

SEQ ID NO: 18908 - DNA, 20 bp, Artificial Sequence
  chemically synthesized
aataaattttataaagaaat

SEQ ID NO: 18909 - DNA, 20 bp, Artificial Sequence
  chemically synthesized
aagaaataagctaataccta

SEQ ID NO: 18910 - DNA, 20 bp, Artificial Sequence
  chemically synthesized
gaaataagctaatacctaca

SEQ ID NO: 18911 - DNA, 20 bp, Artificial Sequence
  chemically synthesized
acagagtgtttattaaatgc

SEQ ID NO: 18912 - DNA, 20 bp, Artificial Sequence
  chemically synthesized
cagagtgtttattaaatgct

SEQ ID NO: 18913 - DNA, 20 bp, Artificial Sequence
  chemically synthesized
tgtttattaaatgctaggca

SEQ ID NO: 18914 - DNA, 20 bp, Artificial Sequence
  chemically synthesized
taaatgctaggcacagttct

SEQ ID NO: 18915 - DNA, 20 bp, Artificial Sequence
  chemically synthesized
agttctgagtgatttacaac

SEQ ID NO: 18916 - DNA, 20 bp, Artificial Sequence
  chemically synthesized
taattttcacaacattatta

SEQ ID NO: 18917 - DNA, 20 bp, Artificial Sequence
  chemically synthesized
aattttcacaacattattac

SEQ ID NO: 18918 - DNA, 20 bp, Artificial Sequence
  chemically synthesized
tttcacaacattattacagg

SEQ ID NO: 18919 - DNA, 20 bp, Artificial Sequence
  chemically synthesized
ttacaggtagattttatata

SEQ ID NO: 18920 - DNA, 20 bp, Artificial Sequence
  chemically synthesized
acaggtagattttatatatg

SEQ ID NO: 18921 - DNA, 20 bp, Artificial Sequence
  chemically synthesized
attttatatatggagaaact

SEQ ID NO: 18922 - DNA, 20 bp, Artificial Sequence
  chemically synthesized
ttttatatatggagaaactg

SEQ ID NO: 18923 - DNA, 20 bp, Artificial Sequence
  chemically synthesized
tatatggagaaactgaggca

SEQ ID NO: 18924 - DNA, 20 bp, Artificial Sequence
  chemically synthesized
tatggagaaactgaggcaca

SEQ ID NO: 18925 - DNA, 20 bp, Artificial Sequence
  chemically synthesized
taataaatctcaacattacc

SEQ ID NO: 18926 - DNA, 20 bp, Artificial Sequence
  chemically synthesized
aataaatctcaacattaccc

SEQ ID NO: 18927 - DNA, 20 bp, Artificial Sequence
  chemically synthesized
tctcaacattacccaggtga

SEQ ID NO: 18928 - DNA, 20 bp, Artificial Sequence
  chemically synthesized
caacattacccaggtgatgg

SEQ ID NO: 18929 - DNA, 20 bp, Artificial Sequence
  chemically synthesized
acattacccaggtgatggtg

SEQ ID NO: 18930 - DNA, 20 bp, Artificial Sequence
  chemically synthesized
tacccaggtgatggtggagt

SEQ ID NO: 18931 - DNA, 20 bp, Artificial Sequence
  chemically synthesized
agttggaattccaaatcatg

SEQ ID NO: 18932 - DNA, 20 bp, Artificial Sequence
  chemically synthesized
caaatcatgcagtctgactt

SEQ ID NO: 18933 - DNA, 20 bp, Artificial Sequence
  chemically synthesized
atgcagtctgactttagctg

SEQ ID NO: 18934 - DNA, 20 bp, Artificial Sequence
  chemically synthesized
agtctgactttagctgtaga

SEQ ID NO: 18935 - DNA, 20 bp, Artificial Sequence
  chemically synthesized
tgactttagctgtagacagc

SEQ ID NO: 18936 - DNA, 20 bp, Artificial Sequence
  chemically synthesized
tttagctgtagacagcaaga

SEQ ID NO: 18937 - DNA, 20 bp, Artificial Sequence
  chemically synthesized
gctgtagacagcaagatagt

SEQ ID NO: 18938 - DNA, 20 bp, Artificial Sequence
  chemically synthesized
agacagcaagatagtaagta

SEQ ID NO: 18939 - DNA, 20 bp, Artificial Sequence
  chemically synthesized
gacagcaagatagtaagtaa

SEQ ID NO: 18940 - DNA, 20 bp, Artificial Sequence
  chemically synthesized
caagatagtaagtaaaggaa

SEQ ID NO: 18941 - DNA, 20 bp, Artificial Sequence
  chemically synthesized
agatagtaagtaaaggaatg

SEQ ID NO: 18942 - DNA, 20 bp, Artificial Sequence
  chemically synthesized
ggaatggagcaacaaattga

SEQ ID NO: 18943 - DNA, 20 bp, Artificial Sequence
  chemically synthesized
ttttgcttgtttgtttgaaa

SEQ ID NO: 18944 - DNA, 20 bp, Artificial Sequence
  chemically synthesized
tttgcttgtttgtttgaaac

SEQ ID NO: 18945 - DNA, 20 bp, Artificial Sequence
  chemically synthesized
ttgcttgtttgtttgaaaca

SEQ ID NO: 18946 - DNA, 20 bp, Artificial Sequence
  chemically synthesized
agggtctcactctgtcaccc

SEQ ID NO: 18947 - DNA, 20 bp, Artificial Sequence
  chemically synthesized
tctcactctgtcaccccggc

SEQ ID NO: 18948 - DNA, 20 bp, Artificial Sequence
  chemically synthesized
tcactctgtcaccccggctg

SEQ ID NO: 18949 - DNA, 20 bp, Artificial Sequence
  chemically synthesized
tcaccccggctggagtgcaa

SEQ ID NO: 18950 - DNA, 20 bp, Artificial Sequence
  chemically synthesized
tggtgcaatcttgctcactg

SEQ ID NO: 18951 - DNA, 20 bp, Artificial Sequence
  chemically synthesized
cttgctcactgaagcctcac

SEQ ID NO: 18952 - DNA, 20 bp, Artificial Sequence
  chemically synthesized
tgaagcctcactagaacgcc

SEQ ID NO: 18953 - DNA, 20 bp, Artificial Sequence
  chemically synthesized
ttcaattgatcctcctgctt

SEQ ID NO: 18954 - DNA, 20 bp, Artificial Sequence
  chemically synthesized
atcctcctgctttagcctct

SEQ ID NO: 18955 - DNA, 20 bp, Artificial Sequence
  chemically synthesized
tcctcctgctttagcctctc

SEQ ID NO: 18956 - DNA, 20 bp, Artificial Sequence
  chemically synthesized
tcctgctttagcctctcagg

SEQ ID NO: 18957 - DNA, 20 bp, Artificial Sequence
  chemically synthesized
gctttagcctctcaggtagc

SEQ ID NO: 18958 - DNA, 20 bp, Artificial Sequence
  chemically synthesized
ctttagcctctcaggtagct

SEQ ID NO: 18959 - DNA, 20 bp, Artificial Sequence
  chemically synthesized
ctctcaggtagctaggacta

SEQ ID NO: 18960 - DNA, 20 bp, Artificial Sequence
  chemically synthesized
tctcaggtagctaggactac

SEQ ID NO: 18961 - DNA, 20 bp, Artificial Sequence
  chemically synthesized
gtagctaggactacaggtgt

SEQ ID NO: 18962 - DNA, 20 bp, Artificial Sequence
  chemically synthesized
actacaggtgtgagcctcca

SEQ ID NO: 18963 - DNA, 20 bp, Artificial Sequence
  chemically synthesized
caggtgtgagcctccatggc

SEQ ID NO: 18964 - DNA, 20 bp, Artificial Sequence
  chemically synthesized
tgtgagcctccatggccagc

SEQ ID NO: 18965 - DNA, 20 bp, Artificial Sequence
  chemically synthesized
tgagcctccatggccagcta

SEQ ID NO: 18966 - DNA, 20 bp, Artificial Sequence
  chemically synthesized
agaaattttttaaatttctg

SEQ ID NO: 18967 - DNA, 20 bp, Artificial Sequence
  chemically synthesized
tttttaaatttctgtagaaa

SEQ ID NO: 18968 - DNA, 20 bp, Artificial Sequence
  chemically synthesized
ttttaaatttctgtagaaac

SEQ ID NO: 18969 - DNA, 20 bp, Artificial Sequence
  chemically synthesized
tttaaatttctgtagaaaca

SEQ ID NO: 18970 - DNA, 20 bp, Artificial Sequence
  chemically synthesized
cagggtctccctatgttccc

SEQ ID NO: 18971 - DNA, 20 bp, Artificial Sequence
  chemically synthesized
agggtctccctatgttcccc

SEQ ID NO: 18972 - DNA, 20 bp, Artificial Sequence
  chemically synthesized
tctccctatgttccccaggc

SEQ ID NO: 18973 - DNA, 20 bp, Artificial Sequence
  chemically synthesized
ccaggctggtatccaactct

SEQ ID NO: 18974 - DNA, 20 bp, Artificial Sequence
  chemically synthesized
ctcaaacaattctcccacct

SEQ ID NO: 18975 - DNA, 20 bp, Artificial Sequence
  chemically synthesized
tctcccacctcagccttgaa

SEQ ID NO: 18976 - DNA, 20 bp, Artificial Sequence
  chemically synthesized
cctcagccttgaaaagtgtt

SEQ ID NO: 18977 - DNA, 20 bp, Artificial Sequence
  chemically synthesized
cttgaaaagtgttgagatta

SEQ ID NO: 18978 - DNA, 20 bp, Artificial Sequence
  chemically synthesized
ttgaaaagtgttgagattac

SEQ ID NO: 18979 - DNA, 20 bp, Artificial Sequence
  chemically synthesized
acaggtgtgaatcaccatgc

SEQ ID NO: 18980 - DNA, 20 bp, Artificial Sequence
  chemically synthesized
caggtgtgaatcaccatgct

SEQ ID NO: 18981 - DNA, 20 bp, Artificial Sequence
  chemically synthesized
atcaccatgctgggccttga

SEQ ID NO: 18982 - DNA, 20 bp, Artificial Sequence
  chemically synthesized
gggccttgatggatctttaa

SEQ ID NO: 18983 - DNA, 20 bp, Artificial Sequence
  chemically synthesized
ccttgatggatctttaaaag

SEQ ID NO: 18984 - DNA, 20 bp, Artificial Sequence
  chemically synthesized
tgatggatctttaaaagtgg

SEQ ID NO: 18985 - DNA, 20 bp, Artificial Sequence
  chemically synthesized
gatggatctttaaaagtggt

SEQ ID NO: 18986 - DNA, 20 bp, Artificial Sequence
  chemically synthesized
atggatctttaaaagtggtg

SEQ ID NO: 18987 - DNA, 20 bp, Artificial Sequence
  chemically synthesized
tggatctttaaaagtggtgg

SEQ ID NO: 18988 - DNA, 20 bp, Artificial Sequence
  chemically synthesized
ggatctttaaaagtggtggg

SEQ ID NO: 18989 - DNA, 20 bp, Artificial Sequence
  chemically synthesized
tctttaaaagtggtgggggg

SEQ ID NO: 18990 - DNA, 20 bp, Artificial Sequence
  chemically synthesized
ctttaaaagtggtggggggt

SEQ ID NO: 18991 - DNA, 20 bp, Artificial Sequence
  chemically synthesized
ttaaaagtggtggggggtag

SEQ ID NO: 18992 - DNA, 20 bp, Artificial Sequence
  chemically synthesized
gtggtggggggtaggagaaa

SEQ ID NO: 18993 - DNA, 20 bp, Artificial Sequence
  chemically synthesized
ggtggggggtaggagaaaaa

SEQ ID NO: 18994 - DNA, 20 bp, Artificial Sequence
  chemically synthesized
gtggggggtaggagaaaaag

SEQ ID NO: 18995 - DNA, 20 bp, Artificial Sequence
  chemically synthesized
gggggtaggagaaaaagagg

SEQ ID NO: 18996 - DNA, 20 bp, Artificial Sequence
  chemically synthesized
aaaaagaggaagaacaaaaa

SEQ ID NO: 18997 - DNA, 20 bp, Artificial Sequence
  chemically synthesized
gaacaaaaacagtatcacga

SEQ ID NO: 18998 - DNA, 20 bp, Artificial Sequence
  chemically synthesized
tcacgaaagataaacatcgt

SEQ ID NO: 18999 - DNA, 20 bp, Artificial Sequence
  chemically synthesized
cacgaaagataaacatcgtt

SEQ ID NO: 19000 - DNA, 20 bp, Artificial Sequence
  chemically synthesized
agataaacatcgttaggtct

SEQ ID NO: 19001 - DNA, 20 bp, Artificial Sequence
  chemically synthesized
gataaacatcgttaggtctc

SEQ ID NO: 19002 - DNA, 20 bp, Artificial Sequence
  chemically synthesized
aaacatcgttaggtctcggg

SEQ ID NO: 19003 - DNA, 20 bp, Artificial Sequence
  chemically synthesized
aacatcgttaggtctcggga

SEQ ID NO: 19004 - DNA, 20 bp, Artificial Sequence
  chemically synthesized
tcgttaggtctcgggaagga

SEQ ID NO: 19005 - DNA, 20 bp, Artificial Sequence
  chemically synthesized
cgttaggtctcgggaaggat

SEQ ID NO: 19006 - DNA, 20 bp, Artificial Sequence
  chemically synthesized
ggatccttttcattttgctc

SEQ ID NO: 19007 - DNA, 20 bp, Artificial Sequence
  chemically synthesized
atccttttcattttgctcta

SEQ ID NO: 19008 - DNA, 20 bp, Artificial Sequence
  chemically synthesized
tttcattttgctctagagaa

SEQ ID NO: 19009 - DNA, 20 bp, Artificial Sequence
  chemically synthesized
tgctctagagaaaagccatt

SEQ ID NO: 19010 - DNA, 20 bp, Artificial Sequence
  chemically synthesized
acttctgtgttaacaaaaaa

SEQ ID NO: 19011 - DNA, 20 bp, Artificial Sequence
  chemically synthesized
tgtgttaacaaaaaacagcc

SEQ ID NO: 19012 - DNA, 20 bp, Artificial Sequence
  chemically synthesized
gttaacaaaaaacagccgag

SEQ ID NO: 19013 - DNA, 20 bp, Artificial Sequence
  chemically synthesized
caaaaaacagccgagtagcc

SEQ ID NO: 19014 - DNA, 20 bp, Artificial Sequence
  chemically synthesized
agtagcctagtattaaactt

SEQ ID NO: 19015 - DNA, 20 bp, Artificial Sequence
  chemically synthesized
tagcctagtattaaacttta

SEQ ID NO: 19016 - DNA, 20 bp, Artificial Sequence
  chemically synthesized
cctagtattaaactttagag

SEQ ID NO: 19017 - DNA, 20 bp, Artificial Sequence
  chemically synthesized
tttagagcagttgttcttta

SEQ ID NO: 19018 - DNA, 20 bp, Artificial Sequence
  chemically synthesized
gttgttctttacggcaatta

SEQ ID NO: 19019 - DNA, 20 bp, Artificial Sequence
  chemically synthesized
ttgttctttacggcaattac

SEQ ID NO: 19020 - DNA, 20 bp, Artificial Sequence
  chemically synthesized
tgttctttacggcaattaca

SEQ ID NO: 19021 - DNA, 20 bp, Artificial Sequence
  chemically synthesized
gttctttacggcaattacag

SEQ ID NO: 19022 - DNA, 20 bp, Artificial Sequence
  chemically synthesized
acggcaattacaggggcctt

SEQ ID NO: 19023 - DNA, 20 bp, Artificial Sequence
  chemically synthesized
cggcaattacaggggccttc

SEQ ID NO: 19024 - DNA, 20 bp, Artificial Sequence
  chemically synthesized
caattacaggggccttcagg

SEQ ID NO: 19025 - DNA, 20 bp, Artificial Sequence
  chemically synthesized
aggggccttcaggaagctga

SEQ ID NO: 19026 - DNA, 20 bp, Artificial Sequence
  chemically synthesized
ggccttcaggaagctgatgg

SEQ ID NO: 19027 - DNA, 20 bp, Artificial Sequence
  chemically synthesized
aggaagctgatggaagtgtg

SEQ ID NO: 19028 - DNA, 20 bp, Artificial Sequence
  chemically synthesized
gaagtgtgaagtcctcttct

SEQ ID NO: 19029 - DNA, 20 bp, Artificial Sequence
  chemically synthesized
agtgtgaagtcctcttctca

SEQ ID NO: 19030 - DNA, 20 bp, Artificial Sequence
  chemically synthesized
gaagtcctcttctcagagaa

SEQ ID NO: 19031 - DNA, 20 bp, Artificial Sequence
  chemically synthesized
atatacgtgcacctaatttt

SEQ ID NO: 19032 - DNA, 20 bp, Artificial Sequence
  chemically synthesized
atttttagatataatttctg

SEQ ID NO: 19033 - DNA, 20 bp, Artificial Sequence
  chemically synthesized
tttttagatataatttctga

SEQ ID NO: 19034 - DNA, 20 bp, Artificial Sequence
  chemically synthesized
agatataatttctgaaggtt

SEQ ID NO: 19035 - DNA, 20 bp, Artificial Sequence
  chemically synthesized
tgaaggtttagaaactcctt

SEQ ID NO: 19036 - DNA, 20 bp, Artificial Sequence
  chemically synthesized
ccttgagttcacttatatca

SEQ ID NO: 19037 - DNA, 20 bp, Artificial Sequence
  chemically synthesized
tatatcaaagtcctcacctt

SEQ ID NO: 19038 - DNA, 20 bp, Artificial Sequence
  chemically synthesized
cacctttagaactcctgtcc

SEQ ID NO: 19039 - DNA, 20 bp, Artificial Sequence
  chemically synthesized
ctttagaactcctgtcctag

SEQ ID NO: 19040 - DNA, 20 bp, Artificial Sequence
  chemically synthesized
ttagaactcctgtcctagaa

SEQ ID NO: 19041 - DNA, 20 bp, Artificial Sequence
  chemically synthesized
gaactcctgtcctagaagag

SEQ ID NO: 19042 - DNA, 20 bp, Artificial Sequence
  chemically synthesized
ttccataaccactttgactc

SEQ ID NO: 19043 - DNA, 20 bp, Artificial Sequence
  chemically synthesized
gccacttgtaccatgtaatt

SEQ ID NO: 19044 - DNA, 20 bp, Artificial Sequence
  chemically synthesized
cacttgtaccatgtaattca

SEQ ID NO: 19045 - DNA, 20 bp, Artificial Sequence
  chemically synthesized
acttgtaccatgtaattcag

SEQ ID NO: 19046 - DNA, 20 bp, Artificial Sequence
  chemically synthesized
taccatgtaattcagaggtg

SEQ ID NO: 19047 - DNA, 20 bp, Artificial Sequence
  chemically synthesized
taattcagaggtgtagtgtc

SEQ ID NO: 19048 - DNA, 20 bp, Artificial Sequence
  chemically synthesized
agaggtgtagtgtcaagact

SEQ ID NO: 19049 - DNA, 20 bp, Artificial Sequence
  chemically synthesized
gaggtgtagtgtcaagactg

SEQ ID NO: 19050 - DNA, 20 bp, Artificial Sequence
  chemically synthesized
ggtgtagtgtcaagactgag

SEQ ID NO: 19051 - DNA, 20 bp, Artificial Sequence
  chemically synthesized
gtgtagtgtcaagactgagg

SEQ ID NO: 19052 - DNA, 20 bp, Artificial Sequence
  chemically synthesized
tagtgtcaagactgaggagg

SEQ ID NO: 19053 - DNA, 20 bp, Artificial Sequence
  chemically synthesized
tgtcaagactgaggaggaag

SEQ ID NO: 19054 - DNA, 20 bp, Artificial Sequence
  chemically synthesized
gtcaagactgaggaggaagc

SEQ ID NO: 19055 - DNA, 20 bp, Artificial Sequence
  chemically synthesized
ggaagcaggtaaattatgtc

SEQ ID NO: 19056 - DNA, 20 bp, Artificial Sequence
  chemically synthesized
aattatgtccagcaatacgt

SEQ ID NO: 19057 - DNA, 20 bp, Artificial Sequence
  chemically synthesized
tgtccagcaatacgttggct

SEQ ID NO: 19058 - DNA, 20 bp, Artificial Sequence
  chemically synthesized
gtccagcaatacgttggctt

SEQ ID NO: 19059 - DNA, 20 bp, Artificial Sequence
  chemically synthesized
aggcaaaaacaaattgtttc

SEQ ID NO: 19060 - DNA, 20 bp, Artificial Sequence
  chemically synthesized
aattgtttctagtccatttt

SEQ ID NO: 19061 - DNA, 20 bp, Artificial Sequence
  chemically synthesized
ttgtttctagtccattttaa

SEQ ID NO: 19062 - DNA, 20 bp, Artificial Sequence
  chemically synthesized
tgtttctagtccattttaag

SEQ ID NO: 19063 - DNA, 20 bp, Artificial Sequence
  chemically synthesized
gtttctagtccattttaaga

SEQ ID NO: 19064 - DNA, 20 bp, Artificial Sequence
  chemically synthesized
tctagtccattttaagaggg

SEQ ID NO: 19065 - DNA, 20 bp, Artificial Sequence
  chemically synthesized
ttaagagggaagcatttatt

SEQ ID NO: 19066 - DNA, 20 bp, Artificial Sequence
  chemically synthesized
taagagggaagcatttattt

SEQ ID NO: 19067 - DNA, 20 bp, Artificial Sequence
  chemically synthesized
aagagggaagcatttattta

SEQ ID NO: 19068 - DNA, 20 bp, Artificial Sequence
  chemically synthesized
atttagggactacatcgctc

SEQ ID NO: 19069 - DNA, 20 bp, Artificial Sequence
  chemically synthesized
ccttaacatgttaatttctc

SEQ ID NO: 19070 - DNA, 20 bp, Artificial Sequence
  chemically synthesized
ttaacatgttaatttctcca

SEQ ID NO: 19071 - DNA, 20 bp, Artificial Sequence
  chemically synthesized
tccagagtttgtaatgttct

SEQ ID NO: 19072 - DNA, 20 bp, Artificial Sequence
  chemically synthesized
gagtttgtaatgttctgagc

SEQ ID NO: 19073 - DNA, 20 bp, Artificial Sequence
  chemically synthesized
atgttctgagcaagtgtgtg

SEQ ID NO: 19074 - DNA, 20 bp, Artificial Sequence
  chemically synthesized
ttctgagcaagtgtgtgcag

SEQ ID NO: 19075 - DNA, 20 bp, Artificial Sequence
  chemically synthesized
gtgtgcagaagaaatgattg

SEQ ID NO: 19076 - DNA, 20 bp, Artificial Sequence
  chemically synthesized
gcagaagaaatgattgtagt

SEQ ID NO: 19077 - DNA, 20 bp, Artificial Sequence
  chemically synthesized
gaaatgattgtagtaagacc

SEQ ID NO: 19078 - DNA, 20 bp, Artificial Sequence
  chemically synthesized
aaatgattgtagtaagacct

SEQ ID NO: 19079 - DNA, 20 bp, Artificial Sequence
  chemically synthesized
attgtagtaagacctgggca

SEQ ID NO: 19080 - DNA, 20 bp, Artificial Sequence
  chemically synthesized
ttgtagtaagacctgggcaa

SEQ ID NO: 19081 - DNA, 20 bp, Artificial Sequence
  chemically synthesized
gtagtaagacctgggcaaag

SEQ ID NO: 19082 - DNA, 20 bp, Artificial Sequence
  chemically synthesized
agtaagacctgggcaaagga

SEQ ID NO: 19083 - DNA, 20 bp, Artificial Sequence
  chemically synthesized
taagacctgggcaaaggaga

SEQ ID NO: 19084 - DNA, 20 bp, Artificial Sequence
  chemically synthesized
aaacatttttcccccacatt

SEQ ID NO: 19085 - DNA, 20 bp, Artificial Sequence
  chemically synthesized
aacatttttcccccacattt

SEQ ID NO: 19086 - DNA, 20 bp, Artificial Sequence
  chemically synthesized
ttgggcaaaactttccatcc

SEQ ID NO: 19087 - DNA, 20 bp, Artificial Sequence
  chemically synthesized
tgggcaaaactttccatcct

SEQ ID NO: 19088 - DNA, 20 bp, Artificial Sequence
  chemically synthesized
ttccatcctgggtcacacca

SEQ ID NO: 19089 - DNA, 20 bp, Artificial Sequence
  chemically synthesized
ctcctctcctctccctcaac

SEQ ID NO: 19090 - DNA, 20 bp, Artificial Sequence
  chemically synthesized
tcctctccctcaactggtaa

SEQ ID NO: 19091 - DNA, 20 bp, Artificial Sequence
  chemically synthesized
ccaaaacatacctgactact

SEQ ID NO: 19092 - DNA, 20 bp, Artificial Sequence
  chemically synthesized
cttagtacttcccactactg

SEQ ID NO: 19093 - DNA, 20 bp, Artificial Sequence
  chemically synthesized
gtacttcccactactgtgga

SEQ ID NO: 19094 - DNA, 20 bp, Artificial Sequence
  chemically synthesized
cactactgtggatagaattt

SEQ ID NO: 19095 - DNA, 20 bp, Artificial Sequence
  chemically synthesized
ctcattcattgttcataccc

SEQ ID NO: 19096 - DNA, 20 bp, Artificial Sequence
  chemically synthesized
cattcattgttcataccctg

SEQ ID NO: 19097 - DNA, 20 bp, Artificial Sequence
  chemically synthesized
ccctggagacaaaactcctt

SEQ ID NO: 19098 - DNA, 20 bp, Artificial Sequence
  chemically synthesized
cctggagacaaaactcctta

SEQ ID NO: 19099 - DNA, 20 bp, Artificial Sequence
  chemically synthesized
taaggctattaactccccct

SEQ ID NO: 19100 - DNA, 20 bp, Artificial Sequence
  chemically synthesized
tccccctgagcttcacaatc

SEQ ID NO: 19101 - DNA, 20 bp, Artificial Sequence
  chemically synthesized
gcttcacaatctagtccctg

SEQ ID NO: 19102 - DNA, 20 bp, Artificial Sequence
  chemically synthesized
cttcacaatctagtccctgc

SEQ ID NO: 19103 - DNA, 20 bp, Artificial Sequence
  chemically synthesized
tcctctccttttccctctct

SEQ ID NO: 19104 - DNA, 20 bp, Artificial Sequence
  chemically synthesized
ttccctctctgagccccgct

SEQ ID NO: 19105 - DNA, 20 bp, Artificial Sequence
  chemically synthesized
gccccgctcagatcttcgaa

SEQ ID NO: 19106 - DNA, 20 bp, Artificial Sequence
  chemically synthesized
cccgctcagatcttcgaaca

SEQ ID NO: 19107 - DNA, 20 bp, Artificial Sequence
  chemically synthesized
cagagaacacttctgcatct

SEQ ID NO: 19108 - DNA, 20 bp, Artificial Sequence
  chemically synthesized
cttctgcatcttggcatata

SEQ ID NO: 19109 - DNA, 20 bp, Artificial Sequence
  chemically synthesized
gcatatatagttctctcaca

SEQ ID NO: 19110 - DNA, 20 bp, Artificial Sequence
  chemically synthesized
atagaacgctttctcccctt

SEQ ID NO: 19111 - DNA, 20 bp, Artificial Sequence
  chemically synthesized
cctttagctatttatccttc

SEQ ID NO: 19112 - DNA, 20 bp, Artificial Sequence
  chemically synthesized
gctatttatccttcaagtgt

SEQ ID NO: 19113 - DNA, 20 bp, Artificial Sequence
  chemically synthesized
cagctcaaacatctcatcat

SEQ ID NO: 19114 - DNA, 20 bp, Artificial Sequence
  chemically synthesized
gctcaaacatctcatcatta

SEQ ID NO: 19115 - DNA, 20 bp, Artificial Sequence
  chemically synthesized
tcaaacatctcatcattaga

SEQ ID NO: 19116 - DNA, 20 bp, Artificial Sequence
  chemically synthesized
caaacatctcatcattagag

SEQ ID NO: 19117 - DNA, 20 bp, Artificial Sequence
  chemically synthesized
agaggtttttcccaaacctc

SEQ ID NO: 19118 - DNA, 20 bp, Artificial Sequence
  chemically synthesized
gaggtttttcccaaacctct

SEQ ID NO: 19119 - DNA, 20 bp, Artificial Sequence
  chemically synthesized
ttcccaaacctctaggtaac

SEQ ID NO: 19120 - DNA, 20 bp, Artificial Sequence
  chemically synthesized
tcccaaacctctaggtaact

SEQ ID NO: 19121 - DNA, 20 bp, Artificial Sequence
  chemically synthesized
aaacctctaggtaactaggt

SEQ ID NO: 19122 - DNA, 20 bp, Artificial Sequence
  chemically synthesized
agaaaccactccccattcca

SEQ ID NO: 19123 - DNA, 20 bp, Artificial Sequence
  chemically synthesized
ccattccacggtacactgta

SEQ ID NO: 19124 - DNA, 20 bp, Artificial Sequence
  chemically synthesized
cacggtacactgtatagtct

SEQ ID NO: 19125 - DNA, 20 bp, Artificial Sequence
  chemically synthesized
acggtacactgtatagtctt

SEQ ID NO: 19126 - DNA, 20 bp, Artificial Sequence
  chemically synthesized
ctgtatagtcttaggacacc

SEQ ID NO: 19127 - DNA, 20 bp, Artificial Sequence
  chemically synthesized
cttaggacacctggttccct

SEQ ID NO: 19128 - DNA, 20 bp, Artificial Sequence
  chemically synthesized
tacaaatttgtcaattcttg

SEQ ID NO: 19129 - DNA, 20 bp, Artificial Sequence
  chemically synthesized
tttgtcaattcttgaagatt

SEQ ID NO: 19130 - DNA, 20 bp, Artificial Sequence
  chemically synthesized
aattcttgaagattaagaat

SEQ ID NO: 19131 - DNA, 20 bp, Artificial Sequence
  chemically synthesized
actctatctccctcgcctct

SEQ ID NO: 19132 - DNA, 20 bp, Artificial Sequence
  chemically synthesized
tctcagtgcctgatacctaa

SEQ ID NO: 19133 - DNA, 20 bp, Artificial Sequence
  chemically synthesized
atccttactgaataataaaa

SEQ ID NO: 19134 - DNA, 20 bp, Artificial Sequence
  chemically synthesized
taaaatggattaatgaataa

SEQ ID NO: 19135 - DNA, 20 bp, Artificial Sequence
  chemically synthesized
gaataaaagcaataaatttc

SEQ ID NO: 19136 - DNA, 20 bp, Artificial Sequence
  chemically synthesized
aataaaagcaataaatttca

SEQ ID NO: 19137 - DNA, 20 bp, Artificial Sequence
  chemically synthesized
gttaatattaataaattaaa

SEQ ID NO: 19138 - DNA, 20 bp, Artificial Sequence
  chemically synthesized
ttaatattaataaattaaaa

SEQ ID NO: 19139 - DNA, 20 bp, Artificial Sequence
  chemically synthesized
aaattaaaaaggttattttg

SEQ ID NO: 19140 - DNA, 20 bp, Artificial Sequence
  chemically synthesized
aaaaggttattttgaagtct

SEQ ID NO: 19141 - DNA, 20 bp, Artificial Sequence
  chemically synthesized
ttattttgaagtctgagaat

SEQ ID NO: 19142 - DNA, 20 bp, Artificial Sequence
  chemically synthesized
tttcacgtttccattgttca

SEQ ID NO: 19143 - DNA, 20 bp, Artificial Sequence
  chemically synthesized
ttcacgtttccattgttcat

SEQ ID NO: 19144 - DNA, 20 bp, Artificial Sequence
  chemically synthesized
attgttcatgggcaaaattc

SEQ ID NO: 19145 - DNA, 20 bp, Artificial Sequence
  chemically synthesized
gttcatgggcaaaattctgg

SEQ ID NO: 19146 - DNA, 20 bp, Artificial Sequence
  chemically synthesized
atgggcaaaattctggcagc

SEQ ID NO: 19147 - DNA, 20 bp, Artificial Sequence
  chemically synthesized
tgggcaaaattctggcagca

SEQ ID NO: 19148 - DNA, 20 bp, Artificial Sequence
  chemically synthesized
gggcaaaattctggcagcaa

SEQ ID NO: 19149 - DNA, 20 bp, Artificial Sequence
  chemically synthesized
cagcaagggattcttctcct

SEQ ID NO: 19150 - DNA, 20 bp, Artificial Sequence
  chemically synthesized
taagaaaccttttgttttct

SEQ ID NO: 19151 - DNA, 20 bp, Artificial Sequence
  chemically synthesized
gaatacatttccttgtttgc

SEQ ID NO: 19152 - DNA, 20 bp, Artificial Sequence
  chemically synthesized
tccttgtttgccagaaaaca

SEQ ID NO: 19153 - DNA, 20 bp, Artificial Sequence
  chemically synthesized
tgtttgccagaaaacatggt

SEQ ID NO: 19154 - DNA, 20 bp, Artificial Sequence
  chemically synthesized
agaaaacatggtaagataac

SEQ ID NO: 19155 - DNA, 20 bp, Artificial Sequence
  chemically synthesized
aaaacatggtaagataactg

SEQ ID NO: 19156 - DNA, 20 bp, Artificial Sequence
  chemically synthesized
aacatggtaagataactgga

SEQ ID NO: 19157 - DNA, 20 bp, Artificial Sequence
  chemically synthesized
taacattcattttattcatg

SEQ ID NO: 19158 - DNA, 20 bp, Artificial Sequence
  chemically synthesized
ttcatgaagaaactgttatt

SEQ ID NO: 19159 - DNA, 20 bp, Artificial Sequence
  chemically synthesized
aagaaactgttattcagttt

SEQ ID NO: 19160 - DNA, 20 bp, Artificial Sequence
  chemically synthesized
agaaactgttattcagttta

SEQ ID NO: 19161 - DNA, 20 bp, Artificial Sequence
  chemically synthesized
gaaactgttattcagtttaa

SEQ ID NO: 19162 - DNA, 20 bp, Artificial Sequence
  chemically synthesized
aaactgttattcagtttaag

SEQ ID NO: 19163 - DNA, 20 bp, Artificial Sequence
  chemically synthesized
cagtttaaggggttcttttt

SEQ ID NO: 19164 - DNA, 20 bp, Artificial Sequence
  chemically synthesized
ttaaggggttctttttcaga

SEQ ID NO: 19165 - DNA, 20 bp, Artificial Sequence
  chemically synthesized
ggttctttttcagaaagttt

SEQ ID NO: 19166 - DNA, 20 bp, Artificial Sequence
  chemically synthesized
tcagaaagtttcagaaatcc

SEQ ID NO: 19167 - DNA, 20 bp, Artificial Sequence
  chemically synthesized
aatccaagacctttgactgc

SEQ ID NO: 19168 - DNA, 20 bp, Artificial Sequence
  chemically synthesized
gtactgtgttctttcatcta

SEQ ID NO: 19169 - DNA, 20 bp, Artificial Sequence
  chemically synthesized
tactgtgttctttcatctat

SEQ ID NO: 19170 - DNA, 20 bp, Artificial Sequence
  chemically synthesized
ggacatttcctttgaaaact

SEQ ID NO: 19171 - DNA, 20 bp, Artificial Sequence
  chemically synthesized
gacatttcctttgaaaactg

SEQ ID NO: 19172 - DNA, 20 bp, Artificial Sequence
  chemically synthesized
aatatttaattcttacataa

SEQ ID NO: 19173 - DNA, 20 bp, Artificial Sequence
  chemically synthesized
attcttacataatagtaaaa

SEQ ID NO: 19174 - DNA, 20 bp, Artificial Sequence
  chemically synthesized
ataatagtaaaaaagtgaat

SEQ ID NO: 19175 - DNA, 20 bp, Artificial Sequence
  chemically synthesized
gtaaaaaagtgaattggcct

SEQ ID NO: 19176 - DNA, 20 bp, Artificial Sequence
  chemically synthesized
aaagtgaattggccttggaa

SEQ ID NO: 19177 - DNA, 20 bp, Artificial Sequence
  chemically synthesized
cttggaaaagacctaaatcc

SEQ ID NO: 19178 - DNA, 20 bp, Artificial Sequence
  chemically synthesized
aatcaatttgctctatgaac

SEQ ID NO: 19179 - DNA, 20 bp, Artificial Sequence
  chemically synthesized
tcaatttgctctatgaactg

SEQ ID NO: 19180 - DNA, 20 bp, Artificial Sequence
  chemically synthesized
caatttgctctatgaactgg

SEQ ID NO: 19181 - DNA, 20 bp, Artificial Sequence
  chemically synthesized
atttgctctatgaactggag

SEQ ID NO: 19182 - DNA, 20 bp, Artificial Sequence
  chemically synthesized
tgctctatgaactggaggag

SEQ ID NO: 19183 - DNA, 20 bp, Artificial Sequence
  chemically synthesized
gctctatgaactggaggagt

SEQ ID NO: 19184 - DNA, 20 bp, Artificial Sequence
  chemically synthesized
gagtgggattcatgatctct

SEQ ID NO: 19185 - DNA, 20 bp, Artificial Sequence
  chemically synthesized
catatcactactatgaaatg

SEQ ID NO: 19186 - DNA, 20 bp, Artificial Sequence
  chemically synthesized
atatcactactatgaaatgc

SEQ ID NO: 19187 - DNA, 20 bp, Artificial Sequence
  chemically synthesized
tatcactactatgaaatgca

SEQ ID NO: 19188 - DNA, 20 bp, Artificial Sequence
  chemically synthesized
cactactatgaaatgcaggg

SEQ ID NO: 19189 - DNA, 20 bp, Artificial Sequence
  chemically synthesized
aattcaaatcattaaattta

SEQ ID NO: 19190 - DNA, 20 bp, Artificial Sequence
  chemically synthesized
cattaaatttaaagaaacta

SEQ ID NO: 19191 - DNA, 20 bp, Artificial Sequence
  chemically synthesized
taaatttaaagaaactatag

SEQ ID NO: 19192 - DNA, 20 bp, Artificial Sequence
  chemically synthesized
ctatagtggcaatgtattat

SEQ ID NO: 19193 - DNA, 20 bp, Artificial Sequence
  chemically synthesized
tatagtggcaatgtattatt

SEQ ID NO: 19194 - DNA, 20 bp, Artificial Sequence
  chemically synthesized
atgaaaatctcaaaccatac

SEQ ID NO: 19195 - DNA, 20 bp, Artificial Sequence
  chemically synthesized
tgaaaatctcaaaccatacc

SEQ ID NO: 19196 - DNA, 20 bp, Artificial Sequence
  chemically synthesized
gctatgataatattaaaata

SEQ ID NO: 19197 - DNA, 20 bp, Artificial Sequence
  chemically synthesized
attaaaataaagatacattg

SEQ ID NO: 19198 - DNA, 20 bp, Artificial Sequence
  chemically synthesized
aacttgtgtaaatcacattg

SEQ ID NO: 19199 - DNA, 20 bp, Artificial Sequence
  chemically synthesized
acttgtgtaaatcacattgt

SEQ ID NO: 19200 - DNA, 20 bp, Artificial Sequence
  chemically synthesized
cttgtgtaaatcacattgtg

SEQ ID NO: 19201 - DNA, 20 bp, Artificial Sequence
  chemically synthesized
aacacttcccttccccttga

SEQ ID NO: 19202 - DNA, 20 bp, Artificial Sequence
  chemically synthesized
acacttcccttccccttgaa

SEQ ID NO: 19203 - DNA, 20 bp, Artificial Sequence
  chemically synthesized
cacttcccttccccttgaaa

SEQ ID NO: 19204 - DNA, 20 bp, Artificial Sequence
  chemically synthesized
tccccttgaaagggaaatga

SEQ ID NO: 19205 - DNA, 20 bp, Artificial Sequence
  chemically synthesized
aaagggaaatgatagaaaat

SEQ ID NO: 19206 - DNA, 20 bp, Artificial Sequence
  chemically synthesized
atgatagaaaataagtatta

SEQ ID NO: 19207 - DNA, 20 bp, Artificial Sequence
  chemically synthesized
tgatagaaaataagtattaa

SEQ ID NO: 19208 - DNA, 20 bp, Artificial Sequence
  chemically synthesized
tagaaaataagtattaaagg

SEQ ID NO: 19209 - DNA, 20 bp, Artificial Sequence
  chemically synthesized
aataagtattaaaggcagct

SEQ ID NO: 19210 - DNA, 20 bp, Artificial Sequence
  chemically synthesized
ataagtattaaaggcagctt

SEQ ID NO: 19211 - DNA, 20 bp, Artificial Sequence
  chemically synthesized
taagtattaaaggcagctta

SEQ ID NO: 19212 - DNA, 20 bp, Artificial Sequence
  chemically synthesized
aagtattaaaggcagcttag

SEQ ID NO: 19213 - DNA, 20 bp, Artificial Sequence
  chemically synthesized
ttttcaaaaaaaaatccatt

SEQ ID NO: 19214 - DNA, 20 bp, Artificial Sequence
  chemically synthesized
attgagcattttctatgtac

SEQ ID NO: 19215 - DNA, 20 bp, Artificial Sequence
  chemically synthesized
ttgagcattttctatgtacc

SEQ ID NO: 19216 - DNA, 20 bp, Artificial Sequence
  chemically synthesized
ctatgtaccaggcactgttc

SEQ ID NO: 19217 - DNA, 20 bp, Artificial Sequence
  chemically synthesized
caggcactgttctagaccct

SEQ ID NO: 19218 - DNA, 20 bp, Artificial Sequence
  chemically synthesized
acacacatgctactgattat

SEQ ID NO: 19219 - DNA, 20 bp, Artificial Sequence
  chemically synthesized
ataagatccataaaataact

SEQ ID NO: 19220 - DNA, 20 bp, Artificial Sequence
  chemically synthesized
ataaaataacttagtttcac

SEQ ID NO: 19221 - DNA, 20 bp, Artificial Sequence
  chemically synthesized
tagtttcactggcgtgttcc

SEQ ID NO: 19222 - DNA, 20 bp, Artificial Sequence
  chemically synthesized
actggcgtgttcccagtgcc

SEQ ID NO: 19223 - DNA, 20 bp, Artificial Sequence
  chemically synthesized
ctggcgtgttcccagtgccc

SEQ ID NO: 19224 - DNA, 20 bp, Artificial Sequence
  chemically synthesized
tgttcccagtgcccaggtaa

SEQ ID NO: 19225 - DNA, 20 bp, Artificial Sequence
  chemically synthesized
attaatgtttgttaaatgat

SEQ ID NO: 19226 - DNA, 20 bp, Artificial Sequence
  chemically synthesized
tgtttgttaaatgatgagaa

SEQ ID NO: 19227 - DNA, 20 bp, Artificial Sequence
  chemically synthesized
tttgttaaatgatgagaaaa

SEQ ID NO: 19228 - DNA, 20 bp, Artificial Sequence
  chemically synthesized
ttgttaaatgatgagaaaag

SEQ ID NO: 19229 - DNA, 20 bp, Artificial Sequence
  chemically synthesized
taaatgatgagaaaagagga

SEQ ID NO: 19230 - DNA, 20 bp, Artificial Sequence
  chemically synthesized
atgatgagaaaagaggaaag

SEQ ID NO: 19231 - DNA, 20 bp, Artificial Sequence
  chemically synthesized
atgagaaaagaggaaagcag

SEQ ID NO: 19232 - DNA, 20 bp, Artificial Sequence
  chemically synthesized
tgagaaaagaggaaagcaga

SEQ ID NO: 19233 - DNA, 20 bp, Artificial Sequence
  chemically synthesized
gagaaaagaggaaagcagaa

SEQ ID NO: 19234 - DNA, 20 bp, Artificial Sequence
  chemically synthesized
agaaaagaggaaagcagaag

SEQ ID NO: 19235 - DNA, 20 bp, Artificial Sequence
  chemically synthesized
aaagcagaaggggctctgct

SEQ ID NO: 19236 - DNA, 20 bp, Artificial Sequence
  chemically synthesized
aagcagaaggggctctgctc

SEQ ID NO: 19237 - DNA, 20 bp, Artificial Sequence
  chemically synthesized
gaaggggctctgctcaggtg

SEQ ID NO: 19238 - DNA, 20 bp, Artificial Sequence
  chemically synthesized
aaggggctctgctcaggtgc

SEQ ID NO: 19239 - DNA, 20 bp, Artificial Sequence
  chemically synthesized
ctcaggtgcaggaacttgtg

SEQ ID NO: 19240 - DNA, 20 bp, Artificial Sequence
  chemically synthesized
caggtgcaggaacttgtgca

SEQ ID NO: 19241 - DNA, 20 bp, Artificial Sequence
  chemically synthesized
gaacttgtgcagagatcttc

SEQ ID NO: 19242 - DNA, 20 bp, Artificial Sequence
  chemically synthesized
agatcttctggactgattcc

SEQ ID NO: 19243 - DNA, 20 bp, Artificial Sequence
  chemically synthesized
gactgattcccagtgctaac

SEQ ID NO: 19244 - DNA, 20 bp, Artificial Sequence
  chemically synthesized
cagtgctaacaagtcccttc

SEQ ID NO: 19245 - DNA, 20 bp, Artificial Sequence
  chemically synthesized
ttccagttttatccaccaat

SEQ ID NO: 19246 - DNA, 20 bp, Artificial Sequence
  chemically synthesized
caccaataagctatgtcctt

SEQ ID NO: 19247 - DNA, 20 bp, Artificial Sequence
  chemically synthesized
ttgagctcctgcccactctc

SEQ ID NO: 19248 - DNA, 20 bp, Artificial Sequence
  chemically synthesized
gagctcctgcccactctcta

SEQ ID NO: 19249 - DNA, 20 bp, Artificial Sequence
  chemically synthesized
ctagagaaaacttttatttc

SEQ ID NO: 19250 - DNA, 20 bp, Artificial Sequence
  chemically synthesized
tagagaaaacttttatttca

SEQ ID NO: 19251 - DNA, 20 bp, Artificial Sequence
  chemically synthesized
ttttatttcaaggcatactc

SEQ ID NO: 19252 - DNA, 20 bp, Artificial Sequence
  chemically synthesized
tttatttcaaggcatactcc

SEQ ID NO: 19253 - DNA, 20 bp, Artificial Sequence
  chemically synthesized
actccgggattcacatgtga

SEQ ID NO: 19254 - DNA, 20 bp, Artificial Sequence
  chemically synthesized
tccgggattcacatgtgata

SEQ ID NO: 19255 - DNA, 20 bp, Artificial Sequence
  chemically synthesized
ggattcacatgtgatagaga

SEQ ID NO: 19256 - DNA, 20 bp, Artificial Sequence
  chemically synthesized
gatagagatggttctgttcc

SEQ ID NO: 19257 - DNA, 20 bp, Artificial Sequence
  chemically synthesized
atagagatggttctgttccc

SEQ ID NO: 19258 - DNA, 20 bp, Artificial Sequence
  chemically synthesized
ggttctgttcccaggaactt

SEQ ID NO: 19259 - DNA, 20 bp, Artificial Sequence
  chemically synthesized
gttctgttcccaggaacttt

SEQ ID NO: 19260 - DNA, 20 bp, Artificial Sequence
  chemically synthesized
ctttgggcatatttaaaaac

SEQ ID NO: 19261 - DNA, 20 bp, Artificial Sequence
  chemically synthesized
ggcatatttaaaaactggac

SEQ ID NO: 19262 - DNA, 20 bp, Artificial Sequence
  chemically synthesized
ggactggaaaaatttgtgac

SEQ ID NO: 19263 - DNA, 20 bp, Artificial Sequence
  chemically synthesized
gaaaaatttgtgactagaaa

SEQ ID NO: 19264 - DNA, 20 bp, Artificial Sequence
  chemically synthesized
aaaaatttgtgactagaaaa

SEQ ID NO: 19265 - DNA, 20 bp, Artificial Sequence
  chemically synthesized
ttaaaaacacatgctcattt

SEQ ID NO: 19266 - DNA, 20 bp, Artificial Sequence
  chemically synthesized
taaaaacacatgctcatttc

SEQ ID NO: 19267 - DNA, 20 bp, Artificial Sequence
  chemically synthesized
cacatgctcatttcaggata

SEQ ID NO: 19268 - DNA, 20 bp, Artificial Sequence
  chemically synthesized
atttcaggataaagatctct

SEQ ID NO: 19269 - DNA, 20 bp, Artificial Sequence
  chemically synthesized
tttcaggataaagatctctg

SEQ ID NO: 19270 - DNA, 20 bp, Artificial Sequence
  chemically synthesized
ggataaagatctctgaggaa

SEQ ID NO: 19271 - DNA, 20 bp, Artificial Sequence
  chemically synthesized
agaatacaaaataatttaaa

SEQ ID NO: 19272 - DNA, 20 bp, Artificial Sequence
  chemically synthesized
aataatttaaaaagaaacaa

SEQ ID NO: 19273 - DNA, 20 bp, Artificial Sequence
  chemically synthesized
ttaaaaagaaacaacagaaa

SEQ ID NO: 19274 - DNA, 20 bp, Artificial Sequence
  chemically synthesized
taaaaagaaacaacagaaac

SEQ ID NO: 19275 - DNA, 20 bp, Artificial Sequence
  chemically synthesized
atacttcacttctctgtaat

SEQ ID NO: 19276 - DNA, 20 bp, Artificial Sequence
  chemically synthesized
tacttcacttctctgtaata

SEQ ID NO: 19277 - DNA, 20 bp, Artificial Sequence
  chemically synthesized
taataaggtttctgtcctcc

SEQ ID NO: 19278 - DNA, 20 bp, Artificial Sequence
  chemically synthesized
gattctttctcactaaacta

SEQ ID NO: 19279 - DNA, 20 bp, Artificial Sequence
  chemically synthesized
ttctttctcactaaactaca

SEQ ID NO: 19280 - DNA, 20 bp, Artificial Sequence
  chemically synthesized
ctcactaaactacagagaat

SEQ ID NO: 19281 - DNA, 20 bp, Artificial Sequence
  chemically synthesized
gcattctgtccacttctaca

SEQ ID NO: 19282 - DNA, 20 bp, Artificial Sequence
  chemically synthesized
cattctgtccacttctacat

SEQ ID NO: 19283 - DNA, 20 bp, Artificial Sequence
  chemically synthesized
ttttatgaatgcatacacac

SEQ ID NO: 19284 - DNA, 20 bp, Artificial Sequence
  chemically synthesized
atacacacgagaactttgaa

SEQ ID NO: 19285 - DNA, 20 bp, Artificial Sequence
  chemically synthesized
acacgagaactttgaacagt

SEQ ID NO: 19286 - DNA, 20 bp, Artificial Sequence
  chemically synthesized
gaactttgaacagttagtat

SEQ ID NO: 19287 - DNA, 20 bp, Artificial Sequence
  chemically synthesized
aactttgaacagttagtata

SEQ ID NO: 19288 - DNA, 20 bp, Artificial Sequence
  chemically synthesized
taaggtgaattctgattttt

SEQ ID NO: 19289 - DNA, 20 bp, Artificial Sequence
  chemically synthesized
tatataatgcatttaatttt

SEQ ID NO: 19290 - DNA, 20 bp, Artificial Sequence
  chemically synthesized
atttaattttgagattatgc

SEQ ID NO: 19291 - DNA, 20 bp, Artificial Sequence
  chemically synthesized
gagattatgctggctctgat

SEQ ID NO: 19292 - DNA, 20 bp, Artificial Sequence
  chemically synthesized
tgctggctctgattagccaa

SEQ ID NO: 19293 - DNA, 20 bp, Artificial Sequence
  chemically synthesized
tggctctgattagccaaaag

SEQ ID NO: 19294 - DNA, 20 bp, Artificial Sequence
  chemically synthesized
ggctctgattagccaaaaga

SEQ ID NO: 19295 - DNA, 20 bp, Artificial Sequence
  chemically synthesized
tctgattagccaaaagaagg

SEQ ID NO: 19296 - DNA, 20 bp, Artificial Sequence
  chemically synthesized
ggaagtaatatatcacattc

SEQ ID NO: 19297 - DNA, 20 bp, Artificial Sequence
  chemically synthesized
tcacattctggttattattt

SEQ ID NO: 19298 - DNA, 20 bp, Artificial Sequence
  chemically synthesized
ggttattatttcagatcctt

SEQ ID NO: 19299 - DNA, 20 bp, Artificial Sequence
  chemically synthesized
gatcctttagattactgtaa

SEQ ID NO: 19300 - DNA, 20 bp, Artificial Sequence
  chemically synthesized
ttactgtaatagacatgaaa

SEQ ID NO: 19301 - DNA, 20 bp, Artificial Sequence
  chemically synthesized
cacaacacatgacataattt

SEQ ID NO: 19302 - DNA, 20 bp, Artificial Sequence
  chemically synthesized
tcagatcgtttaaatcacac

SEQ ID NO: 19303 - DNA, 20 bp, Artificial Sequence
  chemically synthesized
agtcatcactgccatttacc

SEQ ID NO: 19304 - DNA, 20 bp, Artificial Sequence
  chemically synthesized
actgccatttacccagcaat

SEQ ID NO: 19305 - DNA, 20 bp, Artificial Sequence
  chemically synthesized
ccatttacccagcaatcagt

SEQ ID NO: 19306 - DNA, 20 bp, Artificial Sequence
  chemically synthesized
atcagttggcttgattcttc

SEQ ID NO: 19307 - DNA, 20 bp, Artificial Sequence
  chemically synthesized
gcttgattcttcaagatctt

SEQ ID NO: 19308 - DNA, 20 bp, Artificial Sequence
  chemically synthesized
cttgattcttcaagatcttg

SEQ ID NO: 19309 - DNA, 20 bp, Artificial Sequence
  chemically synthesized
cttcaagatcttgaggaact

SEQ ID NO: 19310 - DNA, 20 bp, Artificial Sequence
  chemically synthesized
ctttgctaatgttccttcaa

SEQ ID NO: 19311 - DNA, 20 bp, Artificial Sequence
  chemically synthesized
tagtcttgacacttttaaac

SEQ ID NO: 19312 - DNA, 20 bp, Artificial Sequence
  chemically synthesized
gtcttgacacttttaaacta

SEQ ID NO: 19313 - DNA, 20 bp, Artificial Sequence
  chemically synthesized
cttgacacttttaaactaga

SEQ ID NO: 19314 - DNA, 20 bp, Artificial Sequence
  chemically synthesized
actagagagtataaacccac

SEQ ID NO: 19315 - DNA, 20 bp, Artificial Sequence
  chemically synthesized
ctagagagtataaacccaca

SEQ ID NO: 19316 - DNA, 20 bp, Artificial Sequence
  chemically synthesized
ggaattgttttataatttta

SEQ ID NO: 19317 - DNA, 20 bp, Artificial Sequence
  chemically synthesized
tttcaaaatcatttacattg

SEQ ID NO: 19318 - DNA, 20 bp, Artificial Sequence
  chemically synthesized
ctaccttgccttctcttacc

SEQ ID NO: 19319 - DNA, 20 bp, Artificial Sequence
  chemically synthesized
ttgccttctcttacccagca

SEQ ID NO: 19320 - DNA, 20 bp, Artificial Sequence
  chemically synthesized
ttctcttacccagcacagat

SEQ ID NO: 19321 - DNA, 20 bp, Artificial Sequence
  chemically synthesized
tctcttacccagcacagatg

SEQ ID NO: 19322 - DNA, 20 bp, Artificial Sequence
  chemically synthesized
ttattttataattcctacat

SEQ ID NO: 19323 - DNA, 20 bp, Artificial Sequence
  chemically synthesized
ttataattcctacataagca

SEQ ID NO: 19324 - DNA, 20 bp, Artificial Sequence
  chemically synthesized
cctacataagcatagcattg

SEQ ID NO: 19325 - DNA, 20 bp, Artificial Sequence
  chemically synthesized
aaaaattactttcattctga

SEQ ID NO: 19326 - DNA, 20 bp, Artificial Sequence
  chemically synthesized
aaaattactttcattctgaa

SEQ ID NO: 19327 - DNA, 20 bp, Artificial Sequence
  chemically synthesized
aattactttcattctgaaag

SEQ ID NO: 19328 - DNA, 20 bp, Artificial Sequence
  chemically synthesized
ctttcattctgaaaggagca

SEQ ID NO: 19329 - DNA, 20 bp, Artificial Sequence
  chemically synthesized
agcacagtattttgcctttt

SEQ ID NO: 19330 - DNA, 20 bp, Artificial Sequence
  chemically synthesized
acagtattttgccttttgag

SEQ ID NO: 19331 - DNA, 20 bp, Artificial Sequence
  chemically synthesized
tgaattaaaacattaattcc

SEQ ID NO: 19332 - DNA, 20 bp, Artificial Sequence
  chemically synthesized
tgtgaatatgaaacattctt

SEQ ID NO: 19333 - DNA, 20 bp, Artificial Sequence
  chemically synthesized
gcatttcatataattactaa

SEQ ID NO: 19334 - DNA, 20 bp, Artificial Sequence
  chemically synthesized
atataattactaacagaatg

SEQ ID NO: 19335 - DNA, 20 bp, Artificial Sequence
  chemically synthesized
ataattactaacagaatgta

SEQ ID NO: 19336 - DNA, 20 bp, Artificial Sequence
  chemically synthesized
tactaacagaatgtagagtt

SEQ ID NO: 19337 - DNA, 20 bp, Artificial Sequence
  chemically synthesized
actaacagaatgtagagttg

SEQ ID NO: 19338 - DNA, 20 bp, Artificial Sequence
  chemically synthesized
gtagagttgaggtttccaac

SEQ ID NO: 19339 - DNA, 20 bp, Artificial Sequence
  chemically synthesized
tttaattatactattttgct

SEQ ID NO: 19340 - DNA, 20 bp, Artificial Sequence
  chemically synthesized
atttctatgttgtcataata

SEQ ID NO: 19341 - DNA, 20 bp, Artificial Sequence
  chemically synthesized
taatttaaatgcacattcca

SEQ ID NO: 19342 - DNA, 20 bp, Artificial Sequence
  chemically synthesized
aaatgcacattccatggcaa

SEQ ID NO: 19343 - DNA, 20 bp, Artificial Sequence
  chemically synthesized
tccctcttcaacacatacac

SEQ ID NO: 19344 - DNA, 20 bp, Artificial Sequence
  chemically synthesized
catacacaagtctgtattca

SEQ ID NO: 19345 - DNA, 20 bp, Artificial Sequence
  chemically synthesized
gtattcatagcctgttgtaa

SEQ ID NO: 19346 - DNA, 20 bp, Artificial Sequence
  chemically synthesized
catagcctgttgtaatagac

SEQ ID NO: 19347 - DNA, 20 bp, Artificial Sequence
  chemically synthesized
atagcctgttgtaatagaca

SEQ ID NO: 19348 - DNA, 20 bp, Artificial Sequence
  chemically synthesized
gtaatagacaaggttaaatg

SEQ ID NO: 19349 - DNA, 20 bp, Artificial Sequence
  chemically synthesized
taaatgctttcctcactcac

SEQ ID NO: 19350 - DNA, 20 bp, Artificial Sequence
  chemically synthesized
tttcctcactcactagcaat

SEQ ID NO: 19351 - DNA, 20 bp, Artificial Sequence
  chemically synthesized
cactagcaattggttatcac

SEQ ID NO: 19352 - DNA, 20 bp, Artificial Sequence
  chemically synthesized
ctagcaattggttatcacta

SEQ ID NO: 19353 - DNA, 20 bp, Artificial Sequence
  chemically synthesized
agcaattggttatcactaga

SEQ ID NO: 19354 - DNA, 20 bp, Artificial Sequence
  chemically synthesized
aaatcttactctacattcct

SEQ ID NO: 19355 - DNA, 20 bp, Artificial Sequence
  chemically synthesized
ctctacattcctcagtcacc

SEQ ID NO: 19356 - DNA, 20 bp, Artificial Sequence
  chemically synthesized
cattcctcagtcacctagtg

SEQ ID NO: 19357 - DNA, 20 bp, Artificial Sequence
  chemically synthesized
attcctcagtcacctagtga

SEQ ID NO: 19358 - DNA, 20 bp, Artificial Sequence
  chemically synthesized
aaggtgtactgatccacctt

SEQ ID NO: 19359 - DNA, 20 bp, Artificial Sequence
  chemically synthesized
aggtgtactgatccaccttc

SEQ ID NO: 19360 - DNA, 20 bp, Artificial Sequence
  chemically synthesized
gtgtactgatccaccttcag

SEQ ID NO: 19361 - DNA, 20 bp, Artificial Sequence
  chemically synthesized
tactgatccaccttcaggag

SEQ ID NO: 19362 - DNA, 20 bp, Artificial Sequence
  chemically synthesized
ggagcagtacaaacctttat

SEQ ID NO: 19363 - DNA, 20 bp, Artificial Sequence
  chemically synthesized
acctttattggtcacttccc

SEQ ID NO: 19364 - DNA, 20 bp, Artificial Sequence
  chemically synthesized
tcacttcccaagcaacttca

SEQ ID NO: 19365 - DNA, 20 bp, Artificial Sequence
  chemically synthesized
acttcccaagcaacttcaaa

SEQ ID NO: 19366 - DNA, 20 bp, Artificial Sequence
  chemically synthesized
tcccaagcaacttcaaagag

SEQ ID NO: 19367 - DNA, 20 bp, Artificial Sequence
  chemically synthesized
aaagagcagtaactcctcca

SEQ ID NO: 19368 - DNA, 20 bp, Artificial Sequence
  chemically synthesized
aagagcagtaactcctccac

SEQ ID NO: 19369 - DNA, 20 bp, Artificial Sequence
  chemically synthesized
agcagtaactcctccacagg

SEQ ID NO: 19370 - DNA, 20 bp, Artificial Sequence
  chemically synthesized
gaagttcttcgacttcccac

SEQ ID NO: 19371 - DNA, 20 bp, Artificial Sequence
  chemically synthesized
aagttcttcgacttcccact

SEQ ID NO: 19372 - DNA, 20 bp, Artificial Sequence
  chemically synthesized
agttcttcgacttcccactg

SEQ ID NO: 19373 - DNA, 20 bp, Artificial Sequence
  chemically synthesized
tcttcgacttcccactgggg

SEQ ID NO: 19374 - DNA, 20 bp, Artificial Sequence
  chemically synthesized
tcccactggggaagcccacc

SEQ ID NO: 19375 - DNA, 20 bp, Artificial Sequence
  chemically synthesized
cccactggggaagcccaccc

SEQ ID NO: 19376 - DNA, 20 bp, Artificial Sequence
  chemically synthesized
ccactggggaagcccaccca

SEQ ID NO: 19377 - DNA, 20 bp, Artificial Sequence
  chemically synthesized
aagcccacccagggatgtta

SEQ ID NO: 19378 - DNA, 20 bp, Artificial Sequence
  chemically synthesized
gcccacccagggatgttaca

SEQ ID NO: 19379 - DNA, 20 bp, Artificial Sequence
  chemically synthesized
ccacccagggatgttacaga

SEQ ID NO: 19380 - DNA, 20 bp, Artificial Sequence
  chemically synthesized
cacccagggatgttacagag

SEQ ID NO: 19381 - DNA, 20 bp, Artificial Sequence
  chemically synthesized
acccagggatgttacagaga

SEQ ID NO: 19382 - DNA, 20 bp, Artificial Sequence
  chemically synthesized
gggatgttacagagagggat

SEQ ID NO: 19383 - DNA, 20 bp, Artificial Sequence
  chemically synthesized
acagagagggatcggcctcg

SEQ ID NO: 19384 - DNA, 20 bp, Artificial Sequence
  chemically synthesized
gcctcgaagcattcttctta

SEQ ID NO: 19385 - DNA, 20 bp, Artificial Sequence
  chemically synthesized
cattcttcttacagtcctcc

SEQ ID NO: 19386 - DNA, 20 bp, Artificial Sequence
  chemically synthesized
ctttgaattcctgtttcaat

SEQ ID NO: 19387 - DNA, 20 bp, Artificial Sequence
  chemically synthesized
gtttcaattagttgtaatcc

SEQ ID NO: 19388 - DNA, 20 bp, Artificial Sequence
  chemically synthesized
tttcaattagttgtaatccc

SEQ ID NO: 19389 - DNA, 20 bp, Artificial Sequence
  chemically synthesized
tcaattagttgtaatcccag

SEQ ID NO: 19390 - DNA, 20 bp, Artificial Sequence
  chemically synthesized
attagttgtaatcccaggag

SEQ ID NO: 19391 - DNA, 20 bp, Artificial Sequence
  chemically synthesized
tagttgtaatcccaggagaa

SEQ ID NO: 19392 - DNA, 20 bp, Artificial Sequence
  chemically synthesized
tcccaggagaagagaactta

SEQ ID NO: 19393 - DNA, 20 bp, Artificial Sequence
  chemically synthesized
cccaggagaagagaacttac

SEQ ID NO: 19394 - DNA, 20 bp, Artificial Sequence
  chemically synthesized
aagagaacttacaggcacaa

SEQ ID NO: 19395 - DNA, 20 bp, Artificial Sequence
  chemically synthesized
gaacttacaggcacaaaagt

SEQ ID NO: 19396 - DNA, 20 bp, Artificial Sequence
  chemically synthesized
acttacaggcacaaaagtta

SEQ ID NO: 19397 - DNA, 20 bp, Artificial Sequence
  chemically synthesized
acaggcacaaaagttagagt

SEQ ID NO: 19398 - DNA, 20 bp, Artificial Sequence
  chemically synthesized
ggcacaaaagttagagttgg

SEQ ID NO: 19399 - DNA, 20 bp, Artificial Sequence
  chemically synthesized
cacaaaagttagagttggta

SEQ ID NO: 19400 - DNA, 20 bp, Artificial Sequence
  chemically synthesized
gttagagttggtagagttac

SEQ ID NO: 19401 - DNA, 20 bp, Artificial Sequence
  chemically synthesized
ttagagttggtagagttacc

SEQ ID NO: 19402 - DNA, 20 bp, Artificial Sequence
  chemically synthesized
ttggtagagttaccaggctt

SEQ ID NO: 19403 - DNA, 20 bp, Artificial Sequence
  chemically synthesized
gtagagttaccaggctttgg

SEQ ID NO: 19404 - DNA, 20 bp, Artificial Sequence
  chemically synthesized
caggctttggtagcttctct

SEQ ID NO: 19405 - DNA, 20 bp, Artificial Sequence
  chemically synthesized
aggctttggtagcttctctt

SEQ ID NO: 19406 - DNA, 20 bp, Artificial Sequence
  chemically synthesized
agcttctcttgggaataaac

SEQ ID NO: 19407 - DNA, 20 bp, Artificial Sequence
  chemically synthesized
ttctcttgggaataaactag

SEQ ID NO: 19408 - DNA, 20 bp, Artificial Sequence
  chemically synthesized
gaaatcttatgtgcttccca

SEQ ID NO: 19409 - DNA, 20 bp, Artificial Sequence
  chemically synthesized
tgtgcttcccacagaattcc

SEQ ID NO: 19410 - DNA, 20 bp, Artificial Sequence
  chemically synthesized
gcttcccacagaattcctgg

SEQ ID NO: 19411 - DNA, 20 bp, Artificial Sequence
  chemically synthesized
tcccacagaattcctggtgg

SEQ ID NO: 19412 - DNA, 20 bp, Artificial Sequence
  chemically synthesized
cccacagaattcctggtgga

SEQ ID NO: 19413 - DNA, 20 bp, Artificial Sequence
  chemically synthesized
cacagaattcctggtggaag

SEQ ID NO: 19414 - DNA, 20 bp, Artificial Sequence
  chemically synthesized
acagaattcctggtggaagg

SEQ ID NO: 19415 - DNA, 20 bp, Artificial Sequence
  chemically synthesized
cctcctctttctcgtctttc

SEQ ID NO: 19416 - DNA, 20 bp, Artificial Sequence
  chemically synthesized
ctcctctttctcgtctttct

SEQ ID NO: 19417 - DNA, 20 bp, Artificial Sequence
  chemically synthesized
ctctttctcgtctttctggg

SEQ ID NO: 19418 - DNA, 20 bp, Artificial Sequence
  chemically synthesized
tctttctcgtctttctgggc

SEQ ID NO: 19419 - DNA, 20 bp, Artificial Sequence
  chemically synthesized
tctttctgggcaggtattgt

SEQ ID NO: 19420 - DNA, 20 bp, Artificial Sequence
  chemically synthesized
ctttctgggcaggtattgtg

SEQ ID NO: 19421 - DNA, 20 bp, Artificial Sequence
  chemically synthesized
ctgggcaggtattgtgagga

SEQ ID NO: 19422 - DNA, 20 bp, Artificial Sequence
  chemically synthesized
gaggacggtatctgccctgt

SEQ ID NO: 19423 - DNA, 20 bp, Artificial Sequence
  chemically synthesized
ccgtcctcacaatacctgcc

SEQ ID NO: 19424 - DNA, 20 bp, Artificial Sequence
  chemically synthesized
cctcacaatacctgcccaga

SEQ ID NO: 19425 - DNA, 20 bp, Artificial Sequence
  chemically synthesized
caatacctgcccagaaagac

SEQ ID NO: 19426 - DNA, 20 bp, Artificial Sequence
  chemically synthesized
acctgcccagaaagacgaga

SEQ ID NO: 19427 - DNA, 20 bp, Artificial Sequence
  chemically synthesized
ctgcccagaaagacgagaaa

SEQ ID NO: 19428 - DNA, 20 bp, Artificial Sequence
  chemically synthesized
tgcccagaaagacgagaaag

SEQ ID NO: 19429 - DNA, 20 bp, Artificial Sequence
  chemically synthesized
cccagaaagacgagaaagag

SEQ ID NO: 19430 - DNA, 20 bp, Artificial Sequence
  chemically synthesized
ccagaaagacgagaaagagg

SEQ ID NO: 19431 - DNA, 20 bp, Artificial Sequence
  chemically synthesized
gaaagacgagaaagaggagg

SEQ ID NO: 19432 - DNA, 20 bp, Artificial Sequence
  chemically synthesized
ggaagaattcctccttccac

SEQ ID NO: 19433 - DNA, 20 bp, Artificial Sequence
  chemically synthesized
gaagaattcctccttccacc

SEQ ID NO: 19434 - DNA, 20 bp, Artificial Sequence
  chemically synthesized
tccttccaccaggaattctg

SEQ ID NO: 19435 - DNA, 20 bp, Artificial Sequence
  chemically synthesized
ccttccaccaggaattctgt

SEQ ID NO: 19436 - DNA, 20 bp, Artificial Sequence
  chemically synthesized
tccaccaggaattctgtggg

SEQ ID NO: 19437 - DNA, 20 bp, Artificial Sequence
  chemically synthesized
gaattctgtgggaagcacat

SEQ ID NO: 19438 - DNA, 20 bp, Artificial Sequence
  chemically synthesized
cacataagatttcatgctac

SEQ ID NO: 19439 - DNA, 20 bp, Artificial Sequence
  chemically synthesized
catgctactagtttattccc

SEQ ID NO: 19440 - DNA, 20 bp, Artificial Sequence
  chemically synthesized
tgctactagtttattcccaa

SEQ ID NO: 19441 - DNA, 20 bp, Artificial Sequence
  chemically synthesized
tactagtttattcccaagag

SEQ ID NO: 19442 - DNA, 20 bp, Artificial Sequence
  chemically synthesized
attcccaagagaagctacca

SEQ ID NO: 19443 - DNA, 20 bp, Artificial Sequence
  chemically synthesized
caagagaagctaccaaagcc

SEQ ID NO: 19444 - DNA, 20 bp, Artificial Sequence
  chemically synthesized
actctaacttttgtgcctgt

SEQ ID NO: 19445 - DNA, 20 bp, Artificial Sequence
  chemically synthesized
gcctgtaagttctcttctcc

SEQ ID NO: 19446 - DNA, 20 bp, Artificial Sequence
  chemically synthesized
cctgtaagttctcttctcct

SEQ ID NO: 19447 - DNA, 20 bp, Artificial Sequence
  chemically synthesized
gggattacaactaattgaaa

SEQ ID NO: 19448 - DNA, 20 bp, Artificial Sequence
  chemically synthesized
ggattacaactaattgaaac

SEQ ID NO: 19449 - DNA, 20 bp, Artificial Sequence
  chemically synthesized
ctaattgaaacaggaattca

SEQ ID NO: 19450 - DNA, 20 bp, Artificial Sequence
  chemically synthesized
taattgaaacaggaattcaa

SEQ ID NO: 19451 - DNA, 20 bp, Artificial Sequence
  chemically synthesized
attgaaacaggaattcaaag

SEQ ID NO: 19452 - DNA, 20 bp, Artificial Sequence
  chemically synthesized
acaggaattcaaaggagtct

SEQ ID NO: 19453 - DNA, 20 bp, Artificial Sequence
  chemically synthesized
aggaattcaaaggagtctcg

SEQ ID NO: 19454 - DNA, 20 bp, Artificial Sequence
  chemically synthesized
ggaattcaaaggagtctcgg

SEQ ID NO: 19455 - DNA, 20 bp, Artificial Sequence
  chemically synthesized
aaggagtctcggaggactgt

SEQ ID NO: 19456 - DNA, 20 bp, Artificial Sequence
  chemically synthesized
gagtctcggaggactgtaag

SEQ ID NO: 19457 - DNA, 20 bp, Artificial Sequence
  chemically synthesized
gactgtaagaagaatgcttc

SEQ ID NO: 19458 - DNA, 20 bp, Artificial Sequence
  chemically synthesized
actgtaagaagaatgcttcg

SEQ ID NO: 19459 - DNA, 20 bp, Artificial Sequence
  chemically synthesized
atccctctctgtaacatccc

SEQ ID NO: 19460 - DNA, 20 bp, Artificial Sequence
  chemically synthesized
tccctctctgtaacatccct

SEQ ID NO: 19461 - DNA, 20 bp, Artificial Sequence
  chemically synthesized
ctctctgtaacatccctggg

SEQ ID NO: 19462 - DNA, 20 bp, Artificial Sequence
  chemically synthesized
tctctgtaacatccctgggt

SEQ ID NO: 19463 - DNA, 20 bp, Artificial Sequence
  chemically synthesized
catccctgggtgggcttccc

SEQ ID NO: 19464 - DNA, 20 bp, Artificial Sequence
  chemically synthesized
ccctgggtgggcttccccag

SEQ ID NO: 19465 - DNA, 20 bp, Artificial Sequence
  chemically synthesized
cctgggtgggcttccccagt

SEQ ID NO: 19466 - DNA, 20 bp, Artificial Sequence
  chemically synthesized
gggtgggcttccccagtggg

SEQ ID NO: 19467 - DNA, 20 bp, Artificial Sequence
  chemically synthesized
gcttccccagtgggaagtcg

SEQ ID NO: 19468 - DNA, 20 bp, Artificial Sequence
  chemically synthesized
ggaagtcgaagaacttcctg

SEQ ID NO: 19469 - DNA, 20 bp, Artificial Sequence
  chemically synthesized
aagtcgaagaacttcctgtg

SEQ ID NO: 19470 - DNA, 20 bp, Artificial Sequence
  chemically synthesized
agtcgaagaacttcctgtgg

SEQ ID NO: 19471 - DNA, 20 bp, Artificial Sequence
  chemically synthesized
tcgaagaacttcctgtggag

SEQ ID NO: 19472 - DNA, 20 bp, Artificial Sequence
  chemically synthesized
ggaggagttactgctctttg

SEQ ID NO: 19473 - DNA, 20 bp, Artificial Sequence
  chemically synthesized
tactgctctttgaagttgct

SEQ ID NO: 19474 - DNA, 20 bp, Artificial Sequence
  chemically synthesized
actgctctttgaagttgctt

SEQ ID NO: 19475 - DNA, 20 bp, Artificial Sequence
  chemically synthesized
gctctttgaagttgcttggg

SEQ ID NO: 19476 - DNA, 20 bp, Artificial Sequence
  chemically synthesized
tgcttgggaagtgaccaata

SEQ ID NO: 19477 - DNA, 20 bp, Artificial Sequence
  chemically synthesized
gcttgggaagtgaccaataa

SEQ ID NO: 19478 - DNA, 20 bp, Artificial Sequence
  chemically synthesized
aaaggtttgtactgctcctg

SEQ ID NO: 19479 - DNA, 20 bp, Artificial Sequence
  chemically synthesized
aaggtttgtactgctcctga

SEQ ID NO: 19480 - DNA, 20 bp, Artificial Sequence
  chemically synthesized
gtttgtactgctcctgaagg

SEQ ID NO: 19481 - DNA, 20 bp, Artificial Sequence
  chemically synthesized
tactgctcctgaaggtggat

SEQ ID NO: 19482 - DNA, 20 bp, Artificial Sequence
  chemically synthesized
gtggatcagtacaccttcac

SEQ ID NO: 19483 - DNA, 20 bp, Artificial Sequence
  chemically synthesized
tggatcagtacaccttcact

SEQ ID NO: 19484 - DNA, 20 bp, Artificial Sequence
  chemically synthesized
tacaccttcactaggtgact

SEQ ID NO: 19485 - DNA, 20 bp, Artificial Sequence
  chemically synthesized
acaccttcactaggtgactg

SEQ ID NO: 19486 - DNA, 20 bp, Artificial Sequence
  chemically synthesized
cactaggtgactgaggaatg

SEQ ID NO: 19487 - DNA, 20 bp, Artificial Sequence
  chemically synthesized
ctaggtgactgaggaatgta

SEQ ID NO: 19488 - DNA, 20 bp, Artificial Sequence
  chemically synthesized
gtgactgaggaatgtagagt

SEQ ID NO: 19489 - DNA, 20 bp, Artificial Sequence
  chemically synthesized
gaatgtagagtaagatttca

SEQ ID NO: 19490 - DNA, 20 bp, Artificial Sequence
  chemically synthesized
agatttcacagataactctc

SEQ ID NO: 19491 - DNA, 20 bp, Artificial Sequence
  chemically synthesized
ctctagtgataaccaattgc

SEQ ID NO: 19492 - DNA, 20 bp, Artificial Sequence
  chemically synthesized
agtgataaccaattgctagt

SEQ ID NO: 19493 - DNA, 20 bp, Artificial Sequence
  chemically synthesized
ataaccaattgctagtgagt

SEQ ID NO: 19494 - DNA, 20 bp, Artificial Sequence
  chemically synthesized
taaccaattgctagtgagtg

SEQ ID NO: 19495 - DNA, 20 bp, Artificial Sequence
  chemically synthesized
caattgctagtgagtgagga

SEQ ID NO: 19496 - DNA, 20 bp, Artificial Sequence
  chemically synthesized
gagtgaggaaagcatttaaa

SEQ ID NO: 19497 - DNA, 20 bp, Artificial Sequence
  chemically synthesized
atttaaacggaatatatatt

SEQ ID NO: 19498 - DNA, 20 bp, Artificial Sequence
  chemically synthesized
tttaaacggaatatatattt

SEQ ID NO: 19499 - DNA, 20 bp, Artificial Sequence
  chemically synthesized
tttaaccttgtctattacaa

SEQ ID NO: 19500 - DNA, 20 bp, Artificial Sequence
  chemically synthesized
ttaaccttgtctattacaac

SEQ ID NO: 19501 - DNA, 20 bp, Artificial Sequence
  chemically synthesized
attacaacaggctatgaata

SEQ ID NO: 19502 - DNA, 20 bp, Artificial Sequence
  chemically synthesized
acagacttgtgtatgtgttg

SEQ ID NO: 19503 - DNA, 20 bp, Artificial Sequence
  chemically synthesized
agacttgtgtatgtgttgaa

SEQ ID NO: 19504 - DNA, 20 bp, Artificial Sequence
  chemically synthesized
gacttgtgtatgtgttgaag

SEQ ID NO: 19505 - DNA, 20 bp, Artificial Sequence
  chemically synthesized
acttgtgtatgtgttgaaga

SEQ ID NO: 19506 - DNA, 20 bp, Artificial Sequence
  chemically synthesized
ttgtgtatgtgttgaagagg

SEQ ID NO: 19507 - DNA, 20 bp, Artificial Sequence
  chemically synthesized
gtatgtgttgaagagggaga

SEQ ID NO: 19508 - DNA, 20 bp, Artificial Sequence
  chemically synthesized
agggagaaagttgaaaatat

SEQ ID NO: 19509 - DNA, 20 bp, Artificial Sequence
  chemically synthesized
gaaaatattagccattgcca

SEQ ID NO: 19510 - DNA, 20 bp, Artificial Sequence
  chemically synthesized
aaatccatattatgacaaca

SEQ ID NO: 19511 - DNA, 20 bp, Artificial Sequence
  chemically synthesized
tatgacaacatagaaataaa

SEQ ID NO: 19512 - DNA, 20 bp, Artificial Sequence
  chemically synthesized
ttttgttttaaaatttttct

SEQ ID NO: 19513 - DNA, 20 bp, Artificial Sequence
  chemically synthesized
taaaatttttctcagcaaaa

SEQ ID NO: 19514 - DNA, 20 bp, Artificial Sequence
  chemically synthesized
tataattaaacattttattt

SEQ ID NO: 19515 - DNA, 20 bp, Artificial Sequence
  chemically synthesized
ataattaaacattttatttt

SEQ ID NO: 19516 - DNA, 20 bp, Artificial Sequence
  chemically synthesized
attaaacattttattttagg

SEQ ID NO: 19517 - DNA, 20 bp, Artificial Sequence
  chemically synthesized
taggaagatgtatatgtgat

SEQ ID NO: 19518 - DNA, 20 bp, Artificial Sequence
  chemically synthesized
gatgtatatgtgattagaac

SEQ ID NO: 19519 - DNA, 20 bp, Artificial Sequence
  chemically synthesized
tatatgtgattagaaccagt

SEQ ID NO: 19520 - DNA, 20 bp, Artificial Sequence
  chemically synthesized
acctcaactctacattctgt

SEQ ID NO: 19521 - DNA, 20 bp, Artificial Sequence
  chemically synthesized
agtaattatatgaaatgctt

SEQ ID NO: 19522 - DNA, 20 bp, Artificial Sequence
  chemically synthesized
gaatgtttcatattcacaat

SEQ ID NO: 19523 - DNA, 20 bp, Artificial Sequence
  chemically synthesized
tttcatattcacaattagct

SEQ ID NO: 19524 - DNA, 20 bp, Artificial Sequence
  chemically synthesized
ttggaattaatgttttaatt

SEQ ID NO: 19525 - DNA, 20 bp, Artificial Sequence
  chemically synthesized
tggaattaatgttttaattc

SEQ ID NO: 19526 - DNA, 20 bp, Artificial Sequence
  chemically synthesized
gaattaatgttttaattcag

SEQ ID NO: 19527 - DNA, 20 bp, Artificial Sequence
  chemically synthesized
ttaattcaggagcttctcaa

SEQ ID NO: 19528 - DNA, 20 bp, Artificial Sequence
  chemically synthesized
taattcaggagcttctcaaa

SEQ ID NO: 19529 - DNA, 20 bp, Artificial Sequence
  chemically synthesized
gcaaaatactgtgctccttt

SEQ ID NO: 19530 - DNA, 20 bp, Artificial Sequence
  chemically synthesized
ctgtgctcctttcagaatga

SEQ ID NO: 19531 - DNA, 20 bp, Artificial Sequence
  chemically synthesized
tcttcaatgctatgcttatg

SEQ ID NO: 19532 - DNA, 20 bp, Artificial Sequence
  chemically synthesized
cttcaatgctatgcttatgt

SEQ ID NO: 19533 - DNA, 20 bp, Artificial Sequence
  chemically synthesized
tatgtaggaattataaaata

SEQ ID NO: 19534 - DNA, 20 bp, Artificial Sequence
  chemically synthesized
aaattgataaaacaatttgc

SEQ ID NO: 19535 - DNA, 20 bp, Artificial Sequence
  chemically synthesized
tgataaaacaatttgcgagt

SEQ ID NO: 19536 - DNA, 20 bp, Artificial Sequence
  chemically synthesized
gataaaacaatttgcgagtg

SEQ ID NO: 19537 - DNA, 20 bp, Artificial Sequence
  chemically synthesized
aggtataacctcatctgtgc

SEQ ID NO: 19538 - DNA, 20 bp, Artificial Sequence
  chemically synthesized
ggtataacctcatctgtgct

SEQ ID NO: 19539 - DNA, 20 bp, Artificial Sequence
  chemically synthesized
taacctcatctgtgctgggt

SEQ ID NO: 19540 - DNA, 20 bp, Artificial Sequence
  chemically synthesized
acctcatctgtgctgggtaa

SEQ ID NO: 19541 - DNA, 20 bp, Artificial Sequence
  chemically synthesized
tcatctgtgctgggtaagag

SEQ ID NO: 19542 - DNA, 20 bp, Artificial Sequence
  chemically synthesized
catctgtgctgggtaagaga

SEQ ID NO: 19543 - DNA, 20 bp, Artificial Sequence
  chemically synthesized
tgtgctgggtaagagaaggc

SEQ ID NO: 19544 - DNA, 20 bp, Artificial Sequence
  chemically synthesized
gtgctgggtaagagaaggca

SEQ ID NO: 19545 - DNA, 20 bp, Artificial Sequence
  chemically synthesized
ctgggtaagagaaggcaagg

SEQ ID NO: 19546 - DNA, 20 bp, Artificial Sequence
  chemically synthesized
gggtaagagaaggcaaggta

SEQ ID NO: 19547 - DNA, 20 bp, Artificial Sequence
  chemically synthesized
tgtaaatgattttgaaaata

SEQ ID NO: 19548 - DNA, 20 bp, Artificial Sequence
  chemically synthesized
aattataaaacaattccttg

SEQ ID NO: 19549 - DNA, 20 bp, Artificial Sequence
  chemically synthesized
attataaaacaattccttgt

SEQ ID NO: 19550 - DNA, 20 bp, Artificial Sequence
  chemically synthesized
ccttgtgggtttatactctc

SEQ ID NO: 19551 - DNA, 20 bp, Artificial Sequence
  chemically synthesized
gtttatactctctagtttaa

SEQ ID NO: 19552 - DNA, 20 bp, Artificial Sequence
  chemically synthesized
ctctctagtttaaaagtgtc

SEQ ID NO: 19553 - DNA, 20 bp, Artificial Sequence
  chemically synthesized
taaaagtgtcaagactattg

SEQ ID NO: 19554 - DNA, 20 bp, Artificial Sequence
  chemically synthesized
aaaagtgtcaagactattga

SEQ ID NO: 19555 - DNA, 20 bp, Artificial Sequence
  chemically synthesized
caagactattgaaggaacat

SEQ ID NO: 19556 - DNA, 20 bp, Artificial Sequence
  chemically synthesized
ctattgaaggaacattagca

SEQ ID NO: 19557 - DNA, 20 bp, Artificial Sequence
  chemically synthesized
aaggaacattagcaaagaaa

SEQ ID NO: 19558 - DNA, 20 bp, Artificial Sequence
  chemically synthesized
cattagcaaagaaaaagtca

SEQ ID NO: 19559 - DNA, 20 bp, Artificial Sequence
  chemically synthesized
aagaaaaagtcatggttttg

SEQ ID NO: 19560 - DNA, 20 bp, Artificial Sequence
  chemically synthesized
agaaaaagtcatggttttga

SEQ ID NO: 19561 - DNA, 20 bp, Artificial Sequence
  chemically synthesized
aagtcatggttttgaaggct

SEQ ID NO: 19562 - DNA, 20 bp, Artificial Sequence
  chemically synthesized
ttttgaaggctgagttcctc

SEQ ID NO: 19563 - DNA, 20 bp, Artificial Sequence
  chemically synthesized
ctgagttcctcaagatcttg

SEQ ID NO: 19564 - DNA, 20 bp, Artificial Sequence
  chemically synthesized
cctcaagatcttgaagaatc

SEQ ID NO: 19565 - DNA, 20 bp, Artificial Sequence
  chemically synthesized
gaatcaagccaactgattgc

SEQ ID NO: 19566 - DNA, 20 bp, Artificial Sequence
  chemically synthesized
aatcaagccaactgattgct

SEQ ID NO: 19567 - DNA, 20 bp, Artificial Sequence
  chemically synthesized
ccaactgattgctgggtaaa

SEQ ID NO: 19568 - DNA, 20 bp, Artificial Sequence
  chemically synthesized
actgattgctgggtaaatgg

SEQ ID NO: 19569 - DNA, 20 bp, Artificial Sequence
  chemically synthesized
ttactatttcatgtctatta

SEQ ID NO: 19570 - DNA, 20 bp, Artificial Sequence
  chemically synthesized
atgtctattacagtaatcta

SEQ ID NO: 19571 - DNA, 20 bp, Artificial Sequence
  chemically synthesized
tgtctattacagtaatctaa

SEQ ID NO: 19572 - DNA, 20 bp, Artificial Sequence
  chemically synthesized
aaaggatctgaaataataac

SEQ ID NO: 19573 - DNA, 20 bp, Artificial Sequence
  chemically synthesized
gatatattacttccttcttt

SEQ ID NO: 19574 - DNA, 20 bp, Artificial Sequence
  chemically synthesized
acttccttcttttggctaat

SEQ ID NO: 19575 - DNA, 20 bp, Artificial Sequence
  chemically synthesized
ttccttcttttggctaatca

SEQ ID NO: 19576 - DNA, 20 bp, Artificial Sequence
  chemically synthesized
ttcttttggctaatcagagc

SEQ ID NO: 19577 - DNA, 20 bp, Artificial Sequence
  chemically synthesized
aaaattaaatgcattatata

SEQ ID NO: 19578 - DNA, 20 bp, Artificial Sequence
  chemically synthesized
tggcatgcattctgaaaaat

SEQ ID NO: 19579 - DNA, 20 bp, Artificial Sequence
  chemically synthesized
caccttatactaactgttca

SEQ ID NO: 19580 - DNA, 20 bp, Artificial Sequence
  chemically synthesized
attcataaaatcaaaattaa

SEQ ID NO: 19581 - DNA, 20 bp, Artificial Sequence
  chemically synthesized
aaaagtcaattttgcctatg

SEQ ID NO: 19582 - DNA, 20 bp, Artificial Sequence
  chemically synthesized
agtcaattttgcctatgtag

SEQ ID NO: 19583 - DNA, 20 bp, Artificial Sequence
  chemically synthesized
caattttgcctatgtagaag

SEQ ID NO: 19584 - DNA, 20 bp, Artificial Sequence
  chemically synthesized
tttgcctatgtagaagtgga

SEQ ID NO: 19585 - DNA, 20 bp, Artificial Sequence
  chemically synthesized
gaagtggacagaatgcatat

SEQ ID NO: 19586 - DNA, 20 bp, Artificial Sequence
  chemically synthesized
agtggacagaatgcatataa

SEQ ID NO: 19587 - DNA, 20 bp, Artificial Sequence
  chemically synthesized
agaatgcatataagagaaca

SEQ ID NO: 19588 - DNA, 20 bp, Artificial Sequence
  chemically synthesized
gcatataagagaacaaagca

SEQ ID NO: 19589 - DNA, 20 bp, Artificial Sequence
  chemically synthesized
aagcacggtcttattctctg

SEQ ID NO: 19590 - DNA, 20 bp, Artificial Sequence
  chemically synthesized
cggtcttattctctgtagtt

SEQ ID NO: 19591 - DNA, 20 bp, Artificial Sequence
  chemically synthesized
cttattctctgtagtttagt

SEQ ID NO: 19592 - DNA, 20 bp, Artificial Sequence
  chemically synthesized
ttctctgtagtttagtgaga

SEQ ID NO: 19593 - DNA, 20 bp, Artificial Sequence
  chemically synthesized
tagtttagtgagaaagaatc

SEQ ID NO: 19594 - DNA, 20 bp, Artificial Sequence
  chemically synthesized
agtttagtgagaaagaatct

SEQ ID NO: 19595 - DNA, 20 bp, Artificial Sequence
  chemically synthesized
tttagtgagaaagaatctag

SEQ ID NO: 19596 - DNA, 20 bp, Artificial Sequence
  chemically synthesized
ttagtgagaaagaatctagg

SEQ ID NO: 19597 - DNA, 20 bp, Artificial Sequence
  chemically synthesized
tgagaaagaatctaggagga

SEQ ID NO: 19598 - DNA, 20 bp, Artificial Sequence
  chemically synthesized
ggaggacagaaaccttatta

SEQ ID NO: 19599 - DNA, 20 bp, Artificial Sequence
  chemically synthesized
aggacagaaaccttattaca

SEQ ID NO: 19600 - DNA, 20 bp, Artificial Sequence
  chemically synthesized
acagaaaccttattacagag

SEQ ID NO: 19601 - DNA, 20 bp, Artificial Sequence
  chemically synthesized
aaccttattacagagaagtg

SEQ ID NO: 19602 - DNA, 20 bp, Artificial Sequence
  chemically synthesized
ttattttgtattcttttcct

SEQ ID NO: 19603 - DNA, 20 bp, Artificial Sequence
  chemically synthesized
attttgtattcttttcctca

SEQ ID NO: 19604 - DNA, 20 bp, Artificial Sequence
  chemically synthesized
agagatctttatcctgaaat

SEQ ID NO: 19605 - DNA, 20 bp, Artificial Sequence
  chemically synthesized
tgtttttaatgtcctttttc

SEQ ID NO: 19606 - DNA, 20 bp, Artificial Sequence
  chemically synthesized
tttctagtcacaaatttttc

SEQ ID NO: 19607 - DNA, 20 bp, Artificial Sequence
  chemically synthesized
agtcacaaatttttccagtc

SEQ ID NO: 19608 - DNA, 20 bp, Artificial Sequence
  chemically synthesized
ccagtttttaaatatgccca

SEQ ID NO: 19609 - DNA, 20 bp, Artificial Sequence
  chemically synthesized
ttaaatatgcccaaagttcc

SEQ ID NO: 19610 - DNA, 20 bp, Artificial Sequence
  chemically synthesized
taaatatgcccaaagttcct

SEQ ID NO: 19611 - DNA, 20 bp, Artificial Sequence
  chemically synthesized
atgcccaaagttcctgggaa

SEQ ID NO: 19612 - DNA, 20 bp, Artificial Sequence
  chemically synthesized
tctctatcacatgtgaatcc

SEQ ID NO: 19613 - DNA, 20 bp, Artificial Sequence
  chemically synthesized
tctatcacatgtgaatcccg

SEQ ID NO: 19614 - DNA, 20 bp, Artificial Sequence
  chemically synthesized
cggagtatgccttgaaataa

SEQ ID NO: 19615 - DNA, 20 bp, Artificial Sequence
  chemically synthesized
cttgaaataaaagttttctc

SEQ ID NO: 19616 - DNA, 20 bp, Artificial Sequence
  chemically synthesized
tgaaataaaagttttctcta

SEQ ID NO: 19617 - DNA, 20 bp, Artificial Sequence
  chemically synthesized
aaataaaagttttctctaga

SEQ ID NO: 19618 - DNA, 20 bp, Artificial Sequence
  chemically synthesized
taaaagttttctctagagag

SEQ ID NO: 19619 - DNA, 20 bp, Artificial Sequence
  chemically synthesized
aaaagttttctctagagagt

SEQ ID NO: 19620 - DNA, 20 bp, Artificial Sequence
  chemically synthesized
agttttctctagagagtggg

SEQ ID NO: 19621 - DNA, 20 bp, Artificial Sequence
  chemically synthesized
gttttctctagagagtgggc

SEQ ID NO: 19622 - DNA, 20 bp, Artificial Sequence
  chemically synthesized
tttctctagagagtgggcag

SEQ ID NO: 19623 - DNA, 20 bp, Artificial Sequence
  chemically synthesized
tagagagtgggcaggagctc

SEQ ID NO: 19624 - DNA, 20 bp, Artificial Sequence
  chemically synthesized
agagagtgggcaggagctca

SEQ ID NO: 19625 - DNA, 20 bp, Artificial Sequence
  chemically synthesized
tgggcaggagctcaaggaca

SEQ ID NO: 19626 - DNA, 20 bp, Artificial Sequence
  chemically synthesized
agctcaaggacatagcttat

SEQ ID NO: 19627 - DNA, 20 bp, Artificial Sequence
  chemically synthesized
tcaaggacatagcttattgg

SEQ ID NO: 19628 - DNA, 20 bp, Artificial Sequence
  chemically synthesized
agcttattggtggataaaac

SEQ ID NO: 19629 - DNA, 20 bp, Artificial Sequence
  chemically synthesized
ttattggtggataaaactgg

SEQ ID NO: 19630 - DNA, 20 bp, Artificial Sequence
  chemically synthesized
tattggtggataaaactgga

SEQ ID NO: 19631 - DNA, 20 bp, Artificial Sequence
  chemically synthesized
attggtggataaaactggaa

SEQ ID NO: 19632 - DNA, 20 bp, Artificial Sequence
  chemically synthesized
taaaactggaagggacttgt

SEQ ID NO: 19633 - DNA, 20 bp, Artificial Sequence
  chemically synthesized
tggaagggacttgttagcac

SEQ ID NO: 19634 - DNA, 20 bp, Artificial Sequence
  chemically synthesized
ggaagggacttgttagcact

SEQ ID NO: 19635 - DNA, 20 bp, Artificial Sequence
  chemically synthesized
gacttgttagcactgggaat

SEQ ID NO: 19636 - DNA, 20 bp, Artificial Sequence
  chemically synthesized
gttagcactgggaatcagtc

SEQ ID NO: 19637 - DNA, 20 bp, Artificial Sequence
  chemically synthesized
agcactgggaatcagtccag

SEQ ID NO: 19638 - DNA, 20 bp, Artificial Sequence
  chemically synthesized
agtccagaagatctctgcac

SEQ ID NO: 19639 - DNA, 20 bp, Artificial Sequence
  chemically synthesized
ctgcacaagttcctgcacct

SEQ ID NO: 19640 - DNA, 20 bp, Artificial Sequence
  chemically synthesized
cacaagttcctgcacctgag

SEQ ID NO: 19641 - DNA, 20 bp, Artificial Sequence
  chemically synthesized
caagttcctgcacctgagca

SEQ ID NO: 19642 - DNA, 20 bp, Artificial Sequence
  chemically synthesized
catcatttaacaaacattaa

SEQ ID NO: 19643 - DNA, 20 bp, Artificial Sequence
  chemically synthesized
tcatttaacaaacattaatg

SEQ ID NO: 19644 - DNA, 20 bp, Artificial Sequence
  chemically synthesized
attaatggagcactgttacc

SEQ ID NO: 19645 - DNA, 20 bp, Artificial Sequence
  chemically synthesized
ttaatggagcactgttacct

SEQ ID NO: 19646 - DNA, 20 bp, Artificial Sequence
  chemically synthesized
gagcactgttacctgggcac

SEQ ID NO: 19647 - DNA, 20 bp, Artificial Sequence
  chemically synthesized
agcactgttacctgggcact

SEQ ID NO: 19648 - DNA, 20 bp, Artificial Sequence
  chemically synthesized
cctgggcactgggaacacgc

SEQ ID NO: 19649 - DNA, 20 bp, Artificial Sequence
  chemically synthesized
gggaacacgccagtgaaact

SEQ ID NO: 19650 - DNA, 20 bp, Artificial Sequence
  chemically synthesized
agtgaaactaagttatttta

SEQ ID NO: 19651 - DNA, 20 bp, Artificial Sequence
  chemically synthesized
tattttatggatcttataat

SEQ ID NO: 19652 - DNA, 20 bp, Artificial Sequence
  chemically synthesized
tttatggatcttataatcag

SEQ ID NO: 19653 - DNA, 20 bp, Artificial Sequence
  chemically synthesized
agtagcatgtgtgttgatct

SEQ ID NO: 19654 - DNA, 20 bp, Artificial Sequence
  chemically synthesized
gtagcatgtgtgttgatctc

SEQ ID NO: 19655 - DNA, 20 bp, Artificial Sequence
  chemically synthesized
tagcatgtgtgttgatctca

SEQ ID NO: 19656 - DNA, 20 bp, Artificial Sequence
  chemically synthesized
tgtgtgttgatctcagggtc

SEQ ID NO: 19657 - DNA, 20 bp, Artificial Sequence
  chemically synthesized
gttgatctcagggtctagaa

SEQ ID NO: 19658 - DNA, 20 bp, Artificial Sequence
  chemically synthesized
tcagggtctagaacagtgcc

SEQ ID NO: 19659 - DNA, 20 bp, Artificial Sequence
  chemically synthesized
ctagaacagtgcctggtaca

SEQ ID NO: 19660 - DNA, 20 bp, Artificial Sequence
  chemically synthesized
ggtacatagaaaatgctcaa

SEQ ID NO: 19661 - DNA, 20 bp, Artificial Sequence
  chemically synthesized
aaatttgtttttcaacccct

SEQ ID NO: 19662 - DNA, 20 bp, Artificial Sequence
  chemically synthesized
ttttctatcatttccctttc

SEQ ID NO: 19663 - DNA, 20 bp, Artificial Sequence
  chemically synthesized
tttctatcatttccctttca

SEQ ID NO: 19664 - DNA, 20 bp, Artificial Sequence
  chemically synthesized
ttctatcatttccctttcaa

SEQ ID NO: 19665 - DNA, 20 bp, Artificial Sequence
  chemically synthesized
tctatcatttccctttcaag

SEQ ID NO: 19666 - DNA, 20 bp, Artificial Sequence
  chemically synthesized
atcatttccctttcaagggg

SEQ ID NO: 19667 - DNA, 20 bp, Artificial Sequence
  chemically synthesized
tcatttccctttcaagggga

SEQ ID NO: 19668 - DNA, 20 bp, Artificial Sequence
  chemically synthesized
catttccctttcaaggggaa

SEQ ID NO: 19669 - DNA, 20 bp, Artificial Sequence
  chemically synthesized
ttccctttcaaggggaaggg

SEQ ID NO: 19670 - DNA, 20 bp, Artificial Sequence
  chemically synthesized
ggggaagggaagtgtttttg

SEQ ID NO: 19671 - DNA, 20 bp, Artificial Sequence
  chemically synthesized
ggaagggaagtgtttttgtg

SEQ ID NO: 19672 - DNA, 20 bp, Artificial Sequence
  chemically synthesized
aagggaagtgtttttgtgga

SEQ ID NO: 19673 - DNA, 20 bp, Artificial Sequence
  chemically synthesized
agggaagtgtttttgtggag

SEQ ID NO: 19674 - DNA, 20 bp, Artificial Sequence
  chemically synthesized
ccccacaatgtgatttacac

SEQ ID NO: 19675 - DNA, 20 bp, Artificial Sequence
  chemically synthesized
tctttattttaatattatca

SEQ ID NO: 19676 - DNA, 20 bp, Artificial Sequence
  chemically synthesized
attttaatattatcatagcc

SEQ ID NO: 19677 - DNA, 20 bp, Artificial Sequence
  chemically synthesized
aatattatcatagcctggta

SEQ ID NO: 19678 - DNA, 20 bp, Artificial Sequence
  chemically synthesized
atcatagcctggtatggttt

SEQ ID NO: 19679 - DNA, 20 bp, Artificial Sequence
  chemically synthesized
tatggtttgagattttcata

SEQ ID NO: 19680 - DNA, 20 bp, Artificial Sequence
  chemically synthesized
gtttgagattttcatataga

SEQ ID NO: 19681 - DNA, 20 bp, Artificial Sequence
  chemically synthesized
ctaataatacattgccacta

SEQ ID NO: 19682 - DNA, 20 bp, Artificial Sequence
  chemically synthesized
ttttacttccctgcatttca

SEQ ID NO: 19683 - DNA, 20 bp, Artificial Sequence
  chemically synthesized
tacttccctgcatttcatag

SEQ ID NO: 19684 - DNA, 20 bp, Artificial Sequence
  chemically synthesized
gcatttcatagtagtgatat

SEQ ID NO: 19685 - DNA, 20 bp, Artificial Sequence
  chemically synthesized
catttcatagtagtgatatg

SEQ ID NO: 19686 - DNA, 20 bp, Artificial Sequence
  chemically synthesized
agtagtgatatgaggtatct

SEQ ID NO: 19687 - DNA, 20 bp, Artificial Sequence
  chemically synthesized
tagtgatatgaggtatctta

SEQ ID NO: 19688 - DNA, 20 bp, Artificial Sequence
  chemically synthesized
gatcatgaatcccactcctc

SEQ ID NO: 19689 - DNA, 20 bp, Artificial Sequence
  chemically synthesized
aatcccactcctccagttca

SEQ ID NO: 19690 - DNA, 20 bp, Artificial Sequence
  chemically synthesized
tcccactcctccagttcata

SEQ ID NO: 19691 - DNA, 20 bp, Artificial Sequence
  chemically synthesized
tcatagagcaaattgattcg

SEQ ID NO: 19692 - DNA, 20 bp, Artificial Sequence
  chemically synthesized
atagagcaaattgattcgta

SEQ ID NO: 19693 - DNA, 20 bp, Artificial Sequence
  chemically synthesized
tagagcaaattgattcgtag

SEQ ID NO: 19694 - DNA, 20 bp, Artificial Sequence
  chemically synthesized
cgtagaggtatttaatgatc

SEQ ID NO: 19695 - DNA, 20 bp, Artificial Sequence
  chemically synthesized
gtatttaatgatcaagcaaa

SEQ ID NO: 19696 - DNA, 20 bp, Artificial Sequence
  chemically synthesized
tttaatgatcaagcaaatgg

SEQ ID NO: 19697 - DNA, 20 bp, Artificial Sequence
  chemically synthesized
taatgatcaagcaaatggca

SEQ ID NO: 19698 - DNA, 20 bp, Artificial Sequence
  chemically synthesized
gatcaagcaaatggcagagt

SEQ ID NO: 19699 - DNA, 20 bp, Artificial Sequence
  chemically synthesized
atcaagcaaatggcagagtt

SEQ ID NO: 19700 - DNA, 20 bp, Artificial Sequence
  chemically synthesized
gcaaatggcagagttaggac

SEQ ID NO: 19701 - DNA, 20 bp, Artificial Sequence
  chemically synthesized
caaatggcagagttaggacc

SEQ ID NO: 19702 - DNA, 20 bp, Artificial Sequence
  chemically synthesized
gcagagttaggaccaggatt

SEQ ID NO: 19703 - DNA, 20 bp, Artificial Sequence
  chemically synthesized
cagagttaggaccaggattt

SEQ ID NO: 19704 - DNA, 20 bp, Artificial Sequence
  chemically synthesized
ccaggatttaggtcttttcc

SEQ ID NO: 19705 - DNA, 20 bp, Artificial Sequence
  chemically synthesized
caggatttaggtcttttcca

SEQ ID NO: 19706 - DNA, 20 bp, Artificial Sequence
  chemically synthesized
tcacttttttactattatgt

SEQ ID NO: 19707 - DNA, 20 bp, Artificial Sequence
  chemically synthesized
agaattaaatattaaaacct

SEQ ID NO: 19708 - DNA, 20 bp, Artificial Sequence
  chemically synthesized
tattaaaacctcagttttca

SEQ ID NO: 19709 - DNA, 20 bp, Artificial Sequence
  chemically synthesized
attaaaacctcagttttcaa

SEQ ID NO: 19710 - DNA, 20 bp, Artificial Sequence
  chemically synthesized
ttttcaaaggaaatgtccta

SEQ ID NO: 19711 - DNA, 20 bp, Artificial Sequence
  chemically synthesized
aggaaatgtcctatagatga

SEQ ID NO: 19712 - DNA, 20 bp, Artificial Sequence
  chemically synthesized
gtcctatagatgaaagaaca

SEQ ID NO: 19713 - DNA, 20 bp, Artificial Sequence
  chemically synthesized
atgaaagaacacagtacttg

SEQ ID NO: 19714 - DNA, 20 bp, Artificial Sequence
  chemically synthesized
gaacacagtacttgcagtca

SEQ ID NO: 19715 - DNA, 20 bp, Artificial Sequence
  chemically synthesized
aacacagtacttgcagtcaa

SEQ ID NO: 19716 - DNA, 20 bp, Artificial Sequence
  chemically synthesized
gtacttgcagtcaaaggtct

SEQ ID NO: 19717 - DNA, 20 bp, Artificial Sequence
  chemically synthesized
atttctgaaactttctgaaa

SEQ ID NO: 19718 - DNA, 20 bp, Artificial Sequence
  chemically synthesized
gaaccccttaaactgaataa

SEQ ID NO: 19719 - DNA, 20 bp, Artificial Sequence
  chemically synthesized
aaaatgaatgttatactctc

SEQ ID NO: 19720 - DNA, 20 bp, Artificial Sequence
  chemically synthesized
agttatcttaccatgttttc

SEQ ID NO: 19721 - DNA, 20 bp, Artificial Sequence
  chemically synthesized
taccatgttttctggcaaac

SEQ ID NO: 19722 - DNA, 20 bp, Artificial Sequence
  chemically synthesized
accatgttttctggcaaaca

SEQ ID NO: 19723 - DNA, 20 bp, Artificial Sequence
  chemically synthesized
aaggaaatgtattcacatcc

SEQ ID NO: 19724 - DNA, 20 bp, Artificial Sequence
  chemically synthesized
attcacatccaagaaaacaa

SEQ ID NO: 19725 - DNA, 20 bp, Artificial Sequence
  chemically synthesized
ttcacatccaagaaaacaaa

SEQ ID NO: 19726 - DNA, 20 bp, Artificial Sequence
  chemically synthesized
caagaaaacaaaaggtttct

SEQ ID NO: 19727 - DNA, 20 bp, Artificial Sequence
  chemically synthesized
aagaaaacaaaaggtttctt

SEQ ID NO: 19728 - DNA, 20 bp, Artificial Sequence
  chemically synthesized
gaaaacaaaaggtttcttag

SEQ ID NO: 19729 - DNA, 20 bp, Artificial Sequence
  chemically synthesized
aacaaaaggtttcttaggag

SEQ ID NO: 19730 - DNA, 20 bp, Artificial Sequence
  chemically synthesized
ggagaagaatcccttgctgc

SEQ ID NO: 19731 - DNA, 20 bp, Artificial Sequence
  chemically synthesized
agaattttgcccatgaacaa

SEQ ID NO: 19732 - DNA, 20 bp, Artificial Sequence
  chemically synthesized
tggaaacgtgaaaaacataa

SEQ ID NO: 19733 - DNA, 20 bp, Artificial Sequence
  chemically synthesized
acgtgaaaaacataacagat

SEQ ID NO: 19734 - DNA, 20 bp, Artificial Sequence
  chemically synthesized
gtgaaaaacataacagatga

SEQ ID NO: 19735 - DNA, 20 bp, Artificial Sequence
  chemically synthesized
gaaaaacataacagatgaga

SEQ ID NO: 19736 - DNA, 20 bp, Artificial Sequence
  chemically synthesized
cataacagatgagagagtca

SEQ ID NO: 19737 - DNA, 20 bp, Artificial Sequence
  chemically synthesized
acagatgagagagtcacagt

SEQ ID NO: 19738 - DNA, 20 bp, Artificial Sequence
  chemically synthesized
gagagagtcacagttagttt

SEQ ID NO: 19739 - DNA, 20 bp, Artificial Sequence
  chemically synthesized
agagagtcacagttagtttt

SEQ ID NO: 19740 - DNA, 20 bp, Artificial Sequence
  chemically synthesized
tagttttgggtactaattct

SEQ ID NO: 19741 - DNA, 20 bp, Artificial Sequence
  chemically synthesized
cattaatccattttattatt

SEQ ID NO: 19742 - DNA, 20 bp, Artificial Sequence
  chemically synthesized
aatccattttattattcagt

SEQ ID NO: 19743 - DNA, 20 bp, Artificial Sequence
  chemically synthesized
atccattttattattcagta

SEQ ID NO: 19744 - DNA, 20 bp, Artificial Sequence
  chemically synthesized
ttattcagtaaggattcatc

SEQ ID NO: 19745 - DNA, 20 bp, Artificial Sequence
  chemically synthesized
aggattcatcaagtgtctat

SEQ ID NO: 19746 - DNA, 20 bp, Artificial Sequence
  chemically synthesized
ggattcatcaagtgtctatt

SEQ ID NO: 19747 - DNA, 20 bp, Artificial Sequence
  chemically synthesized
atcaagtgtctattaggtat

SEQ ID NO: 19748 - DNA, 20 bp, Artificial Sequence
  chemically synthesized
tcaagtgtctattaggtatc

SEQ ID NO: 19749 - DNA, 20 bp, Artificial Sequence
  chemically synthesized
tctattaggtatcaggcact

SEQ ID NO: 19750 - DNA, 20 bp, Artificial Sequence
  chemically synthesized
tattaggtatcaggcactga

SEQ ID NO: 19751 - DNA, 20 bp, Artificial Sequence
  chemically synthesized
attaggtatcaggcactgag

SEQ ID NO: 19752 - DNA, 20 bp, Artificial Sequence
  chemically synthesized
ggtatcaggcactgagaggc

SEQ ID NO: 19753 - DNA, 20 bp, Artificial Sequence
  chemically synthesized
gtatcaggcactgagaggcg

SEQ ID NO: 19754 - DNA, 20 bp, Artificial Sequence
  chemically synthesized
tatcaggcactgagaggcga

SEQ ID NO: 19755 - DNA, 20 bp, Artificial Sequence
  chemically synthesized
tcaggcactgagaggcgagg

SEQ ID NO: 19756 - DNA, 20 bp, Artificial Sequence
  chemically synthesized
gcactgagaggcgagggaga

SEQ ID NO: 19757 - DNA, 20 bp, Artificial Sequence
  chemically synthesized
actgagaggcgagggagata

SEQ ID NO: 19758 - DNA, 20 bp, Artificial Sequence
  chemically synthesized
gaggcgagggagatagagtt

SEQ ID NO: 19759 - DNA, 20 bp, Artificial Sequence
  chemically synthesized
gggagatagagttaagaata

SEQ ID NO: 19760 - DNA, 20 bp, Artificial Sequence
  chemically synthesized
agaactgattcttaatcttc

SEQ ID NO: 19761 - DNA, 20 bp, Artificial Sequence
  chemically synthesized
ttcaagaattgacaaatttg

SEQ ID NO: 19762 - DNA, 20 bp, Artificial Sequence
  chemically synthesized
aagaattgacaaatttgtag

SEQ ID NO: 19763 - DNA, 20 bp, Artificial Sequence
  chemically synthesized
agaattgacaaatttgtaga

SEQ ID NO: 19764 - DNA, 20 bp, Artificial Sequence
  chemically synthesized
attgacaaatttgtagaagg

SEQ ID NO: 19765 - DNA, 20 bp, Artificial Sequence
  chemically synthesized
tagacattgaacatacaata

SEQ ID NO: 19766 - DNA, 20 bp, Artificial Sequence
  chemically synthesized
acaatacagtcaaatgtgat

SEQ ID NO: 19767 - DNA, 20 bp, Artificial Sequence
  chemically synthesized
cagtcaaatgtgatgagtgt

SEQ ID NO: 19768 - DNA, 20 bp, Artificial Sequence
  chemically synthesized
aatgtgatgagtgtgagact

SEQ ID NO: 19769 - DNA, 20 bp, Artificial Sequence
  chemically synthesized
atgtgatgagtgtgagacta

SEQ ID NO: 19770 - DNA, 20 bp, Artificial Sequence
  chemically synthesized
tgtgatgagtgtgagactaa

SEQ ID NO: 19771 - DNA, 20 bp, Artificial Sequence
  chemically synthesized
gagtgtgagactaagggaac

SEQ ID NO: 19772 - DNA, 20 bp, Artificial Sequence
  chemically synthesized
agtgtgagactaagggaacc

SEQ ID NO: 19773 - DNA, 20 bp, Artificial Sequence
  chemically synthesized
ctaagggaaccaggtgtcct

SEQ ID NO: 19774 - DNA, 20 bp, Artificial Sequence
  chemically synthesized
ccaggtgtcctaagactata

SEQ ID NO: 19775 - DNA, 20 bp, Artificial Sequence
  chemically synthesized
taagactatacagtgtaccg

SEQ ID NO: 19776 - DNA, 20 bp, Artificial Sequence
  chemically synthesized
ctatacagtgtaccgtggaa

SEQ ID NO: 19777 - DNA, 20 bp, Artificial Sequence
  chemically synthesized
tatacagtgtaccgtggaat

SEQ ID NO: 19778 - DNA, 20 bp, Artificial Sequence
  chemically synthesized
atacagtgtaccgtggaatg

SEQ ID NO: 19779 - DNA, 20 bp, Artificial Sequence
  chemically synthesized
acagtgtaccgtggaatggg

SEQ ID NO: 19780 - DNA, 20 bp, Artificial Sequence
  chemically synthesized
gtgtaccgtggaatggggag

SEQ ID NO: 19781 - DNA, 20 bp, Artificial Sequence
  chemically synthesized
atggggagtggtttctaacc

SEQ ID NO: 19782 - DNA, 20 bp, Artificial Sequence
  chemically synthesized
tggtttctaacctagttacc

SEQ ID NO: 19783 - DNA, 20 bp, Artificial Sequence
  chemically synthesized
gtttctaacctagttaccta

SEQ ID NO: 19784 - DNA, 20 bp, Artificial Sequence
  chemically synthesized
tttctaacctagttacctag

SEQ ID NO: 19785 - DNA, 20 bp, Artificial Sequence
  chemically synthesized
aacctagttacctagaggtt

SEQ ID NO: 19786 - DNA, 20 bp, Artificial Sequence
  chemically synthesized
acctagttacctagaggttt

SEQ ID NO: 19787 - DNA, 20 bp, Artificial Sequence
  chemically synthesized
ggaaaaacctctctaatgat

SEQ ID NO: 19788 - DNA, 20 bp, Artificial Sequence
  chemically synthesized
tctctaatgatgagatgttt

SEQ ID NO: 19789 - DNA, 20 bp, Artificial Sequence
  chemically synthesized
gatgtttgagctgacacttg

SEQ ID NO: 19790 - DNA, 20 bp, Artificial Sequence
  chemically synthesized
atgtttgagctgacacttga

SEQ ID NO: 19791 - DNA, 20 bp, Artificial Sequence
  chemically synthesized
gctgacacttgaaggataaa

SEQ ID NO: 19792 - DNA, 20 bp, Artificial Sequence
  chemically synthesized
acttgaaggataaatagcta

SEQ ID NO: 19793 - DNA, 20 bp, Artificial Sequence
  chemically synthesized
cttgaaggataaatagctaa

SEQ ID NO: 19794 - DNA, 20 bp, Artificial Sequence
  chemically synthesized
ttgaaggataaatagctaaa

SEQ ID NO: 19795 - DNA, 20 bp, Artificial Sequence
  chemically synthesized
tgaaggataaatagctaaag

SEQ ID NO: 19796 - DNA, 20 bp, Artificial Sequence
  chemically synthesized
aaggataaatagctaaaggg

SEQ ID NO: 19797 - DNA, 20 bp, Artificial Sequence
  chemically synthesized
ataaatagctaaaggggaga

SEQ ID NO: 19798 - DNA, 20 bp, Artificial Sequence
  chemically synthesized
ggggagaaagcgttctatgt

SEQ ID NO: 19799 - DNA, 20 bp, Artificial Sequence
  chemically synthesized
ggagaaagcgttctatgtga

SEQ ID NO: 19800 - DNA, 20 bp, Artificial Sequence
  chemically synthesized
gtgagagaactatatatgcc

SEQ ID NO: 19801 - DNA, 20 bp, Artificial Sequence
  chemically synthesized
gaactatatatgccaagatg

SEQ ID NO: 19802 - DNA, 20 bp, Artificial Sequence
  chemically synthesized
ctatatatgccaagatgcag

SEQ ID NO: 19803 - DNA, 20 bp, Artificial Sequence
  chemically synthesized
gcagaagtgttctctgttcg

SEQ ID NO: 19804 - DNA, 20 bp, Artificial Sequence
  chemically synthesized
tgttctctgttcgaagatct

SEQ ID NO: 19805 - DNA, 20 bp, Artificial Sequence
  chemically synthesized
tctctgttcgaagatctgag

SEQ ID NO: 19806 - DNA, 20 bp, Artificial Sequence
  chemically synthesized
ctctgttcgaagatctgagc

SEQ ID NO: 19807 - DNA, 20 bp, Artificial Sequence
  chemically synthesized
tctgttcgaagatctgagcg

SEQ ID NO: 19808 - DNA, 20 bp, Artificial Sequence
  chemically synthesized
tcgaagatctgagcggggct

SEQ ID NO: 19809 - DNA, 20 bp, Artificial Sequence
  chemically synthesized
gaagatctgagcggggctca

SEQ ID NO: 19810 - DNA, 20 bp, Artificial Sequence
  chemically synthesized
agatctgagcggggctcaga

SEQ ID NO: 19811 - DNA, 20 bp, Artificial Sequence
  chemically synthesized
gatctgagcggggctcagag

SEQ ID NO: 19812 - DNA, 20 bp, Artificial Sequence
  chemically synthesized
atctgagcggggctcagaga

SEQ ID NO: 19813 - DNA, 20 bp, Artificial Sequence
  chemically synthesized
agcggggctcagagagggaa

SEQ ID NO: 19814 - DNA, 20 bp, Artificial Sequence
  chemically synthesized
gcggggctcagagagggaaa

SEQ ID NO: 19815 - DNA, 20 bp, Artificial Sequence
  chemically synthesized
ggggctcagagagggaaaag

SEQ ID NO: 19816 - DNA, 20 bp, Artificial Sequence
  chemically synthesized
ggctcagagagggaaaagga

SEQ ID NO: 19817 - DNA, 20 bp, Artificial Sequence
  chemically synthesized
gctcagagagggaaaaggag

SEQ ID NO: 19818 - DNA, 20 bp, Artificial Sequence
  chemically synthesized
tcagagagggaaaaggagag

SEQ ID NO: 19819 - DNA, 20 bp, Artificial Sequence
  chemically synthesized
agggaaaaggagaggagtat

SEQ ID NO: 19820 - DNA, 20 bp, Artificial Sequence
  chemically synthesized
ggaaaaggagaggagtatga

SEQ ID NO: 19821 - DNA, 20 bp, Artificial Sequence
  chemically synthesized
aaaggagaggagtatgagag

SEQ ID NO: 19822 - DNA, 20 bp, Artificial Sequence
  chemically synthesized
gagaggagtatgagagaaga

SEQ ID NO: 19823 - DNA, 20 bp, Artificial Sequence
  chemically synthesized
agaggagtatgagagaagat

SEQ ID NO: 19824 - DNA, 20 bp, Artificial Sequence
  chemically synthesized
aggagtatgagagaagatgg

SEQ ID NO: 19825 - DNA, 20 bp, Artificial Sequence
  chemically synthesized
gagtatgagagaagatggga

SEQ ID NO: 19826 - DNA, 20 bp, Artificial Sequence
  chemically synthesized
gagaagatgggagagacctg

SEQ ID NO: 19827 - DNA, 20 bp, Artificial Sequence
  chemically synthesized
agaagatgggagagacctgc

SEQ ID NO: 19828 - DNA, 20 bp, Artificial Sequence
  chemically synthesized
gaagatgggagagacctgca

SEQ ID NO: 19829 - DNA, 20 bp, Artificial Sequence
  chemically synthesized
tgggagagacctgcagggac

SEQ ID NO: 19830 - DNA, 20 bp, Artificial Sequence
  chemically synthesized
cctgcagggactagattgtg

SEQ ID NO: 19831 - DNA, 20 bp, Artificial Sequence
  chemically synthesized
agggactagattgtgaagct

SEQ ID NO: 19832 - DNA, 20 bp, Artificial Sequence
  chemically synthesized
gggactagattgtgaagctc

SEQ ID NO: 19833 - DNA, 20 bp, Artificial Sequence
  chemically synthesized
ggactagattgtgaagctca

SEQ ID NO: 19834 - DNA, 20 bp, Artificial Sequence
  chemically synthesized
gactagattgtgaagctcag

SEQ ID NO: 19835 - DNA, 20 bp, Artificial Sequence
  chemically synthesized
actagattgtgaagctcagg

SEQ ID NO: 19836 - DNA, 20 bp, Artificial Sequence
  chemically synthesized
tagattgtgaagctcagggg

SEQ ID NO: 19837 - DNA, 20 bp, Artificial Sequence
  chemically synthesized
tgaagctcagggggagttaa

SEQ ID NO: 19838 - DNA, 20 bp, Artificial Sequence
  chemically synthesized
cagggggagttaatagcctt

SEQ ID NO: 19839 - DNA, 20 bp, Artificial Sequence
  chemically synthesized
agggggagttaatagcctta

SEQ ID NO: 19840 - DNA, 20 bp, Artificial Sequence
  chemically synthesized
ggggagttaatagccttaag

SEQ ID NO: 19841 - DNA, 20 bp, Artificial Sequence
  chemically synthesized
gccttaaggagttttgtctc

SEQ ID NO: 19842 - DNA, 20 bp, Artificial Sequence
  chemically synthesized
ccttaaggagttttgtctcc

SEQ ID NO: 19843 - DNA, 20 bp, Artificial Sequence
  chemically synthesized
cttaaggagttttgtctcca

SEQ ID NO: 19844 - DNA, 20 bp, Artificial Sequence
  chemically synthesized
ccagggtatgaacaatgaat

SEQ ID NO: 19845 - DNA, 20 bp, Artificial Sequence
  chemically synthesized
cagggtatgaacaatgaatg

SEQ ID NO: 19846 - DNA, 20 bp, Artificial Sequence
  chemically synthesized
gggtatgaacaatgaatgag

SEQ ID NO: 19847 - DNA, 20 bp, Artificial Sequence
  chemically synthesized
agtcactgaaattctatcca

SEQ ID NO: 19848 - DNA, 20 bp, Artificial Sequence
  chemically synthesized
cactgaaattctatccacag

SEQ ID NO: 19849 - DNA, 20 bp, Artificial Sequence
  chemically synthesized
tgaaattctatccacagtag

SEQ ID NO: 19850 - DNA, 20 bp, Artificial Sequence
  chemically synthesized
gaaattctatccacagtagt

SEQ ID NO: 19851 - DNA, 20 bp, Artificial Sequence
  chemically synthesized
attctatccacagtagtggg

SEQ ID NO: 19852 - DNA, 20 bp, Artificial Sequence
  chemically synthesized
ccacagtagtgggaagtact

SEQ ID NO: 19853 - DNA, 20 bp, Artificial Sequence
  chemically synthesized
cagtagtgggaagtactaag

SEQ ID NO: 19854 - DNA, 20 bp, Artificial Sequence
  chemically synthesized
agtgggaagtactaagtagt

SEQ ID NO: 19855 - DNA, 20 bp, Artificial Sequence
  chemically synthesized
gtgggaagtactaagtagtc

SEQ ID NO: 19856 - DNA, 20 bp, Artificial Sequence
  chemically synthesized
ctaagtagtcaggtatgttt

SEQ ID NO: 19857 - DNA, 20 bp, Artificial Sequence
  chemically synthesized
agtagtcaggtatgttttgg

SEQ ID NO: 19858 - DNA, 20 bp, Artificial Sequence
  chemically synthesized
agtcaggtatgttttggaag

SEQ ID NO: 19859 - DNA, 20 bp, Artificial Sequence
  chemically synthesized
tttggaagaagcactgttac

SEQ ID NO: 19860 - DNA, 20 bp, Artificial Sequence
  chemically synthesized
aagaagcactgttaccagtt

SEQ ID NO: 19861 - DNA, 20 bp, Artificial Sequence
  chemically synthesized
agaagcactgttaccagttg

SEQ ID NO: 19862 - DNA, 20 bp, Artificial Sequence
  chemically synthesized
gaagcactgttaccagttga

SEQ ID NO: 19863 - DNA, 20 bp, Artificial Sequence
  chemically synthesized
agcactgttaccagttgagg

SEQ ID NO: 19864 - DNA, 20 bp, Artificial Sequence
  chemically synthesized
cactgttaccagttgaggga

SEQ ID NO: 19865 - DNA, 20 bp, Artificial Sequence
  chemically synthesized
actgttaccagttgagggag

SEQ ID NO: 19866 - DNA, 20 bp, Artificial Sequence
  chemically synthesized
tgttaccagttgagggagag

SEQ ID NO: 19867 - DNA, 20 bp, Artificial Sequence
  chemically synthesized
ttaccagttgagggagagga

SEQ ID NO: 19868 - DNA, 20 bp, Artificial Sequence
  chemically synthesized
taccagttgagggagaggag

SEQ ID NO: 19869 - DNA, 20 bp, Artificial Sequence
  chemically synthesized
ccagttgagggagaggagag

SEQ ID NO: 19870 - DNA, 20 bp, Artificial Sequence
  chemically synthesized
cagttgagggagaggagagg

SEQ ID NO: 19871 - DNA, 20 bp, Artificial Sequence
  chemically synthesized
agttgagggagaggagagga

SEQ ID NO: 19872 - DNA, 20 bp, Artificial Sequence
  chemically synthesized
ggagaggagaggagggaaat

SEQ ID NO: 19873 - DNA, 20 bp, Artificial Sequence
  chemically synthesized
agaggagggaaattagactg

SEQ ID NO: 19874 - DNA, 20 bp, Artificial Sequence
  chemically synthesized
aattagactgtggtgtgacc

SEQ ID NO: 19875 - DNA, 20 bp, Artificial Sequence
  chemically synthesized
attagactgtggtgtgaccc

SEQ ID NO: 19876 - DNA, 20 bp, Artificial Sequence
  chemically synthesized
gactgtggtgtgacccagga

SEQ ID NO: 19877 - DNA, 20 bp, Artificial Sequence
  chemically synthesized
gtggtgtgacccaggatgga

SEQ ID NO: 19878 - DNA, 20 bp, Artificial Sequence
  chemically synthesized
tggaaagttttgcccaaatg

SEQ ID NO: 19879 - DNA, 20 bp, Artificial Sequence
  chemically synthesized
ggaaagttttgcccaaatgt

SEQ ID NO: 19880 - DNA, 20 bp, Artificial Sequence
  chemically synthesized
gaaagttttgcccaaatgtg

SEQ ID NO: 19881 - DNA, 20 bp, Artificial Sequence
  chemically synthesized
aaagttttgcccaaatgtgg

SEQ ID NO: 19882 - DNA, 20 bp, Artificial Sequence
  chemically synthesized
tgtttactctctcctttgcc

SEQ ID NO: 19883 - DNA, 20 bp, Artificial Sequence
  chemically synthesized
gtttactctctcctttgccc

SEQ ID NO: 19884 - DNA, 20 bp, Artificial Sequence
  chemically synthesized
ttcttctgcacacacttgct

SEQ ID NO: 19885 - DNA, 20 bp, Artificial Sequence
  chemically synthesized
gctcagaacattacaaactc

SEQ ID NO: 19886 - DNA, 20 bp, Artificial Sequence
  chemically synthesized
tcagaacattacaaactctg

SEQ ID NO: 19887 - DNA, 20 bp, Artificial Sequence
  chemically synthesized
tctggagaaattaacatgtt

SEQ ID NO: 19888 - DNA, 20 bp, Artificial Sequence
  chemically synthesized
ctggagaaattaacatgtta

SEQ ID NO: 19889 - DNA, 20 bp, Artificial Sequence
  chemically synthesized
attaacatgttaaggatatt

SEQ ID NO: 19890 - DNA, 20 bp, Artificial Sequence
  chemically synthesized
ttaacatgttaaggatattt

SEQ ID NO: 19891 - DNA, 20 bp, Artificial Sequence
  chemically synthesized
gatatttaggatcattaaaa

SEQ ID NO: 19892 - DNA, 20 bp, Artificial Sequence
  chemically synthesized
aatgttgtcacacataatga

SEQ ID NO: 19893 - DNA, 20 bp, Artificial Sequence
  chemically synthesized
cacataatgaaagttaattt

SEQ ID NO: 19894 - DNA, 20 bp, Artificial Sequence
  chemically synthesized
aagttaatttaagaattgta

SEQ ID NO: 19895 - DNA, 20 bp, Artificial Sequence
  chemically synthesized
tttaagaattgtaaagactt

SEQ ID NO: 19896 - DNA, 20 bp, Artificial Sequence
  chemically synthesized
ttgtaaagacttgagcgatg

SEQ ID NO: 19897 - DNA, 20 bp, Artificial Sequence
  chemically synthesized
taaatgcttccctcttaaaa

SEQ ID NO: 19898 - DNA, 20 bp, Artificial Sequence
  chemically synthesized
gcttccctcttaaaatggac

SEQ ID NO: 19899 - DNA, 20 bp, Artificial Sequence
  chemically synthesized
gaaacaatttgtttttgcct

SEQ ID NO: 19900 - DNA, 20 bp, Artificial Sequence
  chemically synthesized
tgcctaagccaacgtattgc

SEQ ID NO: 19901 - DNA, 20 bp, Artificial Sequence
  chemically synthesized
taatttacctgcttcctcct

SEQ ID NO: 19902 - DNA, 20 bp, Artificial Sequence
  chemically synthesized
cactacacctctgaattaca

SEQ ID NO: 19903 - DNA, 20 bp, Artificial Sequence
  chemically synthesized
acctctgaattacatggtac

SEQ ID NO: 19904 - DNA, 20 bp, Artificial Sequence
  chemically synthesized
tctgaattacatggtacaag

SEQ ID NO: 19905 - DNA, 20 bp, Artificial Sequence
  chemically synthesized
attacatggtacaagtggca

SEQ ID NO: 19906 - DNA, 20 bp, Artificial Sequence
  chemically synthesized
ttacatggtacaagtggcac

SEQ ID NO: 19907 - DNA, 20 bp, Artificial Sequence
  chemically synthesized
tacatggtacaagtggcaca

SEQ ID NO: 19908 - DNA, 20 bp, Artificial Sequence
  chemically synthesized
atggtacaagtggcacaggg

SEQ ID NO: 19909 - DNA, 20 bp, Artificial Sequence
  chemically synthesized
aagtggcacagggaagaatt

SEQ ID NO: 19910 - DNA, 20 bp, Artificial Sequence
  chemically synthesized
cagggaagaattcagaaaac

SEQ ID NO: 19911 - DNA, 20 bp, Artificial Sequence
  chemically synthesized
gggaagaattcagaaaacta

SEQ ID NO: 19912 - DNA, 20 bp, Artificial Sequence
  chemically synthesized
aattcagaaaactagagtca

SEQ ID NO: 19913 - DNA, 20 bp, Artificial Sequence
  chemically synthesized
tcagaaaactagagtcaaag

SEQ ID NO: 19914 - DNA, 20 bp, Artificial Sequence
  chemically synthesized
aactagagtcaaagtggtta

SEQ ID NO: 19915 - DNA, 20 bp, Artificial Sequence
  chemically synthesized
tagagtcaaagtggttatgg

SEQ ID NO: 19916 - DNA, 20 bp, Artificial Sequence
  chemically synthesized
atggaagaaattataataat

SEQ ID NO: 19917 - DNA, 20 bp, Artificial Sequence
  chemically synthesized
taataatgagtccactcttc

SEQ ID NO: 19918 - DNA, 20 bp, Artificial Sequence
  chemically synthesized
aataatgagtccactcttct

SEQ ID NO: 19919 - DNA, 20 bp, Artificial Sequence
  chemically synthesized
atgagtccactcttctagga

SEQ ID NO: 19920 - DNA, 20 bp, Artificial Sequence
  chemically synthesized
tgagtccactcttctaggac

SEQ ID NO: 19921 - DNA, 20 bp, Artificial Sequence
  chemically synthesized
agtccactcttctaggacag

SEQ ID NO: 19922 - DNA, 20 bp, Artificial Sequence
  chemically synthesized
cttctaggacaggagttcta

SEQ ID NO: 19923 - DNA, 20 bp, Artificial Sequence
  chemically synthesized
ttctaggacaggagttctaa

SEQ ID NO: 19924 - DNA, 20 bp, Artificial Sequence
  chemically synthesized
aggacaggagttctaaaggt

SEQ ID NO: 19925 - DNA, 20 bp, Artificial Sequence
  chemically synthesized
ggacaggagttctaaaggtg

SEQ ID NO: 19926 - DNA, 20 bp, Artificial Sequence
  chemically synthesized
aaaggtgaggactttgatat

SEQ ID NO: 19927 - DNA, 20 bp, Artificial Sequence
  chemically synthesized
actttgatataagtgaactc

SEQ ID NO: 19928 - DNA, 20 bp, Artificial Sequence
  chemically synthesized
ctttgatataagtgaactca

SEQ ID NO: 19929 - DNA, 20 bp, Artificial Sequence
  chemically synthesized
ttgatataagtgaactcaag

SEQ ID NO: 19930 - DNA, 20 bp, Artificial Sequence
  chemically synthesized
tcaaggagtttctaaacctt

SEQ ID NO: 19931 - DNA, 20 bp, Artificial Sequence
  chemically synthesized
cagaaattatatctaaaaat

SEQ ID NO: 19932 - DNA, 20 bp, Artificial Sequence
  chemically synthesized
agaaattatatctaaaaatt

SEQ ID NO: 19933 - DNA, 20 bp, Artificial Sequence
  chemically synthesized
aaaaattaggtgcacgtata

SEQ ID NO: 19934 - DNA, 20 bp, Artificial Sequence
  chemically synthesized
aattaggtgcacgtatatag

SEQ ID NO: 19935 - DNA, 20 bp, Artificial Sequence
  chemically synthesized
atatagaagtacttttctct

SEQ ID NO: 19936 - DNA, 20 bp, Artificial Sequence
  chemically synthesized
tagaagtacttttctctgag

SEQ ID NO: 19937 - DNA, 20 bp, Artificial Sequence
  chemically synthesized
gaagtacttttctctgagaa

SEQ ID NO: 19938 - DNA, 20 bp, Artificial Sequence
  chemically synthesized
aagtacttttctctgagaag

SEQ ID NO: 19939 - DNA, 20 bp, Artificial Sequence
  chemically synthesized
agaggacttcacacttccat

SEQ ID NO: 19940 - DNA, 20 bp, Artificial Sequence
  chemically synthesized
acacttccatcagcttcctg

SEQ ID NO: 19941 - DNA, 20 bp, Artificial Sequence
  chemically synthesized
cacttccatcagcttcctga

SEQ ID NO: 19942 - DNA, 20 bp, Artificial Sequence
  chemically synthesized
aggcccctgtaattgccgta

SEQ ID NO: 19943 - DNA, 20 bp, Artificial Sequence
  chemically synthesized
cgtaaagaacaactgctcta

SEQ ID NO: 19944 - DNA, 20 bp, Artificial Sequence
  chemically synthesized
actgctctaaagtttaatac

SEQ ID NO: 19945 - DNA, 20 bp, Artificial Sequence
  chemically synthesized
ctgctctaaagtttaatact

SEQ ID NO: 19946 - DNA, 20 bp, Artificial Sequence
  chemically synthesized
aagtttaatactaggctact

SEQ ID NO: 19947 - DNA, 20 bp, Artificial Sequence
  chemically synthesized
tcggctgttttttgttaaca

SEQ ID NO: 19948 - DNA, 20 bp, Artificial Sequence
  chemically synthesized
gctgttttttgttaacacag

SEQ ID NO: 19949 - DNA, 20 bp, Artificial Sequence
  chemically synthesized
taacacagaagttttccaaa

SEQ ID NO: 19950 - DNA, 20 bp, Artificial Sequence
  chemically synthesized
ttttccaaatggcttttctc

SEQ ID NO: 19951 - DNA, 20 bp, Artificial Sequence
  chemically synthesized
ttccaaatggcttttctcta

SEQ ID NO: 19952 - DNA, 20 bp, Artificial Sequence
  chemically synthesized
tttctctagagcaaaatgaa

SEQ ID NO: 19953 - DNA, 20 bp, Artificial Sequence
  chemically synthesized
ttctctagagcaaaatgaaa

SEQ ID NO: 19954 - DNA, 20 bp, Artificial Sequence
  chemically synthesized
aaaaggatcccatccttccc

SEQ ID NO: 19955 - DNA, 20 bp, Artificial Sequence
  chemically synthesized
cctaccccccaccactttta

SEQ ID NO: 19956 - DNA, 20 bp, Artificial Sequence
  chemically synthesized
accacttttaaagatccatc

SEQ ID NO: 19957 - DNA, 20 bp, Artificial Sequence
  chemically synthesized
ccacttttaaagatccatca

SEQ ID NO: 19958 - DNA, 20 bp, Artificial Sequence
  chemically synthesized
tttaaagatccatcaaggcc

SEQ ID NO: 19959 - DNA, 20 bp, Artificial Sequence
  chemically synthesized
agatccatcaaggcccagca

SEQ ID NO: 19960 - DNA, 20 bp, Artificial Sequence
  chemically synthesized
ctgtaatctcaacacttttc

SEQ ID NO: 19961 - DNA, 20 bp, Artificial Sequence
  chemically synthesized
tgtaatctcaacacttttca

SEQ ID NO: 19962 - DNA, 20 bp, Artificial Sequence
  chemically synthesized
tctcaacacttttcaaggct

SEQ ID NO: 19963 - DNA, 20 bp, Artificial Sequence
  chemically synthesized
ctcaacacttttcaaggctg

SEQ ID NO: 19964 - DNA, 20 bp, Artificial Sequence
  chemically synthesized
aacacttttcaaggctgagg

SEQ ID NO: 19965 - DNA, 20 bp, Artificial Sequence
  chemically synthesized
acacttttcaaggctgaggt

SEQ ID NO: 19966 - DNA, 20 bp, Artificial Sequence
  chemically synthesized
acttttcaaggctgaggtgg

SEQ ID NO: 19967 - DNA, 20 bp, Artificial Sequence
  chemically synthesized
ctgaggtgggagaattgttt

SEQ ID NO: 19968 - DNA, 20 bp, Artificial Sequence
  chemically synthesized
tgggagaattgtttgagacc

SEQ ID NO: 19969 - DNA, 20 bp, Artificial Sequence
  chemically synthesized
ggagaattgtttgagaccaa

SEQ ID NO: 19970 - DNA, 20 bp, Artificial Sequence
  chemically synthesized
aattgtttgagaccaagagt

SEQ ID NO: 19971 - DNA, 20 bp, Artificial Sequence
  chemically synthesized
tgagaccaagagttggatac

SEQ ID NO: 19972 - DNA, 20 bp, Artificial Sequence
  chemically synthesized
ccaagagttggataccagcc

SEQ ID NO: 19973 - DNA, 20 bp, Artificial Sequence
  chemically synthesized
caagagttggataccagcct

SEQ ID NO: 19974 - DNA, 20 bp, Artificial Sequence
  chemically synthesized
aagagttggataccagcctg

SEQ ID NO: 19975 - DNA, 20 bp, Artificial Sequence
  chemically synthesized
ggataccagcctggggaaca

SEQ ID NO: 19976 - DNA, 20 bp, Artificial Sequence
  chemically synthesized
gataccagcctggggaacat

SEQ ID NO: 19977 - DNA, 20 bp, Artificial Sequence
  chemically synthesized
ataccagcctggggaacata

SEQ ID NO: 19978 - DNA, 20 bp, Artificial Sequence
  chemically synthesized
accagcctggggaacatagg

SEQ ID NO: 19979 - DNA, 20 bp, Artificial Sequence
  chemically synthesized
atagggagaccctgtttcta

SEQ ID NO: 19980 - DNA, 20 bp, Artificial Sequence
  chemically synthesized
agaaatttaaaaaatttctc

SEQ ID NO: 19981 - DNA, 20 bp, Artificial Sequence
  chemically synthesized
atttaaaaaatttctctagc

SEQ ID NO: 19982 - DNA, 20 bp, Artificial Sequence
  chemically synthesized
aaaatttctctagctggcca

SEQ ID NO: 19983 - DNA, 20 bp, Artificial Sequence
  chemically synthesized
aatttctctagctggccatg

SEQ ID NO: 19984 - DNA, 20 bp, Artificial Sequence
  chemically synthesized
atttctctagctggccatgg

SEQ ID NO: 19985 - DNA, 20 bp, Artificial Sequence
  chemically synthesized
gccatggaggctcacacctg

SEQ ID NO: 19986 - DNA, 20 bp, Artificial Sequence
  chemically synthesized
gaggctcacacctgtagtcc

SEQ ID NO: 19987 - DNA, 20 bp, Artificial Sequence
  chemically synthesized
acctgtagtcctagctacct

SEQ ID NO: 19988 - DNA, 20 bp, Artificial Sequence
  chemically synthesized
ctgtagtcctagctacctga

SEQ ID NO: 19989 - DNA, 20 bp, Artificial Sequence
  chemically synthesized
tgtagtcctagctacctgag

SEQ ID NO: 19990 - DNA, 20 bp, Artificial Sequence
  chemically synthesized
cctagctacctgagaggcta

SEQ ID NO: 19991 - DNA, 20 bp, Artificial Sequence
  chemically synthesized
agctacctgagaggctaaag

SEQ ID NO: 19992 - DNA, 20 bp, Artificial Sequence
  chemically synthesized
gctacctgagaggctaaagc

SEQ ID NO: 19993 - DNA, 20 bp, Artificial Sequence
  chemically synthesized
tacctgagaggctaaagcag

SEQ ID NO: 19994 - DNA, 20 bp, Artificial Sequence
  chemically synthesized
acctgagaggctaaagcagg

SEQ ID NO: 19995 - DNA, 20 bp, Artificial Sequence
  chemically synthesized
gcaggaggatcaattgaatc

SEQ ID NO: 19996 - DNA, 20 bp, Artificial Sequence
  chemically synthesized
caggaggatcaattgaatcc

SEQ ID NO: 19997 - DNA, 20 bp, Artificial Sequence
  chemically synthesized
tcaattgaatccaggcgttc

SEQ ID NO: 19998 - DNA, 20 bp, Artificial Sequence
  chemically synthesized
ttgaatccaggcgttctagt

SEQ ID NO: 19999 - DNA, 20 bp, Artificial Sequence
  chemically synthesized
tgaatccaggcgttctagtg

SEQ ID NO: 20000 - DNA, 20 bp, Artificial Sequence
  chemically synthesized
caggcgttctagtgaggctt

SEQ ID NO: 20001 - DNA, 20 bp, Artificial Sequence
  chemically synthesized
cgttctagtgaggcttcagt

SEQ ID NO: 20002 - DNA, 20 bp, Artificial Sequence
  chemically synthesized
ctagtgaggcttcagtgagc

SEQ ID NO: 20003 - DNA, 20 bp, Artificial Sequence
  chemically synthesized
aagattgcaccattgcactc

SEQ ID NO: 20004 - DNA, 20 bp, Artificial Sequence
  chemically synthesized
ttgcaccattgcactccagc

SEQ ID NO: 20005 - DNA, 20 bp, Artificial Sequence
  chemically synthesized
tgcaccattgcactccagcc

SEQ ID NO: 20006 - DNA, 20 bp, Artificial Sequence
  chemically synthesized
gcaccattgcactccagccg

SEQ ID NO: 20007 - DNA, 20 bp, Artificial Sequence
  chemically synthesized
ttgcactccagccggggtga

SEQ ID NO: 20008 - DNA, 20 bp, Artificial Sequence
  chemically synthesized
gcactccagccggggtgaca

SEQ ID NO: 20009 - DNA, 20 bp, Artificial Sequence
  chemically synthesized
tccagccggggtgacagagt

SEQ ID NO: 20010 - DNA, 20 bp, Artificial Sequence
  chemically synthesized
agaccctgtttcaaacaaac

SEQ ID NO: 20011 - DNA, 20 bp, Artificial Sequence
  chemically synthesized
tgtttcaaacaaacaagcaa

SEQ ID NO: 20012 - DNA, 20 bp, Artificial Sequence
  chemically synthesized
aacaaacaagcaaaagcaaa

SEQ ID NO: 20013 - DNA, 20 bp, Artificial Sequence
  chemically synthesized
acttactatcttgctgtcta

SEQ ID NO: 20014 - DNA, 20 bp, Artificial Sequence
  chemically synthesized
tatcttgctgtctacagcta

SEQ ID NO: 20015 - DNA, 20 bp, Artificial Sequence
  chemically synthesized
ttgctgtctacagctaaagt

SEQ ID NO: 20016 - DNA, 20 bp, Artificial Sequence
  chemically synthesized
taaagtcagactgcatgatt

SEQ ID NO: 20017 - DNA, 20 bp, Artificial Sequence
  chemically synthesized
attccaactccaccatcacc

SEQ ID NO: 20018 - DNA, 20 bp, Artificial Sequence
  chemically synthesized
ttccaactccaccatcacct

SEQ ID NO: 20019 - DNA, 20 bp, Artificial Sequence
  chemically synthesized
accatcacctgggtaatgtt

SEQ ID NO: 20020 - DNA, 20 bp, Artificial Sequence
  chemically synthesized
taatgttgagatttattaca

SEQ ID NO: 20021 - DNA, 20 bp, Artificial Sequence
  chemically synthesized
tacatagcatctctgtgcct

SEQ ID NO: 20022 - DNA, 20 bp, Artificial Sequence
  chemically synthesized
aataatgttgtgaaaattaa

SEQ ID NO: 20023 - DNA, 20 bp, Artificial Sequence
  chemically synthesized
gtgaaaattaaaagaaatac

SEQ ID NO: 20024 - DNA, 20 bp, Artificial Sequence
  chemically synthesized
aataccagttgtaaatcact

SEQ ID NO: 20025 - DNA, 20 bp, Artificial Sequence
  chemically synthesized
aaatcactcagaactgtgcc

SEQ ID NO: 20026 - DNA, 20 bp, Artificial Sequence
  chemically synthesized
agcatttaataaacactctg

SEQ ID NO: 20027 - DNA, 20 bp, Artificial Sequence
  chemically synthesized
gcatttaataaacactctgt

SEQ ID NO: 20028 - DNA, 20 bp, Artificial Sequence
  chemically synthesized
aataaacactctgtaggtat

SEQ ID NO: 20029 - DNA, 20 bp, Artificial Sequence
  chemically synthesized
ataaaatttattcataaaat

SEQ ID NO: 20030 - DNA, 20 bp, Artificial Sequence
  chemically synthesized
taaaatttattcataaaatg

SEQ ID NO: 20031 - DNA, 20 bp, Artificial Sequence
  chemically synthesized
aatttattcataaaatgagg

SEQ ID NO: 20032 - DNA, 20 bp, Artificial Sequence
  chemically synthesized
tattcataaaatgaggaagt

SEQ ID NO: 20033 - DNA, 20 bp, Artificial Sequence
  chemically synthesized
tagctcatgtattgtcatac

SEQ ID NO: 20034 - DNA, 20 bp, Artificial Sequence
  chemically synthesized
taccagctttcactttgaat

SEQ ID NO: 20035 - DNA, 20 bp, Artificial Sequence
  chemically synthesized
attgcatttttaaacacaaa

SEQ ID NO: 20036 - DNA, 20 bp, Artificial Sequence
  chemically synthesized
tgcatttttaaacacaaaaa

SEQ ID NO: 20037 - DNA, 20 bp, Artificial Sequence
  chemically synthesized
aaacacaaaaagagaaataa

SEQ ID NO: 20038 - DNA, 20 bp, Artificial Sequence
  chemically synthesized
aacacaaaaagagaaataat

SEQ ID NO: 20039 - DNA, 20 bp, Artificial Sequence
  chemically synthesized
catcaatgttacttcaatca

SEQ ID NO: 20040 - DNA, 20 bp, Artificial Sequence
  chemically synthesized
atcaatgttacttcaatcac

SEQ ID NO: 20041 - DNA, 20 bp, Artificial Sequence
  chemically synthesized
tacttcaatcacgggatgca

SEQ ID NO: 20042 - DNA, 20 bp, Artificial Sequence
  chemically synthesized
atcacgggatgcatagtaat

SEQ ID NO: 20043 - DNA, 20 bp, Artificial Sequence
  chemically synthesized
tcacgggatgcatagtaatt

SEQ ID NO: 20044 - DNA, 20 bp, Artificial Sequence
  chemically synthesized
ctttgccctaattactgatg

SEQ ID NO: 20045 - DNA, 20 bp, Artificial Sequence
  chemically synthesized
ccctaattactgatgtggat

SEQ ID NO: 20046 - DNA, 20 bp, Artificial Sequence
  chemically synthesized
aattactgatgtggataagc

SEQ ID NO: 20047 - DNA, 20 bp, Artificial Sequence
  chemically synthesized
tactgatgtggataagccgg

SEQ ID NO: 20048 - DNA, 20 bp, Artificial Sequence
  chemically synthesized
actgatgtggataagccggt

SEQ ID NO: 20049 - DNA, 20 bp, Artificial Sequence
  chemically synthesized
aagccggtgggccatgtcaa

SEQ ID NO: 20050 - DNA, 20 bp, Artificial Sequence
  chemically synthesized
ggccatgtcaatggcatctc

SEQ ID NO: 20051 - DNA, 20 bp, Artificial Sequence
  chemically synthesized
atctatgtaaaaactatgct

SEQ ID NO: 20052 - DNA, 20 bp, Artificial Sequence
  chemically synthesized
aaaaactatgcttggttgca

SEQ ID NO: 20053 - DNA, 20 bp, Artificial Sequence
  chemically synthesized
atgcttggttgcacagcttc

SEQ ID NO: 20054 - DNA, 20 bp, Artificial Sequence
  chemically synthesized
tgcttggttgcacagcttca

SEQ ID NO: 20055 - DNA, 20 bp, Artificial Sequence
  chemically synthesized
tggttgcacagcttcaagga

SEQ ID NO: 20056 - DNA, 20 bp, Artificial Sequence
  chemically synthesized
cacagcttcaaggaaagcac

SEQ ID NO: 20057 - DNA, 20 bp, Artificial Sequence
  chemically synthesized
ctactcacttccttttcatt

SEQ ID NO: 20058 - DNA, 20 bp, Artificial Sequence
  chemically synthesized
ttcattcagcatgctatgtc

SEQ ID NO: 20059 - DNA, 20 bp, Artificial Sequence
  chemically synthesized
tcattcagcatgctatgtct

SEQ ID NO: 20060 - DNA, 20 bp, Artificial Sequence
  chemically synthesized
cccctttcatataaaatatt

SEQ ID NO: 20061 - DNA, 20 bp, Artificial Sequence
  chemically synthesized
cctttcatataaaatatttg

SEQ ID NO: 20062 - DNA, 20 bp, Artificial Sequence
  chemically synthesized
aatatttggagctgccattg

SEQ ID NO: 20063 - DNA, 20 bp, Artificial Sequence
  chemically synthesized
atatttggagctgccattgt

SEQ ID NO: 20064 - DNA, 20 bp, Artificial Sequence
  chemically synthesized
tttggagctgccattgtagg

SEQ ID NO: 20065 - DNA, 20 bp, Artificial Sequence
  chemically synthesized
agctgccattgtaggtagtg

SEQ ID NO: 20066 - DNA, 20 bp, Artificial Sequence
  chemically synthesized
gctgccattgtaggtagtgc

SEQ ID NO: 20067 - DNA, 20 bp, Artificial Sequence
  chemically synthesized
gccattgtaggtagtgcagg

SEQ ID NO: 20068 - DNA, 20 bp, Artificial Sequence
  chemically synthesized
agtgcaggtggtcttgttca

SEQ ID NO: 20069 - DNA, 20 bp, Artificial Sequence
  chemically synthesized
ggtggtcttgttcaaagtgt

SEQ ID NO: 20070 - DNA, 20 bp, Artificial Sequence
  chemically synthesized
gagtatcacctcccactgcc

SEQ ID NO: 20071 - DNA, 20 bp, Artificial Sequence
  chemically synthesized
acctcccactgccaagactg

SEQ ID NO: 20072 - DNA, 20 bp, Artificial Sequence
  chemically synthesized
cagctgctttgattttaact

SEQ ID NO: 20073 - DNA, 20 bp, Artificial Sequence
  chemically synthesized
agctgctttgattttaactg

SEQ ID NO: 20074 - DNA, 20 bp, Artificial Sequence
  chemically synthesized
tttgattttaactgaggatc

SEQ ID NO: 20075 - DNA, 20 bp, Artificial Sequence
  chemically synthesized
ttttaactgaggatctagaa

SEQ ID NO: 20076 - DNA, 20 bp, Artificial Sequence
  chemically synthesized
ctgaggatctagaaaagtgc

SEQ ID NO: 20077 - DNA, 20 bp, Artificial Sequence
  chemically synthesized
tgaggatctagaaaagtgct

SEQ ID NO: 20078 - DNA, 20 bp, Artificial Sequence
  chemically synthesized
tatttgctgacctttgtcac

SEQ ID NO: 20079 - DNA, 20 bp, Artificial Sequence
  chemically synthesized
ttgctgacctttgtcacaag

SEQ ID NO: 20080 - DNA, 20 bp, Artificial Sequence
  chemically synthesized
gcacctaatctccttcctac

SEQ ID NO: 20081 - DNA, 20 bp, Artificial Sequence
  chemically synthesized
gccttataaaatgatgttct

SEQ ID NO: 20082 - DNA, 20 bp, Artificial Sequence
  chemically synthesized
ctgcttctgcaactgtgttt

SEQ ID NO: 20083 - DNA, 20 bp, Artificial Sequence
  chemically synthesized
tctgcaactgtgttttggaa

SEQ ID NO: 20084 - DNA, 20 bp, Artificial Sequence
  chemically synthesized
ctgcaactgtgttttggaac

SEQ ID NO: 20085 - DNA, 20 bp, Artificial Sequence
  chemically synthesized
gcaactgtgttttggaacag

SEQ ID NO: 20086 - DNA, 20 bp, Artificial Sequence
  chemically synthesized
caactgtgttttggaacagg

SEQ ID NO: 20087 - DNA, 20 bp, Artificial Sequence
  chemically synthesized
aactgtgttttggaacagga

SEQ ID NO: 20088 - DNA, 20 bp, Artificial Sequence
  chemically synthesized
gtgttttggaacaggagggt

SEQ ID NO: 20089 - DNA, 20 bp, Artificial Sequence
  chemically synthesized
ttggaacaggagggtgagat

SEQ ID NO: 20090 - DNA, 20 bp, Artificial Sequence
  chemically synthesized
gaacaggagggtgagattag

SEQ ID NO: 20091 - DNA, 20 bp, Artificial Sequence
  chemically synthesized
agtagccacacacactgaaa

SEQ ID NO: 20092 - DNA, 20 bp, Artificial Sequence
  chemically synthesized
aaatagtcatatgacttcca

SEQ ID NO: 20093 - DNA, 20 bp, Artificial Sequence
  chemically synthesized
ttccaaagtctgtaattttt

SEQ ID NO: 20094 - DNA, 20 bp, Artificial Sequence
  chemically synthesized
atttttaagcatatacaaaa

SEQ ID NO: 20095 - DNA, 20 bp, Artificial Sequence
  chemically synthesized
tatgtgtgtatacatatata

SEQ ID NO: 20096 - DNA, 20 bp, Artificial Sequence
  chemically synthesized
tgtgtgtatacatatatata

SEQ ID NO: 20097 - DNA, 20 bp, Artificial Sequence
  chemically synthesized
tgtgtatacatatatataga

SEQ ID NO: 20098 - DNA, 20 bp, Artificial Sequence
  chemically synthesized
tgtatacatatatatagaga

SEQ ID NO: 20099 - DNA, 20 bp, Artificial Sequence
  chemically synthesized
tatacatatatatagagaga

SEQ ID NO: 20100 - DNA, 20 bp, Artificial Sequence
  chemically synthesized
catatatatagagagagaga

SEQ ID NO: 20101 - DNA, 20 bp, Artificial Sequence
  chemically synthesized
tatatatagagagagagaca

SEQ ID NO: 20102 - DNA, 20 bp, Artificial Sequence
  chemically synthesized
tatatagagagagagacaga

SEQ ID NO: 20103 - DNA, 20 bp, Artificial Sequence
  chemically synthesized
tatagagagagagacagaga

SEQ ID NO: 20104 - DNA, 20 bp, Artificial Sequence
  chemically synthesized
gagagagagacagagagaga

SEQ ID NO: 20105 - DNA, 20 bp, Artificial Sequence
  chemically synthesized
agagagagacagagagagat

SEQ ID NO: 20106 - DNA, 20 bp, Artificial Sequence
  chemically synthesized
gagagagacagagagagatg

SEQ ID NO: 20107 - DNA, 20 bp, Artificial Sequence
  chemically synthesized
agagagacagagagagatgg

SEQ ID NO: 20108 - DNA, 20 bp, Artificial Sequence
  chemically synthesized
agagacagagagagatgggg

SEQ ID NO: 20109 - DNA, 20 bp, Artificial Sequence
  chemically synthesized
agacagagagagatggggga

SEQ ID NO: 20110 - DNA, 20 bp, Artificial Sequence
  chemically synthesized
acagagagagatgggggaga

SEQ ID NO: 20111 - DNA, 20 bp, Artificial Sequence
  chemically synthesized
agagagagatgggggagaga

SEQ ID NO: 20112 - DNA, 20 bp, Artificial Sequence
  chemically synthesized
agagagatgggggagagaga

SEQ ID NO: 20113 - DNA, 20 bp, Artificial Sequence
  chemically synthesized
agagatgggggagagagaga

SEQ ID NO: 20114 - DNA, 20 bp, Artificial Sequence
  chemically synthesized
agatgggggagagagagaga

SEQ ID NO: 20115 - DNA, 20 bp, Artificial Sequence
  chemically synthesized
atgggggagagagagagaga

SEQ ID NO: 20116 - DNA, 20 bp, Artificial Sequence
  chemically synthesized
gggagagagagagagagagc

SEQ ID NO: 20117 - DNA, 20 bp, Artificial Sequence
  chemically synthesized
gagagagagagagagagcga

SEQ ID NO: 20118 - DNA, 20 bp, Artificial Sequence
  chemically synthesized
gagagagagagagagcgaga

SEQ ID NO: 20119 - DNA, 20 bp, Artificial Sequence
  chemically synthesized
gagagagagagagcgagaga

SEQ ID NO: 20120 - DNA, 20 bp, Artificial Sequence
  chemically synthesized
agagagagagagcgagagag

SEQ ID NO: 20121 - DNA, 20 bp, Artificial Sequence
  chemically synthesized
gagagagagcgagagagagg

SEQ ID NO: 20122 - DNA, 20 bp, Artificial Sequence
  chemically synthesized
gagagagcgagagagaggca

SEQ ID NO: 20123 - DNA, 20 bp, Artificial Sequence
  chemically synthesized
gagcgagagagaggcagaga

SEQ ID NO: 20124 - DNA, 20 bp, Artificial Sequence
  chemically synthesized
gcgagagagaggcagagaaa

SEQ ID NO: 20125 - DNA, 20 bp, Artificial Sequence
  chemically synthesized
agagaaagagatccttattt

SEQ ID NO: 20126 - DNA, 20 bp, Artificial Sequence
  chemically synthesized
tattctatacttctttgaaa

SEQ ID NO: 20127 - DNA, 20 bp, Artificial Sequence
  chemically synthesized
ttctttgaaatagtgatttt

SEQ ID NO: 20128 - DNA, 20 bp, Artificial Sequence
  chemically synthesized
aatagtgatttttagtaaat

SEQ ID NO: 20129 - DNA, 20 bp, Artificial Sequence
  chemically synthesized
agtgatttttagtaaattgg

SEQ ID NO: 20130 - DNA, 20 bp, Artificial Sequence
  chemically synthesized
tagtaaattggcagtgttgc

SEQ ID NO: 20131 - DNA, 20 bp, Artificial Sequence
  chemically synthesized
agtgttgccagatgacgact

SEQ ID NO: 20132 - DNA, 20 bp, Artificial Sequence
  chemically synthesized
tgttgccagatgacgactta

SEQ ID NO: 20133 - DNA, 20 bp, Artificial Sequence
  chemically synthesized
cctcattgttatatgtacca

SEQ ID NO: 20134 - DNA, 20 bp, Artificial Sequence
  chemically synthesized
cattgttatatgtaccatgg

SEQ ID NO: 20135 - DNA, 20 bp, Artificial Sequence
  chemically synthesized
tggtagctcatcttttcttt

SEQ ID NO: 20136 - DNA, 20 bp, Artificial Sequence
  chemically synthesized
ggtagctcatcttttctttc

SEQ ID NO: 20137 - DNA, 20 bp, Artificial Sequence
  chemically synthesized
tcatcttttctttcaggtga

SEQ ID NO: 20138 - DNA, 20 bp, Artificial Sequence
  chemically synthesized
ctttgtcctcacgctaaaca

SEQ ID NO: 20139 - DNA, 20 bp, Artificial Sequence
  chemically synthesized
acatagcccccatgttgttc

SEQ ID NO: 20140 - DNA, 20 bp, Artificial Sequence
  chemically synthesized
catagcccccatgttgttcc

SEQ ID NO: 20141 - DNA, 20 bp, Artificial Sequence
  chemically synthesized
cccatgttgttccaggaaaa

SEQ ID NO: 20142 - DNA, 20 bp, Artificial Sequence
  chemically synthesized
catgttgttccaggaaaata

SEQ ID NO: 20143 - DNA, 20 bp, Artificial Sequence
  chemically synthesized
atagagatcaataaaataca

SEQ ID NO: 20144 - DNA, 20 bp, Artificial Sequence
  chemically synthesized
aatacaaagtacttgtttga

SEQ ID NO: 20145 - DNA, 20 bp, Artificial Sequence
  chemically synthesized
aaagtacttgtttgaaagtg

SEQ ID NO: 20146 - DNA, 20 bp, Artificial Sequence
  chemically synthesized
aagtacttgtttgaaagtga

SEQ ID NO: 20147 - DNA, 20 bp, Artificial Sequence
  chemically synthesized
cttgtttgaaagtgaaggtt

SEQ ID NO: 20148 - DNA, 20 bp, Artificial Sequence
  chemically synthesized
aaattcaatgacctacgctg

SEQ ID NO: 20149 - DNA, 20 bp, Artificial Sequence
  chemically synthesized
gatcattcattaatgatatt

SEQ ID NO: 20150 - DNA, 20 bp, Artificial Sequence
  chemically synthesized
agtattttcttttttaatgt

SEQ ID NO: 20151 - DNA, 20 bp, Artificial Sequence
  chemically synthesized
agaataaaaccatttatttg

SEQ ID NO: 20152 - DNA, 20 bp, Artificial Sequence
  chemically synthesized
tatgtgtatgtaaatctcct

SEQ ID NO: 20153 - DNA, 20 bp, Artificial Sequence
  chemically synthesized
ttatacctcaaatatgaaaa

SEQ ID NO: 20154 - DNA, 20 bp, Artificial Sequence
  chemically synthesized
tatacctcaaatatgaaaat

SEQ ID NO: 20155 - DNA, 20 bp, Artificial Sequence
  chemically synthesized
tcttgcattcacttatattc

SEQ ID NO: 20156 - DNA, 20 bp, Artificial Sequence
  chemically synthesized
cacttatattctagcttgtt

SEQ ID NO: 20157 - DNA, 20 bp, Artificial Sequence
  chemically synthesized
cttatattctagcttgttaa

SEQ ID NO: 20158 - DNA, 20 bp, Artificial Sequence
  chemically synthesized
tatattctagcttgttaaga

SEQ ID NO: 20159 - DNA, 20 bp, Artificial Sequence
  chemically synthesized
attctagcttgttaagagag

SEQ ID NO: 20160 - DNA, 20 bp, Artificial Sequence
  chemically synthesized
agcttgttaagagagaagtt

SEQ ID NO: 20161 - DNA, 20 bp, Artificial Sequence
  chemically synthesized
gcttgttaagagagaagttt

SEQ ID NO: 20162 - DNA, 20 bp, Artificial Sequence
  chemically synthesized
cttgttaagagagaagtttg

SEQ ID NO: 20163 - DNA, 20 bp, Artificial Sequence
  chemically synthesized
ggcaaaatgtgctttataaa

SEQ ID NO: 20164 - DNA, 20 bp, Artificial Sequence
  chemically synthesized
ctttataaatagtaaaaact

SEQ ID NO: 20165 - DNA, 20 bp, Artificial Sequence
  chemically synthesized
tttataaatagtaaaaactg

SEQ ID NO: 20166 - DNA, 20 bp, Artificial Sequence
  chemically synthesized
gtaaaaactgaggtaaacta

SEQ ID NO: 20167 - DNA, 20 bp, Artificial Sequence
  chemically synthesized
ctgaggtaaactatagcaca

SEQ ID NO: 20168 - DNA, 20 bp, Artificial Sequence
  chemically synthesized
cacaaagtgtgctatataaa

SEQ ID NO: 20169 - DNA, 20 bp, Artificial Sequence
  chemically synthesized
ctatataaacagtaaaaacc

SEQ ID NO: 20170 - DNA, 20 bp, Artificial Sequence
  chemically synthesized
tatataaacagtaaaaaccg

SEQ ID NO: 20171 - DNA, 20 bp, Artificial Sequence
  chemically synthesized
taaaaaccgaggtaaaaata

SEQ ID NO: 20172 - DNA, 20 bp, Artificial Sequence
  chemically synthesized
aaaaaccgaggtaaaaatat

SEQ ID NO: 20173 - DNA, 20 bp, Artificial Sequence
  chemically synthesized
aaaaccgaggtaaaaatatg

SEQ ID NO: 20174 - DNA, 20 bp, Artificial Sequence
  chemically synthesized
aaccgaggtaaaaatatggg

SEQ ID NO: 20175 - DNA, 20 bp, Artificial Sequence
  chemically synthesized
accgaggtaaaaatatgggg

SEQ ID NO: 20176 - DNA, 20 bp, Artificial Sequence
  chemically synthesized
aaaatatggggaggacaaaa

SEQ ID NO: 20177 - DNA, 20 bp, Artificial Sequence
  chemically synthesized
aaatatggggaggacaaaaa

SEQ ID NO: 20178 - DNA, 20 bp, Artificial Sequence
  chemically synthesized
aatatggggaggacaaaaaa

SEQ ID NO: 20179 - DNA, 20 bp, Artificial Sequence
  chemically synthesized
aggacaaaaaagggctaaaa

SEQ ID NO: 20180 - DNA, 20 bp, Artificial Sequence
  chemically synthesized
aaaaagggctaaaatggtgt

SEQ ID NO: 20181 - DNA, 20 bp, Artificial Sequence
  chemically synthesized
ctaaaatggtgttggaatat

SEQ ID NO: 20182 - DNA, 20 bp, Artificial Sequence
  chemically synthesized
tggtgttggaatataagaaa

SEQ ID NO: 20183 - DNA, 20 bp, Artificial Sequence
  chemically synthesized
tgttggaatataagaaatag

SEQ ID NO: 20184 - DNA, 20 bp, Artificial Sequence
  chemically synthesized
aatataagaaatagcagtaa

SEQ ID NO: 20185 - DNA, 20 bp, Artificial Sequence
  chemically synthesized
ataagaaatagcagtaaaag

SEQ ID NO: 20186 - DNA, 20 bp, Artificial Sequence
  chemically synthesized
gcagtaaaagaagctcctca

SEQ ID NO: 20187 - DNA, 20 bp, Artificial Sequence
  chemically synthesized
taaaagaagctcctcacagc

SEQ ID NO: 20188 - DNA, 20 bp, Artificial Sequence
  chemically synthesized
agaagctcctcacagcaaga

SEQ ID NO: 20189 - DNA, 20 bp, Artificial Sequence
  chemically synthesized
ctcctcacagcaagacagta

SEQ ID NO: 20190 - DNA, 20 bp, Artificial Sequence
  chemically synthesized
tcctcacagcaagacagtac

SEQ ID NO: 20191 - DNA, 20 bp, Artificial Sequence
  chemically synthesized
cctcacagcaagacagtaca

SEQ ID NO: 20192 - DNA, 20 bp, Artificial Sequence
  chemically synthesized
agacagtacagggaaatgtc

SEQ ID NO: 20193 - DNA, 20 bp, Artificial Sequence
  chemically synthesized
acagtacagggaaatgtctg

SEQ ID NO: 20194 - DNA, 20 bp, Artificial Sequence
  chemically synthesized
cagtacagggaaatgtctgg

SEQ ID NO: 20195 - DNA, 20 bp, Artificial Sequence
  chemically synthesized
agtacagggaaatgtctgga

SEQ ID NO: 20196 - DNA, 20 bp, Artificial Sequence
  chemically synthesized
gggaaatgtctggagggaca

SEQ ID NO: 20197 - DNA, 20 bp, Artificial Sequence
  chemically synthesized
gacaaagatttacttacaat

SEQ ID NO: 20198 - DNA, 20 bp, Artificial Sequence
  chemically synthesized
acaaagatttacttacaatc

SEQ ID NO: 20199 - DNA, 20 bp, Artificial Sequence
  chemically synthesized
aatcaggcctcaaccaatat

SEQ ID NO: 20200 - DNA, 20 bp, Artificial Sequence
  chemically synthesized
tatgacgtgtttatatgtat

SEQ ID NO: 20201 - DNA, 20 bp, Artificial Sequence
  chemically synthesized
atgacgtgtttatatgtatc

SEQ ID NO: 20202 - DNA, 20 bp, Artificial Sequence
  chemically synthesized
gcatataatgtataatgatc

SEQ ID NO: 20203 - DNA, 20 bp, Artificial Sequence
  chemically synthesized
ataatgtataatgatcaagt

SEQ ID NO: 20204 - DNA, 20 bp, Artificial Sequence
  chemically synthesized
taatgtataatgatcaagtc

SEQ ID NO: 20205 - DNA, 20 bp, Artificial Sequence
  chemically synthesized
taatgatcaagtcaggtatt

SEQ ID NO: 20206 - DNA, 20 bp, Artificial Sequence
  chemically synthesized
aatgatcaagtcaggtattt

SEQ ID NO: 20207 - DNA, 20 bp, Artificial Sequence
  chemically synthesized
atgatcaagtcaggtatttg

SEQ ID NO: 20208 - DNA, 20 bp, Artificial Sequence
  chemically synthesized
tttggggtattcatcacctc

SEQ ID NO: 20209 - DNA, 20 bp, Artificial Sequence
  chemically synthesized
tatttatcgtttctatgtgt

SEQ ID NO: 20210 - DNA, 20 bp, Artificial Sequence
  chemically synthesized
atttatcgtttctatgtgtt

SEQ ID NO: 20211 - DNA, 20 bp, Artificial Sequence
  chemically synthesized
ctatgtgttaggaacatttc

SEQ ID NO: 20212 - DNA, 20 bp, Artificial Sequence
  chemically synthesized
cctactttgctattgaacat

SEQ ID NO: 20213 - DNA, 20 bp, Artificial Sequence
  chemically synthesized
tacacacctttctctacctc

SEQ ID NO: 20214 - DNA, 20 bp, Artificial Sequence
  chemically synthesized
ctacatgatattaacttttt

SEQ ID NO: 20215 - DNA, 20 bp, Artificial Sequence
  chemically synthesized
cttttttagctcccacatat

SEQ ID NO: 20216 - DNA, 20 bp, Artificial Sequence
  chemically synthesized
tttagctcccacatatcagt

SEQ ID NO: 20217 - DNA, 20 bp, Artificial Sequence
  chemically synthesized
aaaatttgtctttctatgcc

SEQ ID NO: 20218 - DNA, 20 bp, Artificial Sequence
  chemically synthesized
tcgtttaacataatgacttc

SEQ ID NO: 20219 - DNA, 20 bp, Artificial Sequence
  chemically synthesized
gaaatgattttatatttgta

SEQ ID NO: 20220 - DNA, 20 bp, Artificial Sequence
  chemically synthesized
tttcttcattcatccattga

SEQ ID NO: 20221 - DNA, 20 bp, Artificial Sequence
  chemically synthesized
ttcatccattgatggacact

SEQ ID NO: 20222 - DNA, 20 bp, Artificial Sequence
  chemically synthesized
tcatccattgatggacactt

SEQ ID NO: 20223 - DNA, 20 bp, Artificial Sequence
  chemically synthesized
gtgaatcgtgctgcaataaa

SEQ ID NO: 20224 - DNA, 20 bp, Artificial Sequence
  chemically synthesized
tcgtgctgcaataaacagtg

SEQ ID NO: 20225 - DNA, 20 bp, Artificial Sequence
  chemically synthesized
tgcaataaacagtgtggtac

SEQ ID NO: 20226 - DNA, 20 bp, Artificial Sequence
  chemically synthesized
tattctgaattcttttcctt

SEQ ID NO: 20227 - DNA, 20 bp, Artificial Sequence
  chemically synthesized
ttttcctttggataaatacc

SEQ ID NO: 20228 - DNA, 20 bp, Artificial Sequence
  chemically synthesized
ttggataaatacccagtaat

SEQ ID NO: 20229 - DNA, 20 bp, Artificial Sequence
  chemically synthesized
atacccagtaataagattgc

SEQ ID NO: 20230 - DNA, 20 bp, Artificial Sequence
  chemically synthesized
aagattgctggatcttatga

SEQ ID NO: 20231 - DNA, 20 bp, Artificial Sequence
  chemically synthesized
tcttatgatagttcaatttt

SEQ ID NO: 20232 - DNA, 20 bp, Artificial Sequence
  chemically synthesized
tagttcaatttttagctttt

SEQ ID NO: 20233 - DNA, 20 bp, Artificial Sequence
  chemically synthesized
aatctacatattgttttcca

SEQ ID NO: 20234 - DNA, 20 bp, Artificial Sequence
  chemically synthesized
ctacatattgttttccatag

SEQ ID NO: 20235 - DNA, 20 bp, Artificial Sequence
  chemically synthesized
ctaatttgcatgcttaccaa

SEQ ID NO: 20236 - DNA, 20 bp, Artificial Sequence
  chemically synthesized
tgcttaccaatagtgcctac

SEQ ID NO: 20237 - DNA, 20 bp, Artificial Sequence
  chemically synthesized
cttttccttcacatccttgc

SEQ ID NO: 20238 - DNA, 20 bp, Artificial Sequence
  chemically synthesized
taaatcatgatgattctaac

SEQ ID NO: 20239 - DNA, 20 bp, Artificial Sequence
  chemically synthesized
atgatgattctaactggcat

SEQ ID NO: 20240 - DNA, 20 bp, Artificial Sequence
  chemically synthesized
cataagatgatatctcattg

SEQ ID NO: 20241 - DNA, 20 bp, Artificial Sequence
  chemically synthesized
atttgcatttctctgatgat

SEQ ID NO: 20242 - DNA, 20 bp, Artificial Sequence
  chemically synthesized
ctctgatgattagtaatgtt

SEQ ID NO: 20243 - DNA, 20 bp, Artificial Sequence
  chemically synthesized
tcctttgccaattttttaat

SEQ ID NO: 20244 - DNA, 20 bp, Artificial Sequence
  chemically synthesized
ttatttgtttttccactgtt

SEQ ID NO: 20245 - DNA, 20 bp, Artificial Sequence
  chemically synthesized
tttccactgttgagttgttt

SEQ ID NO: 20246 - DNA, 20 bp, Artificial Sequence
  chemically synthesized
tttgagtttcttatatattc

SEQ ID NO: 20247 - DNA, 20 bp, Artificial Sequence
  chemically synthesized
tgagtttcttatatattctg

SEQ ID NO: 20248 - DNA, 20 bp, Artificial Sequence
  chemically synthesized
aaatattttctcgcattcaa

SEQ ID NO: 20249 - DNA, 20 bp, Artificial Sequence
  chemically synthesized
tgattgtttcctttactgtg

SEQ ID NO: 20250 - DNA, 20 bp, Artificial Sequence
  chemically synthesized
tttactgtgcagatgtattt

SEQ ID NO: 20251 - DNA, 20 bp, Artificial Sequence
  chemically synthesized
agatgtattttagcttaata

SEQ ID NO: 20252 - DNA, 20 bp, Artificial Sequence
  chemically synthesized
cttttgttgcctgtgctttt

SEQ ID NO: 20253 - DNA, 20 bp, Artificial Sequence
  chemically synthesized
ttttgttgcctgtgcttttg

SEQ ID NO: 20254 - DNA, 20 bp, Artificial Sequence
  chemically synthesized
tgcctgtgcttttgaggtct

SEQ ID NO: 20255 - DNA, 20 bp, Artificial Sequence
  chemically synthesized
ggccataaaatctttgccca

SEQ ID NO: 20256 - DNA, 20 bp, Artificial Sequence
  chemically synthesized
ttgcccaaagccatgtcttg

SEQ ID NO: 20257 - DNA, 20 bp, Artificial Sequence
  chemically synthesized
gtctcccttatgttttcttt

SEQ ID NO: 20258 - DNA, 20 bp, Artificial Sequence
  chemically synthesized
tcccttatgttttcttttag

SEQ ID NO: 20259 - DNA, 20 bp, Artificial Sequence
  chemically synthesized
gttttcttttagtagtttta

SEQ ID NO: 20260 - DNA, 20 bp, Artificial Sequence
  chemically synthesized
tttagtagttttatagtttt

SEQ ID NO: 20261 - DNA, 20 bp, Artificial Sequence
  chemically synthesized
tagttttaagttttatattt

SEQ ID NO: 20262 - DNA, 20 bp, Artificial Sequence
  chemically synthesized
ttaagtctttaatccatctt

SEQ ID NO: 20263 - DNA, 20 bp, Artificial Sequence
  chemically synthesized
aagtctttaatccatcttga

SEQ ID NO: 20264 - DNA, 20 bp, Artificial Sequence
  chemically synthesized
tcttgagagtacgttttata

SEQ ID NO: 20265 - DNA, 20 bp, Artificial Sequence
  chemically synthesized
acgttttatatggcaataaa

SEQ ID NO: 20266 - DNA, 20 bp, Artificial Sequence
  chemically synthesized
cgttttatatggcaataaat

SEQ ID NO: 20267 - DNA, 20 bp, Artificial Sequence
  chemically synthesized
gttttatatggcaataaata

SEQ ID NO: 20268 - DNA, 20 bp, Artificial Sequence
  chemically synthesized
ttttatatggcaataaatag

SEQ ID NO: 20269 - DNA, 20 bp, Artificial Sequence
  chemically synthesized
gcaataaataggggttgtat

SEQ ID NO: 20270 - DNA, 20 bp, Artificial Sequence
  chemically synthesized
caataaataggggttgtatt

SEQ ID NO: 20271 - DNA, 20 bp, Artificial Sequence
  chemically synthesized
catttttgcatctattgtac

SEQ ID NO: 20272 - DNA, 20 bp, Artificial Sequence
  chemically synthesized
atttttgcatctattgtaca

SEQ ID NO: 20273 - DNA, 20 bp, Artificial Sequence
  chemically synthesized
tttttgcatctattgtacaa

SEQ ID NO: 20274 - DNA, 20 bp, Artificial Sequence
  chemically synthesized
ttttgcatctattgtacaag

SEQ ID NO: 20275 - DNA, 20 bp, Artificial Sequence
  chemically synthesized
catctattgtacaaggggtt

SEQ ID NO: 20276 - DNA, 20 bp, Artificial Sequence
  chemically synthesized
tcttgatttgattctccatt

SEQ ID NO: 20277 - DNA, 20 bp, Artificial Sequence
  chemically synthesized
attctccatttggttgctgt

SEQ ID NO: 20278 - DNA, 20 bp, Artificial Sequence
  chemically synthesized
atttggttgctgttggtgta

SEQ ID NO: 20279 - DNA, 20 bp, Artificial Sequence
  chemically synthesized
tggttgctgttggtgtatag

SEQ ID NO: 20280 - DNA, 20 bp, Artificial Sequence
  chemically synthesized
gttgctgttggtgtatagaa

SEQ ID NO: 20281 - DNA, 20 bp, Artificial Sequence
  chemically synthesized
gtgtgcattcatcttgtatc

SEQ ID NO: 20282 - DNA, 20 bp, Artificial Sequence
  chemically synthesized
actttgctgaattattttat

SEQ ID NO: 20283 - DNA, 20 bp, Artificial Sequence
  chemically synthesized
ctgaattattttatcagttc

SEQ ID NO: 20284 - DNA, 20 bp, Artificial Sequence
  chemically synthesized
tgaattattttatcagttct

SEQ ID NO: 20285 - DNA, 20 bp, Artificial Sequence
  chemically synthesized
aattattttatcagttctag

SEQ ID NO: 20286 - DNA, 20 bp, Artificial Sequence
  chemically synthesized
tatcagttctaggagctttc

SEQ ID NO: 20287 - DNA, 20 bp, Artificial Sequence
  chemically synthesized
tcagttctaggagctttctg

SEQ ID NO: 20288 - DNA, 20 bp, Artificial Sequence
  chemically synthesized
cagttctaggagctttctgg

SEQ ID NO: 20289 - DNA, 20 bp, Artificial Sequence
  chemically synthesized
gttctaggagctttctggag

SEQ ID NO: 20290 - DNA, 20 bp, Artificial Sequence
  chemically synthesized
gagctttctggaggagtctt

SEQ ID NO: 20291 - DNA, 20 bp, Artificial Sequence
  chemically synthesized
agctttctggaggagtcttt

SEQ ID NO: 20292 - DNA, 20 bp, Artificial Sequence
  chemically synthesized
gctttctggaggagtcttta

SEQ ID NO: 20293 - DNA, 20 bp, Artificial Sequence
  chemically synthesized
gaggagtctttagggtttta

SEQ ID NO: 20294 - DNA, 20 bp, Artificial Sequence
  chemically synthesized
aggagtctttagggttttaa

SEQ ID NO: 20295 - DNA, 20 bp, Artificial Sequence
  chemically synthesized
aaggtaaatgatcatatcat

SEQ ID NO: 20296 - DNA, 20 bp, Artificial Sequence
  chemically synthesized
atgatcatatcatcagcaaa

SEQ ID NO: 20297 - DNA, 20 bp, Artificial Sequence
  chemically synthesized
atatcatcagcaaacagtga

SEQ ID NO: 20298 - DNA, 20 bp, Artificial Sequence
  chemically synthesized
tttgttttgtctgattgccc

SEQ ID NO: 20299 - DNA, 20 bp, Artificial Sequence
  chemically synthesized
ttttgtctgattgccctggc

SEQ ID NO: 20300 - DNA, 20 bp, Artificial Sequence
  chemically synthesized
tttgtctgattgccctggct

SEQ ID NO: 20301 - DNA, 20 bp, Artificial Sequence
  chemically synthesized
attgccctggctaggacttc

SEQ ID NO: 20302 - DNA, 20 bp, Artificial Sequence
  chemically synthesized
ggacttccagtactatgttg

SEQ ID NO: 20303 - DNA, 20 bp, Artificial Sequence
  chemically synthesized
acttccagtactatgttgaa

SEQ ID NO: 20304 - DNA, 20 bp, Artificial Sequence
  chemically synthesized
cttccagtactatgttgaag

SEQ ID NO: 20305 - DNA, 20 bp, Artificial Sequence
  chemically synthesized
tccagtactatgttgaagag

SEQ ID NO: 20306 - DNA, 20 bp, Artificial Sequence
  chemically synthesized
agtactatgttgaagaggag

SEQ ID NO: 20307 - DNA, 20 bp, Artificial Sequence
  chemically synthesized
ctatgttgaagaggagtggt

SEQ ID NO: 20308 - DNA, 20 bp, Artificial Sequence
  chemically synthesized
atgttgaagaggagtggtga

SEQ ID NO: 20309 - DNA, 20 bp, Artificial Sequence
  chemically synthesized
ttgaagaggagtggtgagag

SEQ ID NO: 20310 - DNA, 20 bp, Artificial Sequence
  chemically synthesized
tgaagaggagtggtgagagt

SEQ ID NO: 20311 - DNA, 20 bp, Artificial Sequence
  chemically synthesized
tgggcatccttgtcttgttc

SEQ ID NO: 20312 - DNA, 20 bp, Artificial Sequence
  chemically synthesized
ccttgtcttgttccagttct

SEQ ID NO: 20313 - DNA, 20 bp, Artificial Sequence
  chemically synthesized
ttgtcttgttccagttctca

SEQ ID NO: 20314 - DNA, 20 bp, Artificial Sequence
  chemically synthesized
tgtcttgttccagttctcag

SEQ ID NO: 20315 - DNA, 20 bp, Artificial Sequence
  chemically synthesized
gtcttgttccagttctcaga

SEQ ID NO: 20316 - DNA, 20 bp, Artificial Sequence
  chemically synthesized
ttccccattcaatattatgt

SEQ ID NO: 20317 - DNA, 20 bp, Artificial Sequence
  chemically synthesized
attcaatattatgttggctg

SEQ ID NO: 20318 - DNA, 20 bp, Artificial Sequence
  chemically synthesized
ttcaatattatgttggctgt

SEQ ID NO: 20319 - DNA, 20 bp, Artificial Sequence
  chemically synthesized
tgttggctgtgggtttgtca

SEQ ID NO: 20320 - DNA, 20 bp, Artificial Sequence
  chemically synthesized
ggctgtgggtttgtcacaga

SEQ ID NO: 20321 - DNA, 20 bp, Artificial Sequence
  chemically synthesized
cagatggcttttattacact

SEQ ID NO: 20322 - DNA, 20 bp, Artificial Sequence
  chemically synthesized
agatggcttttattacactg

SEQ ID NO: 20323 - DNA, 20 bp, Artificial Sequence
  chemically synthesized
tcttgtatgctgattttgct

SEQ ID NO: 20324 - DNA, 20 bp, Artificial Sequence
  chemically synthesized
ttttaatcataaatgtatgc

SEQ ID NO: 20325 - DNA, 20 bp, Artificial Sequence
  chemically synthesized
atgctttttctgcatctatt

SEQ ID NO: 20326 - DNA, 20 bp, Artificial Sequence
  chemically synthesized
tgtttttaaatctgtttatg

SEQ ID NO: 20327 - DNA, 20 bp, Artificial Sequence
  chemically synthesized
gtatcacacttattgacttg

SEQ ID NO: 20328 - DNA, 20 bp, Artificial Sequence
  chemically synthesized
tcaaaccaaccctgcatccc

SEQ ID NO: 20329 - DNA, 20 bp, Artificial Sequence
  chemically synthesized
ccaaccctgcatccctggca

SEQ ID NO: 20330 - DNA, 20 bp, Artificial Sequence
  chemically synthesized
gcatggaacctgcttgatca

SEQ ID NO: 20331 - DNA, 20 bp, Artificial Sequence
  chemically synthesized
tggaacctgcttgatcatgg

SEQ ID NO: 20332 - DNA, 20 bp, Artificial Sequence
  chemically synthesized
ttttgttatgttgttgaatt

SEQ ID NO: 20333 - DNA, 20 bp, Artificial Sequence
  chemically synthesized
tgttgttgaatttggttatc

SEQ ID NO: 20334 - DNA, 20 bp, Artificial Sequence
  chemically synthesized
tggttatctagtattttgtt

SEQ ID NO: 20335 - DNA, 20 bp, Artificial Sequence
  chemically synthesized
ggttatctagtattttgtta

SEQ ID NO: 20336 - DNA, 20 bp, Artificial Sequence
  chemically synthesized
tagtattttgttaaggattt

SEQ ID NO: 20337 - DNA, 20 bp, Artificial Sequence
  chemically synthesized
ttttagcatctatgttcatc

SEQ ID NO: 20338 - DNA, 20 bp, Artificial Sequence
  chemically synthesized
tttagcatctatgttcatca

SEQ ID NO: 20339 - DNA, 20 bp, Artificial Sequence
  chemically synthesized
tctatgttcatcaaggctat

SEQ ID NO: 20340 - DNA, 20 bp, Artificial Sequence
  chemically synthesized
tcatcaaggctatcagtctg

SEQ ID NO: 20341 - DNA, 20 bp, Artificial Sequence
  chemically synthesized
cagtctgtagttttcttttt

SEQ ID NO: 20342 - DNA, 20 bp, Artificial Sequence
  chemically synthesized
tttttggttatgtccttccc

SEQ ID NO: 20343 - DNA, 20 bp, Artificial Sequence
  chemically synthesized
gttatgtccttccctggttt

SEQ ID NO: 20344 - DNA, 20 bp, Artificial Sequence
  chemically synthesized
ccctggttttggtgtgatgc

SEQ ID NO: 20345 - DNA, 20 bp, Artificial Sequence
  chemically synthesized
ttggtgtgatgctggcttca

SEQ ID NO: 20346 - DNA, 20 bp, Artificial Sequence
  chemically synthesized
gctggcttcatagaatgaat

SEQ ID NO: 20347 - DNA, 20 bp, Artificial Sequence
  chemically synthesized
ctggcttcatagaatgaatt

SEQ ID NO: 20348 - DNA, 20 bp, Artificial Sequence
  chemically synthesized
tggcttcatagaatgaatta

SEQ ID NO: 20349 - DNA, 20 bp, Artificial Sequence
  chemically synthesized
cttcatagaatgaattaggg

SEQ ID NO: 20350 - DNA, 20 bp, Artificial Sequence
  chemically synthesized
ttcatagaatgaattagggc

SEQ ID NO: 20351 - DNA, 20 bp, Artificial Sequence
  chemically synthesized
ttccttctttatctgtcttg

SEQ ID NO: 20352 - DNA, 20 bp, Artificial Sequence
  chemically synthesized
tctttatctgtcttgtagaa

SEQ ID NO: 20353 - DNA, 20 bp, Artificial Sequence
  chemically synthesized
tcttgtagaatagtgtcaaa

SEQ ID NO: 20354 - DNA, 20 bp, Artificial Sequence
  chemically synthesized
gtagaatagtgtcaaaaaga

SEQ ID NO: 20355 - DNA, 20 bp, Artificial Sequence
  chemically synthesized
tagaatagtgtcaaaaagat

SEQ ID NO: 20356 - DNA, 20 bp, Artificial Sequence
  chemically synthesized
agaatagtgtcaaaaagatg

SEQ ID NO: 20357 - DNA, 20 bp, Artificial Sequence
  chemically synthesized
ccaattcctctttgaatgtc

SEQ ID NO: 20358 - DNA, 20 bp, Artificial Sequence
  chemically synthesized
attcctctttgaatgtctag

SEQ ID NO: 20359 - DNA, 20 bp, Artificial Sequence
  chemically synthesized
aattctgttgtgaatccatc

SEQ ID NO: 20360 - DNA, 20 bp, Artificial Sequence
  chemically synthesized
tctggtcctgaacttttttt

SEQ ID NO: 20361 - DNA, 20 bp, Artificial Sequence
  chemically synthesized
gtcctgaacttttttttggt

SEQ ID NO: 20362 - DNA, 20 bp, Artificial Sequence
  chemically synthesized
taaatctcactgcttgttat

SEQ ID NO: 20363 - DNA, 20 bp, Artificial Sequence
  chemically synthesized
actgcttgttattggtctgt

SEQ ID NO: 20364 - DNA, 20 bp, Artificial Sequence
  chemically synthesized
ggtctgttagtaaatttatt

SEQ ID NO: 20365 - DNA, 20 bp, Artificial Sequence
  chemically synthesized
gtctgttagtaaatttattg

SEQ ID NO: 20366 - DNA, 20 bp, Artificial Sequence
  chemically synthesized
atttattgaggctcatttca

SEQ ID NO: 20367 - DNA, 20 bp, Artificial Sequence
  chemically synthesized
tcatttcatggcctatcata

SEQ ID NO: 20368 - DNA, 20 bp, Artificial Sequence
  chemically synthesized
gcctatcatatggtctacct

SEQ ID NO: 20369 - DNA, 20 bp, Artificial Sequence
  chemically synthesized
ctatcatatggtctaccttg

SEQ ID NO: 20370 - DNA, 20 bp, Artificial Sequence
  chemically synthesized
aatttccacgcgctgttgaa

SEQ ID NO: 20371 - DNA, 20 bp, Artificial Sequence
  chemically synthesized
tgaatagaatgtgtgttctg

SEQ ID NO: 20372 - DNA, 20 bp, Artificial Sequence
  chemically synthesized
aatgtgtgttctgtggttat

SEQ ID NO: 20373 - DNA, 20 bp, Artificial Sequence
  chemically synthesized
atgttctgtatataactgtt

SEQ ID NO: 20374 - DNA, 20 bp, Artificial Sequence
  chemically synthesized
ctgttaagtccatttgttct

SEQ ID NO: 20375 - DNA, 20 bp, Artificial Sequence
  chemically synthesized
tgttaagtccatttgttcta

SEQ ID NO: 20376 - DNA, 20 bp, Artificial Sequence
  chemically synthesized
ttctgtcttgatgaactgtc

SEQ ID NO: 20377 - DNA, 20 bp, Artificial Sequence
  chemically synthesized
actgtctagtgctgtcaatg

SEQ ID NO: 20378 - DNA, 20 bp, Artificial Sequence
  chemically synthesized
gtgctgtcaatgaagtattg

SEQ ID NO: 20379 - DNA, 20 bp, Artificial Sequence
  chemically synthesized
ttgctgtctatctcatttct

SEQ ID NO: 20380 - DNA, 20 bp, Artificial Sequence
  chemically synthesized
tgctgtctatctcatttctt

SEQ ID NO: 20381 - DNA, 20 bp, Artificial Sequence
  chemically synthesized
atctcatttcttaggtctat

SEQ ID NO: 20382 - DNA, 20 bp, Artificial Sequence
  chemically synthesized
tagtaattgttctataaatt

SEQ ID NO: 20383 - DNA, 20 bp, Artificial Sequence
  chemically synthesized
agtaattgttctataaattt

SEQ ID NO: 20384 - DNA, 20 bp, Artificial Sequence
  chemically synthesized
taattgttctataaatttgg

SEQ ID NO: 20385 - DNA, 20 bp, Artificial Sequence
  chemically synthesized
ttctataaatttgggagctc

SEQ ID NO: 20386 - DNA, 20 bp, Artificial Sequence
  chemically synthesized
aaatttgggagctccagtgt

SEQ ID NO: 20387 - DNA, 20 bp, Artificial Sequence
  chemically synthesized
aatttgggagctccagtgtt

SEQ ID NO: 20388 - DNA, 20 bp, Artificial Sequence
  chemically synthesized
tgttaggtgcatatatgttt

SEQ ID NO: 20389 - DNA, 20 bp, Artificial Sequence
  chemically synthesized
agattgtgatattttcctgt

SEQ ID NO: 20390 - DNA, 20 bp, Artificial Sequence
  chemically synthesized
gtgatattttcctgttggac

SEQ ID NO: 20391 - DNA, 20 bp, Artificial Sequence
  chemically synthesized
tgatattttcctgttggaca

SEQ ID NO: 20392 - DNA, 20 bp, Artificial Sequence
  chemically synthesized
ttttaactgctgttgcttta

SEQ ID NO: 20393 - DNA, 20 bp, Artificial Sequence
  chemically synthesized
ttgttttgcctactcacttt

SEQ ID NO: 20394 - DNA, 20 bp, Artificial Sequence
  chemically synthesized
ttttgcctactcacttttgg

SEQ ID NO: 20395 - DNA, 20 bp, Artificial Sequence
  chemically synthesized
aatacctttttcaccctttt

SEQ ID NO: 20396 - DNA, 20 bp, Artificial Sequence
  chemically synthesized
acctttttcacccttttaag

SEQ ID NO: 20397 - DNA, 20 bp, Artificial Sequence
  chemically synthesized
ctttttcacccttttaagtg

SEQ ID NO: 20398 - DNA, 20 bp, Artificial Sequence
  chemically synthesized
acccttttaagtggagcatt

SEQ ID NO: 20399 - DNA, 20 bp, Artificial Sequence
  chemically synthesized
cccttttaagtggagcattt

SEQ ID NO: 20400 - DNA, 20 bp, Artificial Sequence
  chemically synthesized
aggccatttacattcaatgt

SEQ ID NO: 20401 - DNA, 20 bp, Artificial Sequence
  chemically synthesized
atgttagtaatgtaaatgcc

SEQ ID NO: 20402 - DNA, 20 bp, Artificial Sequence
  chemically synthesized
atgtaaatgcctggctatgc

SEQ ID NO: 20403 - DNA, 20 bp, Artificial Sequence
  chemically synthesized
tgtaaatgcctggctatgcc

SEQ ID NO: 20404 - DNA, 20 bp, Artificial Sequence
  chemically synthesized
aaatgcctggctatgccagg

SEQ ID NO: 20405 - DNA, 20 bp, Artificial Sequence
  chemically synthesized
aatgcctggctatgccaggc

SEQ ID NO: 20406 - DNA, 20 bp, Artificial Sequence
  chemically synthesized
ctggctatgccaggcaggaa

SEQ ID NO: 20407 - DNA, 20 bp, Artificial Sequence
  chemically synthesized
ccaggcaggaatggcctgct

SEQ ID NO: 20408 - DNA, 20 bp, Artificial Sequence
  chemically synthesized
caggcaggaatggcctgctc

SEQ ID NO: 20409 - DNA, 20 bp, Artificial Sequence
  chemically synthesized
aggcaggaatggcctgctca

SEQ ID NO: 20410 - DNA, 20 bp, Artificial Sequence
  chemically synthesized
gaatggcctgctcagggacc

SEQ ID NO: 20411 - DNA, 20 bp, Artificial Sequence
  chemically synthesized
ggcctgctcagggacccagt

SEQ ID NO: 20412 - DNA, 20 bp, Artificial Sequence
  chemically synthesized
tcagggacccagtgagctcc

SEQ ID NO: 20413 - DNA, 20 bp, Artificial Sequence
  chemically synthesized
cagggacccagtgagctccc

SEQ ID NO: 20414 - DNA, 20 bp, Artificial Sequence
  chemically synthesized
agggacccagtgagctccca

SEQ ID NO: 20415 - DNA, 20 bp, Artificial Sequence
  chemically synthesized
ctctacacctgtattttgct

SEQ ID NO: 20416 - DNA, 20 bp, Artificial Sequence
  chemically synthesized
tgtattttgctcagctctct

SEQ ID NO: 20417 - DNA, 20 bp, Artificial Sequence
  chemically synthesized
tctctaagttaactcaactc

SEQ ID NO: 20418 - DNA, 20 bp, Artificial Sequence
  chemically synthesized
ctctaagttaactcaactcc

SEQ ID NO: 20419 - DNA, 20 bp, Artificial Sequence
  chemically synthesized
aagttaactcaactccaggt

SEQ ID NO: 20420 - DNA, 20 bp, Artificial Sequence
  chemically synthesized
agttaactcaactccaggta

SEQ ID NO: 20421 - DNA, 20 bp, Artificial Sequence
  chemically synthesized
aactcaactccaggtaaggt

SEQ ID NO: 20422 - DNA, 20 bp, Artificial Sequence
  chemically synthesized
tcagaaacttctcccacaaa

SEQ ID NO: 20423 - DNA, 20 bp, Artificial Sequence
  chemically synthesized
ttctcccacaaacagacctt

SEQ ID NO: 20424 - DNA, 20 bp, Artificial Sequence
  chemically synthesized
aaacagaccttcagtttctc

SEQ ID NO: 20425 - DNA, 20 bp, Artificial Sequence
  chemically synthesized
cagaccttcagtttctccag

SEQ ID NO: 20426 - DNA, 20 bp, Artificial Sequence
  chemically synthesized
agaccttcagtttctccagt

SEQ ID NO: 20427 - DNA, 20 bp, Artificial Sequence
  chemically synthesized
accttcagtttctccagtgg

SEQ ID NO: 20428 - DNA, 20 bp, Artificial Sequence
  chemically synthesized
ctccagtgggagtgtgtgtt

SEQ ID NO: 20429 - DNA, 20 bp, Artificial Sequence
  chemically synthesized
tccagtgggagtgtgtgttt

SEQ ID NO: 20430 - DNA, 20 bp, Artificial Sequence
  chemically synthesized
cagtgggagtgtgtgtttag

SEQ ID NO: 20431 - DNA, 20 bp, Artificial Sequence
  chemically synthesized
gtgggagtgtgtgtttagga

SEQ ID NO: 20432 - DNA, 20 bp, Artificial Sequence
  chemically synthesized
tgggagtgtgtgtttaggag

SEQ ID NO: 20433 - DNA, 20 bp, Artificial Sequence
  chemically synthesized
ggagtgtgtgtttaggagag

SEQ ID NO: 20434 - DNA, 20 bp, Artificial Sequence
  chemically synthesized
gagtgtgtgtttaggagagg

SEQ ID NO: 20435 - DNA, 20 bp, Artificial Sequence
  chemically synthesized
atctccctttcccacttccg

SEQ ID NO: 20436 - DNA, 20 bp, Artificial Sequence
  chemically synthesized
ccctttcccacttccgcagt

SEQ ID NO: 20437 - DNA, 20 bp, Artificial Sequence
  chemically synthesized
cctttcccacttccgcagtt

SEQ ID NO: 20438 - DNA, 20 bp, Artificial Sequence
  chemically synthesized
ctttcccacttccgcagttg

SEQ ID NO: 20439 - DNA, 20 bp, Artificial Sequence
  chemically synthesized
ttccgcagttggggcactca

SEQ ID NO: 20440 - DNA, 20 bp, Artificial Sequence
  chemically synthesized
gttggggcactcacagtatt

SEQ ID NO: 20441 - DNA, 20 bp, Artificial Sequence
  chemically synthesized
ttggggcactcacagtattt

SEQ ID NO: 20442 - DNA, 20 bp, Artificial Sequence
  chemically synthesized
tggggcactcacagtatttg

SEQ ID NO: 20443 - DNA, 20 bp, Artificial Sequence
  chemically synthesized
acagtatttggggtgtctcc

SEQ ID NO: 20444 - DNA, 20 bp, Artificial Sequence
  chemically synthesized
cagtatttggggtgtctcct

SEQ ID NO: 20445 - DNA, 20 bp, Artificial Sequence
  chemically synthesized
ggggtgtctcctgggtcctg

SEQ ID NO: 20446 - DNA, 20 bp, Artificial Sequence
  chemically synthesized
gggtgtctcctgggtcctgc

SEQ ID NO: 20447 - DNA, 20 bp, Artificial Sequence
  chemically synthesized
gtgtctcctgggtcctgcag

SEQ ID NO: 20448 - DNA, 20 bp, Artificial Sequence
  chemically synthesized
caggagcaatctacttcctt

SEQ ID NO: 20449 - DNA, 20 bp, Artificial Sequence
  chemically synthesized
ggagcaatctacttccttca

SEQ ID NO: 20450 - DNA, 20 bp, Artificial Sequence
  chemically synthesized
gagcaatctacttccttcag

SEQ ID NO: 20451 - DNA, 20 bp, Artificial Sequence
  chemically synthesized
agcaatctacttccttcaga

SEQ ID NO: 20452 - DNA, 20 bp, Artificial Sequence
  chemically synthesized
tacttccttcagagggtctg

SEQ ID NO: 20453 - DNA, 20 bp, Artificial Sequence
  chemically synthesized
acttccttcagagggtctgt

SEQ ID NO: 20454 - DNA, 20 bp, Artificial Sequence
  chemically synthesized
agagggtctgtgggtcctct

SEQ ID NO: 20455 - DNA, 20 bp, Artificial Sequence
  chemically synthesized
gagggtctgtgggtcctctc

SEQ ID NO: 20456 - DNA, 20 bp, Artificial Sequence
  chemically synthesized
gtgggtcctctcaggattgc

SEQ ID NO: 20457 - DNA, 20 bp, Artificial Sequence
  chemically synthesized
ggattgctggtttgttcttg

SEQ ID NO: 20458 - DNA, 20 bp, Artificial Sequence
  chemically synthesized
ttgttcttgcagtctatctg

SEQ ID NO: 20459 - DNA, 20 bp, Artificial Sequence
  chemically synthesized
gcagctaaaattcacaatgc

SEQ ID NO: 20460 - DNA, 20 bp, Artificial Sequence
  chemically synthesized
acatgctgctctgtccatct

SEQ ID NO: 20461 - DNA, 20 bp, Artificial Sequence
  chemically synthesized
gctgctctgtccatctgagt

SEQ ID NO: 20462 - DNA, 20 bp, Artificial Sequence
  chemically synthesized
tgctctgtccatctgagttg

SEQ ID NO: 20463 - DNA, 20 bp, Artificial Sequence
  chemically synthesized
tctgagttggagctgcaatc

SEQ ID NO: 20464 - DNA, 20 bp, Artificial Sequence
  chemically synthesized
ctgagttggagctgcaatct

SEQ ID NO: 20465 - DNA, 20 bp, Artificial Sequence
  chemically synthesized
aggcctacctcccatccgcc

SEQ ID NO: 20466 - DNA, 20 bp, Artificial Sequence
  chemically synthesized
ctcccatccgccaagatcct

SEQ ID NO: 20467 - DNA, 20 bp, Artificial Sequence
  chemically synthesized
ccatccgccaagatcctgag

SEQ ID NO: 20468 - DNA, 20 bp, Artificial Sequence
  chemically synthesized
ccgccaagatcctgagaagt

SEQ ID NO: 20469 - DNA, 20 bp, Artificial Sequence
  chemically synthesized
cgccaagatcctgagaagtt

SEQ ID NO: 20470 - DNA, 20 bp, Artificial Sequence
  chemically synthesized
gccaagatcctgagaagttg

SEQ ID NO: 20471 - DNA, 20 bp, Artificial Sequence
  chemically synthesized
tggggattatatttcaacat

SEQ ID NO: 20472 - DNA, 20 bp, Artificial Sequence
  chemically synthesized
ttatatttcaacatgagatt

SEQ ID NO: 20473 - DNA, 20 bp, Artificial Sequence
  chemically synthesized
atatttcaacatgagatttg

SEQ ID NO: 20474 - DNA, 20 bp, Artificial Sequence
  chemically synthesized
tatttcaacatgagatttgg

SEQ ID NO: 20475 - DNA, 20 bp, Artificial Sequence
  chemically synthesized
atttcaacatgagatttgga

SEQ ID NO: 20476 - DNA, 20 bp, Artificial Sequence
  chemically synthesized
aacaaacatccaaaccatat

SEQ ID NO: 20477 - DNA, 20 bp, Artificial Sequence
  chemically synthesized
aaacatccaaaccatatcag

SEQ ID NO: 20478 - DNA, 20 bp, Artificial Sequence
  chemically synthesized
tccaaaccatatcagcagtc

SEQ ID NO: 20479 - DNA, 20 bp, Artificial Sequence
  chemically synthesized
cagttttattcttttgcaca

SEQ ID NO: 20480 - DNA, 20 bp, Artificial Sequence
  chemically synthesized
ttttgcacatggatatccaa

SEQ ID NO: 20481 - DNA, 20 bp, Artificial Sequence
  chemically synthesized
caatggatatccaatttttt

SEQ ID NO: 20482 - DNA, 20 bp, Artificial Sequence
  chemically synthesized
cacctttgttgaaaatctgt

SEQ ID NO: 20483 - DNA, 20 bp, Artificial Sequence
  chemically synthesized
atctgttggctataaatatg

SEQ ID NO: 20484 - DNA, 20 bp, Artificial Sequence
  chemically synthesized
taaatatgtggatgcatttc

SEQ ID NO: 20485 - DNA, 20 bp, Artificial Sequence
  chemically synthesized
aaatatgtggatgcatttct

SEQ ID NO: 20486 - DNA, 20 bp, Artificial Sequence
  chemically synthesized
ggttctctattctcttccat

SEQ ID NO: 20487 - DNA, 20 bp, Artificial Sequence
  chemically synthesized
ctattctcttccattggtct

SEQ ID NO: 20488 - DNA, 20 bp, Artificial Sequence
  chemically synthesized
ctaagtgtctgttctaatgt

SEQ ID NO: 20489 - DNA, 20 bp, Artificial Sequence
  chemically synthesized
aatgtcagtatcatgctgtt

SEQ ID NO: 20490 - DNA, 20 bp, Artificial Sequence
  chemically synthesized
atgtcagtatcatgctgttt

SEQ ID NO: 20491 - DNA, 20 bp, Artificial Sequence
  chemically synthesized
tttgtaatatactttgaaat

SEQ ID NO: 20492 - DNA, 20 bp, Artificial Sequence
  chemically synthesized
ttgtaatatactttgaaatc

SEQ ID NO: 20493 - DNA, 20 bp, Artificial Sequence
  chemically synthesized
taatatactttgaaatcagg

SEQ ID NO: 20494 - DNA, 20 bp, Artificial Sequence
  chemically synthesized
atcaggtagtatgatacctc

SEQ ID NO: 20495 - DNA, 20 bp, Artificial Sequence
  chemically synthesized
ctagcattgttcttttttca

SEQ ID NO: 20496 - DNA, 20 bp, Artificial Sequence
  chemically synthesized
tagcattgttcttttttcac

SEQ ID NO: 20497 - DNA, 20 bp, Artificial Sequence
  chemically synthesized
cttttttcacaggatgactt

SEQ ID NO: 20498 - DNA, 20 bp, Artificial Sequence
  chemically synthesized
cacaggatgactttggctac

SEQ ID NO: 20499 - DNA, 20 bp, Artificial Sequence
  chemically synthesized
caggatgactttggctactg

SEQ ID NO: 20500 - DNA, 20 bp, Artificial Sequence
  chemically synthesized
ttttaatttcatacaaattt

SEQ ID NO: 20501 - DNA, 20 bp, Artificial Sequence
  chemically synthesized
atttcatacaaattttagat

SEQ ID NO: 20502 - DNA, 20 bp, Artificial Sequence
  chemically synthesized
aaatgacattgctattttga

SEQ ID NO: 20503 - DNA, 20 bp, Artificial Sequence
  chemically synthesized
tgacattgctattttgatag

SEQ ID NO: 20504 - DNA, 20 bp, Artificial Sequence
  chemically synthesized
ctattttgatagcggtcata

SEQ ID NO: 20505 - DNA, 20 bp, Artificial Sequence
  chemically synthesized
tagcggtcatatagaatctg

SEQ ID NO: 20506 - DNA, 20 bp, Artificial Sequence
  chemically synthesized
atagaatctgtagattgctt

SEQ ID NO: 20507 - DNA, 20 bp, Artificial Sequence
  chemically synthesized
tagaatctgtagattgcttt

SEQ ID NO: 20508 - DNA, 20 bp, Artificial Sequence
  chemically synthesized
aatctgtagattgctttggg

SEQ ID NO: 20509 - DNA, 20 bp, Artificial Sequence
  chemically synthesized
gtagattgctttgggtagta

SEQ ID NO: 20510 - DNA, 20 bp, Artificial Sequence
  chemically synthesized
atttttctgatccatgaaca

SEQ ID NO: 20511 - DNA, 20 bp, Artificial Sequence
  chemically synthesized
tttttctgatccatgaacat

SEQ ID NO: 20512 - DNA, 20 bp, Artificial Sequence
  chemically synthesized
gtccttttcaattcttttat

SEQ ID NO: 20513 - DNA, 20 bp, Artificial Sequence
  chemically synthesized
attcttttatcagtgttttg

SEQ ID NO: 20514 - DNA, 20 bp, Artificial Sequence
  chemically synthesized
gtgttttgtagttttccgaa

SEQ ID NO: 20515 - DNA, 20 bp, Artificial Sequence
  chemically synthesized
gttttgtagttttccgaata

SEQ ID NO: 20516 - DNA, 20 bp, Artificial Sequence
  chemically synthesized
ttttgtagttttccgaatag

SEQ ID NO: 20517 - DNA, 20 bp, Artificial Sequence
  chemically synthesized
ttttccgaatagaggttttt

SEQ ID NO: 20518 - DNA, 20 bp, Artificial Sequence
  chemically synthesized
atagaggtttttcggttcct

SEQ ID NO: 20519 - DNA, 20 bp, Artificial Sequence
  chemically synthesized
tccctaaatattttattttt

SEQ ID NO: 20520 - DNA, 20 bp, Artificial Sequence
  chemically synthesized
tattttttagctattgtaaa

SEQ ID NO: 20521 - DNA, 20 bp, Artificial Sequence
  chemically synthesized
attttttagctattgtaaat

SEQ ID NO: 20522 - DNA, 20 bp, Artificial Sequence
  chemically synthesized
tgccttcttaatttccttct

SEQ ID NO: 20523 - DNA, 20 bp, Artificial Sequence
  chemically synthesized
ttcttaatttccttctcagc

SEQ ID NO: 20524 - DNA, 20 bp, Artificial Sequence
  chemically synthesized
cttctcagctagtttattat

SEQ ID NO: 20525 - DNA, 20 bp, Artificial Sequence
  chemically synthesized
gctagtttattattggtgtg

SEQ ID NO: 20526 - DNA, 20 bp, Artificial Sequence
  chemically synthesized
actttactgaatttattttt

SEQ ID NO: 20527 - DNA, 20 bp, Artificial Sequence
  chemically synthesized
tgaatttatttttcagcgct

SEQ ID NO: 20528 - DNA, 20 bp, Artificial Sequence
  chemically synthesized
aatttatttttcagcgctaa

SEQ ID NO: 20529 - DNA, 20 bp, Artificial Sequence
  chemically synthesized
tttcagcgctaagagtgctt

SEQ ID NO: 20530 - DNA, 20 bp, Artificial Sequence
  chemically synthesized
cagcgctaagagtgctttgg

SEQ ID NO: 20531 - DNA, 20 bp, Artificial Sequence
  chemically synthesized
gcgctaagagtgctttggtg

SEQ ID NO: 20532 - DNA, 20 bp, Artificial Sequence
  chemically synthesized
agagtgctttggtggagtct

SEQ ID NO: 20533 - DNA, 20 bp, Artificial Sequence
  chemically synthesized
tggtggagtcttggtttttc

SEQ ID NO: 20534 - DNA, 20 bp, Artificial Sequence
  chemically synthesized
ggtggagtcttggtttttct

SEQ ID NO: 20535 - DNA, 20 bp, Artificial Sequence
  chemically synthesized
aggtataaaatcatgtcatc

SEQ ID NO: 20536 - DNA, 20 bp, Artificial Sequence
  chemically synthesized
ataaaatcatgtcatctgga

SEQ ID NO: 20537 - DNA, 20 bp, Artificial Sequence
  chemically synthesized
aatcatgtcatctggaaaga

SEQ ID NO: 20538 - DNA, 20 bp, Artificial Sequence
  chemically synthesized
atgtcatctggaaagatgga

SEQ ID NO: 20539 - DNA, 20 bp, Artificial Sequence
  chemically synthesized
tctttctttctctgacctga

SEQ ID NO: 20540 - DNA, 20 bp, Artificial Sequence
  chemically synthesized
tttctctgacctgaaagctg

SEQ ID NO: 20541 - DNA, 20 bp, Artificial Sequence
  chemically synthesized
tctgacctgaaagctgtggc

SEQ ID NO: 20542 - DNA, 20 bp, Artificial Sequence
  chemically synthesized
ctgacctgaaagctgtggct

SEQ ID NO: 20543 - DNA, 20 bp, Artificial Sequence
  chemically synthesized
aaagctgtggctaggacttc

SEQ ID NO: 20544 - DNA, 20 bp, Artificial Sequence
  chemically synthesized
acttccagtattatattgaa

SEQ ID NO: 20545 - DNA, 20 bp, Artificial Sequence
  chemically synthesized
cttccagtattatattgaat

SEQ ID NO: 20546 - DNA, 20 bp, Artificial Sequence
  chemically synthesized
tccagtattatattgaatag

SEQ ID NO: 20547 - DNA, 20 bp, Artificial Sequence
  chemically synthesized
attatattgaataggagtga

SEQ ID NO: 20548 - DNA, 20 bp, Artificial Sequence
  chemically synthesized
atattgaataggagtgatgg

SEQ ID NO: 20549 - DNA, 20 bp, Artificial Sequence
  chemically synthesized
ttgaataggagtgatggaag

SEQ ID NO: 20550 - DNA, 20 bp, Artificial Sequence
  chemically synthesized
tgaataggagtgatggaagt

SEQ ID NO: 20551 - DNA, 20 bp, Artificial Sequence
  chemically synthesized
tgggcatccttattttgttt

SEQ ID NO: 20552 - DNA, 20 bp, Artificial Sequence
  chemically synthesized
ccttattttgtttcagttct

SEQ ID NO: 20553 - DNA, 20 bp, Artificial Sequence
  chemically synthesized
ttattttgtttcagttctta

SEQ ID NO: 20554 - DNA, 20 bp, Artificial Sequence
  chemically synthesized
tattttgtttcagttcttag

SEQ ID NO: 20555 - DNA, 20 bp, Artificial Sequence
  chemically synthesized
ttgtttcagttcttagagga

SEQ ID NO: 20556 - DNA, 20 bp, Artificial Sequence
  chemically synthesized
tgtttcagttcttagaggaa

SEQ ID NO: 20557 - DNA, 20 bp, Artificial Sequence
  chemically synthesized
gttcttagaggaaaggcttc

SEQ ID NO: 20558 - DNA, 20 bp, Artificial Sequence
  chemically synthesized
gcttccagcttttcccaatt

SEQ ID NO: 20559 - DNA, 20 bp, Artificial Sequence
  chemically synthesized
ttcccaattcagtatgatgt

SEQ ID NO: 20560 - DNA, 20 bp, Artificial Sequence
  chemically synthesized
attcagtatgatgttagctg

SEQ ID NO: 20561 - DNA, 20 bp, Artificial Sequence
  chemically synthesized
ttcagtatgatgttagctgt

SEQ ID NO: 20562 - DNA, 20 bp, Artificial Sequence
  chemically synthesized
tatatgacttttattatatt

SEQ ID NO: 20563 - DNA, 20 bp, Artificial Sequence
  chemically synthesized
agatatgttccttctatgat

SEQ ID NO: 20564 - DNA, 20 bp, Artificial Sequence
  chemically synthesized
gttccttctatgattggctg

SEQ ID NO: 20565 - DNA, 20 bp, Artificial Sequence
  chemically synthesized
cttctatgattggctgcaga

SEQ ID NO: 20566 - DNA, 20 bp, Artificial Sequence
  chemically synthesized
tgcagatagtttttatcatg

SEQ ID NO: 20567 - DNA, 20 bp, Artificial Sequence
  chemically synthesized
gcagatagtttttatcatga

SEQ ID NO: 20568 - DNA, 20 bp, Artificial Sequence
  chemically synthesized
atactttttctgtatctatt

SEQ ID NO: 20569 - DNA, 20 bp, Artificial Sequence
  chemically synthesized
tatctattgagatgatcata

SEQ ID NO: 20570 - DNA, 20 bp, Artificial Sequence
  chemically synthesized
ttgaactgttcttgcaaccc

SEQ ID NO: 20571 - DNA, 20 bp, Artificial Sequence
  chemically synthesized
gtataaatcccacttgatca

SEQ ID NO: 20572 - DNA, 20 bp, Artificial Sequence
  chemically synthesized
gatcatggtgtattatcttt

SEQ ID NO: 20573 - DNA, 20 bp, Artificial Sequence
  chemically synthesized
ttatcttttggatgtactgt

SEQ ID NO: 20574 - DNA, 20 bp, Artificial Sequence
  chemically synthesized
tttggatgtactgttggatt

SEQ ID NO: 20575 - DNA, 20 bp, Artificial Sequence
  chemically synthesized
tactgttggattcagtttgc

SEQ ID NO: 20576 - DNA, 20 bp, Artificial Sequence
  chemically synthesized
cagtttgctagtattttgtt

SEQ ID NO: 20577 - DNA, 20 bp, Artificial Sequence
  chemically synthesized
agtttgctagtattttgttg

SEQ ID NO: 20578 - DNA, 20 bp, Artificial Sequence
  chemically synthesized
ttttcacacctatgttccat

SEQ ID NO: 20579 - DNA, 20 bp, Artificial Sequence
  chemically synthesized
tttcacacctatgttccatc

SEQ ID NO: 20580 - DNA, 20 bp, Artificial Sequence
  chemically synthesized
ttcacacctatgttccatca

SEQ ID NO: 20581 - DNA, 20 bp, Artificial Sequence
  chemically synthesized
ccatcagggatattgacctg

SEQ ID NO: 20582 - DNA, 20 bp, Artificial Sequence
  chemically synthesized
tttttacttgcatccttgtc

SEQ ID NO: 20583 - DNA, 20 bp, Artificial Sequence
  chemically synthesized
cttgcatccttgtctggtta

SEQ ID NO: 20584 - DNA, 20 bp, Artificial Sequence
  chemically synthesized
tccttgtctggttatggaat

SEQ ID NO: 20585 - DNA, 20 bp, Artificial Sequence
  chemically synthesized
ccttgtctggttatggaatc

SEQ ID NO: 20586 - DNA, 20 bp, Artificial Sequence
  chemically synthesized
ttatggaatcaggataatac

SEQ ID NO: 20587 - DNA, 20 bp, Artificial Sequence
  chemically synthesized
aatcaggataatactggcct

SEQ ID NO: 20588 - DNA, 20 bp, Artificial Sequence
  chemically synthesized
tcaggataatactggcctca

SEQ ID NO: 20589 - DNA, 20 bp, Artificial Sequence
  chemically synthesized
taatactggcctcagagaat

SEQ ID NO: 20590 - DNA, 20 bp, Artificial Sequence
  chemically synthesized
actggcctcagagaatgagt

SEQ ID NO: 20591 - DNA, 20 bp, Artificial Sequence
  chemically synthesized
ctggcctcagagaatgagtt

SEQ ID NO: 20592 - DNA, 20 bp, Artificial Sequence
  chemically synthesized
tggcctcagagaatgagtta

SEQ ID NO: 20593 - DNA, 20 bp, Artificial Sequence
  chemically synthesized
gcctcagagaatgagttagg

SEQ ID NO: 20594 - DNA, 20 bp, Artificial Sequence
  chemically synthesized
ccttcctgtttaatttttaa

SEQ ID NO: 20595 - DNA, 20 bp, Artificial Sequence
  chemically synthesized
tttaatttttaaaagaattt

SEQ ID NO: 20596 - DNA, 20 bp, Artificial Sequence
  chemically synthesized
ttaatttttaaaagaattta

SEQ ID NO: 20597 - DNA, 20 bp, Artificial Sequence
  chemically synthesized
aatttttaaaagaatttaag

SEQ ID NO: 20598 - DNA, 20 bp, Artificial Sequence
  chemically synthesized
aagaatttaaggagacttgt

SEQ ID NO: 20599 - DNA, 20 bp, Artificial Sequence
  chemically synthesized
gacttgttagttttctttga

SEQ ID NO: 20600 - DNA, 20 bp, Artificial Sequence
  chemically synthesized
gttagttttctttgaaagtt

SEQ ID NO: 20601 - DNA, 20 bp, Artificial Sequence
  chemically synthesized
gaaagtttggtaaaatttga

SEQ ID NO: 20602 - DNA, 20 bp, Artificial Sequence
  chemically synthesized
tttggtaaaatttgacagta

SEQ ID NO: 20603 - DNA, 20 bp, Artificial Sequence
  chemically synthesized
aatttgacagtaaagccatc

SEQ ID NO: 20604 - DNA, 20 bp, Artificial Sequence
  chemically synthesized
ggtcttgaaattttcttttt

SEQ ID NO: 20605 - DNA, 20 bp, Artificial Sequence
  chemically synthesized
gtcttgaaattttctttttt

SEQ ID NO: 20606 - DNA, 20 bp, Artificial Sequence
  chemically synthesized
cttgaaattttcttttttgg

SEQ ID NO: 20607 - DNA, 20 bp, Artificial Sequence
  chemically synthesized
tcaatttcattattcattac

SEQ ID NO: 20608 - DNA, 20 bp, Artificial Sequence
  chemically synthesized
ttattcattactggtctgtt

SEQ ID NO: 20609 - DNA, 20 bp, Artificial Sequence
  chemically synthesized
tattcattactggtctgttc

SEQ ID NO: 20610 - DNA, 20 bp, Artificial Sequence
  chemically synthesized
attctttcttaattcaatct

SEQ ID NO: 20611 - DNA, 20 bp, Artificial Sequence
  chemically synthesized
ctttcttaattcaatcttgg

SEQ ID NO: 20612 - DNA, 20 bp, Artificial Sequence
  chemically synthesized
tttcttaattcaatcttggt

SEQ ID NO: 20613 - DNA, 20 bp, Artificial Sequence
  chemically synthesized
cttaattcaatcttggtagg

SEQ ID NO: 20614 - DNA, 20 bp, Artificial Sequence
  chemically synthesized
cttggtaggtggtatgtgtc

SEQ ID NO: 20615 - DNA, 20 bp, Artificial Sequence
  chemically synthesized
agaaatttattaatttcctc

SEQ ID NO: 20616 - DNA, 20 bp, Artificial Sequence
  chemically synthesized
ttaatttcctctagattttt

SEQ ID NO: 20617 - DNA, 20 bp, Artificial Sequence
  chemically synthesized
ctctagatttttcagttttt

SEQ ID NO: 20618 - DNA, 20 bp, Artificial Sequence
  chemically synthesized
tttttcagttttttagtgta

SEQ ID NO: 20619 - DNA, 20 bp, Artificial Sequence
  chemically synthesized
tagtgtatggttgttcataa

SEQ ID NO: 20620 - DNA, 20 bp, Artificial Sequence
  chemically synthesized
gataatcttttctatttctg

SEQ ID NO: 20621 - DNA, 20 bp, Artificial Sequence
  chemically synthesized
cttttctatttctgtggtat

SEQ ID NO: 20622 - DNA, 20 bp, Artificial Sequence
  chemically synthesized
atttctgattttctttattt

SEQ ID NO: 20623 - DNA, 20 bp, Artificial Sequence
  chemically synthesized
tcagtctcttctctttttct

SEQ ID NO: 20624 - DNA, 20 bp, Artificial Sequence
  chemically synthesized
tctcttctctttttcttggt

SEQ ID NO: 20625 - DNA, 20 bp, Artificial Sequence
  chemically synthesized
tctctttttcttggttagtc

SEQ ID NO: 20626 - DNA, 20 bp, Artificial Sequence
  chemically synthesized
tttttcttggttagtctagc

SEQ ID NO: 20627 - DNA, 20 bp, Artificial Sequence
  chemically synthesized
tttcttggttagtctagcta

SEQ ID NO: 20628 - DNA, 20 bp, Artificial Sequence
  chemically synthesized
ttgtttttctctatttcatt

SEQ ID NO: 20629 - DNA, 20 bp, Artificial Sequence
  chemically synthesized
cattttttctttccttctgc

SEQ ID NO: 20630 - DNA, 20 bp, Artificial Sequence
  chemically synthesized
ttctttccttctgctagttt

SEQ ID NO: 20631 - DNA, 20 bp, Artificial Sequence
  chemically synthesized
tctttccttctgctagtttt

SEQ ID NO: 20632 - DNA, 20 bp, Artificial Sequence
  chemically synthesized
gggttttgttcttgcttttc

SEQ ID NO: 20633 - DNA, 20 bp, Artificial Sequence
  chemically synthesized
tcttgcttttctagcttgtt

SEQ ID NO: 20634 - DNA, 20 bp, Artificial Sequence
  chemically synthesized
cttgcttttctagcttgttg

SEQ ID NO: 20635 - DNA, 20 bp, Artificial Sequence
  chemically synthesized
agcttgttgaggtacatgat

SEQ ID NO: 20636 - DNA, 20 bp, Artificial Sequence
  chemically synthesized
tctttctatgtttttaattt

SEQ ID NO: 20637 - DNA, 20 bp, Artificial Sequence
  chemically synthesized
taatttaagtgtttattgat

SEQ ID NO: 20638 - DNA, 20 bp, Artificial Sequence
  chemically synthesized
ttattgataagcttctctct

SEQ ID NO: 20639 - DNA, 20 bp, Artificial Sequence
  chemically synthesized
actgcttttgctgtatccca

SEQ ID NO: 20640 - DNA, 20 bp, Artificial Sequence
  chemically synthesized
ttcttgacataacgttcatt

SEQ ID NO: 20641 - DNA, 20 bp, Artificial Sequence
  chemically synthesized
tcttgacataacgttcattc

SEQ ID NO: 20642 - DNA, 20 bp, Artificial Sequence
  chemically synthesized
ttgacataacgttcattcag

SEQ ID NO: 20643 - DNA, 20 bp, Artificial Sequence
  chemically synthesized
ttaatttccatgtatttgta

SEQ ID NO: 20644 - DNA, 20 bp, Artificial Sequence
  chemically synthesized
taatttccatgtatttgtat

SEQ ID NO: 20645 - DNA, 20 bp, Artificial Sequence
  chemically synthesized
atgtatttgtataggtttta

SEQ ID NO: 20646 - DNA, 20 bp, Artificial Sequence
  chemically synthesized
tttttcttgttattgatttc

SEQ ID NO: 20647 - DNA, 20 bp, Artificial Sequence
  chemically synthesized
tttctagttttattccattg

SEQ ID NO: 20648 - DNA, 20 bp, Artificial Sequence
  chemically synthesized
gttttattccattgtggtct

SEQ ID NO: 20649 - DNA, 20 bp, Artificial Sequence
  chemically synthesized
ttattccattgtggtctgag

SEQ ID NO: 20650 - DNA, 20 bp, Artificial Sequence
  chemically synthesized
tgatttcaaatatttcaaat

SEQ ID NO: 20651 - DNA, 20 bp, Artificial Sequence
  chemically synthesized
tcaaatatttcaaattagtt

SEQ ID NO: 20652 - DNA, 20 bp, Artificial Sequence
  chemically synthesized
ttcttttgtgttctaacata

SEQ ID NO: 20653 - DNA, 20 bp, Artificial Sequence
  chemically synthesized
ttctaacatatggtgtatcc

SEQ ID NO: 20654 - DNA, 20 bp, Artificial Sequence
  chemically synthesized
tctaacatatggtgtatcct

SEQ ID NO: 20655 - DNA, 20 bp, Artificial Sequence
  chemically synthesized
ctaacatatggtgtatcctg

SEQ ID NO: 20656 - DNA, 20 bp, Artificial Sequence
  chemically synthesized
ggaatgcgtcatgtgctgat

SEQ ID NO: 20657 - DNA, 20 bp, Artificial Sequence
  chemically synthesized
gatgagataaatatattctg

SEQ ID NO: 20658 - DNA, 20 bp, Artificial Sequence
  chemically synthesized
taaatatattctgtagctgt

SEQ ID NO: 20659 - DNA, 20 bp, Artificial Sequence
  chemically synthesized
atgaaatattgtgtaaatgt

SEQ ID NO: 20660 - DNA, 20 bp, Artificial Sequence
  chemically synthesized
gtgtaaatgttagatccatt

SEQ ID NO: 20661 - DNA, 20 bp, Artificial Sequence
  chemically synthesized
tgttagatccatttggtcta

SEQ ID NO: 20662 - DNA, 20 bp, Artificial Sequence
  chemically synthesized
gatccatttggtctaaagtc

SEQ ID NO: 20663 - DNA, 20 bp, Artificial Sequence
  chemically synthesized
ttctttgttaattttctgtc

SEQ ID NO: 20664 - DNA, 20 bp, Artificial Sequence
  chemically synthesized
tagatgatctatctgatgct

SEQ ID NO: 20665 - DNA, 20 bp, Artificial Sequence
  chemically synthesized
gatctatctgatgctgagat

SEQ ID NO: 20666 - DNA, 20 bp, Artificial Sequence
  chemically synthesized
atccccaactattattgtat

SEQ ID NO: 20667 - DNA, 20 bp, Artificial Sequence
  chemically synthesized
taacatttgctttacatatc

SEQ ID NO: 20668 - DNA, 20 bp, Artificial Sequence
  chemically synthesized
ctttacatatctggatgctc

SEQ ID NO: 20669 - DNA, 20 bp, Artificial Sequence
  chemically synthesized
tatctggatgctctggtgtt

SEQ ID NO: 20670 - DNA, 20 bp, Artificial Sequence
  chemically synthesized
tggtgttgagtgtgaatgtt

SEQ ID NO: 20671 - DNA, 20 bp, Artificial Sequence
  chemically synthesized
atgtaatgacttttgtctct

SEQ ID NO: 20672 - DNA, 20 bp, Artificial Sequence
  chemically synthesized
ctcttagtgttttttattta

SEQ ID NO: 20673 - DNA, 20 bp, Artificial Sequence
  chemically synthesized
aaagtcaattttatctgtta

SEQ ID NO: 20674 - DNA, 20 bp, Artificial Sequence
  chemically synthesized
aagtcaattttatctgttat

SEQ ID NO: 20675 - DNA, 20 bp, Artificial Sequence
  chemically synthesized
taactacttttgctcatttt

SEQ ID NO: 20676 - DNA, 20 bp, Artificial Sequence
  chemically synthesized
atttttggtttctctttgta

SEQ ID NO: 20677 - DNA, 20 bp, Artificial Sequence
  chemically synthesized
tttggtttctctttgtatgg

SEQ ID NO: 20678 - DNA, 20 bp, Artificial Sequence
  chemically synthesized
atctttcatctttttacttt

SEQ ID NO: 20679 - DNA, 20 bp, Artificial Sequence
  chemically synthesized
cagtctatatttatctttac

SEQ ID NO: 20680 - DNA, 20 bp, Artificial Sequence
  chemically synthesized
ctatatttatctttacaagt

SEQ ID NO: 20681 - DNA, 20 bp, Artificial Sequence
  chemically synthesized
tttatctttacaagtgagat

SEQ ID NO: 20682 - DNA, 20 bp, Artificial Sequence
  chemically synthesized
caagtgagataagtttctta

SEQ ID NO: 20683 - DNA, 20 bp, Artificial Sequence
  chemically synthesized
aagtgagataagtttcttat

SEQ ID NO: 20684 - DNA, 20 bp, Artificial Sequence
  chemically synthesized
tgagataagtttcttatagg

SEQ ID NO: 20685 - DNA, 20 bp, Artificial Sequence
  chemically synthesized
tcttataggcagcttacaac

SEQ ID NO: 20686 - DNA, 20 bp, Artificial Sequence
  chemically synthesized
cttataggcagcttacaact

SEQ ID NO: 20687 - DNA, 20 bp, Artificial Sequence
  chemically synthesized
atttttgttttaaatctatt

SEQ ID NO: 20688 - DNA, 20 bp, Artificial Sequence
  chemically synthesized
ttgttttaaatctatttagc

SEQ ID NO: 20689 - DNA, 20 bp, Artificial Sequence
  chemically synthesized
ttagccagtctatatctttc

SEQ ID NO: 20690 - DNA, 20 bp, Artificial Sequence
  chemically synthesized
aatttaatccatttacatgc

SEQ ID NO: 20691 - DNA, 20 bp, Artificial Sequence
  chemically synthesized
atttaatccatttacatgca

SEQ ID NO: 20692 - DNA, 20 bp, Artificial Sequence
  chemically synthesized
caaggctattattgacatgt

SEQ ID NO: 20693 - DNA, 20 bp, Artificial Sequence
  chemically synthesized
aggctattattgacatgtga

SEQ ID NO: 20694 - DNA, 20 bp, Artificial Sequence
  chemically synthesized
ccattttgttaattgattcc

SEQ ID NO: 20695 - DNA, 20 bp, Artificial Sequence
  chemically synthesized
tggttgttttgttttttttt

SEQ ID NO: 20696 - DNA, 20 bp, Artificial Sequence
  chemically synthesized
tttcttattatttatgattg

SEQ ID NO: 20697 - DNA, 20 bp, Artificial Sequence
  chemically synthesized
tattatttatgattgtggtt

SEQ ID NO: 20698 - DNA, 20 bp, Artificial Sequence
  chemically synthesized
tgtggtttggtgattttctg

SEQ ID NO: 20699 - DNA, 20 bp, Artificial Sequence
  chemically synthesized
ggtttggtgattttctgtag

SEQ ID NO: 20700 - DNA, 20 bp, Artificial Sequence
  chemically synthesized
tttctgtagtggtaacgttt

SEQ ID NO: 20701 - DNA, 20 bp, Artificial Sequence
  chemically synthesized
ttatttgtgttttgctctac

SEQ ID NO: 20702 - DNA, 20 bp, Artificial Sequence
  chemically synthesized
ttgtgttttgctctaccagt

SEQ ID NO: 20703 - DNA, 20 bp, Artificial Sequence
  chemically synthesized
acctttgtgtgtcttcataa

SEQ ID NO: 20704 - DNA, 20 bp, Artificial Sequence
  chemically synthesized
tttgtgtgtcttcataatgg

SEQ ID NO: 20705 - DNA, 20 bp, Artificial Sequence
  chemically synthesized
tgtcctgtcactttcatgtg

SEQ ID NO: 20706 - DNA, 20 bp, Artificial Sequence
  chemically synthesized
gtcctgtcactttcatgtgt

SEQ ID NO: 20707 - DNA, 20 bp, Artificial Sequence
  chemically synthesized
tcccttaaatatttcttgta

SEQ ID NO: 20708 - DNA, 20 bp, Artificial Sequence
  chemically synthesized
ttaaatatttcttgtaaagc

SEQ ID NO: 20709 - DNA, 20 bp, Artificial Sequence
  chemically synthesized
tatttcttgtaaagccagtc

SEQ ID NO: 20710 - DNA, 20 bp, Artificial Sequence
  chemically synthesized
ttgtaaagccagtctagtga

SEQ ID NO: 20711 - DNA, 20 bp, Artificial Sequence
  chemically synthesized
tccttcaaatttttcttgcc

SEQ ID NO: 20712 - DNA, 20 bp, Artificial Sequence
  chemically synthesized
caaatttttcttgcccagaa

SEQ ID NO: 20713 - DNA, 20 bp, Artificial Sequence
  chemically synthesized
ttatttatccttcatttttg

SEQ ID NO: 20714 - DNA, 20 bp, Artificial Sequence
  chemically synthesized
tttttgaagaacaatgttgc

SEQ ID NO: 20715 - DNA, 20 bp, Artificial Sequence
  chemically synthesized
ttttgaagaacaatgttgct

SEQ ID NO: 20716 - DNA, 20 bp, Artificial Sequence
  chemically synthesized
gttgctgggtataacatcct

SEQ ID NO: 20717 - DNA, 20 bp, Artificial Sequence
  chemically synthesized
tatatcatcccatcttctcc

SEQ ID NO: 20718 - DNA, 20 bp, Artificial Sequence
  chemically synthesized
cccatcttctcctggcctgt

SEQ ID NO: 20719 - DNA, 20 bp, Artificial Sequence
  chemically synthesized
ccatcttctcctggcctgtg

SEQ ID NO: 20720 - DNA, 20 bp, Artificial Sequence
  chemically synthesized
tggcctgtgaggtttctgct

SEQ ID NO: 20721 - DNA, 20 bp, Artificial Sequence
  chemically synthesized
ctgttaatctgttaatcttg

SEQ ID NO: 20722 - DNA, 20 bp, Artificial Sequence
  chemically synthesized
ttaatctgttaatcttgtgg

SEQ ID NO: 20723 - DNA, 20 bp, Artificial Sequence
  chemically synthesized
tcttgtggaagttcccttat

SEQ ID NO: 20724 - DNA, 20 bp, Artificial Sequence
  chemically synthesized
gaagttcccttataagtgac

SEQ ID NO: 20725 - DNA, 20 bp, Artificial Sequence
  chemically synthesized
agacattttgcttgctgttt

SEQ ID NO: 20726 - DNA, 20 bp, Artificial Sequence
  chemically synthesized
acattttgcttgctgtttta

SEQ ID NO: 20727 - DNA, 20 bp, Artificial Sequence
  chemically synthesized
gttttagagttcttactctt

SEQ ID NO: 20728 - DNA, 20 bp, Artificial Sequence
  chemically synthesized
tcttactctttggcttttga

SEQ ID NO: 20729 - DNA, 20 bp, Artificial Sequence
  chemically synthesized
agtttgactataatgtgctg

SEQ ID NO: 20730 - DNA, 20 bp, Artificial Sequence
  chemically synthesized
tttgactataatgtgctgtg

SEQ ID NO: 20731 - DNA, 20 bp, Artificial Sequence
  chemically synthesized
gactataatgtgctgtggag

SEQ ID NO: 20732 - DNA, 20 bp, Artificial Sequence
  chemically synthesized
ctataatgtgctgtggagaa

SEQ ID NO: 20733 - DNA, 20 bp, Artificial Sequence
  chemically synthesized
gctttttgcattatattatt

SEQ ID NO: 20734 - DNA, 20 bp, Artificial Sequence
  chemically synthesized
ctttttgcattatattattt

SEQ ID NO: 20735 - DNA, 20 bp, Artificial Sequence
  chemically synthesized
atttctgattttcatttgtc

SEQ ID NO: 20736 - DNA, 20 bp, Artificial Sequence
  chemically synthesized
tggatgtctacatttcttgc

SEQ ID NO: 20737 - DNA, 20 bp, Artificial Sequence
  chemically synthesized
catttcttgctagacttgac

SEQ ID NO: 20738 - DNA, 20 bp, Artificial Sequence
  chemically synthesized
tgctagacttgacaagtttt

SEQ ID NO: 20739 - DNA, 20 bp, Artificial Sequence
  chemically synthesized
tcagctattgtgttgttacg

SEQ ID NO: 20740 - DNA, 20 bp, Artificial Sequence
  chemically synthesized
cagctattgtgttgttacgt

SEQ ID NO: 20741 - DNA, 20 bp, Artificial Sequence
  chemically synthesized
ttcatgttctctttaccttc

SEQ ID NO: 20742 - DNA, 20 bp, Artificial Sequence
  chemically synthesized
tcatgttctctttaccttct

SEQ ID NO: 20743 - DNA, 20 bp, Artificial Sequence
  chemically synthesized
ttgaatatttgttcacttta

SEQ ID NO: 20744 - DNA, 20 bp, Artificial Sequence
  chemically synthesized
tttcctttctatcatttgac

SEQ ID NO: 20745 - DNA, 20 bp, Artificial Sequence
  chemically synthesized
atttgaccagctaattttaa

SEQ ID NO: 20746 - DNA, 20 bp, Artificial Sequence
  chemically synthesized
attttaaaagacctgtcttc

SEQ ID NO: 20747 - DNA, 20 bp, Artificial Sequence
  chemically synthesized
cttgatctgatctattgttg

SEQ ID NO: 20748 - DNA, 20 bp, Artificial Sequence
  chemically synthesized
atttctttcaataaactctt

SEQ ID NO: 20749 - DNA, 20 bp, Artificial Sequence
  chemically synthesized
ttcaataaactcttcagtta

SEQ ID NO: 20750 - DNA, 20 bp, Artificial Sequence
  chemically synthesized
tcagttacagaatttctgtt

SEQ ID NO: 20751 - DNA, 20 bp, Artificial Sequence
  chemically synthesized
ttcttgttgtatctatctct

SEQ ID NO: 20752 - DNA, 20 bp, Artificial Sequence
  chemically synthesized
tcttgttgtatctatctctt

SEQ ID NO: 20753 - DNA, 20 bp, Artificial Sequence
  chemically synthesized
tttctttttattgtttatct

SEQ ID NO: 20754 - DNA, 20 bp, Artificial Sequence
  chemically synthesized
gagttctcttgtgtctcact

SEQ ID NO: 20755 - DNA, 20 bp, Artificial Sequence
  chemically synthesized
cttccttaatatcaacattt

SEQ ID NO: 20756 - DNA, 20 bp, Artificial Sequence
  chemically synthesized
acattttggattcttttttc

SEQ ID NO: 20757 - DNA, 20 bp, Artificial Sequence
  chemically synthesized
taaatgtcttttttttccac

SEQ ID NO: 20758 - DNA, 20 bp, Artificial Sequence
  chemically synthesized
tccactggcttatgttgctg

SEQ ID NO: 20759 - DNA, 20 bp, Artificial Sequence
  chemically synthesized
gaagaattattaaattcctt

SEQ ID NO: 20760 - DNA, 20 bp, Artificial Sequence
  chemically synthesized
gaattattaaattcctttgg

SEQ ID NO: 20761 - DNA, 20 bp, Artificial Sequence
  chemically synthesized
tgcattgatatctctgcatc

SEQ ID NO: 20762 - DNA, 20 bp, Artificial Sequence
  chemically synthesized
ggtgtaatgattgctgcttc

SEQ ID NO: 20763 - DNA, 20 bp, Artificial Sequence
  chemically synthesized
gttttgtaaatttgtttttg

SEQ ID NO: 20764 - DNA, 20 bp, Artificial Sequence
  chemically synthesized
ttttgtaaatttgtttttgt

SEQ ID NO: 20765 - DNA, 20 bp, Artificial Sequence
  chemically synthesized
tttgtaaatttgtttttgta

SEQ ID NO: 20766 - DNA, 20 bp, Artificial Sequence
  chemically synthesized
ttgtaaatttgtttttgtag

SEQ ID NO: 20767 - DNA, 20 bp, Artificial Sequence
  chemically synthesized
taaatttgtttttgtagggg

SEQ ID NO: 20768 - DNA, 20 bp, Artificial Sequence
  chemically synthesized
taggggaagacttttttctg

SEQ ID NO: 20769 - DNA, 20 bp, Artificial Sequence
  chemically synthesized
ttttttctgaagatgtatct

SEQ ID NO: 20770 - DNA, 20 bp, Artificial Sequence
  chemically synthesized
gatgtatcttggtgttgatt

SEQ ID NO: 20771 - DNA, 20 bp, Artificial Sequence
  chemically synthesized
gtatcttggtgttgattgag

SEQ ID NO: 20772 - DNA, 20 bp, Artificial Sequence
  chemically synthesized
tatcttggtgttgattgagt

SEQ ID NO: 20773 - DNA, 20 bp, Artificial Sequence
  chemically synthesized
atcttggtgttgattgagta

SEQ ID NO: 20774 - DNA, 20 bp, Artificial Sequence
  chemically synthesized
ggcactttgattttgatttc

SEQ ID NO: 20775 - DNA, 20 bp, Artificial Sequence
  chemically synthesized
gcactttgattttgatttct

SEQ ID NO: 20776 - DNA, 20 bp, Artificial Sequence
  chemically synthesized
ttttgatttctaggtgcata

SEQ ID NO: 20777 - DNA, 20 bp, Artificial Sequence
  chemically synthesized
tgatttctaggtgcatacag

SEQ ID NO: 20778 - DNA, 20 bp, Artificial Sequence
  chemically synthesized
tctaggtgcatacagcagca

SEQ ID NO: 20779 - DNA, 20 bp, Artificial Sequence
  chemically synthesized
gtcttcatattatttttttt

SEQ ID NO: 20780 - DNA, 20 bp, Artificial Sequence
  chemically synthesized
tattttttttcagctgccaa

SEQ ID NO: 20781 - DNA, 20 bp, Artificial Sequence
  chemically synthesized
tcagctgccaacagtatcat

SEQ ID NO: 20782 - DNA, 20 bp, Artificial Sequence
  chemically synthesized
atcagtgtctgtgatttttt

SEQ ID NO: 20783 - DNA, 20 bp, Artificial Sequence
  chemically synthesized
agtgtctgtgattttttcag

SEQ ID NO: 20784 - DNA, 20 bp, Artificial Sequence
  chemically synthesized
ctgtgattttttcagtggct

SEQ ID NO: 20785 - DNA, 20 bp, Artificial Sequence
  chemically synthesized
tgtgattttttcagtggctt

SEQ ID NO: 20786 - DNA, 20 bp, Artificial Sequence
  chemically synthesized
gtgattttttcagtggctta

SEQ ID NO: 20787 - DNA, 20 bp, Artificial Sequence
  chemically synthesized
gtggcttagggtgcatttgt

SEQ ID NO: 20788 - DNA, 20 bp, Artificial Sequence
  chemically synthesized
ttagggtgcatttgttagtg

SEQ ID NO: 20789 - DNA, 20 bp, Artificial Sequence
  chemically synthesized
tagggtgcatttgttagtga

SEQ ID NO: 20790 - DNA, 20 bp, Artificial Sequence
  chemically synthesized
ggtgcatttgttagtgaagg

SEQ ID NO: 20791 - DNA, 20 bp, Artificial Sequence
  chemically synthesized
ttgttagtgaaggtggtgat

SEQ ID NO: 20792 - DNA, 20 bp, Artificial Sequence
  chemically synthesized
tgttagtgaaggtggtgatg

SEQ ID NO: 20793 - DNA, 20 bp, Artificial Sequence
  chemically synthesized
aggtggtgatgaggttgtgc

SEQ ID NO: 20794 - DNA, 20 bp, Artificial Sequence
  chemically synthesized
gtggtgatgaggttgtgctg

SEQ ID NO: 20795 - DNA, 20 bp, Artificial Sequence
  chemically synthesized
gatgaggttgtgctggagac

SEQ ID NO: 20796 - DNA, 20 bp, Artificial Sequence
  chemically synthesized
gtgctggagacaagaatatc

SEQ ID NO: 20797 - DNA, 20 bp, Artificial Sequence
  chemically synthesized
ctggagacaagaatatcaag

SEQ ID NO: 20798 - DNA, 20 bp, Artificial Sequence
  chemically synthesized
tggagacaagaatatcaagt

SEQ ID NO: 20799 - DNA, 20 bp, Artificial Sequence
  chemically synthesized
gacaagaatatcaagtgggc

SEQ ID NO: 20800 - DNA, 20 bp, Artificial Sequence
  chemically synthesized
atatcaagtgggccagtcct

SEQ ID NO: 20801 - DNA, 20 bp, Artificial Sequence
  chemically synthesized
agtgggccagtccttggccc

SEQ ID NO: 20802 - DNA, 20 bp, Artificial Sequence
  chemically synthesized
gggccagtccttggccccag

SEQ ID NO: 20803 - DNA, 20 bp, Artificial Sequence
  chemically synthesized
ccagtccttggccccagtgg

SEQ ID NO: 20804 - DNA, 20 bp, Artificial Sequence
  chemically synthesized
gtccttggccccagtggtgg

SEQ ID NO: 20805 - DNA, 20 bp, Artificial Sequence
  chemically synthesized
cttggccccagtggtggtgg

SEQ ID NO: 20806 - DNA, 20 bp, Artificial Sequence
  chemically synthesized
ttggccccagtggtggtggt

SEQ ID NO: 20807 - DNA, 20 bp, Artificial Sequence
  chemically synthesized
cccagtggtggtggtgggcc

SEQ ID NO: 20808 - DNA, 20 bp, Artificial Sequence
  chemically synthesized
gggcctagcattcctgtcct

SEQ ID NO: 20809 - DNA, 20 bp, Artificial Sequence
  chemically synthesized
ggcctagcattcctgtcctt

SEQ ID NO: 20810 - DNA, 20 bp, Artificial Sequence
  chemically synthesized
attcctgtccttgggcccca

SEQ ID NO: 20811 - DNA, 20 bp, Artificial Sequence
  chemically synthesized
ggccccatggctgtgtacat

SEQ ID NO: 20812 - DNA, 20 bp, Artificial Sequence
  chemically synthesized
gctgtgtacattggcactga

SEQ ID NO: 20813 - DNA, 20 bp, Artificial Sequence
  chemically synthesized
acattggcactgatggtaat

SEQ ID NO: 20814 - DNA, 20 bp, Artificial Sequence
  chemically synthesized
ggcactgatggtaatgagtc

SEQ ID NO: 20815 - DNA, 20 bp, Artificial Sequence
  chemically synthesized
ctgatggtaatgagtctagt

SEQ ID NO: 20816 - DNA, 20 bp, Artificial Sequence
  chemically synthesized
tgatggtaatgagtctagtt

SEQ ID NO: 20817 - DNA, 20 bp, Artificial Sequence
  chemically synthesized
gtctagttgggttgattctt

SEQ ID NO: 20818 - DNA, 20 bp, Artificial Sequence
  chemically synthesized
tgggttgattctttggcctt

SEQ ID NO: 20819 - DNA, 20 bp, Artificial Sequence
  chemically synthesized
gggttgattctttggccttc

SEQ ID NO: 20820 - DNA, 20 bp, Artificial Sequence
  chemically synthesized
ttgattctttggccttcagg

SEQ ID NO: 20821 - DNA, 20 bp, Artificial Sequence
  chemically synthesized
tggccttcaggcagtttgct

SEQ ID NO: 20822 - DNA, 20 bp, Artificial Sequence
  chemically synthesized
ggccttcaggcagtttgctt

SEQ ID NO: 20823 - DNA, 20 bp, Artificial Sequence
  chemically synthesized
caggcagtttgcttgggtgt

SEQ ID NO: 20824 - DNA, 20 bp, Artificial Sequence
  chemically synthesized
gcagtttgcttgggtgtcag

SEQ ID NO: 20825 - DNA, 20 bp, Artificial Sequence
  chemically synthesized
gtttgcttgggtgtcagtag

SEQ ID NO: 20826 - DNA, 20 bp, Artificial Sequence
  chemically synthesized
ttgggtgtcagtagtggcca

SEQ ID NO: 20827 - DNA, 20 bp, Artificial Sequence
  chemically synthesized
ggtgtcagtagtggccatag

SEQ ID NO: 20828 - DNA, 20 bp, Artificial Sequence
  chemically synthesized
cagtagtggccatagtagac

SEQ ID NO: 20829 - DNA, 20 bp, Artificial Sequence
  chemically synthesized
agtagtggccatagtagact

SEQ ID NO: 20830 - DNA, 20 bp, Artificial Sequence
  chemically synthesized
gtggccatagtagactgggc

SEQ ID NO: 20831 - DNA, 20 bp, Artificial Sequence
  chemically synthesized
tagtagactgggctggtgtg

SEQ ID NO: 20832 - DNA, 20 bp, Artificial Sequence
  chemically synthesized
agtagactgggctggtgtgt

SEQ ID NO: 20833 - DNA, 20 bp, Artificial Sequence
  chemically synthesized
tgggctggtgtgtgggtcct

SEQ ID NO: 20834 - DNA, 20 bp, Artificial Sequence
  chemically synthesized
gggctggtgtgtgggtcctc

SEQ ID NO: 20835 - DNA, 20 bp, Artificial Sequence
  chemically synthesized
tgtgtgggtcctcaggcttc

SEQ ID NO: 20836 - DNA, 20 bp, Artificial Sequence
  chemically synthesized
tgggtcctcaggcttctgga

SEQ ID NO: 20837 - DNA, 20 bp, Artificial Sequence
  chemically synthesized
gtcctcaggcttctggacag

SEQ ID NO: 20838 - DNA, 20 bp, Artificial Sequence
  chemically synthesized
tcctcaggcttctggacagt

SEQ ID NO: 20839 - DNA, 20 bp, Artificial Sequence
  chemically synthesized
aggcttctggacagtgggtg

SEQ ID NO: 20840 - DNA, 20 bp, Artificial Sequence
  chemically synthesized
tctggacagtgggtgtggtg

SEQ ID NO: 20841 - DNA, 20 bp, Artificial Sequence
  chemically synthesized
ctggacagtgggtgtggtgt

SEQ ID NO: 20842 - DNA, 20 bp, Artificial Sequence
  chemically synthesized
agtgggtgtggtgtgggtga

SEQ ID NO: 20843 - DNA, 20 bp, Artificial Sequence
  chemically synthesized
tgtggtgtgggtgatggctg

SEQ ID NO: 20844 - DNA, 20 bp, Artificial Sequence
  chemically synthesized
ggtgatggctgtagcaactg

SEQ ID NO: 20845 - DNA, 20 bp, Artificial Sequence
  chemically synthesized
gtgatggctgtagcaactgc

SEQ ID NO: 20846 - DNA, 20 bp, Artificial Sequence
  chemically synthesized
gcaactgcaggacaaccctc

SEQ ID NO: 20847 - DNA, 20 bp, Artificial Sequence
  chemically synthesized
aggacaaccctctggctccc

SEQ ID NO: 20848 - DNA, 20 bp, Artificial Sequence
  chemically synthesized
acaaccctctggctcccaag

SEQ ID NO: 20849 - DNA, 20 bp, Artificial Sequence
  chemically synthesized
ggctcccaagcagtctgcac

SEQ ID NO: 20850 - DNA, 20 bp, Artificial Sequence
  chemically synthesized
caagcagtctgcactggtgt

SEQ ID NO: 20851 - DNA, 20 bp, Artificial Sequence
  chemically synthesized
gcagtctgcactggtgttgg

SEQ ID NO: 20852 - DNA, 20 bp, Artificial Sequence
  chemically synthesized
gtctgcactggtgttggtgg

SEQ ID NO: 20853 - DNA, 20 bp, Artificial Sequence
  chemically synthesized
ctggtgttggtggtggctgc

SEQ ID NO: 20854 - DNA, 20 bp, Artificial Sequence
  chemically synthesized
tggtgttggtggtggctgca

SEQ ID NO: 20855 - DNA, 20 bp, Artificial Sequence
  chemically synthesized
ggtgttggtggtggctgcaa

SEQ ID NO: 20856 - DNA, 20 bp, Artificial Sequence
  chemically synthesized
ggtggctgcaagggctgaat

SEQ ID NO: 20857 - DNA, 20 bp, Artificial Sequence
  chemically synthesized
gctgcaagggctgaatgagc

SEQ ID NO: 20858 - DNA, 20 bp, Artificial Sequence
  chemically synthesized
gggctgaatgagccagtctt

SEQ ID NO: 20859 - DNA, 20 bp, Artificial Sequence
  chemically synthesized
tgagccagtcttcagaccca

SEQ ID NO: 20860 - DNA, 20 bp, Artificial Sequence
  chemically synthesized
gagccagtcttcagacccac

SEQ ID NO: 20861 - DNA, 20 bp, Artificial Sequence
  chemically synthesized
ccagtcttcagacccacagg

SEQ ID NO: 20862 - DNA, 20 bp, Artificial Sequence
  chemically synthesized
agacccacaggtggcacatg

SEQ ID NO: 20863 - DNA, 20 bp, Artificial Sequence
  chemically synthesized
gacccacaggtggcacatgc

SEQ ID NO: 20864 - DNA, 20 bp, Artificial Sequence
  chemically synthesized
cccacaggtggcacatgcag

SEQ ID NO: 20865 - DNA, 20 bp, Artificial Sequence
  chemically synthesized
ccacaggtggcacatgcagg

SEQ ID NO: 20866 - DNA, 20 bp, Artificial Sequence
  chemically synthesized
gtggcacatgcaggaggtgc

SEQ ID NO: 20867 - DNA, 20 bp, Artificial Sequence
  chemically synthesized
gcaggaggtgccagttgtga

SEQ ID NO: 20868 - DNA, 20 bp, Artificial Sequence
  chemically synthesized
ggaggtgccagttgtgatgg

SEQ ID NO: 20869 - DNA, 20 bp, Artificial Sequence
  chemically synthesized
ggtgccagttgtgatggcag

SEQ ID NO: 20870 - DNA, 20 bp, Artificial Sequence
  chemically synthesized
gccagttgtgatggcagtgg

SEQ ID NO: 20871 - DNA, 20 bp, Artificial Sequence
  chemically synthesized
ttgtgatggcagtggcagat

SEQ ID NO: 20872 - DNA, 20 bp, Artificial Sequence
  chemically synthesized
tgtgatggcagtggcagatt

SEQ ID NO: 20873 - DNA, 20 bp, Artificial Sequence
  chemically synthesized
gatggcagtggcagattggg

SEQ ID NO: 20874 - DNA, 20 bp, Artificial Sequence
  chemically synthesized
atggcagtggcagattgggt

SEQ ID NO: 20875 - DNA, 20 bp, Artificial Sequence
  chemically synthesized
agattgggtaggcccatcat

SEQ ID NO: 20876 - DNA, 20 bp, Artificial Sequence
  chemically synthesized
gattgggtaggcccatcatc

SEQ ID NO: 20877 - DNA, 20 bp, Artificial Sequence
  chemically synthesized
taggcccatcatcaggcttc

SEQ ID NO: 20878 - DNA, 20 bp, Artificial Sequence
  chemically synthesized
aggcccatcatcaggcttct

SEQ ID NO: 20879 - DNA, 20 bp, Artificial Sequence
  chemically synthesized
gcccatcatcaggcttctgg

SEQ ID NO: 20880 - DNA, 20 bp, Artificial Sequence
  chemically synthesized
cccatcatcaggcttctggg

SEQ ID NO: 20881 - DNA, 20 bp, Artificial Sequence
  chemically synthesized
ccatcatcaggcttctggga

SEQ ID NO: 20882 - DNA, 20 bp, Artificial Sequence
  chemically synthesized
aggcttctgggagggttgct

SEQ ID NO: 20883 - DNA, 20 bp, Artificial Sequence
  chemically synthesized
ggcttctgggagggttgctt

SEQ ID NO: 20884 - DNA, 20 bp, Artificial Sequence
  chemically synthesized
tgggagggttgcttaggtac

SEQ ID NO: 20885 - DNA, 20 bp, Artificial Sequence
  chemically synthesized
ggttgcttaggtaccagtca

SEQ ID NO: 20886 - DNA, 20 bp, Artificial Sequence
  chemically synthesized
tgcttaggtaccagtcatgg

SEQ ID NO: 20887 - DNA, 20 bp, Artificial Sequence
  chemically synthesized
taggtaccagtcatggtgga

SEQ ID NO: 20888 - DNA, 20 bp, Artificial Sequence
  chemically synthesized
ccagtcatggtggatggcac

SEQ ID NO: 20889 - DNA, 20 bp, Artificial Sequence
  chemically synthesized
cagtcatggtggatggcaca

SEQ ID NO: 20890 - DNA, 20 bp, Artificial Sequence
  chemically synthesized
ggatggcacaaggctgtctc

SEQ ID NO: 20891 - DNA, 20 bp, Artificial Sequence
  chemically synthesized
gatggcacaaggctgtctct

SEQ ID NO: 20892 - DNA, 20 bp, Artificial Sequence
  chemically synthesized
caaggctgtctctgggttcc

SEQ ID NO: 20893 - DNA, 20 bp, Artificial Sequence
  chemically synthesized
gggttcccagacaacttgct

SEQ ID NO: 20894 - DNA, 20 bp, Artificial Sequence
  chemically synthesized
ggttcccagacaacttgctt

SEQ ID NO: 20895 - DNA, 20 bp, Artificial Sequence
  chemically synthesized
agacaacttgcttaggcatt

SEQ ID NO: 20896 - DNA, 20 bp, Artificial Sequence
  chemically synthesized
gacaacttgcttaggcattg

SEQ ID NO: 20897 - DNA, 20 bp, Artificial Sequence
  chemically synthesized
aacttgcttaggcattgagg

SEQ ID NO: 20898 - DNA, 20 bp, Artificial Sequence
  chemically synthesized
acttgcttaggcattgagga

SEQ ID NO: 20899 - DNA, 20 bp, Artificial Sequence
  chemically synthesized
cttaggcattgaggaaggca

SEQ ID NO: 20900 - DNA, 20 bp, Artificial Sequence
  chemically synthesized
ggcattgaggaaggcaaagc

SEQ ID NO: 20901 - DNA, 20 bp, Artificial Sequence
  chemically synthesized
gcattgaggaaggcaaagcc

SEQ ID NO: 20902 - DNA, 20 bp, Artificial Sequence
  chemically synthesized
tgaggaaggcaaagccaggc

SEQ ID NO: 20903 - DNA, 20 bp, Artificial Sequence
  chemically synthesized
gaggaaggcaaagccaggct

SEQ ID NO: 20904 - DNA, 20 bp, Artificial Sequence
  chemically synthesized
aggctgggtgttcctgacct

SEQ ID NO: 20905 - DNA, 20 bp, Artificial Sequence
  chemically synthesized
ggctgggtgttcctgacctc

SEQ ID NO: 20906 - DNA, 20 bp, Artificial Sequence
  chemically synthesized
gttcctgacctcaggccact

SEQ ID NO: 20907 - DNA, 20 bp, Artificial Sequence
  chemically synthesized
cctgacctcaggccactcag

SEQ ID NO: 20908 - DNA, 20 bp, Artificial Sequence
  chemically synthesized
aggccactcagtggtgtgtg

SEQ ID NO: 20909 - DNA, 20 bp, Artificial Sequence
  chemically synthesized
tcagtggtgtgtgtggacac

SEQ ID NO: 20910 - DNA, 20 bp, Artificial Sequence
  chemically synthesized
tgtgtggacaccggctatca

SEQ ID NO: 20911 - DNA, 20 bp, Artificial Sequence
  chemically synthesized
gtgtggacaccggctatcat

SEQ ID NO: 20912 - DNA, 20 bp, Artificial Sequence
  chemically synthesized
ggacaccggctatcataggc

SEQ ID NO: 20913 - DNA, 20 bp, Artificial Sequence
  chemically synthesized
acaccggctatcataggctg

SEQ ID NO: 20914 - DNA, 20 bp, Artificial Sequence
  chemically synthesized
ccggctatcataggctggag

SEQ ID NO: 20915 - DNA, 20 bp, Artificial Sequence
  chemically synthesized
ggctatcataggctggagtg

SEQ ID NO: 20916 - DNA, 20 bp, Artificial Sequence
  chemically synthesized
ggctggagtggagtgatcct

SEQ ID NO: 20917 - DNA, 20 bp, Artificial Sequence
  chemically synthesized
gctggagtggagtgatcctc

SEQ ID NO: 20918 - DNA, 20 bp, Artificial Sequence
  chemically synthesized
tggagtgatcctcaggcccc

SEQ ID NO: 20919 - DNA, 20 bp, Artificial Sequence
  chemically synthesized
agtgatcctcaggcccccag

SEQ ID NO: 20920 - DNA, 20 bp, Artificial Sequence
  chemically synthesized
aggcccccagcagaatgcct

SEQ ID NO: 20921 - DNA, 20 bp, Artificial Sequence
  chemically synthesized
agcagaatgcctgagtgaat

SEQ ID NO: 20922 - DNA, 20 bp, Artificial Sequence
  chemically synthesized
agaatgcctgagtgaattag

SEQ ID NO: 20923 - DNA, 20 bp, Artificial Sequence
  chemically synthesized
gcattgttgccctgctcttg

SEQ ID NO: 20924 - DNA, 20 bp, Artificial Sequence
  chemically synthesized
cattgttgccctgctcttga

SEQ ID NO: 20925 - DNA, 20 bp, Artificial Sequence
  chemically synthesized
attgttgccctgctcttgaa

SEQ ID NO: 20926 - DNA, 20 bp, Artificial Sequence
  chemically synthesized
ttgttgccctgctcttgaag

SEQ ID NO: 20927 - DNA, 20 bp, Artificial Sequence
  chemically synthesized
gccctgctcttgaaggggtg

SEQ ID NO: 20928 - DNA, 20 bp, Artificial Sequence
  chemically synthesized
ccctgctcttgaaggggtgc

SEQ ID NO: 20929 - DNA, 20 bp, Artificial Sequence
  chemically synthesized
cctgctcttgaaggggtgcg

SEQ ID NO: 20930 - DNA, 20 bp, Artificial Sequence
  chemically synthesized
ggtgcggggtgtgttgcttt

SEQ ID NO: 20931 - DNA, 20 bp, Artificial Sequence
  chemically synthesized
gcggggtgtgttgctttcag

SEQ ID NO: 20932 - DNA, 20 bp, Artificial Sequence
  chemically synthesized
gggtgtgttgctttcagtgg

SEQ ID NO: 20933 - DNA, 20 bp, Artificial Sequence
  chemically synthesized
tgtgttgctttcagtggcag

SEQ ID NO: 20934 - DNA, 20 bp, Artificial Sequence
  chemically synthesized
tcagtggcagcagctataaa

SEQ ID NO: 20935 - DNA, 20 bp, Artificial Sequence
  chemically synthesized
cagtggcagcagctataaat

SEQ ID NO: 20936 - DNA, 20 bp, Artificial Sequence
  chemically synthesized
agcagctataaatgggttgc

SEQ ID NO: 20937 - DNA, 20 bp, Artificial Sequence
  chemically synthesized
agctataaatgggttgctgg

SEQ ID NO: 20938 - DNA, 20 bp, Artificial Sequence
  chemically synthesized
gctataaatgggttgctggt

SEQ ID NO: 20939 - DNA, 20 bp, Artificial Sequence
  chemically synthesized
ttgctggtgggcatgtgttt

SEQ ID NO: 20940 - DNA, 20 bp, Artificial Sequence
  chemically synthesized
gtgggcatgtgtttcagccc

SEQ ID NO: 20941 - DNA, 20 bp, Artificial Sequence
  chemically synthesized
gcatgtgtttcagccccaga

SEQ ID NO: 20942 - DNA, 20 bp, Artificial Sequence
  chemically synthesized
tgtgtttcagccccagatgg

SEQ ID NO: 20943 - DNA, 20 bp, Artificial Sequence
  chemically synthesized
cagccccagatggtggctgc

SEQ ID NO: 20944 - DNA, 20 bp, Artificial Sequence
  chemically synthesized
ccccagatggtggctgcaag

SEQ ID NO: 20945 - DNA, 20 bp, Artificial Sequence
  chemically synthesized
cccagatggtggctgcaagt

SEQ ID NO: 20946 - DNA, 20 bp, Artificial Sequence
  chemically synthesized
ccagatggtggctgcaagtg

SEQ ID NO: 20947 - DNA, 20 bp, Artificial Sequence
  chemically synthesized
gatggtggctgcaagtgggg

SEQ ID NO: 20948 - DNA, 20 bp, Artificial Sequence
  chemically synthesized
caagtggggtagcattttct

SEQ ID NO: 20949 - DNA, 20 bp, Artificial Sequence
  chemically synthesized
aagtggggtagcattttctt

SEQ ID NO: 20950 - DNA, 20 bp, Artificial Sequence
  chemically synthesized
agtggggtagcattttctta

SEQ ID NO: 20951 - DNA, 20 bp, Artificial Sequence
  chemically synthesized
tggggtagcattttcttagg

SEQ ID NO: 20952 - DNA, 20 bp, Artificial Sequence
  chemically synthesized
ttagggagcttataaatgtg

SEQ ID NO: 20953 - DNA, 20 bp, Artificial Sequence
  chemically synthesized
gggagcttataaatgtgtag

SEQ ID NO: 20954 - DNA, 20 bp, Artificial Sequence
  chemically synthesized
atgtgtagcagccctgctac

SEQ ID NO: 20955 - DNA, 20 bp, Artificial Sequence
  chemically synthesized
tgtgtagcagccctgctact

SEQ ID NO: 20956 - DNA, 20 bp, Artificial Sequence
  chemically synthesized
gtgtagcagccctgctactg

SEQ ID NO: 20957 - DNA, 20 bp, Artificial Sequence
  chemically synthesized
tgtagcagccctgctactgg

SEQ ID NO: 20958 - DNA, 20 bp, Artificial Sequence
  chemically synthesized
agcagccctgctactggggg

SEQ ID NO: 20959 - DNA, 20 bp, Artificial Sequence
  chemically synthesized
gcagccctgctactgggggt

SEQ ID NO: 20960 - DNA, 20 bp, Artificial Sequence
  chemically synthesized
cagccctgctactgggggtg

SEQ ID NO: 20961 - DNA, 20 bp, Artificial Sequence
  chemically synthesized
agccctgctactgggggtgg

SEQ ID NO: 20962 - DNA, 20 bp, Artificial Sequence
  chemically synthesized
ccctgctactgggggtgggg

SEQ ID NO: 20963 - DNA, 20 bp, Artificial Sequence
  chemically synthesized
ctaatgacacactttatccc

SEQ ID NO: 20964 - DNA, 20 bp, Artificial Sequence
  chemically synthesized
acacactttatccctggtga

SEQ ID NO: 20965 - DNA, 20 bp, Artificial Sequence
  chemically synthesized
cactttatccctggtgacag

SEQ ID NO: 20966 - DNA, 20 bp, Artificial Sequence
  chemically synthesized
ttatccctggtgacagcagc

SEQ ID NO: 20967 - DNA, 20 bp, Artificial Sequence
  chemically synthesized
tccctggtgacagcagccag

SEQ ID NO: 20968 - DNA, 20 bp, Artificial Sequence
  chemically synthesized
ctggtgacagcagccagcag

SEQ ID NO: 20969 - DNA, 20 bp, Artificial Sequence
  chemically synthesized
cagcagccagcagtagcact

SEQ ID NO: 20970 - DNA, 20 bp, Artificial Sequence
  chemically synthesized
ccagcagtagcactcagctg

SEQ ID NO: 20971 - DNA, 20 bp, Artificial Sequence
  chemically synthesized
cagcagtagcactcagctgt

SEQ ID NO: 20972 - DNA, 20 bp, Artificial Sequence
  chemically synthesized
cagtagcactcagctgtggg

SEQ ID NO: 20973 - DNA, 20 bp, Artificial Sequence
  chemically synthesized
agtagcactcagctgtgggt

SEQ ID NO: 20974 - DNA, 20 bp, Artificial Sequence
  chemically synthesized
gtagcactcagctgtgggtg

SEQ ID NO: 20975 - DNA, 20 bp, Artificial Sequence
  chemically synthesized
tagcactcagctgtgggtgg

SEQ ID NO: 20976 - DNA, 20 bp, Artificial Sequence
  chemically synthesized
cagctgtgggtgggggatgt

SEQ ID NO: 20977 - DNA, 20 bp, Artificial Sequence
  chemically synthesized
ctgtgggtgggggatgtcag

SEQ ID NO: 20978 - DNA, 20 bp, Artificial Sequence
  chemically synthesized
gtgggtgggggatgtcagca

SEQ ID NO: 20979 - DNA, 20 bp, Artificial Sequence
  chemically synthesized
gggggatgtcagcagagctt

SEQ ID NO: 20980 - DNA, 20 bp, Artificial Sequence
  chemically synthesized
ggggatgtcagcagagcttc

SEQ ID NO: 20981 - DNA, 20 bp, Artificial Sequence
  chemically synthesized
gggatgtcagcagagcttca

SEQ ID NO: 20982 - DNA, 20 bp, Artificial Sequence
  chemically synthesized
tcagcagagcttcagggatg

SEQ ID NO: 20983 - DNA, 20 bp, Artificial Sequence
  chemically synthesized
agcagagcttcagggatgta

SEQ ID NO: 20984 - DNA, 20 bp, Artificial Sequence
  chemically synthesized
gcttcagggatgtagagatg

SEQ ID NO: 20985 - DNA, 20 bp, Artificial Sequence
  chemically synthesized
tgtagagatgcagatgatgt

SEQ ID NO: 20986 - DNA, 20 bp, Artificial Sequence
  chemically synthesized
gtagagatgcagatgatgtt

SEQ ID NO: 20987 - DNA, 20 bp, Artificial Sequence
  chemically synthesized
tagagatgcagatgatgttg

SEQ ID NO: 20988 - DNA, 20 bp, Artificial Sequence
  chemically synthesized
tgcagatgatgttggggtct

SEQ ID NO: 20989 - DNA, 20 bp, Artificial Sequence
  chemically synthesized
gcagatgatgttggggtctg

SEQ ID NO: 20990 - DNA, 20 bp, Artificial Sequence
  chemically synthesized
gtctgaggaacgatgtcatc

SEQ ID NO: 20991 - DNA, 20 bp, Artificial Sequence
  chemically synthesized
tgaggaacgatgtcatctgg

SEQ ID NO: 20992 - DNA, 20 bp, Artificial Sequence
  chemically synthesized
gaggaacgatgtcatctggt

SEQ ID NO: 20993 - DNA, 20 bp, Artificial Sequence
  chemically synthesized
cgatgtcatctggtgggtgt

SEQ ID NO: 20994 - DNA, 20 bp, Artificial Sequence
  chemically synthesized
gatgtcatctggtgggtgtt

SEQ ID NO: 20995 - DNA, 20 bp, Artificial Sequence
  chemically synthesized
tgggtgttgggctctcaaaa

SEQ ID NO: 20996 - DNA, 20 bp, Artificial Sequence
  chemically synthesized
caaaatggcaccttgctgct

SEQ ID NO: 20997 - DNA, 20 bp, Artificial Sequence
  chemically synthesized
ggcaccttgctgctcagtaa

SEQ ID NO: 20998 - DNA, 20 bp, Artificial Sequence
  chemically synthesized
gcaccttgctgctcagtaat

SEQ ID NO: 20999 - DNA, 20 bp, Artificial Sequence
  chemically synthesized
caccttgctgctcagtaatg

SEQ ID NO: 21000 - DNA, 20 bp, Artificial Sequence
  chemically synthesized
ttgctgctcagtaatgggga

SEQ ID NO: 21001 - DNA, 20 bp, Artificial Sequence
  chemically synthesized
ctgctcagtaatggggatgg

SEQ ID NO: 21002 - DNA, 20 bp, Artificial Sequence
  chemically synthesized
tgctcagtaatggggatggc

SEQ ID NO: 21003 - DNA, 20 bp, Artificial Sequence
  chemically synthesized
gctcagtaatggggatggca

SEQ ID NO: 21004 - DNA, 20 bp, Artificial Sequence
  chemically synthesized
ctcagtaatggggatggcag

SEQ ID NO: 21005 - DNA, 20 bp, Artificial Sequence
  chemically synthesized
agtaatggggatggcagggg

SEQ ID NO: 21006 - DNA, 20 bp, Artificial Sequence
  chemically synthesized
gtaatggggatggcaggggt

SEQ ID NO: 21007 - DNA, 20 bp, Artificial Sequence
  chemically synthesized
gggatggcaggggtgggacc

SEQ ID NO: 21008 - DNA, 20 bp, Artificial Sequence
  chemically synthesized
tggcaggggtgggacccagt

SEQ ID NO: 21009 - DNA, 20 bp, Artificial Sequence
  chemically synthesized
gcaggggtgggacccagtga

SEQ ID NO: 21010 - DNA, 20 bp, Artificial Sequence
  chemically synthesized
cccagtgagagctccttctc

SEQ ID NO: 21011 - DNA, 20 bp, Artificial Sequence
  chemically synthesized
cagtgagagctccttctctg

SEQ ID NO: 21012 - DNA, 20 bp, Artificial Sequence
  chemically synthesized
caatgcctttgtgcgattgc

SEQ ID NO: 21013 - DNA, 20 bp, Artificial Sequence
  chemically synthesized
aatgcctttgtgcgattgct

SEQ ID NO: 21014 - DNA, 20 bp, Artificial Sequence
  chemically synthesized
gcctttgtgcgattgctggg

SEQ ID NO: 21015 - DNA, 20 bp, Artificial Sequence
  chemically synthesized
tgctgggcagttccttatga

SEQ ID NO: 21016 - DNA, 20 bp, Artificial Sequence
  chemically synthesized
cagttccttatgatagtctc

SEQ ID NO: 21017 - DNA, 20 bp, Artificial Sequence
  chemically synthesized
agttccttatgatagtctca

SEQ ID NO: 21018 - DNA, 20 bp, Artificial Sequence
  chemically synthesized
tgatagtctcaaggcctgca

SEQ ID NO: 21019 - DNA, 20 bp, Artificial Sequence
  chemically synthesized
gtctcaaggcctgcatggtc

SEQ ID NO: 21020 - DNA, 20 bp, Artificial Sequence
  chemically synthesized
tctcaaggcctgcatggtca

SEQ ID NO: 21021 - DNA, 20 bp, Artificial Sequence
  chemically synthesized
ctcaaggcctgcatggtcaa

SEQ ID NO: 21022 - DNA, 20 bp, Artificial Sequence
  chemically synthesized
atggtcaagggactctcctg

SEQ ID NO: 21023 - DNA, 20 bp, Artificial Sequence
  chemically synthesized
tcaagggactctcctgtggc

SEQ ID NO: 21024 - DNA, 20 bp, Artificial Sequence
  chemically synthesized
caagggactctcctgtggct

SEQ ID NO: 21025 - DNA, 20 bp, Artificial Sequence
  chemically synthesized
tctcctgtggctaggattcc

SEQ ID NO: 21026 - DNA, 20 bp, Artificial Sequence
  chemically synthesized
tcctgtggctaggattcctg

SEQ ID NO: 21027 - DNA, 20 bp, Artificial Sequence
  chemically synthesized
gattcctggagtccataatg

SEQ ID NO: 21028 - DNA, 20 bp, Artificial Sequence
  chemically synthesized
tggagtccataatgcagatg

SEQ ID NO: 21029 - DNA, 20 bp, Artificial Sequence
  chemically synthesized
ataatgcagatgtggaccac

SEQ ID NO: 21030 - DNA, 20 bp, Artificial Sequence
  chemically synthesized
taatgcagatgtggaccact

SEQ ID NO: 21031 - DNA, 20 bp, Artificial Sequence
  chemically synthesized
atgcagatgtggaccactgg

SEQ ID NO: 21032 - DNA, 20 bp, Artificial Sequence
  chemically synthesized
agatgtggaccactgggagt

SEQ ID NO: 21033 - DNA, 20 bp, Artificial Sequence
  chemically synthesized
tcacttaactttcgatgcac

SEQ ID NO: 21034 - DNA, 20 bp, Artificial Sequence
  chemically synthesized
cacttaactttcgatgcact

SEQ ID NO: 21035 - DNA, 20 bp, Artificial Sequence
  chemically synthesized
acttaactttcgatgcactg

SEQ ID NO: 21036 - DNA, 20 bp, Artificial Sequence
  chemically synthesized
ttaactttcgatgcactggg

SEQ ID NO: 21037 - DNA, 20 bp, Artificial Sequence
  chemically synthesized
gatgcactggggagcctctc

SEQ ID NO: 21038 - DNA, 20 bp, Artificial Sequence
  chemically synthesized
ggggagcctctctggcctca

SEQ ID NO: 21039 - DNA, 20 bp, Artificial Sequence
  chemically synthesized
ggagcctctctggcctcaca

SEQ ID NO: 21040 - DNA, 20 bp, Artificial Sequence
  chemically synthesized
gagcctctctggcctcacag

SEQ ID NO: 21041 - DNA, 20 bp, Artificial Sequence
  chemically synthesized
gcctcacagaggatccctac

SEQ ID NO: 21042 - DNA, 20 bp, Artificial Sequence
  chemically synthesized
cctcacagaggatccctact

SEQ ID NO: 21043 - DNA, 20 bp, Artificial Sequence
  chemically synthesized
cacagaggatccctactggg

SEQ ID NO: 21044 - DNA, 20 bp, Artificial Sequence
  chemically synthesized
acagaggatccctactgggt

SEQ ID NO: 21045 - DNA, 20 bp, Artificial Sequence
  chemically synthesized
ttccctccccttcattgcct

SEQ ID NO: 21046 - DNA, 20 bp, Artificial Sequence
  chemically synthesized
gtcacttctctgttgaattc

SEQ ID NO: 21047 - DNA, 20 bp, Artificial Sequence
  chemically synthesized
ttccagaattctctcttatg

SEQ ID NO: 21048 - DNA, 20 bp, Artificial Sequence
  chemically synthesized
tccagaattctctcttatgt

SEQ ID NO: 21049 - DNA, 20 bp, Artificial Sequence
  chemically synthesized
ggattttctacttactattt

SEQ ID NO: 21050 - DNA, 20 bp, Artificial Sequence
  chemically synthesized
cttactattttggttctttg

SEQ ID NO: 21051 - DNA, 20 bp, Artificial Sequence
  chemically synthesized
tactattttggttctttgtg

SEQ ID NO: 21052 - DNA, 20 bp, Artificial Sequence
  chemically synthesized
actattttggttctttgtgg

SEQ ID NO: 21053 - DNA, 20 bp, Artificial Sequence
  chemically synthesized
tattttggttctttgtggag

SEQ ID NO: 21054 - DNA, 20 bp, Artificial Sequence
  chemically synthesized
attttggttctttgtggagg

SEQ ID NO: 21055 - DNA, 20 bp, Artificial Sequence
  chemically synthesized
tggttctttgtggaggaggt

SEQ ID NO: 21056 - DNA, 20 bp, Artificial Sequence
  chemically synthesized
tttgtggaggaggtgagtgt

SEQ ID NO: 21057 - DNA, 20 bp, Artificial Sequence
  chemically synthesized
aggtgagtgtcagctgccct

SEQ ID NO: 21058 - DNA, 20 bp, Artificial Sequence
  chemically synthesized
gagtgtcagctgcccttagt

SEQ ID NO: 21059 - DNA, 20 bp, Artificial Sequence
  chemically synthesized
gcccttagtcagtaatcttc

SEQ ID NO: 21060 - DNA, 20 bp, Artificial Sequence
  chemically synthesized
cccttcccttgaaatttttt

SEQ ID NO: 21061 - DNA, 20 bp, Artificial Sequence
  chemically synthesized
ctttatgtttttatttctaa

SEQ ID NO: 21062 - DNA, 20 bp, Artificial Sequence
  chemically synthesized
ttttatttctaatagactga

SEQ ID NO: 21063 - DNA, 20 bp, Artificial Sequence
  chemically synthesized
ttatttctaatagactgaaa

SEQ ID NO: 21064 - DNA, 20 bp, Artificial Sequence
  chemically synthesized
aatcatattttaaacactct

SEQ ID NO: 21065 - DNA, 20 bp, Artificial Sequence
  chemically synthesized
atcatattttaaacactcta

SEQ ID NO: 21066 - DNA, 20 bp, Artificial Sequence
  chemically synthesized
ttaaacactctaaggctata

SEQ ID NO: 21067 - DNA, 20 bp, Artificial Sequence
  chemically synthesized
taaacactctaaggctatat

SEQ ID NO: 21068 - DNA, 20 bp, Artificial Sequence
  chemically synthesized
aaacactctaaggctatatg

SEQ ID NO: 21069 - DNA, 20 bp, Artificial Sequence
  chemically synthesized
aacactctaaggctatatgg

SEQ ID NO: 21070 - DNA, 20 bp, Artificial Sequence
  chemically synthesized
gctatatgggggactatctg

SEQ ID NO: 21071 - DNA, 20 bp, Artificial Sequence
  chemically synthesized
ctatatgggggactatctga

SEQ ID NO: 21072 - DNA, 20 bp, Artificial Sequence
  chemically synthesized
gggggactatctgaaggcct

SEQ ID NO: 21073 - DNA, 20 bp, Artificial Sequence
  chemically synthesized
actatctgaaggcctcagat

SEQ ID NO: 21074 - DNA, 20 bp, Artificial Sequence
  chemically synthesized
tgaaggcctcagatgagtaa

SEQ ID NO: 21075 - DNA, 20 bp, Artificial Sequence
  chemically synthesized
aggcctcagatgagtaaaag

SEQ ID NO: 21076 - DNA, 20 bp, Artificial Sequence
  chemically synthesized
cctcagatgagtaaaagaag

SEQ ID NO: 21077 - DNA, 20 bp, Artificial Sequence
  chemically synthesized
gagtaaaagaagtagcgaat

SEQ ID NO: 21078 - DNA, 20 bp, Artificial Sequence
  chemically synthesized
atcatttgtttcttcaaata

SEQ ID NO: 21079 - DNA, 20 bp, Artificial Sequence
  chemically synthesized
tatttcccccttatgttctt

SEQ ID NO: 21080 - DNA, 20 bp, Artificial Sequence
  chemically synthesized
aaaaatgtttgcatctacca

SEQ ID NO: 21081 - DNA, 20 bp, Artificial Sequence
  chemically synthesized
aaatacgtaatctaacaaac

SEQ ID NO: 21082 - DNA, 20 bp, Artificial Sequence
  chemically synthesized
aatacgtaatctaacaaaca

SEQ ID NO: 21083 - DNA, 20 bp, Artificial Sequence
  chemically synthesized
ctaacaaacaaggatgtttt

SEQ ID NO: 21084 - DNA, 20 bp, Artificial Sequence
  chemically synthesized
aaggatgttttaagatctct

SEQ ID NO: 21085 - DNA, 20 bp, Artificial Sequence
  chemically synthesized
atgttttaagatctctgagt

SEQ ID NO: 21086 - DNA, 20 bp, Artificial Sequence
  chemically synthesized
agatctctgagtaagatgca

SEQ ID NO: 21087 - DNA, 20 bp, Artificial Sequence
  chemically synthesized
agatgcatagttgcaaataa

SEQ ID NO: 21088 - DNA, 20 bp, Artificial Sequence
  chemically synthesized
gatgcatagttgcaaataaa

SEQ ID NO: 21089 - DNA, 20 bp, Artificial Sequence
  chemically synthesized
tgcatagttgcaaataaaag

SEQ ID NO: 21090 - DNA, 20 bp, Artificial Sequence
  chemically synthesized
tgcaaataaaaggagttttc

SEQ ID NO: 21091 - DNA, 20 bp, Artificial Sequence
  chemically synthesized
gcaaataaaaggagttttca

SEQ ID NO: 21092 - DNA, 20 bp, Artificial Sequence
  chemically synthesized
atctaataaatgtgtaccat

SEQ ID NO: 21093 - DNA, 20 bp, Artificial Sequence
  chemically synthesized
tgtgtaccatcagaaactta

SEQ ID NO: 21094 - DNA, 20 bp, Artificial Sequence
  chemically synthesized
aaacttatggtatattctcc

SEQ ID NO: 21095 - DNA, 20 bp, Artificial Sequence
  chemically synthesized
tatggtatattctcctggaa

SEQ ID NO: 21096 - DNA, 20 bp, Artificial Sequence
  chemically synthesized
atattctcctggaaaagatg

SEQ ID NO: 21097 - DNA, 20 bp, Artificial Sequence
  chemically synthesized
tcctggaaaagatgaagatg

SEQ ID NO: 21098 - DNA, 20 bp, Artificial Sequence
  chemically synthesized
aagatgaagatgaagaaaat

SEQ ID NO: 21099 - DNA, 20 bp, Artificial Sequence
  chemically synthesized
agatgaagaaaataagtcta

SEQ ID NO: 21100 - DNA, 20 bp, Artificial Sequence
  chemically synthesized
tgaagaaaataagtctacag

SEQ ID NO: 21101 - DNA, 20 bp, Artificial Sequence
  chemically synthesized
aagaaaataagtctacagaa

SEQ ID NO: 21102 - DNA, 20 bp, Artificial Sequence
  chemically synthesized
agaaaataagtctacagaag

SEQ ID NO: 21103 - DNA, 20 bp, Artificial Sequence
  chemically synthesized
aaaataagtctacagaagag

SEQ ID NO: 21104 - DNA, 20 bp, Artificial Sequence
  chemically synthesized
acagaagaggagaaattctt

SEQ ID NO: 21105 - DNA, 20 bp, Artificial Sequence
  chemically synthesized
ttggaaattttgcatttttg

SEQ ID NO: 21106 - DNA, 20 bp, Artificial Sequence
  chemically synthesized
aaattttgcatttttgtgga

SEQ ID NO: 21107 - DNA, 20 bp, Artificial Sequence
  chemically synthesized
ttttgcatttttgtggatag

SEQ ID NO: 21108 - DNA, 20 bp, Artificial Sequence
  chemically synthesized
ttttgtggatagtggttttg

SEQ ID NO: 21109 - DNA, 20 bp, Artificial Sequence
  chemically synthesized
gtggatagtggttttgaaga

SEQ ID NO: 21110 - DNA, 20 bp, Artificial Sequence
  chemically synthesized
tagtggttttgaagaaagct

SEQ ID NO: 21111 - DNA, 20 bp, Artificial Sequence
  chemically synthesized
atatatttaaatatgttgct

SEQ ID NO: 21112 - DNA, 20 bp, Artificial Sequence
  chemically synthesized
gatgtgactcccacacttta

SEQ ID NO: 21113 - DNA, 20 bp, Artificial Sequence
  chemically synthesized
gactcccacactttaaagaa

SEQ ID NO: 21114 - DNA, 20 bp, Artificial Sequence
  chemically synthesized
taaagaaaagttcttcattt

SEQ ID NO: 21115 - DNA, 20 bp, Artificial Sequence
  chemically synthesized
ttttagttgcccttgcaaat

SEQ ID NO: 21116 - DNA, 20 bp, Artificial Sequence
  chemically synthesized
gttgcccttgcaaattggct

SEQ ID NO: 21117 - DNA, 20 bp, Artificial Sequence
  chemically synthesized
tcctcaacaaataattttga

SEQ ID NO: 21118 - DNA, 20 bp, Artificial Sequence
  chemically synthesized
tgatggtttctaaaattgtc

SEQ ID NO: 21119 - DNA, 20 bp, Artificial Sequence
  chemically synthesized
tctaaaattgtccagaattt

SEQ ID NO: 21120 - DNA, 20 bp, Artificial Sequence
  chemically synthesized
ctaaaattgtccagaatttg

SEQ ID NO: 21121 - DNA, 20 bp, Artificial Sequence
  chemically synthesized
ccagaatttgaggaaatact

SEQ ID NO: 21122 - DNA, 20 bp, Artificial Sequence
  chemically synthesized
tttgaggaaatacttagatg

SEQ ID NO: 21123 - DNA, 20 bp, Artificial Sequence
  chemically synthesized
gaggaaatacttagatgtag

SEQ ID NO: 21124 - DNA, 20 bp, Artificial Sequence
  chemically synthesized
gacatcaatttatgttaact

SEQ ID NO: 21125 - DNA, 20 bp, Artificial Sequence
  chemically synthesized
tgttaacttagatttattgt

SEQ ID NO: 21126 - DNA, 20 bp, Artificial Sequence
  chemically synthesized
aacttagatttattgttgga

SEQ ID NO: 21127 - DNA, 20 bp, Artificial Sequence
  chemically synthesized
agatttattgttggatggtt

SEQ ID NO: 21128 - DNA, 20 bp, Artificial Sequence
  chemically synthesized
taatcatgtctgttcttgtc

SEQ ID NO: 21129 - DNA, 20 bp, Artificial Sequence
  chemically synthesized
atgtctgttcttgtccagtc

SEQ ID NO: 21130 - DNA, 20 bp, Artificial Sequence
  chemically synthesized
tctgttcttgtccagtctag

SEQ ID NO: 21131 - DNA, 20 bp, Artificial Sequence
  chemically synthesized
acatctgaactgtgatttga

SEQ ID NO: 21132 - DNA, 20 bp, Artificial Sequence
  chemically synthesized
tttgacagtgtccttattat

SEQ ID NO: 21133 - DNA, 20 bp, Artificial Sequence
  chemically synthesized
tatcagactctgctcaatga

SEQ ID NO: 21134 - DNA, 20 bp, Artificial Sequence
  chemically synthesized
gtttaaacttctttttgata

SEQ ID NO: 21135 - DNA, 20 bp, Artificial Sequence
  chemically synthesized
cagtaaaaaacttttcctta

SEQ ID NO: 21136 - DNA, 20 bp, Artificial Sequence
  chemically synthesized
tccttaaagatgaaattctt

SEQ ID NO: 21137 - DNA, 20 bp, Artificial Sequence
  chemically synthesized
ccttaaagatgaaattctta

SEQ ID NO: 21138 - DNA, 20 bp, Artificial Sequence
  chemically synthesized
atgaaattcttaaggacaat

SEQ ID NO: 21139 - DNA, 20 bp, Artificial Sequence
  chemically synthesized
ttaaggacaattagcttgtg

SEQ ID NO: 21140 - DNA, 20 bp, Artificial Sequence
  chemically synthesized
tatgaaaattgcttgcattt

SEQ ID NO: 21141 - DNA, 20 bp, Artificial Sequence
  chemically synthesized
tgaaaattgcttgcattttg

SEQ ID NO: 21142 - DNA, 20 bp, Artificial Sequence
  chemically synthesized
cttgcattttggagttacat

SEQ ID NO: 21143 - DNA, 20 bp, Artificial Sequence
  chemically synthesized
tataaattaatgaatcctat

SEQ ID NO: 21144 - DNA, 20 bp, Artificial Sequence
  chemically synthesized
atcctattggtaccatataa

SEQ ID NO: 21145 - DNA, 20 bp, Artificial Sequence
  chemically synthesized
cttttgtgtctcgcctttca

SEQ ID NO: 21146 - DNA, 20 bp, Artificial Sequence
  chemically synthesized
ttttgtgtctcgcctttcaa

SEQ ID NO: 21147 - DNA, 20 bp, Artificial Sequence
  chemically synthesized
tttgtgtctcgcctttcaaa

SEQ ID NO: 21148 - DNA, 20 bp, Artificial Sequence
  chemically synthesized
tcaaagggcaattttccaaa

SEQ ID NO: 21149 - DNA, 20 bp, Artificial Sequence
  chemically synthesized
tccaaaaagtatattttgca

SEQ ID NO: 21150 - DNA, 20 bp, Artificial Sequence
  chemically synthesized
aaagtatattttgcatggct

SEQ ID NO: 21151 - DNA, 20 bp, Artificial Sequence
  chemically synthesized
aagtatattttgcatggctc

SEQ ID NO: 21152 - DNA, 20 bp, Artificial Sequence
  chemically synthesized
ttttgcatggctcaggctaa

SEQ ID NO: 21153 - DNA, 20 bp, Artificial Sequence
  chemically synthesized
caggctaaaagtaatgtctc

SEQ ID NO: 21154 - DNA, 20 bp, Artificial Sequence
  chemically synthesized
aaaagtaatgtctccagatg

SEQ ID NO: 21155 - DNA, 20 bp, Artificial Sequence
  chemically synthesized
cattgattgtgactattgat

SEQ ID NO: 21156 - DNA, 20 bp, Artificial Sequence
  chemically synthesized
ttgataagatttactatgta

SEQ ID NO: 21157 - DNA, 20 bp, Artificial Sequence
  chemically synthesized
agatttactatgtaaagtat

SEQ ID NO: 21158 - DNA, 20 bp, Artificial Sequence
  chemically synthesized
ctatgtaaagtataagttac

SEQ ID NO: 21159 - DNA, 20 bp, Artificial Sequence
  chemically synthesized
gttactggaataatacattt

SEQ ID NO: 21160 - DNA, 20 bp, Artificial Sequence
  chemically synthesized
aataatacatttaagaaata

SEQ ID NO: 21161 - DNA, 20 bp, Artificial Sequence
  chemically synthesized
aatacatttaagaaatatag

SEQ ID NO: 21162 - DNA, 20 bp, Artificial Sequence
  chemically synthesized
atagtagctattaaaacctg

SEQ ID NO: 21163 - DNA, 20 bp, Artificial Sequence
  chemically synthesized
aaacctgtagtctgatgaaa

SEQ ID NO: 21164 - DNA, 20 bp, Artificial Sequence
  chemically synthesized
tgaaatggaatatgttttga

SEQ ID NO: 21165 - DNA, 20 bp, Artificial Sequence
  chemically synthesized
atggaatatgttttgaaaga

SEQ ID NO: 21166 - DNA, 20 bp, Artificial Sequence
  chemically synthesized
gaatatgttttgaaagacag

SEQ ID NO: 21167 - DNA, 20 bp, Artificial Sequence
  chemically synthesized
gaaagacagcagtgaaaaat

SEQ ID NO: 21168 - DNA, 20 bp, Artificial Sequence
  chemically synthesized
agacagcagtgaaaaatgag

SEQ ID NO: 21169 - DNA, 20 bp, Artificial Sequence
  chemically synthesized
aaaaatgagaagtaatatat

SEQ ID NO: 21170 - DNA, 20 bp, Artificial Sequence
  chemically synthesized
taaaattgctttttgcaatt

SEQ ID NO: 21171 - DNA, 20 bp, Artificial Sequence
  chemically synthesized
tgctttttgcaattgagttg

SEQ ID NO: 21172 - DNA, 20 bp, Artificial Sequence
  chemically synthesized
attgagttgaagattgatgc

SEQ ID NO: 21173 - DNA, 20 bp, Artificial Sequence
  chemically synthesized
ttgagttgaagattgatgcc

SEQ ID NO: 21174 - DNA, 20 bp, Artificial Sequence
  chemically synthesized
tgccaggatcttattacctc

SEQ ID NO: 21175 - DNA, 20 bp, Artificial Sequence
  chemically synthesized
gccaggatcttattacctcc

SEQ ID NO: 21176 - DNA, 20 bp, Artificial Sequence
  chemically synthesized
attacctccaggatttcaca

SEQ ID NO: 21177 - DNA, 20 bp, Artificial Sequence
  chemically synthesized
ttacctccaggatttcacaa

SEQ ID NO: 21178 - DNA, 20 bp, Artificial Sequence
  chemically synthesized
gatttcacaaaggatttctt

SEQ ID NO: 21179 - DNA, 20 bp, Artificial Sequence
  chemically synthesized
cttgagtcatccccttgctc

SEQ ID NO: 21180 - DNA, 20 bp, Artificial Sequence
  chemically synthesized
cttgctctagctcatgaaca

SEQ ID NO: 21181 - DNA, 20 bp, Artificial Sequence
  chemically synthesized
tcatgaacaaagtattgctc

SEQ ID NO: 21182 - DNA, 20 bp, Artificial Sequence
  chemically synthesized
agtattgctcaagtaatcga

SEQ ID NO: 21183 - DNA, 20 bp, Artificial Sequence
  chemically synthesized
tctcacatgtgattattatt

SEQ ID NO: 21184 - DNA, 20 bp, Artificial Sequence
  chemically synthesized
attattatttagtgctgtca

SEQ ID NO: 21185 - DNA, 20 bp, Artificial Sequence
  chemically synthesized
ttattatttagtgctgtcac

SEQ ID NO: 21186 - DNA, 20 bp, Artificial Sequence
  chemically synthesized
tcacgggaaatatcctgcct

SEQ ID NO: 21187 - DNA, 20 bp, Artificial Sequence
  chemically synthesized
aatatcctgcctaagtttac

SEQ ID NO: 21188 - DNA, 20 bp, Artificial Sequence
  chemically synthesized
tatcctgcctaagtttactg

SEQ ID NO: 21189 - DNA, 20 bp, Artificial Sequence
  chemically synthesized
atcctgcctaagtttactgg

SEQ ID NO: 21190 - DNA, 20 bp, Artificial Sequence
  chemically synthesized
cctccctatgtcctcctacc

SEQ ID NO: 21191 - DNA, 20 bp, Artificial Sequence
  chemically synthesized
tttccttgcacactctactc

SEQ ID NO: 21192 - DNA, 20 bp, Artificial Sequence
  chemically synthesized
ttgcacactctactccagct

SEQ ID NO: 21193 - DNA, 20 bp, Artificial Sequence
  chemically synthesized
tgcacactctactccagctt

SEQ ID NO: 21194 - DNA, 20 bp, Artificial Sequence
  chemically synthesized
gcacactctactccagctta

SEQ ID NO: 21195 - DNA, 20 bp, Artificial Sequence
  chemically synthesized
ctctactccagcttagggcc

SEQ ID NO: 21196 - DNA, 20 bp, Artificial Sequence
  chemically synthesized
tctactccagcttagggcct

SEQ ID NO: 21197 - DNA, 20 bp, Artificial Sequence
  chemically synthesized
acccttttaattaccccatt

SEQ ID NO: 21198 - DNA, 20 bp, Artificial Sequence
  chemically synthesized
tcaatttttgccttttcaat

SEQ ID NO: 21199 - DNA, 20 bp, Artificial Sequence
  chemically synthesized
aaaatttatttatatatatt

SEQ ID NO: 21200 - DNA, 20 bp, Artificial Sequence
  chemically synthesized
atttatttatatatatttag

SEQ ID NO: 21201 - DNA, 20 bp, Artificial Sequence
  chemically synthesized
tttatttatatatatttaga

SEQ ID NO: 21202 - DNA, 20 bp, Artificial Sequence
  chemically synthesized
tatatttagaaggtatgtac

SEQ ID NO: 21203 - DNA, 20 bp, Artificial Sequence
  chemically synthesized
tcgttatcatgctgcttata

SEQ ID NO: 21204 - DNA, 20 bp, Artificial Sequence
  chemically synthesized
ctgcttataaagacatacct

SEQ ID NO: 21205 - DNA, 20 bp, Artificial Sequence
  chemically synthesized
tataaagacatacctgagac

SEQ ID NO: 21206 - DNA, 20 bp, Artificial Sequence
  chemically synthesized
ataaagacatacctgagact

SEQ ID NO: 21207 - DNA, 20 bp, Artificial Sequence
  chemically synthesized
cctgagactgggtaatttat

SEQ ID NO: 21208 - DNA, 20 bp, Artificial Sequence
  chemically synthesized
ctgagactgggtaatttata

SEQ ID NO: 21209 - DNA, 20 bp, Artificial Sequence
  chemically synthesized
aaaaacgtttaattgtctca

SEQ ID NO: 21210 - DNA, 20 bp, Artificial Sequence
  chemically synthesized
ttaattgtctcacagttcca

SEQ ID NO: 21211 - DNA, 20 bp, Artificial Sequence
  chemically synthesized
taattgtctcacagttccac

SEQ ID NO: 21212 - DNA, 20 bp, Artificial Sequence
  chemically synthesized
aattgtctcacagttccaca

SEQ ID NO: 21213 - DNA, 20 bp, Artificial Sequence
  chemically synthesized
gtctcacagttccacagggc

SEQ ID NO: 21214 - DNA, 20 bp, Artificial Sequence
  chemically synthesized
tctcacagttccacagggct

SEQ ID NO: 21215 - DNA, 20 bp, Artificial Sequence
  chemically synthesized
ctcacagttccacagggctg

SEQ ID NO: 21216 - DNA, 20 bp, Artificial Sequence
  chemically synthesized
cacagttccacagggctggg

SEQ ID NO: 21217 - DNA, 20 bp, Artificial Sequence
  chemically synthesized
acagttccacagggctgggg

SEQ ID NO: 21218 - DNA, 20 bp, Artificial Sequence
  chemically synthesized
ccacagggctggggaggcct

SEQ ID NO: 21219 - DNA, 20 bp, Artificial Sequence
  chemically synthesized
cacagggctggggaggcctc

SEQ ID NO: 21220 - DNA, 20 bp, Artificial Sequence
  chemically synthesized
cctcgggaaacttacaatca

SEQ ID NO: 21221 - DNA, 20 bp, Artificial Sequence
  chemically synthesized
cgggaaacttacaatcatgg

SEQ ID NO: 21222 - DNA, 20 bp, Artificial Sequence
  chemically synthesized
gaaacttacaatcatggcag

SEQ ID NO: 21223 - DNA, 20 bp, Artificial Sequence
  chemically synthesized
acttacaatcatggcagaag

SEQ ID NO: 21224 - DNA, 20 bp, Artificial Sequence
  chemically synthesized
caaacatgtccttcttcaca

SEQ ID NO: 21225 - DNA, 20 bp, Artificial Sequence
  chemically synthesized
acatgtccttcttcacatgg

SEQ ID NO: 21226 - DNA, 20 bp, Artificial Sequence
  chemically synthesized
tgtccttcttcacatggcag

SEQ ID NO: 21227 - DNA, 20 bp, Artificial Sequence
  chemically synthesized
cttcttcacatggcagcagc

SEQ ID NO: 21228 - DNA, 20 bp, Artificial Sequence
  chemically synthesized
cttcacatggcagcagcaag

SEQ ID NO: 21229 - DNA, 20 bp, Artificial Sequence
  chemically synthesized
cacatggcagcagcaagtag

SEQ ID NO: 21230 - DNA, 20 bp, Artificial Sequence
  chemically synthesized
cagcagcaagtagaagtgcc

SEQ ID NO: 21231 - DNA, 20 bp, Artificial Sequence
  chemically synthesized
caagtagaagtgccaagcaa

SEQ ID NO: 21232 - DNA, 20 bp, Artificial Sequence
  chemically synthesized
aagtagaagtgccaagcaaa

SEQ ID NO: 21233 - DNA, 20 bp, Artificial Sequence
  chemically synthesized
agtagaagtgccaagcaaaa

SEQ ID NO: 21234 - DNA, 20 bp, Artificial Sequence
  chemically synthesized
gtagaagtgccaagcaaaag

SEQ ID NO: 21235 - DNA, 20 bp, Artificial Sequence
  chemically synthesized
tagaagtgccaagcaaaagg

SEQ ID NO: 21236 - DNA, 20 bp, Artificial Sequence
  chemically synthesized
gtgccaagcaaaagggggaa

SEQ ID NO: 21237 - DNA, 20 bp, Artificial Sequence
  chemically synthesized
aaagccgcttataaaaccat

SEQ ID NO: 21238 - DNA, 20 bp, Artificial Sequence
  chemically synthesized
ataaaaccatcagatcttgt

SEQ ID NO: 21239 - DNA, 20 bp, Artificial Sequence
  chemically synthesized
ttgtaagaactcactatcac

SEQ ID NO: 21240 - DNA, 20 bp, Artificial Sequence
  chemically synthesized
taagaactcactatcacgag

SEQ ID NO: 21241 - DNA, 20 bp, Artificial Sequence
  chemically synthesized
agaactcactatcacgagaa

SEQ ID NO: 21242 - DNA, 20 bp, Artificial Sequence
  chemically synthesized
cactatcacgagaagagcat

SEQ ID NO: 21243 - DNA, 20 bp, Artificial Sequence
  chemically synthesized
ctatcacgagaagagcatga

SEQ ID NO: 21244 - DNA, 20 bp, Artificial Sequence
  chemically synthesized
aaatccctcccacaacacgt

SEQ ID NO: 21245 - DNA, 20 bp, Artificial Sequence
  chemically synthesized
aatccctcccacaacacgtg

SEQ ID NO: 21246 - DNA, 20 bp, Artificial Sequence
  chemically synthesized
cccacaacacgtgaggatta

SEQ ID NO: 21247 - DNA, 20 bp, Artificial Sequence
  chemically synthesized
ccacaacacgtgaggattat

SEQ ID NO: 21248 - DNA, 20 bp, Artificial Sequence
  chemically synthesized
gattatgggaactacaattc

SEQ ID NO: 21249 - DNA, 20 bp, Artificial Sequence
  chemically synthesized
tgggaactacaattcaagat

SEQ ID NO: 21250 - DNA, 20 bp, Artificial Sequence
  chemically synthesized
ctacaattcaagatgagatt

SEQ ID NO: 21251 - DNA, 20 bp, Artificial Sequence
  chemically synthesized
tacaattcaagatgagattt

SEQ ID NO: 21252 - DNA, 20 bp, Artificial Sequence
  chemically synthesized
aattcaagatgagatttggg

SEQ ID NO: 21253 - DNA, 20 bp, Artificial Sequence
  chemically synthesized
attcaagatgagatttgggt

SEQ ID NO: 21254 - DNA, 20 bp, Artificial Sequence
  chemically synthesized
ttcaagatgagatttgggtg

SEQ ID NO: 21255 - DNA, 20 bp, Artificial Sequence
  chemically synthesized
atgagatttgggtggggaca

SEQ ID NO: 21256 - DNA, 20 bp, Artificial Sequence
  chemically synthesized
atttgggtggggacacagtc

SEQ ID NO: 21257 - DNA, 20 bp, Artificial Sequence
  chemically synthesized
gggacacagtcaagctgtat

SEQ ID NO: 21258 - DNA, 20 bp, Artificial Sequence
  chemically synthesized
ggacacagtcaagctgtatc

SEQ ID NO: 21259 - DNA, 20 bp, Artificial Sequence
  chemically synthesized
gacacagtcaagctgtatca

SEQ ID NO: 21260 - DNA, 20 bp, Artificial Sequence
  chemically synthesized
gtcaagctgtatcagggtac

SEQ ID NO: 21261 - DNA, 20 bp, Artificial Sequence
  chemically synthesized
gctgtatcagggtacaagct

SEQ ID NO: 21262 - DNA, 20 bp, Artificial Sequence
  chemically synthesized
ctgtatcagggtacaagctc

SEQ ID NO: 21263 - DNA, 20 bp, Artificial Sequence
  chemically synthesized
ccttacatatgtatgttgca

SEQ ID NO: 21264 - DNA, 20 bp, Artificial Sequence
  chemically synthesized
tacatatgtatgttgcatag

SEQ ID NO: 21265 - DNA, 20 bp, Artificial Sequence
  chemically synthesized
atgtatgttgcatagtggtg

SEQ ID NO: 21266 - DNA, 20 bp, Artificial Sequence
  chemically synthesized
gttgcatagtggtgaagtct

SEQ ID NO: 21267 - DNA, 20 bp, Artificial Sequence
  chemically synthesized
agtggtgaagtctgagcttt

SEQ ID NO: 21268 - DNA, 20 bp, Artificial Sequence
  chemically synthesized
ggtgaagtctgagcttttag

SEQ ID NO: 21269 - DNA, 20 bp, Artificial Sequence
  chemically synthesized
ttagtggaccatcacctgaa

SEQ ID NO: 21270 - DNA, 20 bp, Artificial Sequence
  chemically synthesized
tgaatgttgtatccaatccg

SEQ ID NO: 21271 - DNA, 20 bp, Artificial Sequence
  chemically synthesized
gtatccaatccgtagttttt

SEQ ID NO: 21272 - DNA, 20 bp, Artificial Sequence
  chemically synthesized
cctatcctcccacctttctc

SEQ ID NO: 21273 - DNA, 20 bp, Artificial Sequence
  chemically synthesized
tcccacctttctctagtctc

SEQ ID NO: 21274 - DNA, 20 bp, Artificial Sequence
  chemically synthesized
gtctatgcttactcatcgtt

SEQ ID NO: 21275 - DNA, 20 bp, Artificial Sequence
  chemically synthesized
ctcatcgtttagctcccact

SEQ ID NO: 21276 - DNA, 20 bp, Artificial Sequence
  chemically synthesized
ccacttggctctcactaaat

SEQ ID NO: 21277 - DNA, 20 bp, Artificial Sequence
  chemically synthesized
gtgtttgactttctgtttct

SEQ ID NO: 21278 - DNA, 20 bp, Artificial Sequence
  chemically synthesized
tgtttctgagttatttcact

SEQ ID NO: 21279 - DNA, 20 bp, Artificial Sequence
  chemically synthesized
gtttctgagttatttcactg

SEQ ID NO: 21280 - DNA, 20 bp, Artificial Sequence
  chemically synthesized
tcactgaggataatgtcctc

SEQ ID NO: 21281 - DNA, 20 bp, Artificial Sequence
  chemically synthesized
tccagttctaaccatgtttc

SEQ ID NO: 21282 - DNA, 20 bp, Artificial Sequence
  chemically synthesized
cagttctaaccatgtttcta

SEQ ID NO: 21283 - DNA, 20 bp, Artificial Sequence
  chemically synthesized
ttctaaccatgtttctagag

SEQ ID NO: 21284 - DNA, 20 bp, Artificial Sequence
  chemically synthesized
catgatttcattctttttta

SEQ ID NO: 21285 - DNA, 20 bp, Artificial Sequence
  chemically synthesized
tttcattcttttttatggct

SEQ ID NO: 21286 - DNA, 20 bp, Artificial Sequence
  chemically synthesized
ttctttatccaatcgtccat

SEQ ID NO: 21287 - DNA, 20 bp, Artificial Sequence
  chemically synthesized
tttatccaatcgtccattgg

SEQ ID NO: 21288 - DNA, 20 bp, Artificial Sequence
  chemically synthesized
atcgtccattggtagacatt

SEQ ID NO: 21289 - DNA, 20 bp, Artificial Sequence
  chemically synthesized
tcgtccattggtagacattt

SEQ ID NO: 21290 - DNA, 20 bp, Artificial Sequence
  chemically synthesized
tgattccatatctttgctat

SEQ ID NO: 21291 - DNA, 20 bp, Artificial Sequence
  chemically synthesized
gattccatatctttgctatt

SEQ ID NO: 21292 - DNA, 20 bp, Artificial Sequence
  chemically synthesized
catatctttgctattgggaa

SEQ ID NO: 21293 - DNA, 20 bp, Artificial Sequence
  chemically synthesized
ctactttgaacatactaatg

SEQ ID NO: 21294 - DNA, 20 bp, Artificial Sequence
  chemically synthesized
taatatgatctctttcactt

SEQ ID NO: 21295 - DNA, 20 bp, Artificial Sequence
  chemically synthesized
aatatgatctctttcacttt

SEQ ID NO: 21296 - DNA, 20 bp, Artificial Sequence
  chemically synthesized
tttcactttgggtccatacc

SEQ ID NO: 21297 - DNA, 20 bp, Artificial Sequence
  chemically synthesized
cactttgggtccatacccag

SEQ ID NO: 21298 - DNA, 20 bp, Artificial Sequence
  chemically synthesized
tttgggtccatacccagtag

SEQ ID NO: 21299 - DNA, 20 bp, Artificial Sequence
  chemically synthesized
ttgggtccatacccagtagt

SEQ ID NO: 21300 - DNA, 20 bp, Artificial Sequence
  chemically synthesized
catacccagtagtgggattg

SEQ ID NO: 21301 - DNA, 20 bp, Artificial Sequence
  chemically synthesized
atacccagtagtgggattgc

SEQ ID NO: 21302 - DNA, 20 bp, Artificial Sequence
  chemically synthesized
agtgggattgcaggattgaa

SEQ ID NO: 21303 - DNA, 20 bp, Artificial Sequence
  chemically synthesized
gggattgcaggattgaatgg

SEQ ID NO: 21304 - DNA, 20 bp, Artificial Sequence
  chemically synthesized
ttgaatggtagttctgtttc

SEQ ID NO: 21305 - DNA, 20 bp, Artificial Sequence
  chemically synthesized
agttctgtttctagttcttt

SEQ ID NO: 21306 - DNA, 20 bp, Artificial Sequence
  chemically synthesized
tcttcatgctgtcttccata

SEQ ID NO: 21307 - DNA, 20 bp, Artificial Sequence
  chemically synthesized
ctaatttacattcttaccaa

SEQ ID NO: 21308 - DNA, 20 bp, Artificial Sequence
  chemically synthesized
cattcttaccaacagtgtat

SEQ ID NO: 21309 - DNA, 20 bp, Artificial Sequence
  chemically synthesized
gtttttgaactttataatga

SEQ ID NO: 21310 - DNA, 20 bp, Artificial Sequence
  chemically synthesized
ataatgatagccattctgac

SEQ ID NO: 21311 - DNA, 20 bp, Artificial Sequence
  chemically synthesized
atagccattctgactggcat

SEQ ID NO: 21312 - DNA, 20 bp, Artificial Sequence
  chemically synthesized
tagccattctgactggcata

SEQ ID NO: 21313 - DNA, 20 bp, Artificial Sequence
  chemically synthesized
gccattctgactggcataag

SEQ ID NO: 21314 - DNA, 20 bp, Artificial Sequence
  chemically synthesized
ccattctgactggcataagg

SEQ ID NO: 21315 - DNA, 20 bp, Artificial Sequence
  chemically synthesized
tggcataaggaggtatcata

SEQ ID NO: 21316 - DNA, 20 bp, Artificial Sequence
  chemically synthesized
cataaggaggtatcatatgg

SEQ ID NO: 21317 - DNA, 20 bp, Artificial Sequence
  chemically synthesized
aatttgcattctctgattat

SEQ ID NO: 21318 - DNA, 20 bp, Artificial Sequence
  chemically synthesized
aacttttttttgacgtttat

SEQ ID NO: 21319 - DNA, 20 bp, Artificial Sequence
  chemically synthesized
gccacttgtatgtcttcttt

SEQ ID NO: 21320 - DNA, 20 bp, Artificial Sequence
  chemically synthesized
tcttttggaaaatgtctgct

SEQ ID NO: 21321 - DNA, 20 bp, Artificial Sequence
  chemically synthesized
cttttggaaaatgtctgctc

SEQ ID NO: 21322 - DNA, 20 bp, Artificial Sequence
  chemically synthesized
aaaatgtctgctcaggacct

SEQ ID NO: 21323 - DNA, 20 bp, Artificial Sequence
  chemically synthesized
cctgagctcactgtatttgt

SEQ ID NO: 21324 - DNA, 20 bp, Artificial Sequence
  chemically synthesized
ctgagctcactgtatttgtc

SEQ ID NO: 21325 - DNA, 20 bp, Artificial Sequence
  chemically synthesized
tgagctcactgtatttgtca

SEQ ID NO: 21326 - DNA, 20 bp, Artificial Sequence
  chemically synthesized
ctgtatttgtcagggttccc

SEQ ID NO: 21327 - DNA, 20 bp, Artificial Sequence
  chemically synthesized
gtatttgtcagggttcccta

SEQ ID NO: 21328 - DNA, 20 bp, Artificial Sequence
  chemically synthesized
atttgtcagggttccctaga

SEQ ID NO: 21329 - DNA, 20 bp, Artificial Sequence
  chemically synthesized
gtcagggttccctagagaga

SEQ ID NO: 21330 - DNA, 20 bp, Artificial Sequence
  chemically synthesized
ccctagagagacagaactaa

SEQ ID NO: 21331 - DNA, 20 bp, Artificial Sequence
  chemically synthesized
cctagagagacagaactaat

SEQ ID NO: 21332 - DNA, 20 bp, Artificial Sequence
  chemically synthesized
tagagagacagaactaatag

SEQ ID NO: 21333 - DNA, 20 bp, Artificial Sequence
  chemically synthesized
gagacagaactaataggaga

SEQ ID NO: 21334 - DNA, 20 bp, Artificial Sequence
  chemically synthesized
cagaactaataggagataga

SEQ ID NO: 21335 - DNA, 20 bp, Artificial Sequence
  chemically synthesized
actaataggagatagataga

SEQ ID NO: 21336 - DNA, 20 bp, Artificial Sequence
  chemically synthesized
ataggagatagatagataga

SEQ ID NO: 21337 - DNA, 20 bp, Artificial Sequence
  chemically synthesized
gagatagatagatagataga

SEQ ID NO: 21338 - DNA, 20 bp, Artificial Sequence
  chemically synthesized
tagatagatagatagataga

SEQ ID NO: 21339 - DNA, 20 bp, Artificial Sequence
  chemically synthesized
tagatagatagatagataga

SEQ ID NO: 21340 - DNA, 20 bp, Artificial Sequence
  chemically synthesized
tagatagatagatagataga

SEQ ID NO: 21341 - DNA, 20 bp, Artificial Sequence
  chemically synthesized
tagatagatagatagataga

SEQ ID NO: 21342 - DNA, 20 bp, Artificial Sequence
  chemically synthesized
tagatagatagatagataga

SEQ ID NO: 21343 - DNA, 20 bp, Artificial Sequence
  chemically synthesized
gatagatagatagatagata

SEQ ID NO: 21344 - DNA, 20 bp, Artificial Sequence
  chemically synthesized
tagatagatagatatagatt

SEQ ID NO: 21345 - DNA, 20 bp, Artificial Sequence
  chemically synthesized
agatatagatttagatataa

SEQ ID NO: 21346 - DNA, 20 bp, Artificial Sequence
  chemically synthesized
gatatagatttagatataaa

SEQ ID NO: 21347 - DNA, 20 bp, Artificial Sequence
  chemically synthesized
atatagatttagatataaaa

SEQ ID NO: 21348 - DNA, 20 bp, Artificial Sequence
  chemically synthesized
atagatttagatataaaagg

SEQ ID NO: 21349 - DNA, 20 bp, Artificial Sequence
  chemically synthesized
gatataaaagggagtttatt

SEQ ID NO: 21350 - DNA, 20 bp, Artificial Sequence
  chemically synthesized
ataaaagggagtttattaag

SEQ ID NO: 21351 - DNA, 20 bp, Artificial Sequence
  chemically synthesized
gtgttaacttacacaatcac

SEQ ID NO: 21352 - DNA, 20 bp, Artificial Sequence
  chemically synthesized
tgttaacttacacaatcaca

SEQ ID NO: 21353 - DNA, 20 bp, Artificial Sequence
  chemically synthesized
acaatcacaaggtcccacaa

SEQ ID NO: 21354 - DNA, 20 bp, Artificial Sequence
  chemically synthesized
caatcacaaggtcccacaat

SEQ ID NO: 21355 - DNA, 20 bp, Artificial Sequence
  chemically synthesized
tcccacaataggccatctgc

SEQ ID NO: 21356 - DNA, 20 bp, Artificial Sequence
  chemically synthesized
cacaataggccatctgcaag

SEQ ID NO: 21357 - DNA, 20 bp, Artificial Sequence
  chemically synthesized
caataggccatctgcaagca

SEQ ID NO: 21358 - DNA, 20 bp, Artificial Sequence
  chemically synthesized
aataggccatctgcaagcag

SEQ ID NO: 21359 - DNA, 20 bp, Artificial Sequence
  chemically synthesized
taggccatctgcaagcagag

SEQ ID NO: 21360 - DNA, 20 bp, Artificial Sequence
  chemically synthesized
ccatctgcaagcagaggagc

SEQ ID NO: 21361 - DNA, 20 bp, Artificial Sequence
  chemically synthesized
catctgcaagcagaggagca

SEQ ID NO: 21362 - DNA, 20 bp, Artificial Sequence
  chemically synthesized
ctgcaagcagaggagcaagg

SEQ ID NO: 21363 - DNA, 20 bp, Artificial Sequence
  chemically synthesized
aagcagaggagcaaggaagc

SEQ ID NO: 21364 - DNA, 20 bp, Artificial Sequence
  chemically synthesized
aggagcaaggaagccagtcc

SEQ ID NO: 21365 - DNA, 20 bp, Artificial Sequence
  chemically synthesized
ggaagccagtccaagtccca

SEQ ID NO: 21366 - DNA, 20 bp, Artificial Sequence
  chemically synthesized
cagtccaagtcccaaagctg

SEQ ID NO: 21367 - DNA, 20 bp, Artificial Sequence
  chemically synthesized
agtccaagtcccaaagctga

SEQ ID NO: 21368 - DNA, 20 bp, Artificial Sequence
  chemically synthesized
agtcccaaagctgaaggact

SEQ ID NO: 21369 - DNA, 20 bp, Artificial Sequence
  chemically synthesized
tcccaaagctgaaggacttg

SEQ ID NO: 21370 - DNA, 20 bp, Artificial Sequence
  chemically synthesized
ggacttggagtccaatgttt

SEQ ID NO: 21371 - DNA, 20 bp, Artificial Sequence
  chemically synthesized
gacttggagtccaatgtttg

SEQ ID NO: 21372 - DNA, 20 bp, Artificial Sequence
  chemically synthesized
acttggagtccaatgtttga

SEQ ID NO: 21373 - DNA, 20 bp, Artificial Sequence
  chemically synthesized
tggagtccaatgtttgaggg

SEQ ID NO: 21374 - DNA, 20 bp, Artificial Sequence
  chemically synthesized
ggagtccaatgtttgagggc

SEQ ID NO: 21375 - DNA, 20 bp, Artificial Sequence
  chemically synthesized
gtccaatgtttgagggcagg

SEQ ID NO: 21376 - DNA, 20 bp, Artificial Sequence
  chemically synthesized
gtttgagggcaggaagcatc

SEQ ID NO: 21377 - DNA, 20 bp, Artificial Sequence
  chemically synthesized
agggcaggaagcatccagca

SEQ ID NO: 21378 - DNA, 20 bp, Artificial Sequence
  chemically synthesized
gggcaggaagcatccagcat

SEQ ID NO: 21379 - DNA, 20 bp, Artificial Sequence
  chemically synthesized
gcaggaagcatccagcatgg

SEQ ID NO: 21380 - DNA, 20 bp, Artificial Sequence
  chemically synthesized
gaagcatccagcatgggaga

SEQ ID NO: 21381 - DNA, 20 bp, Artificial Sequence
  chemically synthesized
tccagcatgggagaaagatg

SEQ ID NO: 21382 - DNA, 20 bp, Artificial Sequence
  chemically synthesized
ccagcatgggagaaagatgt

SEQ ID NO: 21383 - DNA, 20 bp, Artificial Sequence
  chemically synthesized
atgggagaaagatgtaggct

SEQ ID NO: 21384 - DNA, 20 bp, Artificial Sequence
  chemically synthesized
gggagaaagatgtaggcttg

SEQ ID NO: 21385 - DNA, 20 bp, Artificial Sequence
  chemically synthesized
ggagaaagatgtaggcttgg

SEQ ID NO: 21386 - DNA, 20 bp, Artificial Sequence
  chemically synthesized
aagatgtaggcttggaggct

SEQ ID NO: 21387 - DNA, 20 bp, Artificial Sequence
  chemically synthesized
tgtaggcttggaggctaagc

SEQ ID NO: 21388 - DNA, 20 bp, Artificial Sequence
  chemically synthesized
gcttggaggctaagccagtc

SEQ ID NO: 21389 - DNA, 20 bp, Artificial Sequence
  chemically synthesized
cttggaggctaagccagtcc

SEQ ID NO: 21390 - DNA, 20 bp, Artificial Sequence
  chemically synthesized
tttctgcctgctttatatcc

SEQ ID NO: 21391 - DNA, 20 bp, Artificial Sequence
  chemically synthesized
gctttatatcctggccacac

SEQ ID NO: 21392 - DNA, 20 bp, Artificial Sequence
  chemically synthesized
tggccacactggcaactgat

SEQ ID NO: 21393 - DNA, 20 bp, Artificial Sequence
  chemically synthesized
cacactggcaactgattaga

SEQ ID NO: 21394 - DNA, 20 bp, Artificial Sequence
  chemically synthesized
ctgattagatggtgcccacc

SEQ ID NO: 21395 - DNA, 20 bp, Artificial Sequence
  chemically synthesized
agatggtgcccacccagatt

SEQ ID NO: 21396 - DNA, 20 bp, Artificial Sequence
  chemically synthesized
gatggtgcccacccagatta

SEQ ID NO: 21397 - DNA, 20 bp, Artificial Sequence
  chemically synthesized
atggtgcccacccagattaa

SEQ ID NO: 21398 - DNA, 20 bp, Artificial Sequence
  chemically synthesized
gtgcccacccagattaaggg

SEQ ID NO: 21399 - DNA, 20 bp, Artificial Sequence
  chemically synthesized
tgcccacccagattaagggt

SEQ ID NO: 21400 - DNA, 20 bp, Artificial Sequence
  chemically synthesized
aagggtgggtctgcctttcc

SEQ ID NO: 21401 - DNA, 20 bp, Artificial Sequence
  chemically synthesized
actaaaatgttaatctcctt

SEQ ID NO: 21402 - DNA, 20 bp, Artificial Sequence
  chemically synthesized
ctcctttggcaataccctca

SEQ ID NO: 21403 - DNA, 20 bp, Artificial Sequence
  chemically synthesized
aataccctcacagacacact

SEQ ID NO: 21404 - DNA, 20 bp, Artificial Sequence
  chemically synthesized
ataccctcacagacacactc

SEQ ID NO: 21405 - DNA, 20 bp, Artificial Sequence
  chemically synthesized
ttgcacacttcaatccaatc

SEQ ID NO: 21406 - DNA, 20 bp, Artificial Sequence
  chemically synthesized
aatccaatcaagttgacact

SEQ ID NO: 21407 - DNA, 20 bp, Artificial Sequence
  chemically synthesized
cactcagtattaaccatcac

SEQ ID NO: 21408 - DNA, 20 bp, Artificial Sequence
  chemically synthesized
agtccatcgcttgtcaactt

SEQ ID NO: 21409 - DNA, 20 bp, Artificial Sequence
  chemically synthesized
tgagcctatacacatcccct

SEQ ID NO: 21410 - DNA, 20 bp, Artificial Sequence
  chemically synthesized
gagcctatacacatcccctg

SEQ ID NO: 21411 - DNA, 20 bp, Artificial Sequence
  chemically synthesized
tcatacattatcttcaaata

SEQ ID NO: 21412 - DNA, 20 bp, Artificial Sequence
  chemically synthesized
cttcaaataaagacaacaat

SEQ ID NO: 21413 - DNA, 20 bp, Artificial Sequence
  chemically synthesized
aatacttaaatgctgatatg

SEQ ID NO: 21414 - DNA, 20 bp, Artificial Sequence
  chemically synthesized
aaatcttatgtcacatgata

SEQ ID NO: 21415 - DNA, 20 bp, Artificial Sequence
  chemically synthesized
aatcttatgtcacatgataa

SEQ ID NO: 21416 - DNA, 20 bp, Artificial Sequence
  chemically synthesized
atgtcacatgataaaggaaa

SEQ ID NO: 21417 - DNA, 20 bp, Artificial Sequence
  chemically synthesized
tgtcacatgataaaggaaaa

SEQ ID NO: 21418 - DNA, 20 bp, Artificial Sequence
  chemically synthesized
cacatgataaaggaaaaagg

SEQ ID NO: 21419 - DNA, 20 bp, Artificial Sequence
  chemically synthesized
gtaaaatgtatatattttct

SEQ ID NO: 21420 - DNA, 20 bp, Artificial Sequence
  chemically synthesized
tgtatatattttcttagtac

SEQ ID NO: 21421 - DNA, 20 bp, Artificial Sequence
  chemically synthesized
tttcttagtacaagtgtata

SEQ ID NO: 21422 - DNA, 20 bp, Artificial Sequence
  chemically synthesized
tacaagtgtatacagacacg

SEQ ID NO: 21423 - DNA, 20 bp, Artificial Sequence
  chemically synthesized
acaagtgtatacagacacga

SEQ ID NO: 21424 - DNA, 20 bp, Artificial Sequence
  chemically synthesized
cacgaaggtgtttttaacaa

SEQ ID NO: 21425 - DNA, 20 bp, Artificial Sequence
  chemically synthesized
gaaggtgtttttaacaaaag

SEQ ID NO: 21426 - DNA, 20 bp, Artificial Sequence
  chemically synthesized
aaggtgtttttaacaaaaga

SEQ ID NO: 21427 - DNA, 20 bp, Artificial Sequence
  chemically synthesized
ggtgtttttaacaaaagaag

SEQ ID NO: 21428 - DNA, 20 bp, Artificial Sequence
  chemically synthesized
gtgtttttaacaaaagaagg

SEQ ID NO: 21429 - DNA, 20 bp, Artificial Sequence
  chemically synthesized
ggaaatactcatgacaatta

SEQ ID NO: 21430 - DNA, 20 bp, Artificial Sequence
  chemically synthesized
acagtccttgtatctgcaat

SEQ ID NO: 21431 - DNA, 20 bp, Artificial Sequence
  chemically synthesized
tgcaattggtcacgtgatcg

SEQ ID NO: 21432 - DNA, 20 bp, Artificial Sequence
  chemically synthesized
attggtcacgtgatcgtagc

SEQ ID NO: 21433 - DNA, 20 bp, Artificial Sequence
  chemically synthesized
ttctgtattccctttgccct

SEQ ID NO: 21434 - DNA, 20 bp, Artificial Sequence
  chemically synthesized
gtattccctttgccctcagc

SEQ ID NO: 21435 - DNA, 20 bp, Artificial Sequence
  chemically synthesized
tttgccctcagcaagcacct

SEQ ID NO: 21436 - DNA, 20 bp, Artificial Sequence
  chemically synthesized
gccctcagcaagcacctcag

SEQ ID NO: 21437 - DNA, 20 bp, Artificial Sequence
  chemically synthesized
ccctcagcaagcacctcagc

SEQ ID NO: 21438 - DNA, 20 bp, Artificial Sequence
  chemically synthesized
ttttttttttttttttttcc

SEQ ID NO: 21439 - DNA, 20 bp, Artificial Sequence
  chemically synthesized
tttttttttttttttcctgg

SEQ ID NO: 21440 - DNA, 20 bp, Artificial Sequence
  chemically synthesized
tttttttttttttcctggtg

SEQ ID NO: 21441 - DNA, 20 bp, Artificial Sequence
  chemically synthesized
gtgacccaaacctttatttg

SEQ ID NO: 21442 - DNA, 20 bp, Artificial Sequence
  chemically synthesized
cctttatttgtagtcctgcc

SEQ ID NO: 21443 - DNA, 20 bp, Artificial Sequence
  chemically synthesized
atttgtagtcctgcctggaa

SEQ ID NO: 21444 - DNA, 20 bp, Artificial Sequence
  chemically synthesized
gtcctgcctggaatggcctg

SEQ ID NO: 21445 - DNA, 20 bp, Artificial Sequence
  chemically synthesized
ctgcctggaatggcctgtag

SEQ ID NO: 21446 - DNA, 20 bp, Artificial Sequence
  chemically synthesized
tttcccactgaccttaattc

SEQ ID NO: 21447 - DNA, 20 bp, Artificial Sequence
  chemically synthesized
ttcccactgaccttaattcc

SEQ ID NO: 21448 - DNA, 20 bp, Artificial Sequence
  chemically synthesized
ctgaccttaattccaggaca

SEQ ID NO: 21449 - DNA, 20 bp, Artificial Sequence
  chemically synthesized
ttccaggacatggtaaaact

SEQ ID NO: 21450 - DNA, 20 bp, Artificial Sequence
  chemically synthesized
ccaggacatggtaaaactaa

SEQ ID NO: 21451 - DNA, 20 bp, Artificial Sequence
  chemically synthesized
aaaactaagagacaccctaa

SEQ ID NO: 21452 - DNA, 20 bp, Artificial Sequence
  chemically synthesized
acgcttccttacctccattg

SEQ ID NO: 21453 - DNA, 20 bp, Artificial Sequence
  chemically synthesized
gcttccttacctccattgtg

SEQ ID NO: 21454 - DNA, 20 bp, Artificial Sequence
  chemically synthesized
ttacctccattgtggagttg

SEQ ID NO: 21455 - DNA, 20 bp, Artificial Sequence
  chemically synthesized
gtagactgatttcatcttga

SEQ ID NO: 21456 - DNA, 20 bp, Artificial Sequence
  chemically synthesized
ctgatttcatcttgatagtc

SEQ ID NO: 21457 - DNA, 20 bp, Artificial Sequence
  chemically synthesized
tgatttcatcttgatagtct

SEQ ID NO: 21458 - DNA, 20 bp, Artificial Sequence
  chemically synthesized
atagtctgggttaatcaccg

SEQ ID NO: 21459 - DNA, 20 bp, Artificial Sequence
  chemically synthesized
caacactgtaactctcttct

SEQ ID NO: 21460 - DNA, 20 bp, Artificial Sequence
  chemically synthesized
cttcttagcctgttgactta

SEQ ID NO: 21461 - DNA, 20 bp, Artificial Sequence
  chemically synthesized
ttcttagcctgttgacttaa

SEQ ID NO: 21462 - DNA, 20 bp, Artificial Sequence
  chemically synthesized
ttagcctgttgacttaaagg

SEQ ID NO: 21463 - DNA, 20 bp, Artificial Sequence
  chemically synthesized
tagcctgttgacttaaaggt

SEQ ID NO: 21464 - DNA, 20 bp, Artificial Sequence
  chemically synthesized
gcctgttgacttaaaggtgg

SEQ ID NO: 21465 - DNA, 20 bp, Artificial Sequence
  chemically synthesized
cctgttgacttaaaggtggg

SEQ ID NO: 21466 - DNA, 20 bp, Artificial Sequence
  chemically synthesized
tgttgacttaaaggtgggag

SEQ ID NO: 21467 - DNA, 20 bp, Artificial Sequence
  chemically synthesized
ttaaaggtgggaggagccca

SEQ ID NO: 21468 - DNA, 20 bp, Artificial Sequence
  chemically synthesized
tgggaggagcccaaagtgtc

SEQ ID NO: 21469 - DNA, 20 bp, Artificial Sequence
  chemically synthesized
gggaggagcccaaagtgtcc

SEQ ID NO: 21470 - DNA, 20 bp, Artificial Sequence
  chemically synthesized
aggagcccaaagtgtccagg

SEQ ID NO: 21471 - DNA, 20 bp, Artificial Sequence
  chemically synthesized
caggtggcaatcttaatttg

SEQ ID NO: 21472 - DNA, 20 bp, Artificial Sequence
  chemically synthesized
aatcttaatttgcagtttaa

SEQ ID NO: 21473 - DNA, 20 bp, Artificial Sequence
  chemically synthesized
ggaatcattattgtgtcacc

SEQ ID NO: 21474 - DNA, 20 bp, Artificial Sequence
  chemically synthesized
atcattattgtgtcacctgg

SEQ ID NO: 21475 - DNA, 20 bp, Artificial Sequence
  chemically synthesized
attattgtgtcacctggcgg

SEQ ID NO: 21476 - DNA, 20 bp, Artificial Sequence
  chemically synthesized
ggcggcagtgttcctccctc

SEQ ID NO: 21477 - DNA, 20 bp, Artificial Sequence
  chemically synthesized
gtgttcctccctctggaact

SEQ ID NO: 21478 - DNA, 20 bp, Artificial Sequence
  chemically synthesized
cctctggaactaagacctct

SEQ ID NO: 21479 - DNA, 20 bp, Artificial Sequence
  chemically synthesized
tggaactaagacctctaagc

SEQ ID NO: 21480 - DNA, 20 bp, Artificial Sequence
  chemically synthesized
aactaagacctctaagccag

SEQ ID NO: 21481 - DNA, 20 bp, Artificial Sequence
  chemically synthesized
gccagcagaacataatgcca

SEQ ID NO: 21482 - DNA, 20 bp, Artificial Sequence
  chemically synthesized
ccagcagaacataatgccat

SEQ ID NO: 21483 - DNA, 20 bp, Artificial Sequence
  chemically synthesized
agaacataatgccatgggaa

SEQ ID NO: 21484 - DNA, 20 bp, Artificial Sequence
  chemically synthesized
gaacataatgccatgggaac

SEQ ID NO: 21485 - DNA, 20 bp, Artificial Sequence
  chemically synthesized
cataatgccatgggaacagg

SEQ ID NO: 21486 - DNA, 20 bp, Artificial Sequence
  chemically synthesized
acaggaagcaaaaattttgc

SEQ ID NO: 21487 - DNA, 20 bp, Artificial Sequence
  chemically synthesized
ggaagcaaaaattttgctag

SEQ ID NO: 21488 - DNA, 20 bp, Artificial Sequence
  chemically synthesized
aaattttgctagtggaacac

SEQ ID NO: 21489 - DNA, 20 bp, Artificial Sequence
  chemically synthesized
aattttgctagtggaacact

SEQ ID NO: 21490 - DNA, 20 bp, Artificial Sequence
  chemically synthesized
attttgctagtggaacacta

SEQ ID NO: 21491 - DNA, 20 bp, Artificial Sequence
  chemically synthesized
ttttgctagtggaacactag

SEQ ID NO: 21492 - DNA, 20 bp, Artificial Sequence
  chemically synthesized
tagtggaacactaggggtga

SEQ ID NO: 21493 - DNA, 20 bp, Artificial Sequence
  chemically synthesized
ggaacactaggggtgatggt

SEQ ID NO: 21494 - DNA, 20 bp, Artificial Sequence
  chemically synthesized
acactaggggtgatggtgag

SEQ ID NO: 21495 - DNA, 20 bp, Artificial Sequence
  chemically synthesized
cacttccaccctttgattcc

SEQ ID NO: 21496 - DNA, 20 bp, Artificial Sequence
  chemically synthesized
ggacccgtgaatcctgtcta

SEQ ID NO: 21497 - DNA, 20 bp, Artificial Sequence
  chemically synthesized
gacccgtgaatcctgtctat

SEQ ID NO: 21498 - DNA, 20 bp, Artificial Sequence
  chemically synthesized
cccgtgaatcctgtctatgg

SEQ ID NO: 21499 - DNA, 20 bp, Artificial Sequence
  chemically synthesized
aatcctgtctatgggagaaa

SEQ ID NO: 21500 - DNA, 20 bp, Artificial Sequence
  chemically synthesized
ggagaaacagtaccatatat

SEQ ID NO: 21501 - DNA, 20 bp, Artificial Sequence
  chemically synthesized
ccatatattggacactgatt

SEQ ID NO: 21502 - DNA, 20 bp, Artificial Sequence
  chemically synthesized
atatattggacactgattca

SEQ ID NO: 21503 - DNA, 20 bp, Artificial Sequence
  chemically synthesized
acactgattcagagcataca

SEQ ID NO: 21504 - DNA, 20 bp, Artificial Sequence
  chemically synthesized
tcagagcatacacagccttc

SEQ ID NO: 21505 - DNA, 20 bp, Artificial Sequence
  chemically synthesized
agagcatacacagccttctg

SEQ ID NO: 21506 - DNA, 20 bp, Artificial Sequence
  chemically synthesized
ccttctggagaactttgccc

SEQ ID NO: 21507 - DNA, 20 bp, Artificial Sequence
  chemically synthesized
cttctggagaactttgcccc

SEQ ID NO: 21508 - DNA, 20 bp, Artificial Sequence
  chemically synthesized
aactttgccccaggcctgca

SEQ ID NO: 21509 - DNA, 20 bp, Artificial Sequence
  chemically synthesized
gcctgcaaagtattgtcacc

SEQ ID NO: 21510 - DNA, 20 bp, Artificial Sequence
  chemically synthesized
gcaaagtattgtcacctagt

SEQ ID NO: 21511 - DNA, 20 bp, Artificial Sequence
  chemically synthesized
cattgtaatcgtgacttcaa

SEQ ID NO: 21512 - DNA, 20 bp, Artificial Sequence
  chemically synthesized
attgtaatcgtgacttcaaa

SEQ ID NO: 21513 - DNA, 20 bp, Artificial Sequence
  chemically synthesized
gacttcaaaaggccattcaa

SEQ ID NO: 21514 - DNA, 20 bp, Artificial Sequence
  chemically synthesized
aggccattcaaaagctgctt

SEQ ID NO: 21515 - DNA, 20 bp, Artificial Sequence
  chemically synthesized
ggccattcaaaagctgcttc

SEQ ID NO: 21516 - DNA, 20 bp, Artificial Sequence
  chemically synthesized
caaaagctgcttcaggatga

SEQ ID NO: 21517 - DNA, 20 bp, Artificial Sequence
  chemically synthesized
aaaagctgcttcaggatgat

SEQ ID NO: 21518 - DNA, 20 bp, Artificial Sequence
  chemically synthesized
aaagctgcttcaggatgata

SEQ ID NO: 21519 - DNA, 20 bp, Artificial Sequence
  chemically synthesized
cttcaggatgatagggatca

SEQ ID NO: 21520 - DNA, 20 bp, Artificial Sequence
  chemically synthesized
aggatgatagggatcatggt

SEQ ID NO: 21521 - DNA, 20 bp, Artificial Sequence
  chemically synthesized
gatagggatcatggtaagac

SEQ ID NO: 21522 - DNA, 20 bp, Artificial Sequence
  chemically synthesized
gtaagaccagtaaattccat

SEQ ID NO: 21523 - DNA, 20 bp, Artificial Sequence
  chemically synthesized
ccagtaaattccatgagcat

SEQ ID NO: 21524 - DNA, 20 bp, Artificial Sequence
  chemically synthesized
agcccactgtcacacttctt

SEQ ID NO: 21525 - DNA, 20 bp, Artificial Sequence
  chemically synthesized
gtcacacttctttagccata

SEQ ID NO: 21526 - DNA, 20 bp, Artificial Sequence
  chemically synthesized
cacttctttagccataaagt

SEQ ID NO: 21527 - DNA, 20 bp, Artificial Sequence
  chemically synthesized
ttctttagccataaagtgag

SEQ ID NO: 21528 - DNA, 20 bp, Artificial Sequence
  chemically synthesized
tagccataaagtgagtggct

SEQ ID NO: 21529 - DNA, 20 bp, Artificial Sequence
  chemically synthesized
cataaagtgagtggcttggt

SEQ ID NO: 21530 - DNA, 20 bp, Artificial Sequence
  chemically synthesized
aaagtgagtggcttggtcag

SEQ ID NO: 21531 - DNA, 20 bp, Artificial Sequence
  chemically synthesized
tggtcagaagcaatgctgtg

SEQ ID NO: 21532 - DNA, 20 bp, Artificial Sequence
  chemically synthesized
tgctgtgtggaataccatga

SEQ ID NO: 21533 - DNA, 20 bp, Artificial Sequence
  chemically synthesized
tgtgtggaataccatgacag

SEQ ID NO: 21534 - DNA, 20 bp, Artificial Sequence
  chemically synthesized
gaataccatgacagtggata

SEQ ID NO: 21535 - DNA, 20 bp, Artificial Sequence
  chemically synthesized
tacggcattctgtgattcca

SEQ ID NO: 21536 - DNA, 20 bp, Artificial Sequence
  chemically synthesized
gcattctgtgattccatgga

SEQ ID NO: 21537 - DNA, 20 bp, Artificial Sequence
  chemically synthesized
ttctgtgattccatggatgg

SEQ ID NO: 21538 - DNA, 20 bp, Artificial Sequence
  chemically synthesized
gattccatggatggtagtct

SEQ ID NO: 21539 - DNA, 20 bp, Artificial Sequence
  chemically synthesized
atggatggtagtcttggcat

SEQ ID NO: 21540 - DNA, 20 bp, Artificial Sequence
  chemically synthesized
gtagtcttggcataagcatt

SEQ ID NO: 21541 - DNA, 20 bp, Artificial Sequence
  chemically synthesized
cttggcataagcattgagtt

SEQ ID NO: 21542 - DNA, 20 bp, Artificial Sequence
  chemically synthesized
ttggcataagcattgagttc

SEQ ID NO: 21543 - DNA, 20 bp, Artificial Sequence
  chemically synthesized
ataagcattgagttcaggat

SEQ ID NO: 21544 - DNA, 20 bp, Artificial Sequence
  chemically synthesized
taagcattgagttcaggatt

SEQ ID NO: 21545 - DNA, 20 bp, Artificial Sequence
  chemically synthesized
aggattgggaaacccatatc

SEQ ID NO: 21546 - DNA, 20 bp, Artificial Sequence
  chemically synthesized
gattgggaaacccatatcca

SEQ ID NO: 21547 - DNA, 20 bp, Artificial Sequence
  chemically synthesized
gggaaacccatatccagagt

SEQ ID NO: 21548 - DNA, 20 bp, Artificial Sequence
  chemically synthesized
tccagagtaagtgtctattc

SEQ ID NO: 21549 - DNA, 20 bp, Artificial Sequence
  chemically synthesized
gagtaagtgtctattccagt

SEQ ID NO: 21550 - DNA, 20 bp, Artificial Sequence
  chemically synthesized
agtaagtgtctattccagtg

SEQ ID NO: 21551 - DNA, 20 bp, Artificial Sequence
  chemically synthesized
gtgtctattccagtgaggac

SEQ ID NO: 21552 - DNA, 20 bp, Artificial Sequence
  chemically synthesized
agcctctgccctttccatga

SEQ ID NO: 21553 - DNA, 20 bp, Artificial Sequence
  chemically synthesized
ctctgccctttccatgatgg

SEQ ID NO: 21554 - DNA, 20 bp, Artificial Sequence
  chemically synthesized
ctgccctttccatgatggaa

SEQ ID NO: 21555 - DNA, 20 bp, Artificial Sequence
  chemically synthesized
tgccctttccatgatggaag

SEQ ID NO: 21556 - DNA, 20 bp, Artificial Sequence
  chemically synthesized
caatataatcaacctgccac

SEQ ID NO: 21557 - DNA, 20 bp, Artificial Sequence
  chemically synthesized
aatataatcaacctgccacc

SEQ ID NO: 21558 - DNA, 20 bp, Artificial Sequence
  chemically synthesized
ataatcaacctgccaccagg

SEQ ID NO: 21559 - DNA, 20 bp, Artificial Sequence
  chemically synthesized
tcaacctgccaccaggtagc

SEQ ID NO: 21560 - DNA, 20 bp, Artificial Sequence
  chemically synthesized
ggtagctggctgatcacccc

SEQ ID NO: 21561 - DNA, 20 bp, Artificial Sequence
  chemically synthesized
gtagctggctgatcaccccg

SEQ ID NO: 21562 - DNA, 20 bp, Artificial Sequence
  chemically synthesized
tggctgatcaccccgaggaa

SEQ ID NO: 21563 - DNA, 20 bp, Artificial Sequence
  chemically synthesized
ccgaggaatggtgccatatc

SEQ ID NO: 21564 - DNA, 20 bp, Artificial Sequence
  chemically synthesized
cgaggaatggtgccatatca

SEQ ID NO: 21565 - DNA, 20 bp, Artificial Sequence
  chemically synthesized
gaggaatggtgccatatcaa

SEQ ID NO: 21566 - DNA, 20 bp, Artificial Sequence
  chemically synthesized
atggtgccatatcaagggct

SEQ ID NO: 21567 - DNA, 20 bp, Artificial Sequence
  chemically synthesized
ccatatcaagggcttagtgt

SEQ ID NO: 21568 - DNA, 20 bp, Artificial Sequence
  chemically synthesized
ttagtgttggtctctgatgc

SEQ ID NO: 21569 - DNA, 20 bp, Artificial Sequence
  chemically synthesized
tgttggtctctgatgctggc

SEQ ID NO: 21570 - DNA, 20 bp, Artificial Sequence
  chemically synthesized
tggtctctgatgctggcaag

SEQ ID NO: 21571 - DNA, 20 bp, Artificial Sequence
  chemically synthesized
tctctgatgctggcaagcag

SEQ ID NO: 21572 - DNA, 20 bp, Artificial Sequence
  chemically synthesized
atgctggcaagcagtggctg

SEQ ID NO: 21573 - DNA, 20 bp, Artificial Sequence
  chemically synthesized
tggcaagcagtggctgtggc

SEQ ID NO: 21574 - DNA, 20 bp, Artificial Sequence
  chemically synthesized
ggcaagcagtggctgtggcc

SEQ ID NO: 21575 - DNA, 20 bp, Artificial Sequence
  chemically synthesized
agcagtggctgtggccaggt

SEQ ID NO: 21576 - DNA, 20 bp, Artificial Sequence
  chemically synthesized
ggctgtggccaggtcagctt

SEQ ID NO: 21577 - DNA, 20 bp, Artificial Sequence
  chemically synthesized
gtggccaggtcagctttggt

SEQ ID NO: 21578 - DNA, 20 bp, Artificial Sequence
  chemically synthesized
gccaggtcagctttggtgag

SEQ ID NO: 21579 - DNA, 20 bp, Artificial Sequence
  chemically synthesized
aggtcagctttggtgagtgg

SEQ ID NO: 21580 - DNA, 20 bp, Artificial Sequence
  chemically synthesized
gagtggaagtccatgttgct

SEQ ID NO: 21581 - DNA, 20 bp, Artificial Sequence
  chemically synthesized
aagtccatgttgctgagccc

SEQ ID NO: 21582 - DNA, 20 bp, Artificial Sequence
  chemically synthesized
aacttccatccctgcaactg

SEQ ID NO: 21583 - DNA, 20 bp, Artificial Sequence
  chemically synthesized
aactgtggccactttgttca

SEQ ID NO: 21584 - DNA, 20 bp, Artificial Sequence
  chemically synthesized
actgtggccactttgttcat

SEQ ID NO: 21585 - DNA, 20 bp, Artificial Sequence
  chemically synthesized
cactttgttcatgggtccat

SEQ ID NO: 21586 - DNA, 20 bp, Artificial Sequence
  chemically synthesized
ggtccattggacgatgacat

SEQ ID NO: 21587 - DNA, 20 bp, Artificial Sequence
  chemically synthesized
ccattggacgatgacatgag

SEQ ID NO: 21588 - DNA, 20 bp, Artificial Sequence
  chemically synthesized
ggacgatgacatgagtggcc

SEQ ID NO: 21589 - DNA, 20 bp, Artificial Sequence
  chemically synthesized
gacgatgacatgagtggcct

SEQ ID NO: 21590 - DNA, 20 bp, Artificial Sequence
  chemically synthesized
tgacatgagtggcctgggaa

SEQ ID NO: 21591 - DNA, 20 bp, Artificial Sequence
  chemically synthesized
gacatgagtggcctgggaaa

SEQ ID NO: 21592 - DNA, 20 bp, Artificial Sequence
  chemically synthesized
gagtggcctgggaaaaggct

SEQ ID NO: 21593 - DNA, 20 bp, Artificial Sequence
  chemically synthesized
tggcctgggaaaaggctgag

SEQ ID NO: 21594 - DNA, 20 bp, Artificial Sequence
  chemically synthesized
aaaaggctgagtggtgtcca

SEQ ID NO: 21595 - DNA, 20 bp, Artificial Sequence
  chemically synthesized
tattaaaatcctcttctgct

SEQ ID NO: 21596 - DNA, 20 bp, Artificial Sequence
  chemically synthesized
attaaaatcctcttctgctg

SEQ ID NO: 21597 - DNA, 20 bp, Artificial Sequence
  chemically synthesized
cttctgctgaggtcacccat

SEQ ID NO: 21598 - DNA, 20 bp, Artificial Sequence
  chemically synthesized
tgctgaggtcacccattggt

SEQ ID NO: 21599 - DNA, 20 bp, Artificial Sequence
  chemically synthesized
cccattggtgagcactcaca

SEQ ID NO: 21600 - DNA, 20 bp, Artificial Sequence
  chemically synthesized
ccattggtgagcactcacat

SEQ ID NO: 21601 - DNA, 20 bp, Artificial Sequence
  chemically synthesized
atgggatgaaaatatctttg

SEQ ID NO: 21602 - DNA, 20 bp, Artificial Sequence
  chemically synthesized
ttgtagtttttgactaatca

SEQ ID NO: 21603 - DNA, 20 bp, Artificial Sequence
  chemically synthesized
gtagtttttgactaatcata

SEQ ID NO: 21604 - DNA, 20 bp, Artificial Sequence
  chemically synthesized
tagtttttgactaatcatag

SEQ ID NO: 21605 - DNA, 20 bp, Artificial Sequence
  chemically synthesized
tttctttgtcatcaattttc

SEQ ID NO: 21606 - DNA, 20 bp, Artificial Sequence
  chemically synthesized
tttccagtcatgctttttcc

SEQ ID NO: 21607 - DNA, 20 bp, Artificial Sequence
  chemically synthesized
tttccaagtccctgaccatc

SEQ ID NO: 21608 - DNA, 20 bp, Artificial Sequence
  chemically synthesized
tgaccatctagccaaacctt

SEQ ID NO: 21609 - DNA, 20 bp, Artificial Sequence
  chemically synthesized
tctagccaaacctttggcta

SEQ ID NO: 21610 - DNA, 20 bp, Artificial Sequence
  chemically synthesized
tttggctacagcccatgaat

SEQ ID NO: 21611 - DNA, 20 bp, Artificial Sequence
  chemically synthesized
taagtatataatcgcaaatc

SEQ ID NO: 21612 - DNA, 20 bp, Artificial Sequence
  chemically synthesized
gccatttctccttctgtgca

SEQ ID NO: 21613 - DNA, 20 bp, Artificial Sequence
  chemically synthesized
ttctgtgcaaagtgcacaac

SEQ ID NO: 21614 - DNA, 20 bp, Artificial Sequence
  chemically synthesized
tctgtgcaaagtgcacaacc

SEQ ID NO: 21615 - DNA, 20 bp, Artificial Sequence
  chemically synthesized
acaaccaggcacactgctca

SEQ ID NO: 21616 - DNA, 20 bp, Artificial Sequence
  chemically synthesized
ctgctcaaagttctgccaac

SEQ ID NO: 21617 - DNA, 20 bp, Artificial Sequence
  chemically synthesized
tgctcaaagttctgccaact

SEQ ID NO: 21618 - DNA, 20 bp, Artificial Sequence
  chemically synthesized
tcaaagttctgccaactagg

SEQ ID NO: 21619 - DNA, 20 bp, Artificial Sequence
  chemically synthesized
ttcccttcaccgttgtcctt

SEQ ID NO: 21620 - DNA, 20 bp, Artificial Sequence
  chemically synthesized
tcccttcaccgttgtccttc

SEQ ID NO: 21621 - DNA, 20 bp, Artificial Sequence
  chemically synthesized
cccttcaccgttgtccttca

SEQ ID NO: 21622 - DNA, 20 bp, Artificial Sequence
  chemically synthesized
gttgtccttcagggatgtcc

SEQ ID NO: 21623 - DNA, 20 bp, Artificial Sequence
  chemically synthesized
tccttcagggatgtcctaga

SEQ ID NO: 21624 - DNA, 20 bp, Artificial Sequence
  chemically synthesized
ccttcagggatgtcctagaa

SEQ ID NO: 21625 - DNA, 20 bp, Artificial Sequence
  chemically synthesized
cttcagggatgtcctagaaa

SEQ ID NO: 21626 - DNA, 20 bp, Artificial Sequence
  chemically synthesized
ttcagggatgtcctagaaag

SEQ ID NO: 21627 - DNA, 20 bp, Artificial Sequence
  chemically synthesized
gatgtcctagaaaggggctg

SEQ ID NO: 21628 - DNA, 20 bp, Artificial Sequence
  chemically synthesized
agaaaggggctgtagtgctg

SEQ ID NO: 21629 - DNA, 20 bp, Artificial Sequence
  chemically synthesized
gtgctgcggctgtccacttt

SEQ ID NO: 21630 - DNA, 20 bp, Artificial Sequence
  chemically synthesized
tgctgcggctgtccactttt

SEQ ID NO: 21631 - DNA, 20 bp, Artificial Sequence
  chemically synthesized
tgcggctgtccacttttggg

SEQ ID NO: 21632 - DNA, 20 bp, Artificial Sequence
  chemically synthesized
ggtggtgcctgcatatcgtg

SEQ ID NO: 21633 - DNA, 20 bp, Artificial Sequence
  chemically synthesized
gtgcagaactatctgtgaac

SEQ ID NO: 21634 - DNA, 20 bp, Artificial Sequence
  chemically synthesized
tgcagaactatctgtgaacc

SEQ ID NO: 21635 - DNA, 20 bp, Artificial Sequence
  chemically synthesized
actatctgtgaaccaggacc

SEQ ID NO: 21636 - DNA, 20 bp, Artificial Sequence
  chemically synthesized
ctagtcttctcttcctctgt

SEQ ID NO: 21637 - DNA, 20 bp, Artificial Sequence
  chemically synthesized
cttcctctgtcagctgatca

SEQ ID NO: 21638 - DNA, 20 bp, Artificial Sequence
  chemically synthesized
ttcctctgtcagctgatcat

SEQ ID NO: 21639 - DNA, 20 bp, Artificial Sequence
  chemically synthesized
tcctctgtcagctgatcata

SEQ ID NO: 21640 - DNA, 20 bp, Artificial Sequence
  chemically synthesized
gatcatagggaactccccat

SEQ ID NO: 21641 - DNA, 20 bp, Artificial Sequence
  chemically synthesized
ggaactccccatgagaccat

SEQ ID NO: 21642 - DNA, 20 bp, Artificial Sequence
  chemically synthesized
tccccatgagaccatcggtg

SEQ ID NO: 21643 - DNA, 20 bp, Artificial Sequence
  chemically synthesized
tgagaccatcggtgcagtct

SEQ ID NO: 21644 - DNA, 20 bp, Artificial Sequence
  chemically synthesized
gagaccatcggtgcagtctc

SEQ ID NO: 21645 - DNA, 20 bp, Artificial Sequence
  chemically synthesized
agaccatcggtgcagtctca

SEQ ID NO: 21646 - DNA, 20 bp, Artificial Sequence
  chemically synthesized
accatcggtgcagtctcagg

SEQ ID NO: 21647 - DNA, 20 bp, Artificial Sequence
  chemically synthesized
catcggtgcagtctcaggga

SEQ ID NO: 21648 - DNA, 20 bp, Artificial Sequence
  chemically synthesized
ggtgcagtctcagggagaga

SEQ ID NO: 21649 - DNA, 20 bp, Artificial Sequence
  chemically synthesized
gcagtctcagggagagaaag

SEQ ID NO: 21650 - DNA, 20 bp, Artificial Sequence
  chemically synthesized
agggagagaaagcagtgtgt

SEQ ID NO: 21651 - DNA, 20 bp, Artificial Sequence
  chemically synthesized
gggagagaaagcagtgtgtc

SEQ ID NO: 21652 - DNA, 20 bp, Artificial Sequence
  chemically synthesized
gagagaaagcagtgtgtcag

SEQ ID NO: 21653 - DNA, 20 bp, Artificial Sequence
  chemically synthesized
agaaagcagtgtgtcaggag

SEQ ID NO: 21654 - DNA, 20 bp, Artificial Sequence
  chemically synthesized
aaagcagtgtgtcaggagtg

SEQ ID NO: 21655 - DNA, 20 bp, Artificial Sequence
  chemically synthesized
tgtgtcaggagtggagacca

SEQ ID NO: 21656 - DNA, 20 bp, Artificial Sequence
  chemically synthesized
gtgtcaggagtggagaccat

SEQ ID NO: 21657 - DNA, 20 bp, Artificial Sequence
  chemically synthesized
agtggagaccatgggcattt

SEQ ID NO: 21658 - DNA, 20 bp, Artificial Sequence
  chemically synthesized
ccctttctcatgtaacttac

SEQ ID NO: 21659 - DNA, 20 bp, Artificial Sequence
  chemically synthesized
atgtaacttactagtgcctt

SEQ ID NO: 21660 - DNA, 20 bp, Artificial Sequence
  chemically synthesized
tgtaacttactagtgccttc

SEQ ID NO: 21661 - DNA, 20 bp, Artificial Sequence
  chemically synthesized
agtgccttcaggatctgctc

SEQ ID NO: 21662 - DNA, 20 bp, Artificial Sequence
  chemically synthesized
tgatgcaatgctgctgtgca

SEQ ID NO: 21663 - DNA, 20 bp, Artificial Sequence
  chemically synthesized
gctgtgcacagcccacttta

SEQ ID NO: 21664 - DNA, 20 bp, Artificial Sequence
  chemically synthesized
tgcacagcccactttatggc

SEQ ID NO: 21665 - DNA, 20 bp, Artificial Sequence
  chemically synthesized
cagcccactttatggctaga

SEQ ID NO: 21666 - DNA, 20 bp, Artificial Sequence
  chemically synthesized
cactttatggctagatggat

SEQ ID NO: 21667 - DNA, 20 bp, Artificial Sequence
  chemically synthesized
ttatggctagatggatcaga

SEQ ID NO: 21668 - DNA, 20 bp, Artificial Sequence
  chemically synthesized
tagatggatcagaaagcacc

SEQ ID NO: 21669 - DNA, 20 bp, Artificial Sequence
  chemically synthesized
agaaagcacccagttcatga

SEQ ID NO: 21670 - DNA, 20 bp, Artificial Sequence
  chemically synthesized
gaaagcacccagttcatgat

SEQ ID NO: 21671 - DNA, 20 bp, Artificial Sequence
  chemically synthesized
agcacccagttcatgatagg

SEQ ID NO: 21672 - DNA, 20 bp, Artificial Sequence
  chemically synthesized
ccagttcatgataggcagtt

SEQ ID NO: 21673 - DNA, 20 bp, Artificial Sequence
  chemically synthesized
cagttcatgataggcagttc

SEQ ID NO: 21674 - DNA, 20 bp, Artificial Sequence
  chemically synthesized
gataggcagttcaggtcaca

SEQ ID NO: 21675 - DNA, 20 bp, Artificial Sequence
  chemically synthesized
catggtgacttgatgactca

SEQ ID NO: 21676 - DNA, 20 bp, Artificial Sequence
  chemically synthesized
caaatatttcgtttccacca

SEQ ID NO: 21677 - DNA, 20 bp, Artificial Sequence
  chemically synthesized
atttcgtttccaccaaagcc

SEQ ID NO: 21678 - DNA, 20 bp, Artificial Sequence
  chemically synthesized
tttccaccaaagcccagtaa

SEQ ID NO: 21679 - DNA, 20 bp, Artificial Sequence
  chemically synthesized
ttccaccaaagcccagtaac

SEQ ID NO: 21680 - DNA, 20 bp, Artificial Sequence
  chemically synthesized
ccaaagcccagtaacaggcc

SEQ ID NO: 21681 - DNA, 20 bp, Artificial Sequence
  chemically synthesized
aaagcccagtaacaggccaa

SEQ ID NO: 21682 - DNA, 20 bp, Artificial Sequence
  chemically synthesized
gccaagagctttctccctaa

SEQ ID NO: 21683 - DNA, 20 bp, Artificial Sequence
  chemically synthesized
caagagctttctccctaaaa

SEQ ID NO: 21684 - DNA, 20 bp, Artificial Sequence
  chemically synthesized
agagctttctccctaaaaga

SEQ ID NO: 21685 - DNA, 20 bp, Artificial Sequence
  chemically synthesized
gctttctccctaaaagagag

SEQ ID NO: 21686 - DNA, 20 bp, Artificial Sequence
  chemically synthesized
taaaagagagtagttatctg

SEQ ID NO: 21687 - DNA, 20 bp, Artificial Sequence
  chemically synthesized
aagagagtagttatctgcag

SEQ ID NO: 21688 - DNA, 20 bp, Artificial Sequence
  chemically synthesized
gagtagttatctgcagaaga

SEQ ID NO: 21689 - DNA, 20 bp, Artificial Sequence
  chemically synthesized
tagttatctgcagaagatgg

SEQ ID NO: 21690 - DNA, 20 bp, Artificial Sequence
  chemically synthesized
agttatctgcagaagatggc

SEQ ID NO: 21691 - DNA, 20 bp, Artificial Sequence
  chemically synthesized
gttatctgcagaagatggca

SEQ ID NO: 21692 - DNA, 20 bp, Artificial Sequence
  chemically synthesized
agggccttgctccaaaatcc

SEQ ID NO: 21693 - DNA, 20 bp, Artificial Sequence
  chemically synthesized
ggccttgctccaaaatccta

SEQ ID NO: 21694 - DNA, 20 bp, Artificial Sequence
  chemically synthesized
gccttgctccaaaatcctag

SEQ ID NO: 21695 - DNA, 20 bp, Artificial Sequence
  chemically synthesized
tagaggcctccgctgtgatt

SEQ ID NO: 21696 - DNA, 20 bp, Artificial Sequence
  chemically synthesized
agcctgccaaatgctccaaa

SEQ ID NO: 21697 - DNA, 20 bp, Artificial Sequence
  chemically synthesized
ctccaaacagcatccctatc

SEQ ID NO: 21698 - DNA, 20 bp, Artificial Sequence
  chemically synthesized
ctatctggcactgacacctc

SEQ ID NO: 21699 - DNA, 20 bp, Artificial Sequence
  chemically synthesized
actgacacctcaagcatcat

SEQ ID NO: 21700 - DNA, 20 bp, Artificial Sequence
  chemically synthesized
tcaagcatcattggatctgc

SEQ ID NO: 21701 - DNA, 20 bp, Artificial Sequence
  chemically synthesized
caagcatcattggatctgct

SEQ ID NO: 21702 - DNA, 20 bp, Artificial Sequence
  chemically synthesized
attggatctgctaggtcata

SEQ ID NO: 21703 - DNA, 20 bp, Artificial Sequence
  chemically synthesized
tctgctaggtcatatggccc

SEQ ID NO: 21704 - DNA, 20 bp, Artificial Sequence
  chemically synthesized
gctaggtcatatggcccaag

SEQ ID NO: 21705 - DNA, 20 bp, Artificial Sequence
  chemically synthesized
gtcatatggcccaagtggca

SEQ ID NO: 21706 - DNA, 20 bp, Artificial Sequence
  chemically synthesized
atatggcccaagtggcatag

SEQ ID NO: 21707 - DNA, 20 bp, Artificial Sequence
  chemically synthesized
aagtggcatagcagcttgca

SEQ ID NO: 21708 - DNA, 20 bp, Artificial Sequence
  chemically synthesized
tggcatagcagcttgcacag

SEQ ID NO: 21709 - DNA, 20 bp, Artificial Sequence
  chemically synthesized
tagcagcttgcacagcagcc

SEQ ID NO: 21710 - DNA, 20 bp, Artificial Sequence
  chemically synthesized
tgcacagcagcctggacctg

SEQ ID NO: 21711 - DNA, 20 bp, Artificial Sequence
  chemically synthesized
acagcagcctggacctgtgg

SEQ ID NO: 21712 - DNA, 20 bp, Artificial Sequence
  chemically synthesized
agcagcctggacctgtggca

SEQ ID NO: 21713 - DNA, 20 bp, Artificial Sequence
  chemically synthesized
tgtggcagagccttctgttc

SEQ ID NO: 21714 - DNA, 20 bp, Artificial Sequence
  chemically synthesized
ttctggactccactcaaaac

SEQ ID NO: 21715 - DNA, 20 bp, Artificial Sequence
  chemically synthesized
tggactccactcaaaactgg

SEQ ID NO: 21716 - DNA, 20 bp, Artificial Sequence
  chemically synthesized
actcaaaactggcagccttt

SEQ ID NO: 21717 - DNA, 20 bp, Artificial Sequence
  chemically synthesized
cttttggatcactcgataaa

SEQ ID NO: 21718 - DNA, 20 bp, Artificial Sequence
  chemically synthesized
ttttggatcactcgataaat

SEQ ID NO: 21719 - DNA, 20 bp, Artificial Sequence
  chemically synthesized
ggatcactcgataaatgggc

SEQ ID NO: 21720 - DNA, 20 bp, Artificial Sequence
  chemically synthesized
atcactcgataaatgggcca

SEQ ID NO: 21721 - DNA, 20 bp, Artificial Sequence
  chemically synthesized
ccagagtaacacacccaaat

SEQ ID NO: 21722 - DNA, 20 bp, Artificial Sequence
  chemically synthesized
cagagtaacacacccaaatc

SEQ ID NO: 21723 - DNA, 20 bp, Artificial Sequence
  chemically synthesized
tgttgcctccaaaatccaaa

SEQ ID NO: 21724 - DNA, 20 bp, Artificial Sequence
  chemically synthesized
gttgcctccaaaatccaaat

SEQ ID NO: 21725 - DNA, 20 bp, Artificial Sequence
  chemically synthesized
caaaatccaaataggcccac

SEQ ID NO: 21726 - DNA, 20 bp, Artificial Sequence
  chemically synthesized
aaaatccaaataggcccact

SEQ ID NO: 21727 - DNA, 20 bp, Artificial Sequence
  chemically synthesized
taggcgttgtgcctatttct

SEQ ID NO: 21728 - DNA, 20 bp, Artificial Sequence
  chemically synthesized
tgtgcctatttcttggttgt

SEQ ID NO: 21729 - DNA, 20 bp, Artificial Sequence
  chemically synthesized
tgcctatttcttggttgtaa

SEQ ID NO: 21730 - DNA, 20 bp, Artificial Sequence
  chemically synthesized
ctatttcttggttgtaagag

SEQ ID NO: 21731 - DNA, 20 bp, Artificial Sequence
  chemically synthesized
gttgtaagagtggccaaatg

SEQ ID NO: 21732 - DNA, 20 bp, Artificial Sequence
  chemically synthesized
cagcaaattatccttcactt

SEQ ID NO: 21733 - DNA, 20 bp, Artificial Sequence
  chemically synthesized
caaattatccttcactttag

SEQ ID NO: 21734 - DNA, 20 bp, Artificial Sequence
  chemically synthesized
aaattatccttcactttaga

SEQ ID NO: 21735 - DNA, 20 bp, Artificial Sequence
  chemically synthesized
actttagaaggaatatctca

SEQ ID NO: 21736 - DNA, 20 bp, Artificial Sequence
  chemically synthesized
tttagaaggaatatctcaaa

SEQ ID NO: 21737 - DNA, 20 bp, Artificial Sequence
  chemically synthesized
ctcaaagagccccaaaccat

SEQ ID NO: 21738 - DNA, 20 bp, Artificial Sequence
  chemically synthesized
ggacccctataaattttact

SEQ ID NO: 21739 - DNA, 20 bp, Artificial Sequence
  chemically synthesized
gacccctataaattttactg

SEQ ID NO: 21740 - DNA, 20 bp, Artificial Sequence
  chemically synthesized
ccctataaattttactgagg

SEQ ID NO: 21741 - DNA, 20 bp, Artificial Sequence
  chemically synthesized
tataaattttactgaggtag

SEQ ID NO: 21742 - DNA, 20 bp, Artificial Sequence
  chemically synthesized
ataaattttactgaggtaga

SEQ ID NO: 21743 - DNA, 20 bp, Artificial Sequence
  chemically synthesized
agaaggtccctgaatttaat

SEQ ID NO: 21744 - DNA, 20 bp, Artificial Sequence
  chemically synthesized
aaatgtctcatcaataaatc

SEQ ID NO: 21745 - DNA, 20 bp, Artificial Sequence
  chemically synthesized
gtttgctacttcttgctcac

SEQ ID NO: 21746 - DNA, 20 bp, Artificial Sequence
  chemically synthesized
tacttcttgctcactagttc

SEQ ID NO: 21747 - DNA, 20 bp, Artificial Sequence
  chemically synthesized
tcttgctcactagttccagt

SEQ ID NO: 21748 - DNA, 20 bp, Artificial Sequence
  chemically synthesized
tcagcatgtcatcaatgtaa

SEQ ID NO: 21749 - DNA, 20 bp, Artificial Sequence
  chemically synthesized
tggaccactgtgatatcttg

SEQ ID NO: 21750 - DNA, 20 bp, Artificial Sequence
  chemically synthesized
accactgtgatatcttgtgg

SEQ ID NO: 21751 - DNA, 20 bp, Artificial Sequence
  chemically synthesized
gtgatatcttgtggaagtga

SEQ ID NO: 21752 - DNA, 20 bp, Artificial Sequence
  chemically synthesized
tgatatcttgtggaagtgaa

SEQ ID NO: 21753 - DNA, 20 bp, Artificial Sequence
  chemically synthesized
atcttgtggaagtgaaaggt

SEQ ID NO: 21754 - DNA, 20 bp, Artificial Sequence
  chemically synthesized
tgtggaagtgaaaggtgagc

SEQ ID NO: 21755 - DNA, 20 bp, Artificial Sequence
  chemically synthesized
tgagcaagttctctccaaat

SEQ ID NO: 21756 - DNA, 20 bp, Artificial Sequence
  chemically synthesized
gttctctccaaataagatta

SEQ ID NO: 21757 - DNA, 20 bp, Artificial Sequence
  chemically synthesized
ccaaataagattatggcaca

SEQ ID NO: 21758 - DNA, 20 bp, Artificial Sequence
  chemically synthesized
ataagattatggcacaaagc

SEQ ID NO: 21759 - DNA, 20 bp, Artificial Sequence
  chemically synthesized
aagattatggcacaaagctg

SEQ ID NO: 21760 - DNA, 20 bp, Artificial Sequence
  chemically synthesized
gattatggcacaaagctgga

SEQ ID NO: 21761 - DNA, 20 bp, Artificial Sequence
  chemically synthesized
tggagagttgatatactcct

SEQ ID NO: 21762 - DNA, 20 bp, Artificial Sequence
  chemically synthesized
ttttctttcatcactttgtc

SEQ ID NO: 21763 - DNA, 20 bp, Artificial Sequence
  chemically synthesized
actttgtccagcgaacttac

SEQ ID NO: 21764 - DNA, 20 bp, Artificial Sequence
  chemically synthesized
gttccttgattctccacata

SEQ ID NO: 21765 - DNA, 20 bp, Artificial Sequence
  chemically synthesized
gattctccacatatagtcaa

SEQ ID NO: 21766 - DNA, 20 bp, Artificial Sequence
  chemically synthesized
agtcaaaagtattatgtata

SEQ ID NO: 21767 - DNA, 20 bp, Artificial Sequence
  chemically synthesized
caaaagtattatgtatacag

SEQ ID NO: 21768 - DNA, 20 bp, Artificial Sequence
  chemically synthesized
ctaaattccttgcctctcac

SEQ ID NO: 21769 - DNA, 20 bp, Artificial Sequence
  chemically synthesized
cctctcacaagcgttgaatc

SEQ ID NO: 21770 - DNA, 20 bp, Artificial Sequence
  chemically synthesized
tctcacaagcgttgaatcaa

SEQ ID NO: 21771 - DNA, 20 bp, Artificial Sequence
  chemically synthesized
ctctctaaacaattgatgcc

SEQ ID NO: 21772 - DNA, 20 bp, Artificial Sequence
  chemically synthesized
tctctaaacaattgatgcca

SEQ ID NO: 21773 - DNA, 20 bp, Artificial Sequence
  chemically synthesized
caattgatgccaaggattat

SEQ ID NO: 21774 - DNA, 20 bp, Artificial Sequence
  chemically synthesized
atcagtgttctccataccat

SEQ ID NO: 21775 - DNA, 20 bp, Artificial Sequence
  chemically synthesized
agtgttctccataccattag

SEQ ID NO: 21776 - DNA, 20 bp, Artificial Sequence
  chemically synthesized
gttctccataccattagaag

SEQ ID NO: 21777 - DNA, 20 bp, Artificial Sequence
  chemically synthesized
tctccataccattagaagaa

SEQ ID NO: 21778 - DNA, 20 bp, Artificial Sequence
  chemically synthesized
accattagaagaagagtcct

SEQ ID NO: 21779 - DNA, 20 bp, Artificial Sequence
  chemically synthesized
agaagagtccttagcatatt

SEQ ID NO: 21780 - DNA, 20 bp, Artificial Sequence
  chemically synthesized
gaagagtccttagcatattt

SEQ ID NO: 21781 - DNA, 20 bp, Artificial Sequence
  chemically synthesized
tatttgggtctaatcatatt

SEQ ID NO: 21782 - DNA, 20 bp, Artificial Sequence
  chemically synthesized
ttgggtctaatcatattaag

SEQ ID NO: 21783 - DNA, 20 bp, Artificial Sequence
  chemically synthesized
tcatattaagcagccaactc

SEQ ID NO: 21784 - DNA, 20 bp, Artificial Sequence
  chemically synthesized
agaaaccccaaaaccaatga

SEQ ID NO: 21785 - DNA, 20 bp, Artificial Sequence
  chemically synthesized
tccttaatattctgttcctc

SEQ ID NO: 21786 - DNA, 20 bp, Artificial Sequence
  chemically synthesized
tgttcctctagaaccactcc

SEQ ID NO: 21787 - DNA, 20 bp, Artificial Sequence
  chemically synthesized
cctggtaccaaaatctgtat

SEQ ID NO: 21788 - DNA, 20 bp, Artificial Sequence
  chemically synthesized
ctggtaccaaaatctgtatt

SEQ ID NO: 21789 - DNA, 20 bp, Artificial Sequence
  chemically synthesized
tggtaccaaaatctgtatta

SEQ ID NO: 21790 - DNA, 20 bp, Artificial Sequence
  chemically synthesized
aaatctgtattagggttcta

SEQ ID NO: 21791 - DNA, 20 bp, Artificial Sequence
  chemically synthesized
atctgtattagggttctaca

SEQ ID NO: 21792 - DNA, 20 bp, Artificial Sequence
  chemically synthesized
attagggttctacagagaaa

SEQ ID NO: 21793 - DNA, 20 bp, Artificial Sequence
  chemically synthesized
ctacagagaaacagaattaa

SEQ ID NO: 21794 - DNA, 20 bp, Artificial Sequence
  chemically synthesized
tacagagaaacagaattaat

SEQ ID NO: 21795 - DNA, 20 bp, Artificial Sequence
  chemically synthesized
cagagaaacagaattaatag

SEQ ID NO: 21796 - DNA, 20 bp, Artificial Sequence
  chemically synthesized
ctctatatctatatctatat

SEQ ID NO: 21797 - DNA, 20 bp, Artificial Sequence
  chemically synthesized
ctatatctatatctatatga

SEQ ID NO: 21798 - DNA, 20 bp, Artificial Sequence
  chemically synthesized
ctatatgagagtttattatg

SEQ ID NO: 21799 - DNA, 20 bp, Artificial Sequence
  chemically synthesized
gtattgactcacatgttcac

SEQ ID NO: 21800 - DNA, 20 bp, Artificial Sequence
  chemically synthesized
tattgactcacatgttcaca

SEQ ID NO: 21801 - DNA, 20 bp, Artificial Sequence
  chemically synthesized
atgttcacaaggtcccaaaa

SEQ ID NO: 21802 - DNA, 20 bp, Artificial Sequence
  chemically synthesized
tgttcacaaggtcccaaaac

SEQ ID NO: 21803 - DNA, 20 bp, Artificial Sequence
  chemically synthesized
tcccaaaacaggccatctgc

SEQ ID NO: 21804 - DNA, 20 bp, Artificial Sequence
  chemically synthesized
aaacaggccatctgccagct

SEQ ID NO: 21805 - DNA, 20 bp, Artificial Sequence
  chemically synthesized
aacaggccatctgccagctg

SEQ ID NO: 21806 - DNA, 20 bp, Artificial Sequence
  chemically synthesized
ccatctgccagctgaggaac

SEQ ID NO: 21807 - DNA, 20 bp, Artificial Sequence
  chemically synthesized
catctgccagctgaggaaca

SEQ ID NO: 21808 - DNA, 20 bp, Artificial Sequence
  chemically synthesized
ctgccagctgaggaacaagg

SEQ ID NO: 21809 - DNA, 20 bp, Artificial Sequence
  chemically synthesized
cagctgaggaacaaggaagc

SEQ ID NO: 21810 - DNA, 20 bp, Artificial Sequence
  chemically synthesized
tgaggaacaaggaagctagt

SEQ ID NO: 21811 - DNA, 20 bp, Artificial Sequence
  chemically synthesized
aggaacaaggaagctagtcg

SEQ ID NO: 21812 - DNA, 20 bp, Artificial Sequence
  chemically synthesized
ggaagctagtcggagtccca

SEQ ID NO: 21813 - DNA, 20 bp, Artificial Sequence
  chemically synthesized
tagtcggagtcccaaagctg

SEQ ID NO: 21814 - DNA, 20 bp, Artificial Sequence
  chemically synthesized
agtcccaaagctgaagaacc

SEQ ID NO: 21815 - DNA, 20 bp, Artificial Sequence
  chemically synthesized
tcccaaagctgaagaacctg

SEQ ID NO: 21816 - DNA, 20 bp, Artificial Sequence
  chemically synthesized
gaacctggagttcaatgttc

SEQ ID NO: 21817 - DNA, 20 bp, Artificial Sequence
  chemically synthesized
aacctggagttcaatgttcc

SEQ ID NO: 21818 - DNA, 20 bp, Artificial Sequence
  chemically synthesized
acctggagttcaatgttcca

SEQ ID NO: 21819 - DNA, 20 bp, Artificial Sequence
  chemically synthesized
tggagttcaatgttccaggg

SEQ ID NO: 21820 - DNA, 20 bp, Artificial Sequence
  chemically synthesized
ggagttcaatgttccagggc

SEQ ID NO: 21821 - DNA, 20 bp, Artificial Sequence
  chemically synthesized
gttcaatgttccagggcagg

SEQ ID NO: 21822 - DNA, 20 bp, Artificial Sequence
  chemically synthesized
gttccagggcaggaagaatc

SEQ ID NO: 21823 - DNA, 20 bp, Artificial Sequence
  chemically synthesized
agggcaggaagaatccagca

SEQ ID NO: 21824 - DNA, 20 bp, Artificial Sequence
  chemically synthesized
gggcaggaagaatccagcat

SEQ ID NO: 21825 - DNA, 20 bp, Artificial Sequence
  chemically synthesized
gcaggaagaatccagcatgg

SEQ ID NO: 21826 - DNA, 20 bp, Artificial Sequence
  chemically synthesized
tccagcatgggagaaaaatg

SEQ ID NO: 21827 - DNA, 20 bp, Artificial Sequence
  chemically synthesized
ccagcatgggagaaaaatgt

SEQ ID NO: 21828 - DNA, 20 bp, Artificial Sequence
  chemically synthesized
catgggagaaaaatgtaggc

SEQ ID NO: 21829 - DNA, 20 bp, Artificial Sequence
  chemically synthesized
atgggagaaaaatgtaggct

SEQ ID NO: 21830 - DNA, 20 bp, Artificial Sequence
  chemically synthesized
aaaatgtaggctgggatgcc

SEQ ID NO: 21831 - DNA, 20 bp, Artificial Sequence
  chemically synthesized
gctgggatgccaagccaatc

SEQ ID NO: 21832 - DNA, 20 bp, Artificial Sequence
  chemically synthesized
tttctgcctgctttatatcc

SEQ ID NO: 21833 - DNA, 20 bp, Artificial Sequence
  chemically synthesized
gctttatatcctggctgtgc

SEQ ID NO: 21834 - DNA, 20 bp, Artificial Sequence
  chemically synthesized
tggctgtgctggcaactgat

SEQ ID NO: 21835 - DNA, 20 bp, Artificial Sequence
  chemically synthesized
tgtgctggcaactgattaga

SEQ ID NO: 21836 - DNA, 20 bp, Artificial Sequence
  chemically synthesized
ctgattagatggtgcccacc

SEQ ID NO: 21837 - DNA, 20 bp, Artificial Sequence
  chemically synthesized
agatggtgcccacccagatt

SEQ ID NO: 21838 - DNA, 20 bp, Artificial Sequence
  chemically synthesized
gatggtgcccacccagatta

SEQ ID NO: 21839 - DNA, 20 bp, Artificial Sequence
  chemically synthesized
atggtgcccacccagattaa

SEQ ID NO: 21840 - DNA, 20 bp, Artificial Sequence
  chemically synthesized
gtgcccacccagattaaggg

SEQ ID NO: 21841 - DNA, 20 bp, Artificial Sequence
  chemically synthesized
tgcccacccagattaagggt

SEQ ID NO: 21842 - DNA, 20 bp, Artificial Sequence
  chemically synthesized
aagggtgggtctgccttccc

SEQ ID NO: 21843 - DNA, 20 bp, Artificial Sequence
  chemically synthesized
actgaaatattaatctcctt

SEQ ID NO: 21844 - DNA, 20 bp, Artificial Sequence
  chemically synthesized
ctcctttggtaacaccctca

SEQ ID NO: 21845 - DNA, 20 bp, Artificial Sequence
  chemically synthesized
acaccctcacagacacaccc

SEQ ID NO: 21846 - DNA, 20 bp, Artificial Sequence
  chemically synthesized
gatcattactttgcatcctt

SEQ ID NO: 21847 - DNA, 20 bp, Artificial Sequence
  chemically synthesized
ttgcatccttcagtccaatc

SEQ ID NO: 21848 - DNA, 20 bp, Artificial Sequence
  chemically synthesized
agtccaatcaagttgacact

SEQ ID NO: 21849 - DNA, 20 bp, Artificial Sequence
  chemically synthesized
acactcagtattaaccatca

SEQ ID NO: 21850 - DNA, 20 bp, Artificial Sequence
  chemically synthesized
catcacagtcactttctaat

SEQ ID NO: 21851 - DNA, 20 bp, Artificial Sequence
  chemically synthesized
atcacagtcactttctaatg

SEQ ID NO: 21852 - DNA, 20 bp, Artificial Sequence
  chemically synthesized
cagtcactttctaatgaggt

SEQ ID NO: 21853 - DNA, 20 bp, Artificial Sequence
  chemically synthesized
aggttggtttttttgttgtt

SEQ ID NO: 21854 - DNA, 20 bp, Artificial Sequence
  chemically synthesized
ttttgttgttgagttccttg

SEQ ID NO: 21855 - DNA, 20 bp, Artificial Sequence
  chemically synthesized
tccttgtagattctgtatat

SEQ ID NO: 21856 - DNA, 20 bp, Artificial Sequence
  chemically synthesized
ttagccttttgttgcattca

SEQ ID NO: 21857 - DNA, 20 bp, Artificial Sequence
  chemically synthesized
aatttttttttctcattctg

SEQ ID NO: 21858 - DNA, 20 bp, Artificial Sequence
  chemically synthesized
atttttttttctcattctgt

SEQ ID NO: 21859 - DNA, 20 bp, Artificial Sequence
  chemically synthesized
atccgtttactctgttgatt

SEQ ID NO: 21860 - DNA, 20 bp, Artificial Sequence
  chemically synthesized
tctgttgattcggtcttttg

SEQ ID NO: 21861 - DNA, 20 bp, Artificial Sequence
  chemically synthesized
tgattcggtcttttgcggtg

SEQ ID NO: 21862 - DNA, 20 bp, Artificial Sequence
  chemically synthesized
ttcggtcttttgcggtgcag

SEQ ID NO: 21863 - DNA, 20 bp, Artificial Sequence
  chemically synthesized
tttgcggtgcagaagcattt

SEQ ID NO: 21864 - DNA, 20 bp, Artificial Sequence
  chemically synthesized
agaagcattttagtttaatt

SEQ ID NO: 21865 - DNA, 20 bp, Artificial Sequence
  chemically synthesized
gtttttgtttttgttgtgtt

SEQ ID NO: 21866 - DNA, 20 bp, Artificial Sequence
  chemically synthesized
tttttgttgtgtttagtttt

SEQ ID NO: 21867 - DNA, 20 bp, Artificial Sequence
  chemically synthesized
ttttgttgtgtttagttttg

SEQ ID NO: 21868 - DNA, 20 bp, Artificial Sequence
  chemically synthesized
tgtgtttagttttgaggact

SEQ ID NO: 21869 - DNA, 20 bp, Artificial Sequence
  chemically synthesized
ttggtcataaattctttgcc

SEQ ID NO: 21870 - DNA, 20 bp, Artificial Sequence
  chemically synthesized
tggtcataaattctttgcct

SEQ ID NO: 21871 - DNA, 20 bp, Artificial Sequence
  chemically synthesized
tctaatttttaatcctcttt

SEQ ID NO: 21872 - DNA, 20 bp, Artificial Sequence
  chemically synthesized
taatttttaatcctctttta

SEQ ID NO: 21873 - DNA, 20 bp, Artificial Sequence
  chemically synthesized
tttacccccatttgacacat

SEQ ID NO: 21874 - DNA, 20 bp, Artificial Sequence
  chemically synthesized
atttgacacatgagctaatt

SEQ ID NO: 21875 - DNA, 20 bp, Artificial Sequence
  chemically synthesized
aattgagccttctgtctgtt

SEQ ID NO: 21876 - DNA, 20 bp, Artificial Sequence
  chemically synthesized
gagccttctgtctgttaagt

SEQ ID NO: 21877 - DNA, 20 bp, Artificial Sequence
  chemically synthesized
tgtctgttaagtaagttgac

SEQ ID NO: 21878 - DNA, 20 bp, Artificial Sequence
  chemically synthesized
gttaagtaagttgactagtt

SEQ ID NO: 21879 - DNA, 20 bp, Artificial Sequence
  chemically synthesized
taagttgactagttcagtgt

SEQ ID NO: 21880 - DNA, 20 bp, Artificial Sequence
  chemically synthesized
tttttgccatcataatgctt

SEQ ID NO: 21881 - DNA, 20 bp, Artificial Sequence
  chemically synthesized
tactctccttaattttcccc

SEQ ID NO: 21882 - DNA, 20 bp, Artificial Sequence
  chemically synthesized
actctccttaattttccccc

SEQ ID NO: 21883 - DNA, 20 bp, Artificial Sequence
  chemically synthesized
tccttaattttcccccagga

SEQ ID NO: 21884 - DNA, 20 bp, Artificial Sequence
  chemically synthesized
tttcccccaggatggttttc

SEQ ID NO: 21885 - DNA, 20 bp, Artificial Sequence
  chemically synthesized
ccaggatggttttctagatg

SEQ ID NO: 21886 - DNA, 20 bp, Artificial Sequence
  chemically synthesized
ttttctagatgtggacttgc

SEQ ID NO: 21887 - DNA, 20 bp, Artificial Sequence
  chemically synthesized
atgtggacttgctggatcca

SEQ ID NO: 21888 - DNA, 20 bp, Artificial Sequence
  chemically synthesized
ccaaatgtatccatatattg

SEQ ID NO: 21889 - DNA, 20 bp, Artificial Sequence
  chemically synthesized
attgtggctttgtgttttaa

SEQ ID NO: 21890 - DNA, 20 bp, Artificial Sequence
  chemically synthesized
tgtggctttgtgttttaata

SEQ ID NO: 21891 - DNA, 20 bp, Artificial Sequence
  chemically synthesized
gtggctttgtgttttaatag

SEQ ID NO: 21892 - DNA, 20 bp, Artificial Sequence
  chemically synthesized
gctttgtgttttaatagagg

SEQ ID NO: 21893 - DNA, 20 bp, Artificial Sequence
  chemically synthesized
ttgtgttttaatagaggtag

SEQ ID NO: 21894 - DNA, 20 bp, Artificial Sequence
  chemically synthesized
aatagaggtagcagcaatat

SEQ ID NO: 21895 - DNA, 20 bp, Artificial Sequence
  chemically synthesized
tagaggtagcagcaatatta

SEQ ID NO: 21896 - DNA, 20 bp, Artificial Sequence
  chemically synthesized
agaggtagcagcaatattag

SEQ ID NO: 21897 - DNA, 20 bp, Artificial Sequence
  chemically synthesized
aggtagcagcaatattagag

SEQ ID NO: 21898 - DNA, 20 bp, Artificial Sequence
  chemically synthesized
gtagcagcaatattagagga

SEQ ID NO: 21899 - DNA, 20 bp, Artificial Sequence
  chemically synthesized
caatattagaggagagaatt

SEQ ID NO: 21900 - DNA, 20 bp, Artificial Sequence
  chemically synthesized
aatattagaggagagaatta

SEQ ID NO: 21901 - DNA, 20 bp, Artificial Sequence
  chemically synthesized
agagaattaaggaacgattc

SEQ ID NO: 21902 - DNA, 20 bp, Artificial Sequence
  chemically synthesized
attaaggaacgattctagtg

SEQ ID NO: 21903 - DNA, 20 bp, Artificial Sequence
  chemically synthesized
aaggaacgattctagtgtag

SEQ ID NO: 21904 - DNA, 20 bp, Artificial Sequence
  chemically synthesized
aggaacgattctagtgtagc

SEQ ID NO: 21905 - DNA, 20 bp, Artificial Sequence
  chemically synthesized
cgattctagtgtagcaggac

SEQ ID NO: 21906 - DNA, 20 bp, Artificial Sequence
  chemically synthesized
aagctgcatacaaaacccct

SEQ ID NO: 21907 - DNA, 20 bp, Artificial Sequence
  chemically synthesized
tacaaaacccctcagacacc

SEQ ID NO: 21908 - DNA, 20 bp, Artificial Sequence
  chemically synthesized
acccctcagacaccgagtta

SEQ ID NO: 21909 - DNA, 20 bp, Artificial Sequence
  chemically synthesized
cctcagacaccgagttaaag

SEQ ID NO: 21910 - DNA, 20 bp, Artificial Sequence
  chemically synthesized
ctcagacaccgagttaaaga

SEQ ID NO: 21911 - DNA, 20 bp, Artificial Sequence
  chemically synthesized
agacaccgagttaaagaagg

SEQ ID NO: 21912 - DNA, 20 bp, Artificial Sequence
  chemically synthesized
gacaccgagttaaagaagga

SEQ ID NO: 21913 - DNA, 20 bp, Artificial Sequence
  chemically synthesized
acaccgagttaaagaaggaa

SEQ ID NO: 21914 - DNA, 20 bp, Artificial Sequence
  chemically synthesized
aaagaaggaagggctttatt

SEQ ID NO: 21915 - DNA, 20 bp, Artificial Sequence
  chemically synthesized
aaggaagggctttattcggc

SEQ ID NO: 21916 - DNA, 20 bp, Artificial Sequence
  chemically synthesized
aggaagggctttattcggct

SEQ ID NO: 21917 - DNA, 20 bp, Artificial Sequence
  chemically synthesized
gaagggctttattcggctgg

SEQ ID NO: 21918 - DNA, 20 bp, Artificial Sequence
  chemically synthesized
gctttattcggctgggagct

SEQ ID NO: 21919 - DNA, 20 bp, Artificial Sequence
  chemically synthesized
ctttattcggctgggagctt

SEQ ID NO: 21920 - DNA, 20 bp, Artificial Sequence
  chemically synthesized
attcggctgggagcttgggc

SEQ ID NO: 21921 - DNA, 20 bp, Artificial Sequence
  chemically synthesized
gactcacatctccaacaacc

SEQ ID NO: 21922 - DNA, 20 bp, Artificial Sequence
  chemically synthesized
atctccaacaaccaagctct

SEQ ID NO: 21923 - DNA, 20 bp, Artificial Sequence
  chemically synthesized
ctccaacaaccaagctctca

SEQ ID NO: 21924 - DNA, 20 bp, Artificial Sequence
  chemically synthesized
aacaaccaagctctcagagt

SEQ ID NO: 21925 - DNA, 20 bp, Artificial Sequence
  chemically synthesized
gagcaattcctgtccctttt

SEQ ID NO: 21926 - DNA, 20 bp, Artificial Sequence
  chemically synthesized
agcaattcctgtccctttta

SEQ ID NO: 21927 - DNA, 20 bp, Artificial Sequence
  chemically synthesized
gcaattcctgtcccttttaa

SEQ ID NO: 21928 - DNA, 20 bp, Artificial Sequence
  chemically synthesized
ttttaagggcttacaactct

SEQ ID NO: 21929 - DNA, 20 bp, Artificial Sequence
  chemically synthesized
tttaagggcttacaactcta

SEQ ID NO: 21930 - DNA, 20 bp, Artificial Sequence
  chemically synthesized
ttaagggcttacaactctaa

SEQ ID NO: 21931 - DNA, 20 bp, Artificial Sequence
  chemically synthesized
taagggcttacaactctaag

SEQ ID NO: 21932 - DNA, 20 bp, Artificial Sequence
  chemically synthesized
aagggcttacaactctaagg

SEQ ID NO: 21933 - DNA, 20 bp, Artificial Sequence
  chemically synthesized
actctaagggggtacatgac

SEQ ID NO: 21934 - DNA, 20 bp, Artificial Sequence
  chemically synthesized
ctctaagggggtacatgact

SEQ ID NO: 21935 - DNA, 20 bp, Artificial Sequence
  chemically synthesized
tctaagggggtacatgactg

SEQ ID NO: 21936 - DNA, 20 bp, Artificial Sequence
  chemically synthesized
ctaagggggtacatgactgg

SEQ ID NO: 21937 - DNA, 20 bp, Artificial Sequence
  chemically synthesized
tgactgggggctgcatgcac

SEQ ID NO: 21938 - DNA, 20 bp, Artificial Sequence
  chemically synthesized
gggctgcatgcactggtcat

SEQ ID NO: 21939 - DNA, 20 bp, Artificial Sequence
  chemically synthesized
gcatgcactggtcatcagaa

SEQ ID NO: 21940 - DNA, 20 bp, Artificial Sequence
  chemically synthesized
cactggtcatcagaatggaa

SEQ ID NO: 21941 - DNA, 20 bp, Artificial Sequence
  chemically synthesized
gtcatcagaatggaacagaa

SEQ ID NO: 21942 - DNA, 20 bp, Artificial Sequence
  chemically synthesized
tcatcagaatggaacagaac

SEQ ID NO: 21943 - DNA, 20 bp, Artificial Sequence
  chemically synthesized
cagaatggaacagaacagga

SEQ ID NO: 21944 - DNA, 20 bp, Artificial Sequence
  chemically synthesized
agaatggaacagaacaggac

SEQ ID NO: 21945 - DNA, 20 bp, Artificial Sequence
  chemically synthesized
gaatggaacagaacaggaca

SEQ ID NO: 21946 - DNA, 20 bp, Artificial Sequence
  chemically synthesized
tttcacactgcttttccata

SEQ ID NO: 21947 - DNA, 20 bp, Artificial Sequence
  chemically synthesized
ctgcttttccatacagtgtc

SEQ ID NO: 21948 - DNA, 20 bp, Artificial Sequence
  chemically synthesized
catacagtgtctggaatcta

SEQ ID NO: 21949 - DNA, 20 bp, Artificial Sequence
  chemically synthesized
gaatctatagataacataac

SEQ ID NO: 21950 - DNA, 20 bp, Artificial Sequence
  chemically synthesized
ctatagataacataactggc

SEQ ID NO: 21951 - DNA, 20 bp, Artificial Sequence
  chemically synthesized
tatagataacataactggcc

SEQ ID NO: 21952 - DNA, 20 bp, Artificial Sequence
  chemically synthesized
gataacataactggccaggt

SEQ ID NO: 21953 - DNA, 20 bp, Artificial Sequence
  chemically synthesized
ataacataactggccaggtc

SEQ ID NO: 21954 - DNA, 20 bp, Artificial Sequence
  chemically synthesized
taacataactggccaggtca

SEQ ID NO: 21955 - DNA, 20 bp, Artificial Sequence
  chemically synthesized
aacataactggccaggtcag

SEQ ID NO: 21956 - DNA, 20 bp, Artificial Sequence
  chemically synthesized
gtcaggggtctatctttaac

SEQ ID NO: 21957 - DNA, 20 bp, Artificial Sequence
  chemically synthesized
tcaggggtctatctttaacc

SEQ ID NO: 21958 - DNA, 20 bp, Artificial Sequence
  chemically synthesized
ggtctatctttaaccaggcc

SEQ ID NO: 21959 - DNA, 20 bp, Artificial Sequence
  chemically synthesized
gtctatctttaaccaggccc

SEQ ID NO: 21960 - DNA, 20 bp, Artificial Sequence
  chemically synthesized
ctttaaccaggcccaggatg

SEQ ID NO: 21961 - DNA, 20 bp, Artificial Sequence
  chemically synthesized
ccaggcccaggatgtggtct

SEQ ID NO: 21962 - DNA, 20 bp, Artificial Sequence
  chemically synthesized
caggcccaggatgtggtctc

SEQ ID NO: 21963 - DNA, 20 bp, Artificial Sequence
  chemically synthesized
ggtctcaggctgtttgcctg

SEQ ID NO: 21964 - DNA, 20 bp, Artificial Sequence
  chemically synthesized
tggatttcatttctgccttt

SEQ ID NO: 21965 - DNA, 20 bp, Artificial Sequence
  chemically synthesized
gtttttacttcttctttctt

SEQ ID NO: 21966 - DNA, 20 bp, Artificial Sequence
  chemically synthesized
ttttacttcttctttctttg

SEQ ID NO: 21967 - DNA, 20 bp, Artificial Sequence
  chemically synthesized
tttacttcttctttctttgg

SEQ ID NO: 21968 - DNA, 20 bp, Artificial Sequence
  chemically synthesized
acttcttctttctttggagg

SEQ ID NO: 21969 - DNA, 20 bp, Artificial Sequence
  chemically synthesized
ctttctttggaggcagaaat

SEQ ID NO: 21970 - DNA, 20 bp, Artificial Sequence
  chemically synthesized
tttctttggaggcagaaatt

SEQ ID NO: 21971 - DNA, 20 bp, Artificial Sequence
  chemically synthesized
attgggcataaaacaatatg

SEQ ID NO: 21972 - DNA, 20 bp, Artificial Sequence
  chemically synthesized
ttgggcataaaacaatatga

SEQ ID NO: 21973 - DNA, 20 bp, Artificial Sequence
  chemically synthesized
tgggcataaaacaatatgaa

SEQ ID NO: 21974 - DNA, 20 bp, Artificial Sequence
  chemically synthesized
gcataaaacaatatgaaggg

SEQ ID NO: 21975 - DNA, 20 bp, Artificial Sequence
  chemically synthesized
agggtggtctcctcccttac

SEQ ID NO: 21976 - DNA, 20 bp, Artificial Sequence
  chemically synthesized
gggtggtctcctcccttact

SEQ ID NO: 21977 - DNA, 20 bp, Artificial Sequence
  chemically synthesized
tggtctcctcccttactagg

SEQ ID NO: 21978 - DNA, 20 bp, Artificial Sequence
  chemically synthesized
gtctcctcccttactaggaa

SEQ ID NO: 21979 - DNA, 20 bp, Artificial Sequence
  chemically synthesized
ctcctcccttactaggaaga

SEQ ID NO: 21980 - DNA, 20 bp, Artificial Sequence
  chemically synthesized
ggaagagagaaataccatgt

SEQ ID NO: 21981 - DNA, 20 bp, Artificial Sequence
  chemically synthesized
gaaatacgtatttgtgttat

SEQ ID NO: 21982 - DNA, 20 bp, Artificial Sequence
  chemically synthesized
tgtgttattggatttgacat

SEQ ID NO: 21983 - DNA, 20 bp, Artificial Sequence
  chemically synthesized
gtgttattggatttgacatc

SEQ ID NO: 21984 - DNA, 20 bp, Artificial Sequence
  chemically synthesized
tgttattggatttgacatcg

SEQ ID NO: 21985 - DNA, 20 bp, Artificial Sequence
  chemically synthesized
attggatttgacatcggggt

SEQ ID NO: 21986 - DNA, 20 bp, Artificial Sequence
  chemically synthesized
tttgacatcggggttggacc

SEQ ID NO: 21987 - DNA, 20 bp, Artificial Sequence
  chemically synthesized
catcttctatgaacatctat

SEQ ID NO: 21988 - DNA, 20 bp, Artificial Sequence
  chemically synthesized
aagcacgttctccttatcaa

SEQ ID NO: 21989 - DNA, 20 bp, Artificial Sequence
  chemically synthesized
agcacgttctccttatcaaa

SEQ ID NO: 21990 - DNA, 20 bp, Artificial Sequence
  chemically synthesized
ttatcaaaaggtactttgct

SEQ ID NO: 21991 - DNA, 20 bp, Artificial Sequence
  chemically synthesized
tactttgcttggtgctttaa

SEQ ID NO: 21992 - DNA, 20 bp, Artificial Sequence
  chemically synthesized
ttaaaagataaatgactatg

SEQ ID NO: 21993 - DNA, 20 bp, Artificial Sequence
  chemically synthesized
agataaatgactatgtagct

SEQ ID NO: 21994 - DNA, 20 bp, Artificial Sequence
  chemically synthesized
gataaatgactatgtagctt

SEQ ID NO: 21995 - DNA, 20 bp, Artificial Sequence
  chemically synthesized
taaatgactatgtagcttag

SEQ ID NO: 21996 - DNA, 20 bp, Artificial Sequence
  chemically synthesized
ttcttcataattgaaaacca

SEQ ID NO: 21997 - DNA, 20 bp, Artificial Sequence
  chemically synthesized
ttcataattgaaaaccacag

SEQ ID NO: 21998 - DNA, 20 bp, Artificial Sequence
  chemically synthesized
gctgttatttgaacatacct

SEQ ID NO: 21999 - DNA, 20 bp, Artificial Sequence
  chemically synthesized
gaacatacctgagccccttc

SEQ ID NO: 22000 - DNA, 20 bp, Artificial Sequence
  chemically synthesized
gagccccttctggaccactg

SEQ ID NO: 22001 - DNA, 20 bp, Artificial Sequence
  chemically synthesized
agccccttctggaccactgt

SEQ ID NO: 22002 - DNA, 20 bp, Artificial Sequence
  chemically synthesized
ccccttctggaccactgtag

SEQ ID NO: 22003 - DNA, 20 bp, Artificial Sequence
  chemically synthesized
cttctggaccactgtaggag

SEQ ID NO: 22004 - DNA, 20 bp, Artificial Sequence
  chemically synthesized
ttctggaccactgtaggaga

SEQ ID NO: 22005 - DNA, 20 bp, Artificial Sequence
  chemically synthesized
ctggaccactgtaggagaag

SEQ ID NO: 22006 - DNA, 20 bp, Artificial Sequence
  chemically synthesized
tggaccactgtaggagaagg

SEQ ID NO: 22007 - DNA, 20 bp, Artificial Sequence
  chemically synthesized
accactgtaggagaaggagg

SEQ ID NO: 22008 - DNA, 20 bp, Artificial Sequence
  chemically synthesized
cactgtaggagaaggaggaa

SEQ ID NO: 22009 - DNA, 20 bp, Artificial Sequence
  chemically synthesized
ctgtaggagaaggaggaaga

SEQ ID NO: 22010 - DNA, 20 bp, Artificial Sequence
  chemically synthesized
tgtaggagaaggaggaagag

SEQ ID NO: 22011 - DNA, 20 bp, Artificial Sequence
  chemically synthesized
agaaggaggaagagaggtga

SEQ ID NO: 22012 - DNA, 20 bp, Artificial Sequence
  chemically synthesized
tgaaagtgatttctgctgct

SEQ ID NO: 22013 - DNA, 20 bp, Artificial Sequence
  chemically synthesized
gaaagtgatttctgctgctg

SEQ ID NO: 22014 - DNA, 20 bp, Artificial Sequence
  chemically synthesized
aaagtgatttctgctgctga

SEQ ID NO: 22015 - DNA, 20 bp, Artificial Sequence
  chemically synthesized
gagggcatgtatgatgacaa

SEQ ID NO: 22016 - DNA, 20 bp, Artificial Sequence
  chemically synthesized
agggcatgtatgatgacaat

SEQ ID NO: 22017 - DNA, 20 bp, Artificial Sequence
  chemically synthesized
gtcctaactttgacactaca

SEQ ID NO: 22018 - DNA, 20 bp, Artificial Sequence
  chemically synthesized
ctttgacactacaaagtgac

SEQ ID NO: 22019 - DNA, 20 bp, Artificial Sequence
  chemically synthesized
ttgacactacaaagtgactg

SEQ ID NO: 22020 - DNA, 20 bp, Artificial Sequence
  chemically synthesized
ctacaaagtgactggagctt

SEQ ID NO: 22021 - DNA, 20 bp, Artificial Sequence
  chemically synthesized
tacaaagtgactggagcttt

SEQ ID NO: 22022 - DNA, 20 bp, Artificial Sequence
  chemically synthesized
aagtgactggagctttaggc

SEQ ID NO: 22023 - DNA, 20 bp, Artificial Sequence
  chemically synthesized
tgactggagctttaggcaag

SEQ ID NO: 22024 - DNA, 20 bp, Artificial Sequence
  chemically synthesized
agttactccaattgtctttt

SEQ ID NO: 22025 - DNA, 20 bp, Artificial Sequence
  chemically synthesized
ttttcagactctttcttttt

SEQ ID NO: 22026 - DNA, 20 bp, Artificial Sequence
  chemically synthesized
tttcagactctttctttttg

SEQ ID NO: 22027 - DNA, 20 bp, Artificial Sequence
  chemically synthesized
tgaggtatttgacctctttg

SEQ ID NO: 22028 - DNA, 20 bp, Artificial Sequence
  chemically synthesized
atttgacctctttgcggcat

SEQ ID NO: 22029 - DNA, 20 bp, Artificial Sequence
  chemically synthesized
gctgctatttcacatgcacc

SEQ ID NO: 22030 - DNA, 20 bp, Artificial Sequence
  chemically synthesized
gctatttcacatgcacctag

SEQ ID NO: 22031 - DNA, 20 bp, Artificial Sequence
  chemically synthesized
ctatttcacatgcacctaga

SEQ ID NO: 22032 - DNA, 20 bp, Artificial Sequence
  chemically synthesized
tatttcacatgcacctagaa

SEQ ID NO: 22033 - DNA, 20 bp, Artificial Sequence
  chemically synthesized
aagggactttaaaacatgca

SEQ ID NO: 22034 - DNA, 20 bp, Artificial Sequence
  chemically synthesized
aacatgcacagaattgaaca

SEQ ID NO: 22035 - DNA, 20 bp, Artificial Sequence
  chemically synthesized
atgcacagaattgaacaaag

SEQ ID NO: 22036 - DNA, 20 bp, Artificial Sequence
  chemically synthesized
acaaagcagtaaccattcgt

SEQ ID NO: 22037 - DNA, 20 bp, Artificial Sequence
  chemically synthesized
tcaaatactattatttttga

SEQ ID NO: 22038 - DNA, 20 bp, Artificial Sequence
  chemically synthesized
caaatactattatttttgaa

SEQ ID NO: 22039 - DNA, 20 bp, Artificial Sequence
  chemically synthesized
ttgaaaggtaaataaatcct

SEQ ID NO: 22040 - DNA, 20 bp, Artificial Sequence
  chemically synthesized
tgaaaggtaaataaatcctt

SEQ ID NO: 22041 - DNA, 20 bp, Artificial Sequence
  chemically synthesized
ggtaaataaatccttgggct

SEQ ID NO: 22042 - DNA, 20 bp, Artificial Sequence
  chemically synthesized
aaataaatccttgggcttag

SEQ ID NO: 22043 - DNA, 20 bp, Artificial Sequence
  chemically synthesized
attgctaacctgaatgataa

SEQ ID NO: 22044 - DNA, 20 bp, Artificial Sequence
  chemically synthesized
agaaacttttttccttttaa

SEQ ID NO: 22045 - DNA, 20 bp, Artificial Sequence
  chemically synthesized
acttttttccttttaacagt

SEQ ID NO: 22046 - DNA, 20 bp, Artificial Sequence
  chemically synthesized
ttttttccttttaacagttg

SEQ ID NO: 22047 - DNA, 20 bp, Artificial Sequence
  chemically synthesized
tttttccttttaacagttgg

SEQ ID NO: 22048 - DNA, 20 bp, Artificial Sequence
  chemically synthesized
gaggcatctatactgtgatt

SEQ ID NO: 22049 - DNA, 20 bp, Artificial Sequence
  chemically synthesized
tctatactgtgattcagaca

SEQ ID NO: 22050 - DNA, 20 bp, Artificial Sequence
  chemically synthesized
ctatactgtgattcagacaa

SEQ ID NO: 22051 - DNA, 20 bp, Artificial Sequence
  chemically synthesized
tcagacaaaggccaaaacaa

SEQ ID NO: 22052 - DNA, 20 bp, Artificial Sequence
  chemically synthesized
gacaaaggccaaaacaacag

SEQ ID NO: 22053 - DNA, 20 bp, Artificial Sequence
  chemically synthesized
ccaaaacaacagcagatgaa

SEQ ID NO: 22054 - DNA, 20 bp, Artificial Sequence
  chemically synthesized
caaaacaacagcagatgaat

SEQ ID NO: 22055 - DNA, 20 bp, Artificial Sequence
  chemically synthesized
aaaacaacagcagatgaatg

SEQ ID NO: 22056 - DNA, 20 bp, Artificial Sequence
  chemically synthesized
aacaacagcagatgaatggg

SEQ ID NO: 22057 - DNA, 20 bp, Artificial Sequence
  chemically synthesized
caacagcagatgaatgggga

SEQ ID NO: 22058 - DNA, 20 bp, Artificial Sequence
  chemically synthesized
gggagagaactattttctga

SEQ ID NO: 22059 - DNA, 20 bp, Artificial Sequence
  chemically synthesized
ggagagaactattttctgat

SEQ ID NO: 22060 - DNA, 20 bp, Artificial Sequence
  chemically synthesized
ttctgataggtccatatttt

SEQ ID NO: 22061 - DNA, 20 bp, Artificial Sequence
  chemically synthesized
catattttgagcataatatg

SEQ ID NO: 22062 - DNA, 20 bp, Artificial Sequence
  chemically synthesized
ttgagcataatatgaagact

SEQ ID NO: 22063 - DNA, 20 bp, Artificial Sequence
  chemically synthesized
tgagcataatatgaagactc

SEQ ID NO: 22064 - DNA, 20 bp, Artificial Sequence
  chemically synthesized
gcataatatgaagactcagg

SEQ ID NO: 22065 - DNA, 20 bp, Artificial Sequence
  chemically synthesized
atatgaagactcaggtggaa

SEQ ID NO: 22066 - DNA, 20 bp, Artificial Sequence
  chemically synthesized
gaacctgtaaatgatgctgt

SEQ ID NO: 22067 - DNA, 20 bp, Artificial Sequence
  chemically synthesized
cctgtaaatgatgctgtcag

SEQ ID NO: 22068 - DNA, 20 bp, Artificial Sequence
  chemically synthesized
tgtaaatgatgctgtcagaa

SEQ ID NO: 22069 - DNA, 20 bp, Artificial Sequence
  chemically synthesized
aaatgatgctgtcagaagag

SEQ ID NO: 22070 - DNA, 20 bp, Artificial Sequence
  chemically synthesized
tgatgctgtcagaagagcag

SEQ ID NO: 22071 - DNA, 20 bp, Artificial Sequence
  chemically synthesized
gagcagtggacgcaatgaat

SEQ ID NO: 22072 - DNA, 20 bp, Artificial Sequence
  chemically synthesized
gtggacgcaatgaataagca

SEQ ID NO: 22073 - DNA, 20 bp, Artificial Sequence
  chemically synthesized
caatgaataagcatggctgc

SEQ ID NO: 22074 - DNA, 20 bp, Artificial Sequence
  chemically synthesized
acaggttcacactgttccac

SEQ ID NO: 22075 - DNA, 20 bp, Artificial Sequence
  chemically synthesized
gctgttgttttggcctttgt

SEQ ID NO: 22076 - DNA, 20 bp, Artificial Sequence
  chemically synthesized
gcaatttgtttaaagtaata

SEQ ID NO: 22077 - DNA, 20 bp, Artificial Sequence
  chemically synthesized
taaagtaataagggatggaa

SEQ ID NO: 22078 - DNA, 20 bp, Artificial Sequence
  chemically synthesized
cagatttttaaattagcatt

SEQ ID NO: 22079 - DNA, 20 bp, Artificial Sequence
  chemically synthesized
atttaggatccactaagccc

SEQ ID NO: 22080 - DNA, 20 bp, Artificial Sequence
  chemically synthesized
catattgttaagggacacca

SEQ ID NO: 22081 - DNA, 20 bp, Artificial Sequence
  chemically synthesized
ggtcaaatacctcaaaaaga

SEQ ID NO: 22082 - DNA, 20 bp, Artificial Sequence
  chemically synthesized
aaagagtctgaaaagacaat

SEQ ID NO: 22083 - DNA, 20 bp, Artificial Sequence
  chemically synthesized
cccccagtcatgtaccccct

SEQ ID NO: 22084 - DNA, 20 bp, Artificial Sequence
  chemically synthesized
tgtaagcccttaaaagggac

SEQ ID NO: 22085 - DNA, 20 bp, Artificial Sequence
  chemically synthesized
agagcttggttgttggagat

SEQ ID NO: 22086 - DNA, 20 bp, Artificial Sequence
  chemically synthesized
agtcttgcccaagctcccag

SEQ ID NO: 22087 - DNA, 20 bp, Artificial Sequence
  chemically synthesized
cttctttaactcggtgtctg

SEQ ID NO: 22088 - DNA, 20 bp, Artificial Sequence
  chemically synthesized
tgcagcttgtcctgctacac

SEQ ID NO: 22089 - DNA, 20 bp, Artificial Sequence
  chemically synthesized
aaaacacaaagccacaatat

SEQ ID NO: 22090 - DNA, 20 bp, Artificial Sequence
  chemically synthesized
atttggaaaatatgcacact

SEQ ID NO: 22091 - DNA, 20 bp, Artificial Sequence
  chemically synthesized
catcctgggggaaaattaag

SEQ ID NO: 22092 - DNA, 20 bp, Artificial Sequence
  chemically synthesized
aaaattaaggagagtatgaa

SEQ ID NO: 22093 - DNA, 20 bp, Artificial Sequence
  chemically synthesized
aattagctcatgtgtcaaat

SEQ ID NO: 22094 - DNA, 20 bp, Artificial Sequence
  chemically synthesized
gggaaagacaggctctaaaa

SEQ ID NO: 22095 - DNA, 20 bp, Artificial Sequence
  chemically synthesized
aattagatgtggcctaggca

SEQ ID NO: 22096 - DNA, 20 bp, Artificial Sequence
  chemically synthesized
tgcttctgcaccgcaaaaga

SEQ ID NO: 22097 - DNA, 20 bp, Artificial Sequence
  chemically synthesized
accgcaaaagaccgaatcaa

SEQ ID NO: 22098 - DNA, 20 bp, Artificial Sequence
  chemically synthesized
agaccgaatcaacagagtaa

SEQ ID NO: 22099 - DNA, 20 bp, Artificial Sequence
  chemically synthesized
cagagtaaacggataaccta

SEQ ID NO: 22100 - DNA, 20 bp, Artificial Sequence
  chemically synthesized
agaaaaaaaaattgcaaact

SEQ ID NO: 22101 - DNA, 20 bp, Artificial Sequence
  chemically synthesized
tgcaacaaaaggctaatata

SEQ ID NO: 22102 - DNA, 20 bp, Artificial Sequence
  chemically synthesized
agtgactgtgatggttaata

SEQ ID NO: 22103 - DNA, 20 bp, Artificial Sequence
  chemically synthesized
gtgtcaacttgattggactg

SEQ ID NO: 22104 - DNA, 20 bp, Artificial Sequence
  chemically synthesized
aaggatgcaaagtaatgatc

SEQ ID NO: 22105 - DNA, 20 bp, Artificial Sequence
  chemically synthesized
atgatcttgggtgtgtctgt

SEQ ID NO: 22106 - DNA, 20 bp, Artificial Sequence
  chemically synthesized
aaggcagacccacccttaat

SEQ ID NO: 22107 - DNA, 20 bp, Artificial Sequence
  chemically synthesized
taatcagttgccagcacagc

SEQ ID NO: 22108 - DNA, 20 bp, Artificial Sequence
  chemically synthesized
gcctacatttttctcccatg

SEQ ID NO: 22109 - DNA, 20 bp, Artificial Sequence
  chemically synthesized
ttttgggaccttgtgaacat

SEQ ID NO: 22110 - DNA, 20 bp, Artificial Sequence
  chemically synthesized
ctaatacagattttggtacc

SEQ ID NO: 22111 - DNA, 20 bp, Artificial Sequence
  chemically synthesized
caggagtggttctagaggaa

SEQ ID NO: 22112 - DNA, 20 bp, Artificial Sequence
  chemically synthesized
ttctagaggaacagaatatt

SEQ ID NO: 22113 - DNA, 20 bp, Artificial Sequence
  chemically synthesized
gaggaacagaatattaagga

SEQ ID NO: 22114 - DNA, 20 bp, Artificial Sequence
  chemically synthesized
tggagttctttcattggttt

SEQ ID NO: 22115 - DNA, 20 bp, Artificial Sequence
  chemically synthesized
ttcattggttttggggtttc

SEQ ID NO: 22116 - DNA, 20 bp, Artificial Sequence
  chemically synthesized
tccttggcatcaattgttta

SEQ ID NO: 22117 - DNA, 20 bp, Artificial Sequence
  chemically synthesized
ttcaacgcttgtgagaggca

SEQ ID NO: 22118 - DNA, 20 bp, Artificial Sequence
  chemically synthesized
aatacttttgactatatgtg

SEQ ID NO: 22119 - DNA, 20 bp, Artificial Sequence
  chemically synthesized
tgaaagaaaatgatgaactc

SEQ ID NO: 22120 - DNA, 20 bp, Artificial Sequence
  chemically synthesized
agcaagaagtagcaaacaca

SEQ ID NO: 22121 - DNA, 20 bp, Artificial Sequence
  chemically synthesized
gatgagacatttgtgggaca

SEQ ID NO: 22122 - DNA, 20 bp, Artificial Sequence
  chemically synthesized
tctacctcagtaaaatttat

SEQ ID NO: 22123 - DNA, 20 bp, Artificial Sequence
  chemically synthesized
gagatattccttctaaagtg

SEQ ID NO: 22124 - DNA, 20 bp, Artificial Sequence
  chemically synthesized
acaacgcctagtgggcctat

SEQ ID NO: 22125 - DNA, 20 bp, Artificial Sequence
  chemically synthesized
ggaggcaacatattcctgat

SEQ ID NO: 22126 - DNA, 20 bp, Artificial Sequence
  chemically synthesized
gtgttactctggcccattta

SEQ ID NO: 22127 - DNA, 20 bp, Artificial Sequence
  chemically synthesized
gatccaaaaggctgccagtt

SEQ ID NO: 22128 - DNA, 20 bp, Artificial Sequence
  chemically synthesized
aaaaggctgccagttttgag

SEQ ID NO: 22129 - DNA, 20 bp, Artificial Sequence
  chemically synthesized
ttgaggtgtcagtgccagat

SEQ ID NO: 22130 - DNA, 20 bp, Artificial Sequence
  chemically synthesized
tgtttggagcatttggcagg

SEQ ID NO: 22131 - DNA, 20 bp, Artificial Sequence
  chemically synthesized
tgaatcacagcggaggcctc

SEQ ID NO: 22132 - DNA, 20 bp, Artificial Sequence
  chemically synthesized
tggaaacgaaatatttgact

SEQ ID NO: 22133 - DNA, 20 bp, Artificial Sequence
  chemically synthesized
cctgaactgcctatcatgaa

SEQ ID NO: 22134 - DNA, 20 bp, Artificial Sequence
  chemically synthesized
actgcaccgatggtctcatg

SEQ ID NO: 22135 - DNA, 20 bp, Artificial Sequence
  chemically synthesized
gaaatttggggaagaggtat

SEQ ID NO: 22136 - DNA, 20 bp, Artificial Sequence
  chemically synthesized
caaagatattttcatcccat

SEQ ID NO: 22137 - DNA, 20 bp, Artificial Sequence
  chemically synthesized
tcccatgtgagtgctcacca

SEQ ID NO: 22138 - DNA, 20 bp, Artificial Sequence
  chemically synthesized
aatgggtgacctcagcagaa

SEQ ID NO: 22139 - DNA, 20 bp, Artificial Sequence
  chemically synthesized
aagaggattttaataatcaa

SEQ ID NO: 22140 - DNA, 20 bp, Artificial Sequence
  chemically synthesized
gattttaataatcaagtgga

SEQ ID NO: 22141 - DNA, 20 bp, Artificial Sequence
  chemically synthesized
aacaaagtggccacagttgc

SEQ ID NO: 22142 - DNA, 20 bp, Artificial Sequence
  chemically synthesized
cttgatatggcaccattcct

SEQ ID NO: 22143 - DNA, 20 bp, Artificial Sequence
  chemically synthesized
gggcagaggcttgtcctcac

SEQ ID NO: 22144 - DNA, 20 bp, Artificial Sequence
  chemically synthesized
cactggaatagacacttact

SEQ ID NO: 22145 - DNA, 20 bp, Artificial Sequence
  chemically synthesized
aatagacacttactctggat

SEQ ID NO: 22146 - DNA, 20 bp, Artificial Sequence
  chemically synthesized
tatgccaagactaccatcca

SEQ ID NO: 22147 - DNA, 20 bp, Artificial Sequence
  chemically synthesized
gactaccatccatggaatca

SEQ ID NO: 22148 - DNA, 20 bp, Artificial Sequence
  chemically synthesized
tgacagtgggctcatgctca

SEQ ID NO: 22149 - DNA, 20 bp, Artificial Sequence
  chemically synthesized
ctatcatcctgaagcagctt

SEQ ID NO: 22150 - DNA, 20 bp, Artificial Sequence
  chemically synthesized
tccagaaggctgtgtatgct

SEQ ID NO: 22151 - DNA, 20 bp, Artificial Sequence
  chemically synthesized
ggtactgtttctcccataga

SEQ ID NO: 22152 - DNA, 20 bp, Artificial Sequence
  chemically synthesized
ttctcccatagacaggattc

SEQ ID NO: 22153 - DNA, 20 bp, Artificial Sequence
  chemically synthesized
tagacaggattcacgggtcc

SEQ ID NO: 22154 - DNA, 20 bp, Artificial Sequence
  chemically synthesized
attcacgggtccaggaatca

SEQ ID NO: 22155 - DNA, 20 bp, Artificial Sequence
  chemically synthesized
ttaagtcaacaggctaagaa

SEQ ID NO: 22156 - DNA, 20 bp, Artificial Sequence
  chemically synthesized
gaggtaaggaagcgtatgca

SEQ ID NO: 22157 - DNA, 20 bp, Artificial Sequence
  chemically synthesized
atggaatataggagatccat

SEQ ID NO: 22158 - DNA, 20 bp, Artificial Sequence
  chemically synthesized
ctcttagttttaccatgtcc

SEQ ID NO: 22159 - DNA, 20 bp, Artificial Sequence
  chemically synthesized
gcaggactacaaataaaggt

SEQ ID NO: 22160 - DNA, 20 bp, Artificial Sequence
  chemically synthesized
aggtgcttgctgagggcaaa

SEQ ID NO: 22161 - DNA, 20 bp, Artificial Sequence
  chemically synthesized
tgctgagggcaaagggaata

SEQ ID NO: 22162 - DNA, 20 bp, Artificial Sequence
  chemically synthesized
atacaaggactgtaattgtc

SEQ ID NO: 22163 - DNA, 20 bp, Artificial Sequence
  chemically synthesized
tatgtaatagcatttgcaat

SEQ ID NO: 22164 - DNA, 20 bp, Artificial Sequence
  chemically synthesized
ggtgcattttcaattgcacg

SEQ ID NO: 22165 - DNA, 20 bp, Artificial Sequence
  chemically synthesized
gaagataatgtatgacctca

SEQ ID NO: 22166 - DNA, 20 bp, Artificial Sequence
  chemically synthesized
tggacttgtgatggttaata

SEQ ID NO: 22167 - DNA, 20 bp, Artificial Sequence
  chemically synthesized
aatactgagtgtcaacttga

SEQ ID NO: 22168 - DNA, 20 bp, Artificial Sequence
  chemically synthesized
aagtgtgcaaagtattgatc

SEQ ID NO: 22169 - DNA, 20 bp, Artificial Sequence
  chemically synthesized
ttgatcctgagtgtgtctgt

SEQ ID NO: 22170 - DNA, 20 bp, Artificial Sequence
  chemically synthesized
aaggcagacccacccttaat

SEQ ID NO: 22171 - DNA, 20 bp, Artificial Sequence
  chemically synthesized
taatcagttgccagtgtggc

SEQ ID NO: 22172 - DNA, 20 bp, Artificial Sequence
  chemically synthesized
gcctacatctttctcccatg

SEQ ID NO: 22173 - DNA, 20 bp, Artificial Sequence
  chemically synthesized
ttcaacatcactaataatca

SEQ ID NO: 22174 - DNA, 20 bp, Artificial Sequence
  chemically synthesized
tgatacctccttatgccagt

SEQ ID NO: 22175 - DNA, 20 bp, Artificial Sequence
  chemically synthesized
caaaaacagcagatgttggt

SEQ ID NO: 22176 - DNA, 20 bp, Artificial Sequence
  chemically synthesized
aatgcttatacactgttggt

SEQ ID NO: 22177 - DNA, 20 bp, Artificial Sequence
  chemically synthesized
tcaatcctgcaatcccacta

SEQ ID NO: 22178 - DNA, 20 bp, Artificial Sequence
  chemically synthesized
tgttcccaatagcaaagata

SEQ ID NO: 22179 - DNA, 20 bp, Artificial Sequence
  chemically synthesized
aaatgtctaccaatggacga

SEQ ID NO: 22180 - DNA, 20 bp, Artificial Sequence
  chemically synthesized
tatattactcagccataaaa

SEQ ID NO: 22181 - DNA, 20 bp, Artificial Sequence
  chemically synthesized
agccaagtgggagctaaacg

SEQ ID NO: 22182 - DNA, 20 bp, Artificial Sequence
  chemically synthesized
gatgagtaagcatagacata

SEQ ID NO: 22183 - DNA, 20 bp, Artificial Sequence
  chemically synthesized
ttgagactagagaaaggtgg

SEQ ID NO: 22184 - DNA, 20 bp, Artificial Sequence
  chemically synthesized
ctagagaaaggtgggaggat

SEQ ID NO: 22185 - DNA, 20 bp, Artificial Sequence
  chemically synthesized
atggtgaggactgaaaaact

SEQ ID NO: 22186 - DNA, 20 bp, Artificial Sequence
  chemically synthesized
gaggactgaaaaactacgga

SEQ ID NO: 22187 - DNA, 20 bp, Artificial Sequence
  chemically synthesized
gtccccacccaaatctcatc

SEQ ID NO: 22188 - DNA, 20 bp, Artificial Sequence
  chemically synthesized
taatcctcacgtgttgtggg

SEQ ID NO: 22189 - DNA, 20 bp, Artificial Sequence
  chemically synthesized
agggatttggagggaggtaa

SEQ ID NO: 22190 - DNA, 20 bp, Artificial Sequence
  chemically synthesized
ctcatgctcttctcgtgata

SEQ ID NO: 22191 - DNA, 20 bp, Artificial Sequence
  chemically synthesized
gcaagcaaaatatcacttaa

SEQ ID NO: 22192 - DNA, 20 bp, Artificial Sequence
  chemically synthesized
tcacttaatggggtaattaa

SEQ ID NO: 22193 - DNA, 20 bp, Artificial Sequence
  chemically synthesized
agggtgaagaaattgggcaa

SEQ ID NO: 22194 - DNA, 20 bp, Artificial Sequence
  chemically synthesized
ggcaaatggatgtcatgagg

SEQ ID NO: 22195 - DNA, 20 bp, Artificial Sequence
  chemically synthesized
tcagagcccaggccctaagc

SEQ ID NO: 22196 - DNA, 20 bp, Artificial Sequence
  chemically synthesized
gcccaggccctaagctggag

SEQ ID NO: 22197 - DNA, 20 bp, Artificial Sequence
  chemically synthesized
tggagtagagtgtgcaagga

SEQ ID NO: 22198 - DNA, 20 bp, Artificial Sequence
  chemically synthesized
agtgtgcaaggaaagagtaa

SEQ ID NO: 22199 - DNA, 20 bp, Artificial Sequence
  chemically synthesized
gaaagagtaataggattgaa

SEQ ID NO: 22200 - DNA, 20 bp, Artificial Sequence
  chemically synthesized
ccaggtaggaggacataggg

SEQ ID NO: 22201 - DNA, 20 bp, Artificial Sequence
  chemically synthesized
agacctccagtaaacttagg

SEQ ID NO: 22202 - DNA, 20 bp, Artificial Sequence
  chemically synthesized
actaaataataatcacatgt

SEQ ID NO: 22203 - DNA, 20 bp, Artificial Sequence
  chemically synthesized
ttgttcatgagctagagcaa

SEQ ID NO: 22204 - DNA, 20 bp, Artificial Sequence
  chemically synthesized
atgctattatatggtaccaa

SEQ ID NO: 22205 - DNA, 20 bp, Artificial Sequence
  chemically synthesized
aaaatgcaagcaattttcat

SEQ ID NO: 22206 - DNA, 20 bp, Artificial Sequence
  chemically synthesized
tacacaagctaattgtcctt

SEQ ID NO: 22207 - DNA, 20 bp, Artificial Sequence
  chemically synthesized
aagtttaaactgtcattgag

SEQ ID NO: 22208 - DNA, 20 bp, Artificial Sequence
  chemically synthesized
cagatgttatgtgatgagga

SEQ ID NO: 22209 - DNA, 20 bp, Artificial Sequence
  chemically synthesized
agaacttttctttaaagtgt

SEQ ID NO: 22210 - DNA, 20 bp, Artificial Sequence
  chemically synthesized
acaaaaatgcaaaatttcca

SEQ ID NO: 22211 - DNA, 20 bp, Artificial Sequence
  chemically synthesized
ttcatcttcatcttttccag

SEQ ID NO: 22212 - DNA, 20 bp, Artificial Sequence
  chemically synthesized
gatagtcccccatatagcct

SEQ ID NO: 22213 - DNA, 20 bp, Artificial Sequence
  chemically synthesized
gtagaaaatcccacataaga

SEQ ID NO: 22214 - DNA, 20 bp, Artificial Sequence
  chemically synthesized
tcccacataagagagaattc

SEQ ID NO: 22215 - DNA, 20 bp, Artificial Sequence
  chemically synthesized
agcaaggaagcctacccagt

SEQ ID NO: 22216 - DNA, 20 bp, Artificial Sequence
  chemically synthesized
acatctgcattatggactcc

SEQ ID NO: 22217 - DNA, 20 bp, Artificial Sequence
  chemically synthesized
tccaggaatcctagccacag

SEQ ID NO: 22218 - DNA, 20 bp, Artificial Sequence
  chemically synthesized
ctccagagaaggagctctca

SEQ ID NO: 22219 - DNA, 20 bp, Artificial Sequence
  chemically synthesized
ctgacatcccccacccacag

SEQ ID NO: 22220 - DNA, 20 bp, Artificial Sequence
  chemically synthesized
tactgctggctgctgtcacc

SEQ ID NO: 22221 - DNA, 20 bp, Artificial Sequence
  chemically synthesized
aggcattctgctgggggcct

SEQ ID NO: 22222 - DNA, 20 bp, Artificial Sequence
  chemically synthesized
gccggtgtccacacacacca

SEQ ID NO: 22223 - DNA, 20 bp, Artificial Sequence
  chemically synthesized
acctcctgcatgtgccacct

SEQ ID NO: 22224 - DNA, 20 bp, Artificial Sequence
  chemically synthesized
tgcagactgcttgggagcca

SEQ ID NO: 22225 - DNA, 20 bp, Artificial Sequence
  chemically synthesized
agcaaactgcctgaaggcca

SEQ ID NO: 22226 - DNA, 20 bp, Artificial Sequence
  chemically synthesized
cagccatggggcccaaggac

SEQ ID NO: 22227 - DNA, 20 bp, Artificial Sequence
  chemically synthesized
aagaaatatgacacttccaa

SEQ ID NO: 22228 - DNA, 20 bp, Artificial Sequence
  chemically synthesized
atttataaaattctggaaaa

SEQ ID NO: 22229 - DNA, 20 bp, Artificial Sequence
  chemically synthesized
aagaaatcagaaaaacaatt

SEQ ID NO: 22230 - DNA, 20 bp, Artificial Sequence
  chemically synthesized
tcagaaaaacaattcaggat

SEQ ID NO: 22231 - DNA, 20 bp, Artificial Sequence
  chemically synthesized
acccaagagatagatacaac

SEQ ID NO: 22232 - DNA, 20 bp, Artificial Sequence
  chemically synthesized
aaacagaaattctgtaactg

SEQ ID NO: 22233 - DNA, 20 bp, Artificial Sequence
  chemically synthesized
aatgatagaaaggaaaaaaa

SEQ ID NO: 22234 - DNA, 20 bp, Artificial Sequence
  chemically synthesized
agtcaaactgtcaaaagcca

SEQ ID NO: 22235 - DNA, 20 bp, Artificial Sequence
  chemically synthesized
cctcacaggccaggagaaga

SEQ ID NO: 22236 - DNA, 20 bp, Artificial Sequence
  chemically synthesized
tgaaagaaaaaaatgacacc

SEQ ID NO: 22237 - DNA, 20 bp, Artificial Sequence
  chemically synthesized
aacattgttcttcaaaaatg

SEQ ID NO: 22238 - DNA, 20 bp, Artificial Sequence
  chemically synthesized
tctgggcaagaaaaatttga

SEQ ID NO: 22239 - DNA, 20 bp, Artificial Sequence
  chemically synthesized
gctttacaagaaatatttaa

SEQ ID NO: 22240 - DNA, 20 bp, Artificial Sequence
  chemically synthesized
gaaagaaagagagagagaga

SEQ ID NO: 22241 - DNA, 20 bp, Artificial Sequence
  chemically synthesized
aaaaaaaaaacaaaacaacc

SEQ ID NO: 22242 - DNA, 20 bp, Artificial Sequence
  chemically synthesized
gaatcaattaacaaaatggc

SEQ ID NO: 22243 - DNA, 20 bp, Artificial Sequence
  chemically synthesized
aataatagccttgcatgtaa

SEQ ID NO: 22244 - DNA, 20 bp, Artificial Sequence
  chemically synthesized
gataaaaggaacaattcagc

SEQ ID NO: 22245 - DNA, 20 bp, Artificial Sequence
  chemically synthesized
agcaaatgttattagatata

SEQ ID NO: 22246 - DNA, 20 bp, Artificial Sequence
  chemically synthesized
attagatataaagggtgaaa

SEQ ID NO: 22247 - DNA, 20 bp, Artificial Sequence
  chemically synthesized
aatccaatacaataatagtt

SEQ ID NO: 22248 - DNA, 20 bp, Artificial Sequence
  chemically synthesized
agaaaattaacaaagaaaca

SEQ ID NO: 22249 - DNA, 20 bp, Artificial Sequence
  chemically synthesized
taaacttgactttagaccaa

SEQ ID NO: 22250 - DNA, 20 bp, Artificial Sequence
  chemically synthesized
aatatttcatccaacagcta

SEQ ID NO: 22251 - DNA, 20 bp, Artificial Sequence
  chemically synthesized
tcagcacatgacgcattccc

SEQ ID NO: 22252 - DNA, 20 bp, Artificial Sequence
  chemically synthesized
agcatcttctcagaccacaa

SEQ ID NO: 22253 - DNA, 20 bp, Artificial Sequence
  chemically synthesized
ggaaattaaacaacatgctc

SEQ ID NO: 22254 - DNA, 20 bp, Artificial Sequence
  chemically synthesized
atacaacataggaaaagcca

SEQ ID NO: 22255 - DNA, 20 bp, Artificial Sequence
  chemically synthesized
aatagagaaaaacaacaaca

SEQ ID NO: 22256 - DNA, 20 bp, Artificial Sequence
  chemically synthesized
tgttatttaaaaaagataaa

SEQ ID NO: 22257 - DNA, 20 bp, Artificial Sequence
  chemically synthesized
acacataccacctaccaaga

SEQ ID NO: 22258 - DNA, 20 bp, Artificial Sequence
  chemically synthesized
ctaccaagattgaattaaga

SEQ ID NO: 22259 - DNA, 20 bp, Artificial Sequence
  chemically synthesized
aaaacctgaacagaccagta

SEQ ID NO: 22260 - DNA, 20 bp, Artificial Sequence
  chemically synthesized
accagtaatgaataatgaaa

SEQ ID NO: 22261 - DNA, 20 bp, Artificial Sequence
  chemically synthesized
cttttaaaaattaaacagga

SEQ ID NO: 22262 - DNA, 20 bp, Artificial Sequence
  chemically synthesized
tcctgattccataaccagac

SEQ ID NO: 22263 - DNA, 20 bp, Artificial Sequence
  chemically synthesized
ctcaacaaaatactagcaaa

SEQ ID NO: 22264 - DNA, 20 bp, Artificial Sequence
  chemically synthesized
gataatacaccatgatcaag

SEQ ID NO: 22265 - DNA, 20 bp, Artificial Sequence
  chemically synthesized
tgatcaagtgggatttatac

SEQ ID NO: 22266 - DNA, 20 bp, Artificial Sequence
  chemically synthesized
aacccacagctaacatcata

SEQ ID NO: 22267 - DNA, 20 bp, Artificial Sequence
  chemically synthesized
tctaagaactgaaacaaaat

SEQ ID NO: 22268 - DNA, 20 bp, Artificial Sequence
  chemically synthesized
agctaaaaaataaaatattt

SEQ ID NO: 22269 - DNA, 20 bp, Artificial Sequence
  chemically synthesized
aaactacaaaacactgataa

SEQ ID NO: 22270 - DNA, 20 bp, Artificial Sequence
  chemically synthesized
tggagagatatcctatgttc

SEQ ID NO: 22271 - DNA, 20 bp, Artificial Sequence
  chemically synthesized
agacacttagaccaatggaa

SEQ ID NO: 22272 - DNA, 20 bp, Artificial Sequence
  chemically synthesized
agattttcaacaaaggtgac

SEQ ID NO: 22273 - DNA, 20 bp, Artificial Sequence
  chemically synthesized
aagaaatggtgctgaaaaaa

SEQ ID NO: 22274 - DNA, 20 bp, Artificial Sequence
  chemically synthesized
ctgaaaaaattggatatcca

SEQ ID NO: 22275 - DNA, 20 bp, Artificial Sequence
  chemically synthesized
cattggatatccatgtgcaa

SEQ ID NO: 22276 - DNA, 20 bp, Artificial Sequence
  chemically synthesized
aactggactgctgatatggt

SEQ ID NO: 22277 - DNA, 20 bp, Artificial Sequence
  chemically synthesized
aaatataatccccaacttct

SEQ ID NO: 22278 - DNA, 20 bp, Artificial Sequence
  chemically synthesized
cccaacttctcaggatcttg

SEQ ID NO: 22279 - DNA, 20 bp, Artificial Sequence
  chemically synthesized
agcatgtggaggctcgcatt

SEQ ID NO: 22280 - DNA, 20 bp, Artificial Sequence
  chemically synthesized
caggagacaccccaaatact

SEQ ID NO: 22281 - DNA, 20 bp, Artificial Sequence
  chemically synthesized
gagaagtttctgaccttacc

SEQ ID NO: 22282 - DNA, 20 bp, Artificial Sequence
  chemically synthesized
gtttctgaccttacctggag

SEQ ID NO: 22283 - DNA, 20 bp, Artificial Sequence
  chemically synthesized
agaaaggccctgggagctca

SEQ ID NO: 22284 - DNA, 20 bp, Artificial Sequence
  chemically synthesized
aggcatttacattactaaca

SEQ ID NO: 22285 - DNA, 20 bp, Artificial Sequence
  chemically synthesized
ggcctaaatgctccacttaa

SEQ ID NO: 22286 - DNA, 20 bp, Artificial Sequence
  chemically synthesized
catgcaaatggccaccaaaa

SEQ ID NO: 22287 - DNA, 20 bp, Artificial Sequence
  chemically synthesized
agaaagtcaacaaaaaaata

SEQ ID NO: 22288 - DNA, 20 bp, Artificial Sequence
  chemically synthesized
aaaaaaaagttcaggaccag

SEQ ID NO: 22289 - DNA, 20 bp, Artificial Sequence
  chemically synthesized
aggaccagatggattcacaa

SEQ ID NO: 22290 - DNA, 20 bp, Artificial Sequence
  chemically synthesized
attctactagacattcaaag

SEQ ID NO: 22291 - DNA, 20 bp, Artificial Sequence
  chemically synthesized
gatcaagcaggttccatgcc

SEQ ID NO: 22292 - DNA, 20 bp, Artificial Sequence
  chemically synthesized
caggttccatgccagggatg

SEQ ID NO: 22293 - DNA, 20 bp, Artificial Sequence
  chemically synthesized
aacccacagccaacataata

SEQ ID NO: 22294 - DNA, 20 bp, Artificial Sequence
  chemically synthesized
tctgagaactggaacaagac

SEQ ID NO: 22295 - DNA, 20 bp, Artificial Sequence
  chemically synthesized
gcaaagtttccagatacaag

SEQ ID NO: 22296 - DNA, 20 bp, Artificial Sequence
  chemically synthesized
acaccaacagcaaccaaatg

SEQ ID NO: 22297 - DNA, 20 bp, Artificial Sequence
  chemically synthesized
atataaaacgtactctcaag

SEQ ID NO: 22298 - DNA, 20 bp, Artificial Sequence
  chemically synthesized
cacagtgaagagacaagctg

SEQ ID NO: 22299 - DNA, 20 bp, Artificial Sequence
  chemically synthesized
atatttgcatacatttgaca

SEQ ID NO: 22300 - DNA, 20 bp, Artificial Sequence
  chemically synthesized
tttgacaaggaattaatctc

SEQ ID NO: 22301 - DNA, 20 bp, Artificial Sequence
  chemically synthesized
atctcattaaaaaattggca

SEQ ID NO: 22302 - DNA, 20 bp, Artificial Sequence
  chemically synthesized
agaagacatacaaatgcaca

SEQ ID NO: 22303 - DNA, 20 bp, Artificial Sequence
  chemically synthesized
agatatcatcttatgccagt

SEQ ID NO: 22304 - DNA, 20 bp, Artificial Sequence
  chemically synthesized
aataaataacacatgctggc

SEQ ID NO: 22305 - DNA, 20 bp, Artificial Sequence
  chemically synthesized
aagatccagcaatcttatta

SEQ ID NO: 22306 - DNA, 20 bp, Artificial Sequence
  chemically synthesized
tgggtatttatccaaaggaa

SEQ ID NO: 22307 - DNA, 20 bp, Artificial Sequence
  chemically synthesized
ttatccaaaggaaaagaatt

SEQ ID NO: 22308 - DNA, 20 bp, Artificial Sequence
  chemically synthesized
gattcacattagcaaagata

SEQ ID NO: 22309 - DNA, 20 bp, Artificial Sequence
  chemically synthesized
atcaacctaagtgtccatca

SEQ ID NO: 22310 - DNA, 20 bp, Artificial Sequence
  chemically synthesized
acctaagtgtccatcaatgg

SEQ ID NO: 22311 - DNA, 20 bp, Artificial Sequence
  chemically synthesized
aatgtggtgtatacacacaa

SEQ ID NO: 22312 - DNA, 20 bp, Artificial Sequence
  chemically synthesized
atcatttcatttgcagcaac

SEQ ID NO: 22313 - DNA, 20 bp, Artificial Sequence
  chemically synthesized
aagttaatatcatgtaggta

SEQ ID NO: 22314 - DNA, 20 bp, Artificial Sequence
  chemically synthesized
aatatcatgtaggtagagag

SEQ ID NO: 22315 - DNA, 20 bp, Artificial Sequence
  chemically synthesized
gaaacaggcagttagataga

SEQ ID NO: 22316 - DNA, 20 bp, Artificial Sequence
  chemically synthesized
tctgatgttcaatagcaaag

SEQ ID NO: 22317 - DNA, 20 bp, Artificial Sequence
  chemically synthesized
aacgataaatacttgaggtg

SEQ ID NO: 22318 - DNA, 20 bp, Artificial Sequence
  chemically synthesized
aaacttctctcttaacaagc

SEQ ID NO: 22319 - DNA, 20 bp, Artificial Sequence
  chemically synthesized
cttaacaagctagaatataa

SEQ ID NO: 22320 - DNA, 20 bp, Artificial Sequence
  chemically synthesized
tgaatgcaagagcatagaga

SEQ ID NO: 22321 - DNA, 20 bp, Artificial Sequence
  chemically synthesized
gaaaatacttaatatcatta

SEQ ID NO: 22322 - DNA, 20 bp, Artificial Sequence
  chemically synthesized
ttttaccacagcgtaggtca

SEQ ID NO: 22323 - DNA, 20 bp, Artificial Sequence
  chemically synthesized
atcactatttcaaagaagta

SEQ ID NO: 22324 - DNA, 20 bp, Artificial Sequence
  chemically synthesized
gaatagatatcagccaaaat

SEQ ID NO: 22325 - DNA, 20 bp, Artificial Sequence
  chemically synthesized
aggggcctagacatagcatg

SEQ ID NO: 22326 - DNA, 20 bp, Artificial Sequence
  chemically synthesized
gcatgctgaatgaaaaggaa

SEQ ID NO: 22327 - DNA, 20 bp, Artificial Sequence
  chemically synthesized
tgagctaacttcctcatttt

SEQ ID NO: 22328 - DNA, 20 bp, Artificial Sequence
  chemically synthesized
aagaaataagctaataccta

SEQ ID NO: 22329 - DNA, 20 bp, Artificial Sequence
  chemically synthesized
attaaatgctaggcacagtt

SEQ ID NO: 22330 - DNA, 20 bp, Artificial Sequence
  chemically synthesized
caacattacccaggtgatgg

SEQ ID NO: 22331 - DNA, 20 bp, Artificial Sequence
  chemically synthesized
tacccaggtgatggtggagt

SEQ ID NO: 22332 - DNA, 20 bp, Artificial Sequence
  chemically synthesized
gacagcaagatagtaagtaa

SEQ ID NO: 22333 - DNA, 20 bp, Artificial Sequence
  chemically synthesized
aggaatggagcaacaaattg

SEQ ID NO: 22334 - DNA, 20 bp, Artificial Sequence
  chemically synthesized
ttttgcttgtttgtttgaaa

SEQ ID NO: 22335 - DNA, 20 bp, Artificial Sequence
  chemically synthesized
tctcactctgtcaccccggc

SEQ ID NO: 22336 - DNA, 20 bp, Artificial Sequence
  chemically synthesized
ctgaagcctcactagaacgc

SEQ ID NO: 22337 - DNA, 20 bp, Artificial Sequence
  chemically synthesized
tttttaaatttctgtagaaa

SEQ ID NO: 22338 - DNA, 20 bp, Artificial Sequence
  chemically synthesized
aaagtgttgagattacaggt

SEQ ID NO: 22339 - DNA, 20 bp, Artificial Sequence
  chemically synthesized
aatcaccatgctgggccttg

SEQ ID NO: 22340 - DNA, 20 bp, Artificial Sequence
  chemically synthesized
atggatctttaaaagtggtg

SEQ ID NO: 22341 - DNA, 20 bp, Artificial Sequence
  chemically synthesized
aaacatcgttaggtctcggg

SEQ ID NO: 22342 - DNA, 20 bp, Artificial Sequence
  chemically synthesized
tcgttaggtctcgggaagga

SEQ ID NO: 22343 - DNA, 20 bp, Artificial Sequence
  chemically synthesized
tctgtgttaacaaaaaacag

SEQ ID NO: 22344 - DNA, 20 bp, Artificial Sequence
  chemically synthesized
tctgaaggtttagaaactcc

SEQ ID NO: 22345 - DNA, 20 bp, Artificial Sequence
  chemically synthesized
ctttagaactcctgtcctag

SEQ ID NO: 22346 - DNA, 20 bp, Artificial Sequence
  chemically synthesized
accactttgactctagtttt

SEQ ID NO: 22347 - DNA, 20 bp, Artificial Sequence
  chemically synthesized
ccttaacatgttaatttctc

SEQ ID NO: 22348 - DNA, 20 bp, Artificial Sequence
  chemically synthesized
agtaagacctgggcaaagga

SEQ ID NO: 22349 - DNA, 20 bp, Artificial Sequence
  chemically synthesized
tttgggcaaaactttccatc

SEQ ID NO: 22350 - DNA, 20 bp, Artificial Sequence
  chemically synthesized
acttagtacttcccactact

SEQ ID NO: 22351 - DNA, 20 bp, Artificial Sequence
  chemically synthesized
gtacttcccactactgtgga

SEQ ID NO: 22352 - DNA, 20 bp, Artificial Sequence
  chemically synthesized
tttgtcaattcttgaagatt

SEQ ID NO: 22353 - DNA, 20 bp, Artificial Sequence
  chemically synthesized
tgatacctaatagacacttg

SEQ ID NO: 22354 - DNA, 20 bp, Artificial Sequence
  chemically synthesized
agacacttgatgaatcctta

SEQ ID NO: 22355 - DNA, 20 bp, Artificial Sequence
  chemically synthesized
aatccttactgaataataaa

SEQ ID NO: 22356 - DNA, 20 bp, Artificial Sequence
  chemically synthesized
ctgaataataaaatggatta

SEQ ID NO: 22357 - DNA, 20 bp, Artificial Sequence
  chemically synthesized
aaaaggttattttgaagtct

SEQ ID NO: 22358 - DNA, 20 bp, Artificial Sequence
  chemically synthesized
tgggcaaaattctggcagca

SEQ ID NO: 22359 - DNA, 20 bp, Artificial Sequence
  chemically synthesized
ctaagaaaccttttgttttc

SEQ ID NO: 22360 - DNA, 20 bp, Artificial Sequence
  chemically synthesized
aaccttttgttttcttggat

SEQ ID NO: 22361 - DNA, 20 bp, Artificial Sequence
  chemically synthesized
aaaacatggtaagataactg

SEQ ID NO: 22362 - DNA, 20 bp, Artificial Sequence
  chemically synthesized
agaaactgttattcagttta

SEQ ID NO: 22363 - DNA, 20 bp, Artificial Sequence
  chemically synthesized
tcttacataatagtaaaaaa

SEQ ID NO: 22364 - DNA, 20 bp, Artificial Sequence
  chemically synthesized
cttgatcattaaatacctct

SEQ ID NO: 22365 - DNA, 20 bp, Artificial Sequence
  chemically synthesized
caatttgctctatgaactgg

SEQ ID NO: 22366 - DNA, 20 bp, Artificial Sequence
  chemically synthesized
tgctctatgaactggaggag

SEQ ID NO: 22367 - DNA, 20 bp, Artificial Sequence
  chemically synthesized
tatagtggcaatgtattatt

SEQ ID NO: 22368 - DNA, 20 bp, Artificial Sequence
  chemically synthesized
ataagtattaaaggcagctt

SEQ ID NO: 22369 - DNA, 20 bp, Artificial Sequence
  chemically synthesized
ttttatttcaaggcatactc

SEQ ID NO: 22370 - DNA, 20 bp, Artificial Sequence
  chemically synthesized
ttaaaaacacatgctcattt

SEQ ID NO: 22371 - DNA, 20 bp, Artificial Sequence
  chemically synthesized
ggataaagatctctgaggaa

SEQ ID NO: 22372 - DNA, 20 bp, Artificial Sequence
  chemically synthesized
ttctttctcactaaactaca

SEQ ID NO: 22373 - DNA, 20 bp, Artificial Sequence
  chemically synthesized
tgacttttaattttgatttt

SEQ ID NO: 22374 - DNA, 20 bp, Artificial Sequence
  chemically synthesized
ctttgaacagttagtataag

SEQ ID NO: 22375 - DNA, 20 bp, Artificial Sequence
  chemically synthesized
taaggtgaattctgattttt

SEQ ID NO: 22376 - DNA, 20 bp, Artificial Sequence
  chemically synthesized
gtcttgacacttttaaacta

SEQ ID NO: 22377 - DNA, 20 bp, Artificial Sequence
  chemically synthesized
ctagagagtataaacccaca

SEQ ID NO: 22378 - DNA, 20 bp, Artificial Sequence
  chemically synthesized
ttttgccttttgagaagctc

SEQ ID NO: 22379 - DNA, 20 bp, Artificial Sequence
  chemically synthesized
acattaattccaagctaatt

SEQ ID NO: 22380 - DNA, 20 bp, Artificial Sequence
  chemically synthesized
gcatttcatataattactaa

SEQ ID NO: 22381 - DNA, 20 bp, Artificial Sequence
  chemically synthesized
atataattactaacagaatg

SEQ ID NO: 22382 - DNA, 20 bp, Artificial Sequence
  chemically synthesized
tatttctatgttgtcataat

SEQ ID NO: 22383 - DNA, 20 bp, Artificial Sequence
  chemically synthesized
ctagcaattggttatcacta

SEQ ID NO: 22384 - DNA, 20 bp, Artificial Sequence
  chemically synthesized
cccactggggaagcccaccc

SEQ ID NO: 22385 - DNA, 20 bp, Artificial Sequence
  chemically synthesized
cacccagggatgttacagag

SEQ ID NO: 22386 - DNA, 20 bp, Artificial Sequence
  chemically synthesized
tacagtcctccgagactcct

SEQ ID NO: 22387 - DNA, 20 bp, Artificial Sequence
  chemically synthesized
gaacttacaggcacaaaagt

SEQ ID NO: 22388 - DNA, 20 bp, Artificial Sequence
  chemically synthesized
ggcacaaaagttagagttgg

SEQ ID NO: 22389 - DNA, 20 bp, Artificial Sequence
  chemically synthesized
aggctttggtagcttctctt

SEQ ID NO: 22390 - DNA, 20 bp, Artificial Sequence
  chemically synthesized
gaaatcttatgtgcttccca

SEQ ID NO: 22391 - DNA, 20 bp, Artificial Sequence
  chemically synthesized
acagaattcctggtggaagg

SEQ ID NO: 22392 - DNA, 20 bp, Artificial Sequence
  chemically synthesized
gaaagacgagaaagaggagg

SEQ ID NO: 22393 - DNA, 20 bp, Artificial Sequence
  chemically synthesized
gaagaattcctccttccacc

SEQ ID NO: 22394 - DNA, 20 bp, Artificial Sequence
  chemically synthesized
gcctgtaagttctcttctcc

SEQ ID NO: 22395 - DNA, 20 bp, Artificial Sequence
  chemically synthesized
ggattacaactaattgaaac

SEQ ID NO: 22396 - DNA, 20 bp, Artificial Sequence
  chemically synthesized
taattgaaacaggaattcaa

SEQ ID NO: 22397 - DNA, 20 bp, Artificial Sequence
  chemically synthesized
gagtctcggaggactgtaag

SEQ ID NO: 22398 - DNA, 20 bp, Artificial Sequence
  chemically synthesized
gatccctctctgtaacatcc

SEQ ID NO: 22399 - DNA, 20 bp, Artificial Sequence
  chemically synthesized
agtcgaagaacttcctgtgg

SEQ ID NO: 22400 - DNA, 20 bp, Artificial Sequence
  chemically synthesized
ggtttgtactgctcctgaag

SEQ ID NO: 22401 - DNA, 20 bp, Artificial Sequence
  chemically synthesized
acaccttcactaggtgactg

SEQ ID NO: 22402 - DNA, 20 bp, Artificial Sequence
  chemically synthesized
cactaggtgactgaggaatg

SEQ ID NO: 22403 - DNA, 20 bp, Artificial Sequence
  chemically synthesized
ctagtgataaccaattgcta

SEQ ID NO: 22404 - DNA, 20 bp, Artificial Sequence
  chemically synthesized
gagtgaggaaagcatttaaa

SEQ ID NO: 22405 - DNA, 20 bp, Artificial Sequence
  chemically synthesized
cttgtctattacaacaggct

SEQ ID NO: 22406 - DNA, 20 bp, Artificial Sequence
  chemically synthesized
gaaaatattagccattgcca

SEQ ID NO: 22407 - DNA, 20 bp, Artificial Sequence
  chemically synthesized
agtaattatatgaaatgctt

SEQ ID NO: 22408 - DNA, 20 bp, Artificial Sequence
  chemically synthesized
tttcatattcacaattagct

SEQ ID NO: 22409 - DNA, 20 bp, Artificial Sequence
  chemically synthesized
gcaaaatactgtgctccttt

SEQ ID NO: 22410 - DNA, 20 bp, Artificial Sequence
  chemically synthesized
cttcaatgctatgcttatgt

SEQ ID NO: 22411 - DNA, 20 bp, Artificial Sequence
  chemically synthesized
tcaaattgataaaacaattt

SEQ ID NO: 22412 - DNA, 20 bp, Artificial Sequence
  chemically synthesized
gaggtataacctcatctgtg

SEQ ID NO: 22413 - DNA, 20 bp, Artificial Sequence
  chemically synthesized
aaattataaaacaattcctt

SEQ ID NO: 22414 - DNA, 20 bp, Artificial Sequence
  chemically synthesized
aaaagtcatggttttgaagg

SEQ ID NO: 22415 - DNA, 20 bp, Artificial Sequence
  chemically synthesized
ctgagttcctcaagatcttg

SEQ ID NO: 22416 - DNA, 20 bp, Artificial Sequence
  chemically synthesized
agaatcaagccaactgattg

SEQ ID NO: 22417 - DNA, 20 bp, Artificial Sequence
  chemically synthesized
atgtctattacagtaatcta

SEQ ID NO: 22418 - DNA, 20 bp, Artificial Sequence
  chemically synthesized
aaaggatctgaaataataac

SEQ ID NO: 22419 - DNA, 20 bp, Artificial Sequence
  chemically synthesized
tggcatgcattctgaaaaat

SEQ ID NO: 22420 - DNA, 20 bp, Artificial Sequence
  chemically synthesized
tttgcctatgtagaagtgga

SEQ ID NO: 22421 - DNA, 20 bp, Artificial Sequence
  chemically synthesized
ttctctgtagtttagtgaga

SEQ ID NO: 22422 - DNA, 20 bp, Artificial Sequence
  chemically synthesized
cagaaccatctctatcacat

SEQ ID NO: 22423 - DNA, 20 bp, Artificial Sequence
  chemically synthesized
tctctatcacatgtgaatcc

SEQ ID NO: 22424 - DNA, 20 bp, Artificial Sequence
  chemically synthesized
tgaaataaaagttttctcta

SEQ ID NO: 22425 - DNA, 20 bp, Artificial Sequence
  chemically synthesized
ctcaaggacatagcttattg

SEQ ID NO: 22426 - DNA, 20 bp, Artificial Sequence
  chemically synthesized
ggaagggacttgttagcact

SEQ ID NO: 22427 - DNA, 20 bp, Artificial Sequence
  chemically synthesized
cagtgaaactaagttatttt

SEQ ID NO: 22428 - DNA, 20 bp, Artificial Sequence
  chemically synthesized
agtagcatgtgtgttgatct

SEQ ID NO: 22429 - DNA, 20 bp, Artificial Sequence
  chemically synthesized
tggtacatagaaaatgctca

SEQ ID NO: 22430 - DNA, 20 bp, Artificial Sequence
  chemically synthesized
ggtttgagattttcatatag

SEQ ID NO: 22431 - DNA, 20 bp, Artificial Sequence
  chemically synthesized
gtttctttaaatttaatgat

SEQ ID NO: 22432 - DNA, 20 bp, Artificial Sequence
  chemically synthesized
tatgaggtatcttagagatc

SEQ ID NO: 22433 - DNA, 20 bp, Artificial Sequence
  chemically synthesized
tttaatgatcaagcaaatgg

SEQ ID NO: 22434 - DNA, 20 bp, Artificial Sequence
  chemically synthesized
gcaaatggcagagttaggac

SEQ ID NO: 22435 - DNA, 20 bp, Artificial Sequence
  chemically synthesized
tcacttttttactattatgt

SEQ ID NO: 22436 - DNA, 20 bp, Artificial Sequence
  chemically synthesized
agtacttgcagtcaaaggtc

SEQ ID NO: 22437 - DNA, 20 bp, Artificial Sequence
  chemically synthesized
ctgaaaaagaaccccttaaa

SEQ ID NO: 22438 - DNA, 20 bp, Artificial Sequence
  chemically synthesized
aactgaataacagtttcttc

SEQ ID NO: 22439 - DNA, 20 bp, Artificial Sequence
  chemically synthesized
acagtttcttcatgaataaa

SEQ ID NO: 22440 - DNA, 20 bp, Artificial Sequence
  chemically synthesized
aacaaaaggtttcttaggag

SEQ ID NO: 22441 - DNA, 20 bp, Artificial Sequence
  chemically synthesized
ggagaagaatcccttgctgc

SEQ ID NO: 22442 - DNA, 20 bp, Artificial Sequence
  chemically synthesized
gtgaaaaacataacagatga

SEQ ID NO: 22443 - DNA, 20 bp, Artificial Sequence
  chemically synthesized
tgagagagtcacagttagtt

SEQ ID NO: 22444 - DNA, 20 bp, Artificial Sequence
  chemically synthesized
aatccattttattattcagt

SEQ ID NO: 22445 - DNA, 20 bp, Artificial Sequence
  chemically synthesized
gcactgagaggcgagggaga

SEQ ID NO: 22446 - DNA, 20 bp, Artificial Sequence
  chemically synthesized
gaggcgagggagatagagtt

SEQ ID NO: 22447 - DNA, 20 bp, Artificial Sequence
  chemically synthesized
agaactgattcttaatcttc

SEQ ID NO: 22448 - DNA, 20 bp, Artificial Sequence
  chemically synthesized
atacaatacagtcaaatgtg

SEQ ID NO: 22449 - DNA, 20 bp, Artificial Sequence
  chemically synthesized
taagactatacagtgtaccg

SEQ ID NO: 22450 - DNA, 20 bp, Artificial Sequence
  chemically synthesized
atacagtgtaccgtggaatg

SEQ ID NO: 22451 - DNA, 20 bp, Artificial Sequence
  chemically synthesized
gatgtttgagctgacacttg

SEQ ID NO: 22452 - DNA, 20 bp, Artificial Sequence
  chemically synthesized
gctcagagagggaaaaggag

SEQ ID NO: 22453 - DNA, 20 bp, Artificial Sequence
  chemically synthesized
actagattgtgaagctcagg

SEQ ID NO: 22454 - DNA, 20 bp, Artificial Sequence
  chemically synthesized
agggggagttaatagcctta

SEQ ID NO: 22455 - DNA, 20 bp, Artificial Sequence
  chemically synthesized
gccttaaggagttttgtctc

SEQ ID NO: 22456 - DNA, 20 bp, Artificial Sequence
  chemically synthesized
ttgtctccagggtatgaaca

SEQ ID NO: 22457 - DNA, 20 bp, Artificial Sequence
  chemically synthesized
cagggtatgaacaatgaatg

SEQ ID NO: 22458 - DNA, 20 bp, Artificial Sequence
  chemically synthesized
aattagactgtggtgtgacc

SEQ ID NO: 22459 - DNA, 20 bp, Artificial Sequence
  chemically synthesized
tctggagaaattaacatgtt

SEQ ID NO: 22460 - DNA, 20 bp, Artificial Sequence
  chemically synthesized
attaacatgttaaggatatt

SEQ ID NO: 22461 - DNA, 20 bp, Artificial Sequence
  chemically synthesized
cacataatgaaagttaattt

SEQ ID NO: 22462 - DNA, 20 bp, Artificial Sequence
  chemically synthesized
tcagtcttgacactacacct

SEQ ID NO: 22463 - DNA, 20 bp, Artificial Sequence
  chemically synthesized
atggtacaagtggcacaggg

SEQ ID NO: 22464 - DNA, 20 bp, Artificial Sequence
  chemically synthesized
cagggaagaattcagaaaac

SEQ ID NO: 22465 - DNA, 20 bp, Artificial Sequence
  chemically synthesized
ttatggaagaaattataata

SEQ ID NO: 22466 - DNA, 20 bp, Artificial Sequence
  chemically synthesized
tgagtccactcttctaggac

SEQ ID NO: 22467 - DNA, 20 bp, Artificial Sequence
  chemically synthesized
ctttgatataagtgaactca

SEQ ID NO: 22468 - DNA, 20 bp, Artificial Sequence
  chemically synthesized
tttctctagagcaaaatgaa

SEQ ID NO: 22469 - DNA, 20 bp, Artificial Sequence
  chemically synthesized
acttttcaaggctgaggtgg

SEQ ID NO: 22470 - DNA, 20 bp, Artificial Sequence
  chemically synthesized
tgggagaattgtttgagacc

SEQ ID NO: 22471 - DNA, 20 bp, Artificial Sequence
  chemically synthesized
gaattgtttgagaccaagag

SEQ ID NO: 22472 - DNA, 20 bp, Artificial Sequence
  chemically synthesized
tacctgagaggctaaagcag

SEQ ID NO: 22473 - DNA, 20 bp, Artificial Sequence
  chemically synthesized
ggctaaagcaggaggatcaa

SEQ ID NO: 22474 - DNA, 20 bp, Artificial Sequence
  chemically synthesized
ttgcaccattgcactccagc

SEQ ID NO: 22475 - DNA, 20 bp, Artificial Sequence
  chemically synthesized
ttgcactccagccggggtga

SEQ ID NO: 22476 - DNA, 20 bp, Artificial Sequence
  chemically synthesized
taaagtcagactgcatgatt

SEQ ID NO: 22477 - DNA, 20 bp, Artificial Sequence
  chemically synthesized
aattccaactccaccatcac

SEQ ID NO: 22478 - DNA, 20 bp, Artificial Sequence
  chemically synthesized
ttgtcataccagctttcact

SEQ ID NO: 22479 - DNA, 20 bp, Artificial Sequence
  chemically synthesized
cataccagctttcactttga

SEQ ID NO: 22480 - DNA, 20 bp, Artificial Sequence
  chemically synthesized
catcaatgttacttcaatca

SEQ ID NO: 22481 - DNA, 20 bp, Artificial Sequence
  chemically synthesized
atcacgggatgcatagtaat

SEQ ID NO: 22482 - DNA, 20 bp, Artificial Sequence
  chemically synthesized
tctttgccctaattactgat

SEQ ID NO: 22483 - DNA, 20 bp, Artificial Sequence
  chemically synthesized
caggtggtcttgttcaaagt

SEQ ID NO: 22484 - DNA, 20 bp, Artificial Sequence
  chemically synthesized
cagctgctttgattttaact

SEQ ID NO: 22485 - DNA, 20 bp, Artificial Sequence
  chemically synthesized
gcaactgtgttttggaacag

SEQ ID NO: 22486 - DNA, 20 bp, Artificial Sequence
  chemically synthesized
agtgttgccagatgacgact

SEQ ID NO: 22487 - DNA, 20 bp, Artificial Sequence
  chemically synthesized
agtattttcttttttaatgt

SEQ ID NO: 22488 - DNA, 20 bp, Artificial Sequence
  chemically synthesized
tatacctcaaatatgaaaat

SEQ ID NO: 22489 - DNA, 20 bp, Artificial Sequence
  chemically synthesized
aaaaagggctaaaatggtgt

SEQ ID NO: 22490 - DNA, 20 bp, Artificial Sequence
  chemically synthesized
taatgatcaagtcaggtatt

SEQ ID NO: 22491 - DNA, 20 bp, Artificial Sequence
  chemically synthesized
atgattttatatttgtatgg

SEQ ID NO: 22492 - DNA, 20 bp, Artificial Sequence
  chemically synthesized
gattccatatctttgctaat

SEQ ID NO: 22493 - DNA, 20 bp, Artificial Sequence
  chemically synthesized
accagtatctgtttattatt

SEQ ID NO: 22494 - DNA, 20 bp, Artificial Sequence
  chemically synthesized
ttattctgaattcttttcct

SEQ ID NO: 22495 - DNA, 20 bp, Artificial Sequence
  chemically synthesized
aatacccagtaataagattg

SEQ ID NO: 22496 - DNA, 20 bp, Artificial Sequence
  chemically synthesized
catgcttaccaatagtgcct

SEQ ID NO: 22497 - DNA, 20 bp, Artificial Sequence
  chemically synthesized
gattatttgtttttccactg

SEQ ID NO: 22498 - DNA, 20 bp, Artificial Sequence
  chemically synthesized
tttttccactgttgagttgt

SEQ ID NO: 22499 - DNA, 20 bp, Artificial Sequence
  chemically synthesized
ttaagtctttaatccatctt

SEQ ID NO: 22500 - DNA, 20 bp, Artificial Sequence
  chemically synthesized
cgttttatatggcaataaat

SEQ ID NO: 22501 - DNA, 20 bp, Artificial Sequence
  chemically synthesized
atttttgcatctattgtaca

SEQ ID NO: 22502 - DNA, 20 bp, Artificial Sequence
  chemically synthesized
tgcatctattgtacaagggg

SEQ ID NO: 22503 - DNA, 20 bp, Artificial Sequence
  chemically synthesized
tggttgctgttggtgtatag

SEQ ID NO: 22504 - DNA, 20 bp, Artificial Sequence
  chemically synthesized
tcttgtatctggaaactttg

SEQ ID NO: 22505 - DNA, 20 bp, Artificial Sequence
  chemically synthesized
cagttctaggagctttctgg

SEQ ID NO: 22506 - DNA, 20 bp, Artificial Sequence
  chemically synthesized
gagctttctggaggagtctt

SEQ ID NO: 22507 - DNA, 20 bp, Artificial Sequence
  chemically synthesized
ttgacttcctctttactgat

SEQ ID NO: 22508 - DNA, 20 bp, Artificial Sequence
  chemically synthesized
cttccagtactatgttgaag

SEQ ID NO: 22509 - DNA, 20 bp, Artificial Sequence
  chemically synthesized
ctatgttgaagaggagtggt

SEQ ID NO: 22510 - DNA, 20 bp, Artificial Sequence
  chemically synthesized
gtcttgttccagttctcaga

SEQ ID NO: 22511 - DNA, 20 bp, Artificial Sequence
  chemically synthesized
cattcaatattatgttggct

SEQ ID NO: 22512 - DNA, 20 bp, Artificial Sequence
  chemically synthesized
attttaatcataaatgtatg

SEQ ID NO: 22513 - DNA, 20 bp, Artificial Sequence
  chemically synthesized
taaatgtatgctggattttg

SEQ ID NO: 22514 - DNA, 20 bp, Artificial Sequence
  chemically synthesized
atggaacctgcttgatcatg

SEQ ID NO: 22515 - DNA, 20 bp, Artificial Sequence
  chemically synthesized
attatctttttgttatgttg

SEQ ID NO: 22516 - DNA, 20 bp, Artificial Sequence
  chemically synthesized
tggttatctagtattttgtt

SEQ ID NO: 22517 - DNA, 20 bp, Artificial Sequence
  chemically synthesized
ttggtgtgatgctggcttca

SEQ ID NO: 22518 - DNA, 20 bp, Artificial Sequence
  chemically synthesized
tgtgatgctggcttcataga

SEQ ID NO: 22519 - DNA, 20 bp, Artificial Sequence
  chemically synthesized
ttccttctttatctgtcttg

SEQ ID NO: 22520 - DNA, 20 bp, Artificial Sequence
  chemically synthesized
agatggggaccaattcctct

SEQ ID NO: 22521 - DNA, 20 bp, Artificial Sequence
  chemically synthesized
attcctctttgaatgtctag

SEQ ID NO: 22522 - DNA, 20 bp, Artificial Sequence
  chemically synthesized
atgtctagtagaattctgtt

SEQ ID NO: 22523 - DNA, 20 bp, Artificial Sequence
  chemically synthesized
ggagaaatttccacgcgctg

SEQ ID NO: 22524 - DNA, 20 bp, Artificial Sequence
  chemically synthesized
aatttccacgcgctgttgaa

SEQ ID NO: 22525 - DNA, 20 bp, Artificial Sequence
  chemically synthesized
gaatgtgtgttctgtggtta

SEQ ID NO: 22526 - DNA, 20 bp, Artificial Sequence
  chemically synthesized
aatgcctggctatgccaggc

SEQ ID NO: 22527 - DNA, 20 bp, Artificial Sequence
  chemically synthesized
agaccttcagtttctccagt

SEQ ID NO: 22528 - DNA, 20 bp, Artificial Sequence
  chemically synthesized
ggagtgtgtgtttaggagag

SEQ ID NO: 22529 - DNA, 20 bp, Artificial Sequence
  chemically synthesized
gttggggcactcacagtatt

SEQ ID NO: 22530 - DNA, 20 bp, Artificial Sequence
  chemically synthesized
cacagtatttggggtgtctc

SEQ ID NO: 22531 - DNA, 20 bp, Artificial Sequence
  chemically synthesized
ggagcaatctacttccttca

SEQ ID NO: 22532 - DNA, 20 bp, Artificial Sequence
  chemically synthesized
ctacttccttcagagggtct

SEQ ID NO: 22533 - DNA, 20 bp, Artificial Sequence
  chemically synthesized
agagggtctgtgggtcctct

SEQ ID NO: 22534 - DNA, 20 bp, Artificial Sequence
  chemically synthesized
ccacatgctgctctgtccat

SEQ ID NO: 22535 - DNA, 20 bp, Artificial Sequence
  chemically synthesized
cgccaagatcctgagaagtt

SEQ ID NO: 22536 - DNA, 20 bp, Artificial Sequence
  chemically synthesized
ccagttttattcttttgcac

SEQ ID NO: 22537 - DNA, 20 bp, Artificial Sequence
  chemically synthesized
cttttgcacatggatatcca

SEQ ID NO: 22538 - DNA, 20 bp, Artificial Sequence
  chemically synthesized
aatctgttggctataaatat

SEQ ID NO: 22539 - DNA, 20 bp, Artificial Sequence
  chemically synthesized
ctagcattgttcttttttca

SEQ ID NO: 22540 - DNA, 20 bp, Artificial Sequence
  chemically synthesized
ctattttgatagcggtcata

SEQ ID NO: 22541 - DNA, 20 bp, Artificial Sequence
  chemically synthesized
tatagaatctgtagattgct

SEQ ID NO: 22542 - DNA, 20 bp, Artificial Sequence
  chemically synthesized
atttttctgatccatgaaca

SEQ ID NO: 22543 - DNA, 20 bp, Artificial Sequence
  chemically synthesized
tatcagtgttttgtagtttt

SEQ ID NO: 22544 - DNA, 20 bp, Artificial Sequence
  chemically synthesized
tattttttagctattgtaaa

SEQ ID NO: 22545 - DNA, 20 bp, Artificial Sequence
  chemically synthesized
ttttgtctcctgtaacttta

SEQ ID NO: 22546 - DNA, 20 bp, Artificial Sequence
  chemically synthesized
tgaatttatttttcagcgct

SEQ ID NO: 22547 - DNA, 20 bp, Artificial Sequence
  chemically synthesized
cagcgctaagagtgctttgg

SEQ ID NO: 22548 - DNA, 20 bp, Artificial Sequence
  chemically synthesized
ctaggacttccagtattata

SEQ ID NO: 22549 - DNA, 20 bp, Artificial Sequence
  chemically synthesized
cttccagtattatattgaat

SEQ ID NO: 22550 - DNA, 20 bp, Artificial Sequence
  chemically synthesized
aattcagtatgatgttagct

SEQ ID NO: 22551 - DNA, 20 bp, Artificial Sequence
  chemically synthesized
gcagatagtttttatcatga

SEQ ID NO: 22552 - DNA, 20 bp, Artificial Sequence
  chemically synthesized
tgatcatggtgtattatctt

SEQ ID NO: 22553 - DNA, 20 bp, Artificial Sequence
  chemically synthesized
attatcttttggatgtactg

SEQ ID NO: 22554 - DNA, 20 bp, Artificial Sequence
  chemically synthesized
cagtttgctagtattttgtt

SEQ ID NO: 22555 - DNA, 20 bp, Artificial Sequence
  chemically synthesized
tttcacacctatgttccatc

SEQ ID NO: 22556 - DNA, 20 bp, Artificial Sequence
  chemically synthesized
cttgcatccttgtctggtta

SEQ ID NO: 22557 - DNA, 20 bp, Artificial Sequence
  chemically synthesized
tccttgtctggttatggaat

SEQ ID NO: 22558 - DNA, 20 bp, Artificial Sequence
  chemically synthesized
tcaggataatactggcctca

SEQ ID NO: 22559 - DNA, 20 bp, Artificial Sequence
  chemically synthesized
gataatactggcctcagaga

SEQ ID NO: 22560 - DNA, 20 bp, Artificial Sequence
  chemically synthesized
gcctcagagaatgagttagg

SEQ ID NO: 22561 - DNA, 20 bp, Artificial Sequence
  chemically synthesized
ccttcctgtttaatttttaa

SEQ ID NO: 22562 - DNA, 20 bp, Artificial Sequence
  chemically synthesized
tttctttccttctgctagtt

SEQ ID NO: 22563 - DNA, 20 bp, Artificial Sequence
  chemically synthesized
ctaacatatggtgtatcctg

SEQ ID NO: 22564 - DNA, 20 bp, Artificial Sequence
  chemically synthesized
ataaatatattctgtagctg

SEQ ID NO: 22565 - DNA, 20 bp, Artificial Sequence
  chemically synthesized
gatctatctgatgctgagat

SEQ ID NO: 22566 - DNA, 20 bp, Artificial Sequence
  chemically synthesized
aatccccaactattattgta

SEQ ID NO: 22567 - DNA, 20 bp, Artificial Sequence
  chemically synthesized
ataacatttgctttacatat

SEQ ID NO: 22568 - DNA, 20 bp, Artificial Sequence
  chemically synthesized
catatctggatgctctggtg

SEQ ID NO: 22569 - DNA, 20 bp, Artificial Sequence
  chemically synthesized
tggatgctctggtgttgagt

SEQ ID NO: 22570 - DNA, 20 bp, Artificial Sequence
  chemically synthesized
tggtgttgagtgtgaatgtt

SEQ ID NO: 22571 - DNA, 20 bp, Artificial Sequence
  chemically synthesized
agaattgttatatactcttg

SEQ ID NO: 22572 - DNA, 20 bp, Artificial Sequence
  chemically synthesized
ttcttataggcagcttacaa

SEQ ID NO: 22573 - DNA, 20 bp, Artificial Sequence
  chemically synthesized
attttctgtagtggtaacgt

SEQ ID NO: 22574 - DNA, 20 bp, Artificial Sequence
  chemically synthesized
gtaaagccagtctagtgata

SEQ ID NO: 22575 - DNA, 20 bp, Artificial Sequence
  chemically synthesized
atttttgaagaacaatgttg

SEQ ID NO: 22576 - DNA, 20 bp, Artificial Sequence
  chemically synthesized
catttttttctttcactatt

SEQ ID NO: 22577 - DNA, 20 bp, Artificial Sequence
  chemically synthesized
agacattttgcttgctgttt

SEQ ID NO: 22578 - DNA, 20 bp, Artificial Sequence
  chemically synthesized
ctttttgcattatattattt

SEQ ID NO: 22579 - DNA, 20 bp, Artificial Sequence
  chemically synthesized
aatttctgattttcatttgt

SEQ ID NO: 22580 - DNA, 20 bp, Artificial Sequence
  chemically synthesized
ccttctgggaaactgcaaat

SEQ ID NO: 22581 - DNA, 20 bp, Artificial Sequence
  chemically synthesized
ctgatctattgttgaagttt

SEQ ID NO: 22582 - DNA, 20 bp, Artificial Sequence
  chemically synthesized
ttcaataaactcttcagtta

SEQ ID NO: 22583 - DNA, 20 bp, Artificial Sequence
  chemically synthesized
attcttgttgtatctatctc

SEQ ID NO: 22584 - DNA, 20 bp, Artificial Sequence
  chemically synthesized
gtaaatttctcattcatatc

SEQ ID NO: 22585 - DNA, 20 bp, Artificial Sequence
  chemically synthesized
gatttctttttattgtttat

SEQ ID NO: 22586 - DNA, 20 bp, Artificial Sequence
  chemically synthesized
gcttccttaatatcaacatt

SEQ ID NO: 22587 - DNA, 20 bp, Artificial Sequence
  chemically synthesized
acattttggattcttttttc

SEQ ID NO: 22588 - DNA, 20 bp, Artificial Sequence
  chemically synthesized
tccactggcttatgttgctg

SEQ ID NO: 22589 - DNA, 20 bp, Artificial Sequence
  chemically synthesized
aagatgtatcttggtgttga

SEQ ID NO: 22590 - DNA, 20 bp, Artificial Sequence
  chemically synthesized
ctgtgattttttcagtggct

SEQ ID NO: 22591 - DNA, 20 bp, Artificial Sequence
  chemically synthesized
gatgaggttgtgctggagac

SEQ ID NO: 22592 - DNA, 20 bp, Artificial Sequence
  chemically synthesized
gtacattggcactgatggta

SEQ ID NO: 22593 - DNA, 20 bp, Artificial Sequence
  chemically synthesized
actgatggtaatgagtctag

SEQ ID NO: 22594 - DNA, 20 bp, Artificial Sequence
  chemically synthesized
ttggccttcaggcagtttgc

SEQ ID NO: 22595 - DNA, 20 bp, Artificial Sequence
  chemically synthesized
atagtagactgggctggtgt

SEQ ID NO: 22596 - DNA, 20 bp, Artificial Sequence
  chemically synthesized
ggtcctcaggcttctggaca

SEQ ID NO: 22597 - DNA, 20 bp, Artificial Sequence
  chemically synthesized
ttctggacagtgggtgtggt

SEQ ID NO: 22598 - DNA, 20 bp, Artificial Sequence
  chemically synthesized
gttggtggtggctgcaaggg

SEQ ID NO: 22599 - DNA, 20 bp, Artificial Sequence
  chemically synthesized
gttgtgatggcagtggcaga

SEQ ID NO: 22600 - DNA, 20 bp, Artificial Sequence
  chemically synthesized
gcccatcatcaggcttctgg

SEQ ID NO: 22601 - DNA, 20 bp, Artificial Sequence
  chemically synthesized
ttgcttaggtaccagtcatg

SEQ ID NO: 22602 - DNA, 20 bp, Artificial Sequence
  chemically synthesized
tggatggcacaaggctgtct

SEQ ID NO: 22603 - DNA, 20 bp, Artificial Sequence
  chemically synthesized
ttgaggaaggcaaagccagg

SEQ ID NO: 22604 - DNA, 20 bp, Artificial Sequence
  chemically synthesized
ggacaccggctatcataggc

SEQ ID NO: 22605 - DNA, 20 bp, Artificial Sequence
  chemically synthesized
ccggctatcataggctggag

SEQ ID NO: 22606 - DNA, 20 bp, Artificial Sequence
  chemically synthesized
agtgatcctcaggcccccag

SEQ ID NO: 22607 - DNA, 20 bp, Artificial Sequence
  chemically synthesized
tcaggcccccagcagaatgc

SEQ ID NO: 22608 - DNA, 20 bp, Artificial Sequence
  chemically synthesized
gcccccagcagaatgcctga

SEQ ID NO: 22609 - DNA, 20 bp, Artificial Sequence
  chemically synthesized
cattgttgccctgctcttga

SEQ ID NO: 22610 - DNA, 20 bp, Artificial Sequence
  chemically synthesized
gccctgctcttgaaggggtg

SEQ ID NO: 22611 - DNA, 20 bp, Artificial Sequence
  chemically synthesized
ttcagtggcagcagctataa

SEQ ID NO: 22612 - DNA, 20 bp, Artificial Sequence
  chemically synthesized
ccccagatggtggctgcaag

SEQ ID NO: 22613 - DNA, 20 bp, Artificial Sequence
  chemically synthesized
tgtgtagcagccctgctact

SEQ ID NO: 22614 - DNA, 20 bp, Artificial Sequence
  chemically synthesized
agccctgctactgggggtgg

SEQ ID NO: 22615 - DNA, 20 bp, Artificial Sequence
  chemically synthesized
gccagcagtagcactcagct

SEQ ID NO: 22616 - DNA, 20 bp, Artificial Sequence
  chemically synthesized
gtagcactcagctgtgggtg

SEQ ID NO: 22617 - DNA, 20 bp, Artificial Sequence
  chemically synthesized
ggggatgtcagcagagcttc

SEQ ID NO: 22618 - DNA, 20 bp, Artificial Sequence
  chemically synthesized
tgtagagatgcagatgatgt

SEQ ID NO: 22619 - DNA, 20 bp, Artificial Sequence
  chemically synthesized
ctgaggaacgatgtcatctg

SEQ ID NO: 22620 - DNA, 20 bp, Artificial Sequence
  chemically synthesized
gcaccttgctgctcagtaat

SEQ ID NO: 22621 - DNA, 20 bp, Artificial Sequence
  chemically synthesized
tgctcagtaatggggatggc

SEQ ID NO: 22622 - DNA, 20 bp, Artificial Sequence
  chemically synthesized
tcaagggactctcctgtggc

SEQ ID NO: 22623 - DNA, 20 bp, Artificial Sequence
  chemically synthesized
tctcctgtggctaggattcc

SEQ ID NO: 22624 - DNA, 20 bp, Artificial Sequence
  chemically synthesized
taatgcagatgtggaccact

SEQ ID NO: 22625 - DNA, 20 bp, Artificial Sequence
  chemically synthesized
ggagcctctctggcctcaca

SEQ ID NO: 22626 - DNA, 20 bp, Artificial Sequence
  chemically synthesized
ggcctcacagaggatcccta

SEQ ID NO: 22627 - DNA, 20 bp, Artificial Sequence
  chemically synthesized
tgcttcctgtcacttctctg

SEQ ID NO: 22628 - DNA, 20 bp, Artificial Sequence
  chemically synthesized
gtcacttctctgttgaattc

SEQ ID NO: 22629 - DNA, 20 bp, Artificial Sequence
  chemically synthesized
ttccagaattctctcttatg

SEQ ID NO: 22630 - DNA, 20 bp, Artificial Sequence
  chemically synthesized
tttggttctttgtggaggag

SEQ ID NO: 22631 - DNA, 20 bp, Artificial Sequence
  chemically synthesized
ggactatctgaaggcctcag

SEQ ID NO: 22632 - DNA, 20 bp, Artificial Sequence
  chemically synthesized
tcagatgagtaaaagaagta

SEQ ID NO: 22633 - DNA, 20 bp, Artificial Sequence
  chemically synthesized
atcatttgtttcttcaaata

SEQ ID NO: 22634 - DNA, 20 bp, Artificial Sequence
  chemically synthesized
ttgcatctaccaaagtgtat

SEQ ID NO: 22635 - DNA, 20 bp, Artificial Sequence
  chemically synthesized
aaatacgtaatctaacaaac

SEQ ID NO: 22636 - DNA, 20 bp, Artificial Sequence
  chemically synthesized
acaaggatgttttaagatct

SEQ ID NO: 22637 - DNA, 20 bp, Artificial Sequence
  chemically synthesized
gatgcatagttgcaaataaa

SEQ ID NO: 22638 - DNA, 20 bp, Artificial Sequence
  chemically synthesized
tgcaaataaaaggagttttc

SEQ ID NO: 22639 - DNA, 20 bp, Artificial Sequence
  chemically synthesized
tttggaaattttgcattttt

SEQ ID NO: 22640 - DNA, 20 bp, Artificial Sequence
  chemically synthesized
tgatggtttctaaaattgtc

SEQ ID NO: 22641 - DNA, 20 bp, Artificial Sequence
  chemically synthesized
atgttaacttagatttattg

SEQ ID NO: 22642 - DNA, 20 bp, Artificial Sequence
  chemically synthesized
tatgaaaattgcttgcattt

SEQ ID NO: 22643 - DNA, 20 bp, Artificial Sequence
  chemically synthesized
ctcttctcctttataaatta

SEQ ID NO: 22644 - DNA, 20 bp, Artificial Sequence
  chemically synthesized
ctatgtaaagtataagttac

SEQ ID NO: 22645 - DNA, 20 bp, Artificial Sequence
  chemically synthesized
aaacctgtagtctgatgaaa

SEQ ID NO: 22646 - DNA, 20 bp, Artificial Sequence
  chemically synthesized
aataaaattgctttttgcaa

SEQ ID NO: 22647 - DNA, 20 bp, Artificial Sequence
  chemically synthesized
attgagttgaagattgatgc

SEQ ID NO: 22648 - DNA, 20 bp, Artificial Sequence
  chemically synthesized
tgccaggatcttattacctc

SEQ ID NO: 22649 - DNA, 20 bp, Artificial Sequence
  chemically synthesized
attacctccaggatttcaca

SEQ ID NO: 22650 - DNA, 20 bp, Artificial Sequence
  chemically synthesized
aggatttcacaaaggatttc

SEQ ID NO: 22651 - DNA, 20 bp, Artificial Sequence
  chemically synthesized
ttataaagacatacctgaga

SEQ ID NO: 22652 - DNA, 20 bp, Artificial Sequence
  chemically synthesized
cactatcacgagaagagcat

SEQ ID NO: 22653 - DNA, 20 bp, Artificial Sequence
  chemically synthesized
aaatccctcccacaacacgt

SEQ ID NO: 22654 - DNA, 20 bp, Artificial Sequence
  chemically synthesized
actacaattcaagatgagat

SEQ ID NO: 22655 - DNA, 20 bp, Artificial Sequence
  chemically synthesized
gggacacagtcaagctgtat

SEQ ID NO: 22656 - DNA, 20 bp, Artificial Sequence
  chemically synthesized
agctgtatcagggtacaagc

SEQ ID NO: 22657 - DNA, 20 bp, Artificial Sequence
  chemically synthesized
agtggaccatcacctgaaaa

SEQ ID NO: 22658 - DNA, 20 bp, Artificial Sequence
  chemically synthesized
ctgtgtttgactttctgttt

SEQ ID NO: 22659 - DNA, 20 bp, Artificial Sequence
  chemically synthesized
tgtttctgagttatttcact

SEQ ID NO: 22660 - DNA, 20 bp, Artificial Sequence
  chemically synthesized
gatttcattcttttttatgg

SEQ ID NO: 22661 - DNA, 20 bp, Artificial Sequence
  chemically synthesized
ttaatatgatctctttcact

SEQ ID NO: 22662 - DNA, 20 bp, Artificial Sequence
  chemically synthesized
tttgggtccatacccagtag

SEQ ID NO: 22663 - DNA, 20 bp, Artificial Sequence
  chemically synthesized
catacccagtagtgggattg

SEQ ID NO: 22664 - DNA, 20 bp, Artificial Sequence
  chemically synthesized
ccagtagtgggattgcagga

SEQ ID NO: 22665 - DNA, 20 bp, Artificial Sequence
  chemically synthesized
cctgagctcactgtatttgt

SEQ ID NO: 22666 - DNA, 20 bp, Artificial Sequence
  chemically synthesized
atatagatttagatataaaa

SEQ ID NO: 22667 - DNA, 20 bp, Artificial Sequence
  chemically synthesized
agtcccaaagctgaaggact

SEQ ID NO: 22668 - DNA, 20 bp, Artificial Sequence
  chemically synthesized
gcttggaggctaagccagtc

SEQ ID NO: 22669 - DNA, 20 bp, Artificial Sequence
  chemically synthesized
agatggtgcccacccagatt

SEQ ID NO: 22670 - DNA, 20 bp, Artificial Sequence
  chemically synthesized
ggtgcccacccagattaagg

SEQ ID NO: 22671 - DNA, 20 bp, Artificial Sequence
  chemically synthesized
aataccctcacagacacact

SEQ ID NO: 22672 - DNA, 20 bp, Artificial Sequence
  chemically synthesized
tttttttttttttttcctgg

SEQ ID NO: 22673 - DNA, 20 bp, Artificial Sequence
  chemically synthesized
cctttatttgtagtcctgcc

SEQ ID NO: 22674 - DNA, 20 bp, Artificial Sequence
  chemically synthesized
taaaactaagagacacccta

SEQ ID NO: 22675 - DNA, 20 bp, Artificial Sequence
  chemically synthesized
acgcttccttacctccattg

SEQ ID NO: 22676 - DNA, 20 bp, Artificial Sequence
  chemically synthesized
actgatttcatcttgatagt

SEQ ID NO: 22677 - DNA, 20 bp, Artificial Sequence
  chemically synthesized
aatcttaatttgcagtttaa

SEQ ID NO: 22678 - DNA, 20 bp, Artificial Sequence
  chemically synthesized
aattttgctagtggaacact

SEQ ID NO: 22679 - DNA, 20 bp, Artificial Sequence
  chemically synthesized
gtggaacactaggggtgatg

SEQ ID NO: 22680 - DNA, 20 bp, Artificial Sequence
  chemically synthesized
accctttgattcctggaccc

SEQ ID NO: 22681 - DNA, 20 bp, Artificial Sequence
  chemically synthesized
aggccattcaaaagctgctt

SEQ ID NO: 22682 - DNA, 20 bp, Artificial Sequence
  chemically synthesized
aaaagctgcttcaggatgat

SEQ ID NO: 22683 - DNA, 20 bp, Artificial Sequence
  chemically synthesized
cacacttctttagccataaa

SEQ ID NO: 22684 - DNA, 20 bp, Artificial Sequence
  chemically synthesized
tggtcagaagcaatgctgtg

SEQ ID NO: 22685 - DNA, 20 bp, Artificial Sequence
  chemically synthesized
ctgtgtggaataccatgaca

SEQ ID NO: 22686 - DNA, 20 bp, Artificial Sequence
  chemically synthesized
atacggcattctgtgattcc

SEQ ID NO: 22687 - DNA, 20 bp, Artificial Sequence
  chemically synthesized
tggtagtcttggcataagca

SEQ ID NO: 22688 - DNA, 20 bp, Artificial Sequence
  chemically synthesized
cttggcataagcattgagtt

SEQ ID NO: 22689 - DNA, 20 bp, Artificial Sequence
  chemically synthesized
aggattgggaaacccatatc

SEQ ID NO: 22690 - DNA, 20 bp, Artificial Sequence
  chemically synthesized
gtagctggctgatcaccccg

SEQ ID NO: 22691 - DNA, 20 bp, Artificial Sequence
  chemically synthesized
ctgtggccaggtcagctttg

SEQ ID NO: 22692 - DNA, 20 bp, Artificial Sequence
  chemically synthesized
caactgtggccactttgttc

SEQ ID NO: 22693 - DNA, 20 bp, Artificial Sequence
  chemically synthesized
tgggtccattggacgatgac

SEQ ID NO: 22694 - DNA, 20 bp, Artificial Sequence
  chemically synthesized
atgagtggcctgggaaaagg

SEQ ID NO: 22695 - DNA, 20 bp, Artificial Sequence
  chemically synthesized
aaaaggctgagtggtgtcca

SEQ ID NO: 22696 - DNA, 20 bp, Artificial Sequence
  chemically synthesized
cccattggtgagcactcaca

SEQ ID NO: 22697 - DNA, 20 bp, Artificial Sequence
  chemically synthesized
caaacctttggctacagccc

SEQ ID NO: 22698 - DNA, 20 bp, Artificial Sequence
  chemically synthesized
tcccttcaccgttgtccttc

SEQ ID NO: 22699 - DNA, 20 bp, Artificial Sequence
  chemically synthesized
agtgctgcggctgtccactt

SEQ ID NO: 22700 - DNA, 20 bp, Artificial Sequence
  chemically synthesized
gggagagaaagcagtgtgtc

SEQ ID NO: 22701 - DNA, 20 bp, Artificial Sequence
  chemically synthesized
atgtaacttactagtgcctt

SEQ ID NO: 22702 - DNA, 20 bp, Artificial Sequence
  chemically synthesized
acagcccactttatggctag

SEQ ID NO: 22703 - DNA, 20 bp, Artificial Sequence
  chemically synthesized
caagagctttctccctaaaa

SEQ ID NO: 22704 - DNA, 20 bp, Artificial Sequence
  chemically synthesized
cactgacacctcaagcatca

SEQ ID NO: 22705 - DNA, 20 bp, Artificial Sequence
  chemically synthesized
cactcaaaactggcagcctt

SEQ ID NO: 22706 - DNA, 20 bp, Artificial Sequence
  chemically synthesized
ggatcactcgataaatgggc

SEQ ID NO: 22707 - DNA, 20 bp, Artificial Sequence
  chemically synthesized
cagagtaacacacccaaatc

SEQ ID NO: 22708 - DNA, 20 bp, Artificial Sequence
  chemically synthesized
tgtgcctatttcttggttgt

SEQ ID NO: 22709 - DNA, 20 bp, Artificial Sequence
  chemically synthesized
aaattatccttcactttaga

SEQ ID NO: 22710 - DNA, 20 bp, Artificial Sequence
  chemically synthesized
tttactgaggtagaaggtcc

SEQ ID NO: 22711 - DNA, 20 bp, Artificial Sequence
  chemically synthesized
aagattatggcacaaagctg

SEQ ID NO: 22712 - DNA, 20 bp, Artificial Sequence
  chemically synthesized
gctggagagttgatatactc

SEQ ID NO: 22713 - DNA, 20 bp, Artificial Sequence
  chemically synthesized
ttccttgcctctcacaagcg

SEQ ID NO: 22714 - DNA, 20 bp, Artificial Sequence
  chemically synthesized
cctctcacaagcgttgaatc

SEQ ID NO: 22715 - DNA, 20 bp, Artificial Sequence
  chemically synthesized
ctctctaaacaattgatgcc

SEQ ID NO: 22716 - DNA, 20 bp, Artificial Sequence
  chemically synthesized
gttctccataccattagaag

SEQ ID NO: 22717 - DNA, 20 bp, Artificial Sequence
  chemically synthesized
aagaagagtccttagcatat

SEQ ID NO: 22718 - DNA, 20 bp, Artificial Sequence
  chemically synthesized
cctggtaccaaaatctgtat

SEQ ID NO: 22719 - DNA, 20 bp, Artificial Sequence
  chemically synthesized
attagggttctacagagaaa

SEQ ID NO: 22720 - DNA, 20 bp, Artificial Sequence
  chemically synthesized
ctctatatctatatctatat

SEQ ID NO: 22721 - DNA, 20 bp, Artificial Sequence
  chemically synthesized
tgaggaacaaggaagctagt

SEQ ID NO: 22722 - DNA, 20 bp, Artificial Sequence
  chemically synthesized
agtcccaaagctgaagaacc

SEQ ID NO: 22723 - DNA, 20 bp, Artificial Sequence
  chemically synthesized
gttcaatgttccagggcagg

SEQ ID NO: 22724 - DNA, 20 bp, Artificial Sequence
  chemically synthesized
catgggagaaaaatgtaggc

SEQ ID NO: 22725 - DNA, 20 bp, Artificial Sequence
  chemically synthesized
agatggtgcccacccagatt

SEQ ID NO: 22726 - DNA, 20 bp, Artificial Sequence
  chemically synthesized
ggtgcccacccagattaagg

SEQ ID NO: 22727 - DNA, 20 bp, Artificial Sequence
  chemically synthesized
tgaggttggtttttttgttg

SEQ ID NO: 22728 - DNA, 20 bp, Artificial Sequence
  chemically synthesized
tactctccttaattttcccc

SEQ ID NO: 22729 - DNA, 20 bp, Artificial Sequence
  chemically synthesized
gttttctagatgtggacttg

SEQ ID NO: 22730 - DNA, 20 bp, Artificial Sequence
  chemically synthesized
gtagcagcaatattagagga

SEQ ID NO: 22731 - DNA, 20 bp, Artificial Sequence
  chemically synthesized
catacaaaacccctcagaca

SEQ ID NO: 22732 - DNA, 20 bp, Artificial Sequence
  chemically synthesized
atctccaacaaccaagctct

SEQ ID NO: 22733 - DNA, 20 bp, Artificial Sequence
  chemically synthesized
ttaagggcttacaactctaa

SEQ ID NO: 22734 - DNA, 20 bp, Artificial Sequence
  chemically synthesized
gggctgcatgcactggtcat

SEQ ID NO: 22735 - DNA, 20 bp, Artificial Sequence
  chemically synthesized
agaatggaacagaacaggac

SEQ ID NO: 22736 - DNA, 20 bp, Artificial Sequence
  chemically synthesized
ctgcttttccatacagtgtc

SEQ ID NO: 22737 - DNA, 20 bp, Artificial Sequence
  chemically synthesized
ataacataactggccaggtc

SEQ ID NO: 22738 - DNA, 20 bp, Artificial Sequence
  chemically synthesized
ggtctatctttaaccaggcc

SEQ ID NO: 22739 - DNA, 20 bp, Artificial Sequence
  chemically synthesized
tggtctcaggctgtttgcct

SEQ ID NO: 22740 - DNA, 20 bp, Artificial Sequence
  chemically synthesized
attgggcataaaacaatatg

SEQ ID NO: 22741 - DNA, 20 bp, Artificial Sequence
  chemically synthesized
ggaagagagaaataccatgt

SEQ ID NO: 22742 - DNA, 20 bp, Artificial Sequence
  chemically synthesized
tgaaatacgtatttgtgtta

SEQ ID NO: 22743 - DNA, 20 bp, Artificial Sequence
  chemically synthesized
tgtgttattggatttgacat

SEQ ID NO: 22744 - DNA, 20 bp, Artificial Sequence
  chemically synthesized
tgagggcatgtatgatgaca

SEQ ID NO: 22745 - DNA, 20 bp, Artificial Sequence
  chemically synthesized
aagggactttaaaacatgca

SEQ ID NO: 22746 - DNA, 20 bp, Artificial Sequence
  chemically synthesized
taaataaatccttgggctta

SEQ ID NO: 22747 - DNA, 20 bp, Artificial Sequence
  chemically synthesized
actttaaacaaattgctaac

SEQ ID NO: 22748 - DNA, 20 bp, Artificial Sequence
  chemically synthesized
aaaggccaaaacaacagcag

SEQ ID NO: 22749 - DNA, 20 bp, Artificial Sequence
  chemically synthesized
tcagaagagcagtggacgca

SEQ ID NO: 22750 - DNA, 20 bp, Artificial Sequence
  chemically synthesized
atgctcaaaatatggaccta

SEQ ID NO: 22751 - DNA, 20 bp, Artificial Sequence
  chemically synthesized
aaagaggtcaaatacctcaa

SEQ ID NO: 22752 - DNA, 20 bp, Artificial Sequence
  chemically synthesized
catcatacatgccctcagca

SEQ ID NO: 22753 - DNA, 20 bp, Artificial Sequence
  chemically synthesized
ctgctgtggttttcaattat

SEQ ID NO: 22754 - DNA, 20 bp, Artificial Sequence
  chemically synthesized
tatgcccaatttctgcctcc

SEQ ID NO: 22755 - DNA, 20 bp, Artificial Sequence
  chemically synthesized
gaagaagtaaaaactaaaag

SEQ ID NO: 22756 - DNA, 20 bp, Artificial Sequence
  chemically synthesized
atgcagcttgtcctgctaca

SEQ ID NO: 22757 - DNA, 20 bp, Artificial Sequence
  chemically synthesized
tggatccagcaagtccacat

SEQ ID NO: 22758 - DNA, 20 bp, Artificial Sequence
  chemically synthesized
agcattatgatggcaaaaaa

SEQ ID NO: 22759 - DNA, 20 bp, Artificial Sequence
  chemically synthesized
aaattagatgtggcctaggc

SEQ ID NO: 22760 - DNA, 20 bp, Artificial Sequence
  chemically synthesized
acagagtaaacggataacct

SEQ ID NO: 22761 - DNA, 20 bp, Artificial Sequence
  chemically synthesized
taaacggataacctacagaa

SEQ ID NO: 22762 - DNA, 20 bp, Artificial Sequence
  chemically synthesized
atgcaacaaaaggctaatat

SEQ ID NO: 22763 - DNA, 20 bp, Artificial Sequence
  chemically synthesized
caacaaaaaaaccaacctca

SEQ ID NO: 22764 - DNA, 20 bp, Artificial Sequence
  chemically synthesized
acagccaggatataaagcag

SEQ ID NO: 22765 - DNA, 20 bp, Artificial Sequence
  chemically synthesized
ccaggagtggttctagagga

SEQ ID NO: 22766 - DNA, 20 bp, Artificial Sequence
  chemically synthesized
taatacttttgactatatgt

SEQ ID NO: 22767 - DNA, 20 bp, Artificial Sequence
  chemically synthesized
gttcgctggacaaagtgatg

SEQ ID NO: 22768 - DNA, 20 bp, Artificial Sequence
  chemically synthesized
catttggccactcttacaac

SEQ ID NO: 22769 - DNA, 20 bp, Artificial Sequence
  chemically synthesized
agataactactctcttttag

SEQ ID NO: 22770 - DNA, 20 bp, Artificial Sequence
  chemically synthesized
gaaggcactagtaagttaca

SEQ ID NO: 22771 - DNA, 20 bp, Artificial Sequence
  chemically synthesized
gttgtgcactttgcacagaa

SEQ ID NO: 22772 - DNA, 20 bp, Artificial Sequence
  chemically synthesized
atgactggaaaattgatgac

SEQ ID NO: 22773 - DNA, 20 bp, Artificial Sequence
  chemically synthesized
agactaccatccatggaatc

SEQ ID NO: 22774 - DNA, 20 bp, Artificial Sequence
  chemically synthesized
ttgctgagggcaaagggaat

SEQ ID NO: 22775 - DNA, 20 bp, Artificial Sequence
  chemically synthesized
gtgtctgtatacacttgtac

SEQ ID NO: 22776 - DNA, 20 bp, Artificial Sequence
  chemically synthesized
gtggccaggatataaagcag

SEQ ID NO: 22777 - DNA, 20 bp, Artificial Sequence
  chemically synthesized
gttcaacatcactaataatc

SEQ ID NO: 22778 - DNA, 20 bp, Artificial Sequence
  chemically synthesized
atgatacctccttatgccag

SEQ ID NO: 22779 - DNA, 20 bp, Artificial Sequence
  chemically synthesized
tgttggtgaggatgtggaga

SEQ ID NO: 22780 - DNA, 20 bp, Artificial Sequence
  chemically synthesized
aaatgcttatacactgttgg

SEQ ID NO: 22781 - DNA, 20 bp, Artificial Sequence
  chemically synthesized
catgaagatttcttaaagaa

SEQ ID NO: 22782 - DNA, 20 bp, Artificial Sequence
  chemically synthesized
ctaccaatggacgattggat

SEQ ID NO: 22783 - DNA, 20 bp, Artificial Sequence
  chemically synthesized
atatattactcagccataaa

SEQ ID NO: 22784 - DNA, 20 bp, Artificial Sequence
  chemically synthesized
agaatgaaatcatgtcttct

SEQ ID NO: 22785 - DNA, 20 bp, Artificial Sequence
  chemically synthesized
attatcctcagtgaaataac

SEQ ID NO: 22786 - DNA, 20 bp, Artificial Sequence
  chemically synthesized
ctcagtgaaataactcagaa

SEQ ID NO: 22787 - DNA, 20 bp, Artificial Sequence
  chemically synthesized
cgatgagtaagcatagacat

SEQ ID NO: 22788 - DNA, 20 bp, Artificial Sequence
  chemically synthesized
aataatagacacttgagact

SEQ ID NO: 22789 - DNA, 20 bp, Artificial Sequence
  chemically synthesized
aatggggtaattaaaagggt

SEQ ID NO: 22790 - DNA, 20 bp, Artificial Sequence
  chemically synthesized
cactaaataataatcacatg

SEQ ID NO: 22791 - DNA, 20 bp, Artificial Sequence
  chemically synthesized
gctagagcaaggggatgact

SEQ ID NO: 22792 - DNA, 20 bp, Artificial Sequence
  chemically synthesized
ctacacaagctaattgtcct

SEQ ID NO: 22793 - DNA, 20 bp, Artificial Sequence
  chemically synthesized
tcagatgttatgtgatgagg

SEQ ID NO: 22794 - DNA, 20 bp, Artificial Sequence
  chemically synthesized
atagaacacatgaggaggaa

SEQ ID NO: 22795 - DNA, 20 bp, Artificial Sequence
  chemically synthesized
tcctcaaattctggacaatt

SEQ ID NO: 22796 - DNA, 20 bp, Artificial Sequence
  chemically synthesized
cacaaaaatgcaaaatttcc

SEQ ID NO: 22797 - DNA, 20 bp, Artificial Sequence
  chemically synthesized
cttcatcttcatcttttcca

SEQ ID NO: 22798 - DNA, 20 bp, Artificial Sequence
  chemically synthesized
gaaatagagattctttattt

SEQ ID NO: 22799 - DNA, 20 bp, Artificial Sequence
  chemically synthesized
tgatttgggaaatgaaatga

SEQ ID NO: 22800 - DNA, 20 bp, Artificial Sequence
  chemically synthesized
gattatgctctttcagtcta

SEQ ID NO: 22801 - DNA, 20 bp, Artificial Sequence
  chemically synthesized
acaaagaaccaaaatagtaa

SEQ ID NO: 22802 - DNA, 20 bp, Artificial Sequence
  chemically synthesized
agtagaaaatcccacataag

SEQ ID NO: 22803 - DNA, 20 bp, Artificial Sequence
  chemically synthesized
ctacacatttataagctccc

SEQ ID NO: 22804 - DNA, 20 bp, Artificial Sequence
  chemically synthesized
aagcaaactgcctgaaggcc

SEQ ID NO: 22805 - DNA, 20 bp, Artificial Sequence
  chemically synthesized
gactatgctgctgtatgcac

SEQ ID NO: 22806 - DNA, 20 bp, Artificial Sequence
  chemically synthesized
atcaacaccaagatacatct

SEQ ID NO: 22807 - DNA, 20 bp, Artificial Sequence
  chemically synthesized
caaaataaacataaaaaggt

SEQ ID NO: 22808 - DNA, 20 bp, Artificial Sequence
  chemically synthesized
catttataaaattctggaaa

SEQ ID NO: 22809 - DNA, 20 bp, Artificial Sequence
  chemically synthesized
agaactcagataaacaataa

SEQ ID NO: 22810 - DNA, 20 bp, Artificial Sequence
  chemically synthesized
agataaacaataaaaagaaa

SEQ ID NO: 22811 - DNA, 20 bp, Artificial Sequence
  chemically synthesized
aaaacaattcaggatatgaa

SEQ ID NO: 22812 - DNA, 20 bp, Artificial Sequence
  chemically synthesized
tacccaagagatagatacaa

SEQ ID NO: 22813 - DNA, 20 bp, Artificial Sequence
  chemically synthesized
atacaacaagaatgaaccaa

SEQ ID NO: 22814 - DNA, 20 bp, Artificial Sequence
  chemically synthesized
tgtaactgaagagtttattg

SEQ ID NO: 22815 - DNA, 20 bp, Artificial Sequence
  chemically synthesized
acaatagatcagatcaagca

SEQ ID NO: 22816 - DNA, 20 bp, Artificial Sequence
  chemically synthesized
taaaattagctggtcaaatg

SEQ ID NO: 22817 - DNA, 20 bp, Artificial Sequence
  chemically synthesized
aaatgatagaaaggaaaaaa

SEQ ID NO: 22818 - DNA, 20 bp, Artificial Sequence
  chemically synthesized
tgaaaacttgtcaagtctag

SEQ ID NO: 22819 - DNA, 20 bp, Artificial Sequence
  chemically synthesized
gacatccagacaaatgaaaa

SEQ ID NO: 22820 - DNA, 20 bp, Artificial Sequence
  chemically synthesized
gattaacagcagatttctca

SEQ ID NO: 22821 - DNA, 20 bp, Artificial Sequence
  chemically synthesized
atgatatattcaaaatagtg

SEQ ID NO: 22822 - DNA, 20 bp, Artificial Sequence
  chemically synthesized
taaataaaatcttttctggg

SEQ ID NO: 22823 - DNA, 20 bp, Artificial Sequence
  chemically synthesized
ctatcactagactggcttta

SEQ ID NO: 22824 - DNA, 20 bp, Artificial Sequence
  chemically synthesized
gagcaaaacacaaataaaga

SEQ ID NO: 22825 - DNA, 20 bp, Artificial Sequence
  chemically synthesized
agaactcaaacgttaccact

SEQ ID NO: 22826 - DNA, 20 bp, Artificial Sequence
  chemically synthesized
caaaccacaatcataaataa

SEQ ID NO: 22827 - DNA, 20 bp, Artificial Sequence
  chemically synthesized
ccacaatcataaataataag

SEQ ID NO: 22828 - DNA, 20 bp, Artificial Sequence
  chemically synthesized
aatcataaataataagaaag

SEQ ID NO: 22829 - DNA, 20 bp, Artificial Sequence
  chemically synthesized
ataaataataagaaagaaag

SEQ ID NO: 22830 - DNA, 20 bp, Artificial Sequence
  chemically synthesized
ataataagaaagaaagaaag

SEQ ID NO: 22831 - DNA, 20 bp, Artificial Sequence
  chemically synthesized
agaaagaaagagagagagag

SEQ ID NO: 22832 - DNA, 20 bp, Artificial Sequence
  chemically synthesized
agagagagagagagagaatg

SEQ ID NO: 22833 - DNA, 20 bp, Artificial Sequence
  chemically synthesized
agagagagagagaatgaaag

SEQ ID NO: 22834 - DNA, 20 bp, Artificial Sequence
  chemically synthesized
aagaaagaaaaggaaggaag

SEQ ID NO: 22835 - DNA, 20 bp, Artificial Sequence
  chemically synthesized
acccagttgtaagctgccta

SEQ ID NO: 22836 - DNA, 20 bp, Artificial Sequence
  chemically synthesized
atgaaagatcttccatacaa

SEQ ID NO: 22837 - DNA, 20 bp, Artificial Sequence
  chemically synthesized
tattagatataaagggtgaa

SEQ ID NO: 22838 - DNA, 20 bp, Artificial Sequence
  chemically synthesized
gcatcagatagatcatctag

SEQ ID NO: 22839 - DNA, 20 bp, Artificial Sequence
  chemically synthesized
catctagacagaaaattaac

SEQ ID NO: 22840 - DNA, 20 bp, Artificial Sequence
  chemically synthesized
caatatttcatccaacagct

SEQ ID NO: 22841 - DNA, 20 bp, Artificial Sequence
  chemically synthesized
cagaccacaatggaataaaa

SEQ ID NO: 22842 - DNA, 20 bp, Artificial Sequence
  chemically synthesized
ataaaactagaaatcaataa

SEQ ID NO: 22843 - DNA, 20 bp, Artificial Sequence
  chemically synthesized
ctgaatgaacgttatgtcaa

SEQ ID NO: 22844 - DNA, 20 bp, Artificial Sequence
  chemically synthesized
taaacacttaaattaaaaac

SEQ ID NO: 22845 - DNA, 20 bp, Artificial Sequence
  chemically synthesized
taatcatgtacctcaacaag

SEQ ID NO: 22846 - DNA, 20 bp, Artificial Sequence
  chemically synthesized
aacccaaaactagcagaagg

SEQ ID NO: 22847 - DNA, 20 bp, Artificial Sequence
  chemically synthesized
acagaagaacttaatgaaat

SEQ ID NO: 22848 - DNA, 20 bp, Artificial Sequence
  chemically synthesized
atagctctagctagactaac

SEQ ID NO: 22849 - DNA, 20 bp, Artificial Sequence
  chemically synthesized
aaaagagaagagactgaaat

SEQ ID NO: 22850 - DNA, 20 bp, Artificial Sequence
  chemically synthesized
agagactgaaataaagaaaa

SEQ ID NO: 22851 - DNA, 20 bp, Artificial Sequence
  chemically synthesized
taaagaaaatcagaaataaa

SEQ ID NO: 22852 - DNA, 20 bp, Artificial Sequence
  chemically synthesized
aatatattacaaccgatacc

SEQ ID NO: 22853 - DNA, 20 bp, Artificial Sequence
  chemically synthesized
ttacaaccgataccacagaa

SEQ ID NO: 22854 - DNA, 20 bp, Artificial Sequence
  chemically synthesized
accacctaccaagattgaat

SEQ ID NO: 22855 - DNA, 20 bp, Artificial Sequence
  chemically synthesized
cctaccaagattgaattaag

SEQ ID NO: 22856 - DNA, 20 bp, Artificial Sequence
  chemically synthesized
caagattgaattaagaaaga

SEQ ID NO: 22857 - DNA, 20 bp, Artificial Sequence
  chemically synthesized
gtagtaaaaagtctcccaaa

SEQ ID NO: 22858 - DNA, 20 bp, Artificial Sequence
  chemically synthesized
tcaaattttaccaaactttc

SEQ ID NO: 22859 - DNA, 20 bp, Artificial Sequence
  chemically synthesized
atatgatcatctcaatagat

SEQ ID NO: 22860 - DNA, 20 bp, Artificial Sequence
  chemically synthesized
ctagccacagctttcaggtc

SEQ ID NO: 22861 - DNA, 20 bp, Artificial Sequence
  chemically synthesized
ccacagctttcaggtcagag

SEQ ID NO: 22862 - DNA, 20 bp, Artificial Sequence
  chemically synthesized
agctttcaggtcagagaaag

SEQ ID NO: 22863 - DNA, 20 bp, Artificial Sequence
  chemically synthesized
ttcaggtcagagaaagaaag

SEQ ID NO: 22864 - DNA, 20 bp, Artificial Sequence
  chemically synthesized
cagatgacatgattttatac

SEQ ID NO: 22865 - DNA, 20 bp, Artificial Sequence
  chemically synthesized
aaaactacaaaacactgata

SEQ ID NO: 22866 - DNA, 20 bp, Artificial Sequence
  chemically synthesized
tgataaaagaattgaaaagg

SEQ ID NO: 22867 - DNA, 20 bp, Artificial Sequence
  chemically synthesized
agatatcctatgttcatgga

SEQ ID NO: 22868 - DNA, 20 bp, Artificial Sequence
  chemically synthesized
aaatagcaatgtcatttttc

SEQ ID NO: 22869 - DNA, 20 bp, Artificial Sequence
  chemically synthesized
cagacacttagaccaatgga

SEQ ID NO: 22870 - DNA, 20 bp, Artificial Sequence
  chemically synthesized
aatggaagagaatagagaac

SEQ ID NO: 22871 - DNA, 20 bp, Artificial Sequence
  chemically synthesized
cagattttcaacaaaggtga

SEQ ID NO: 22872 - DNA, 20 bp, Artificial Sequence
  chemically synthesized
tgaggaaaggacacagtgtt

SEQ ID NO: 22873 - DNA, 20 bp, Artificial Sequence
  chemically synthesized
ccattggatatccatgtgca

SEQ ID NO: 22874 - DNA, 20 bp, Artificial Sequence
  chemically synthesized
cctaaacacacactcccact

SEQ ID NO: 22875 - DNA, 20 bp, Artificial Sequence
  chemically synthesized
tacaggtgtagaggaagcag

SEQ ID NO: 22876 - DNA, 20 bp, Artificial Sequence
  chemically synthesized
agaacaattactaatagacc

SEQ ID NO: 22877 - DNA, 20 bp, Artificial Sequence
  chemically synthesized
gcactagacagttcatcaag

SEQ ID NO: 22878 - DNA, 20 bp, Artificial Sequence
  chemically synthesized
caggaccagatggattcaca

SEQ ID NO: 22879 - DNA, 20 bp, Artificial Sequence
  chemically synthesized
cagggaaggacataaccaaa

SEQ ID NO: 22880 - DNA, 20 bp, Artificial Sequence
  chemically synthesized
acatgatcatctcaatagat

SEQ ID NO: 22881 - DNA, 20 bp, Artificial Sequence
  chemically synthesized
ccagggcaatcagacaaaac

SEQ ID NO: 22882 - DNA, 20 bp, Artificial Sequence
  chemically synthesized
ttaaaaccctaaagactcct

SEQ ID NO: 22883 - DNA, 20 bp, Artificial Sequence
  chemically synthesized
tacaccaacagcaaccaaat

SEQ ID NO: 22884 - DNA, 20 bp, Artificial Sequence
  chemically synthesized
ttaaaactataaaactacta

SEQ ID NO: 22885 - DNA, 20 bp, Artificial Sequence
  chemically synthesized
aagagacaagctgttgaatg

SEQ ID NO: 22886 - DNA, 20 bp, Artificial Sequence
  chemically synthesized
atttgacaaggaattaatct

SEQ ID NO: 22887 - DNA, 20 bp, Artificial Sequence
  chemically synthesized
gaattaatctccagaatata

SEQ ID NO: 22888 - DNA, 20 bp, Artificial Sequence
  chemically synthesized
gctcaacattactaatcatc

SEQ ID NO: 22889 - DNA, 20 bp, Artificial Sequence
  chemically synthesized
gagatatcatcttatgccag

SEQ ID NO: 22890 - DNA, 20 bp, Artificial Sequence
  chemically synthesized
ctgggtatttatccaaagga

SEQ ID NO: 22891 - DNA, 20 bp, Artificial Sequence
  chemically synthesized
tttatccaaaggaaaagaat

SEQ ID NO: 22892 - DNA, 20 bp, Artificial Sequence
  chemically synthesized
gtgtccatcaatggatgaat

SEQ ID NO: 22893 - DNA, 20 bp, Artificial Sequence
  chemically synthesized
ttaaacgaaataagccaggc

SEQ ID NO: 22894 - DNA, 20 bp, Artificial Sequence
  chemically synthesized
taatatcatgtaggtagaga

SEQ ID NO: 22895 - DNA, 20 bp, Artificial Sequence
  chemically synthesized
tgtaggtagagagtagaatg

SEQ ID NO: 22896 - DNA, 20 bp, Artificial Sequence
  chemically synthesized
gaatgacagaaaccagaggt

SEQ ID NO: 22897 - DNA, 20 bp, Artificial Sequence
  chemically synthesized
ttgtatatttcaaaatagta

SEQ ID NO: 22898 - DNA, 20 bp, Artificial Sequence
  chemically synthesized
tcttgaaatgttcctaacac

SEQ ID NO: 22899 - DNA, 20 bp, Artificial Sequence
  chemically synthesized
aaacacgtcatatatcaata

SEQ ID NO: 22900 - DNA, 20 bp, Artificial Sequence
  chemically synthesized
caaacttctctcttaacaag

SEQ ID NO: 22901 - DNA, 20 bp, Artificial Sequence
  chemically synthesized
ggttttattctgacattaaa

SEQ ID NO: 22902 - DNA, 20 bp, Artificial Sequence
  chemically synthesized
agtatcacaactttcacctg

SEQ ID NO: 22903 - DNA, 20 bp, Artificial Sequence
  chemically synthesized
aatcactatttcaaagaagt

SEQ ID NO: 22904 - DNA, 20 bp, Artificial Sequence
  chemically synthesized
tatacatattatacacatat

SEQ ID NO: 22905 - DNA, 20 bp, Artificial Sequence
  chemically synthesized
tccacatcagtaattagggc

SEQ ID NO: 22906 - DNA, 20 bp, Artificial Sequence
  chemically synthesized
attttatgaataaattttat

SEQ ID NO: 22907 - DNA, 20 bp, Artificial Sequence
  chemically synthesized
tacaggtagattttatatat

SEQ ID NO: 22908 - DNA, 20 bp, Artificial Sequence
  chemically synthesized
gtgagcctccatggccagct

SEQ ID NO: 22909 - DNA, 20 bp, Artificial Sequence
  chemically synthesized
gagaaattttttaaatttct

SEQ ID NO: 22910 - DNA, 20 bp, Artificial Sequence
  chemically synthesized
tttaaaagtggtggggggta

SEQ ID NO: 22911 - DNA, 20 bp, Artificial Sequence
  chemically synthesized
gatccttttcattttgctct

SEQ ID NO: 22912 - DNA, 20 bp, Artificial Sequence
  chemically synthesized
aagtgtgaagtcctcttctc

SEQ ID NO: 22913 - DNA, 20 bp, Artificial Sequence
  chemically synthesized
tagatataatttctgaaggt

SEQ ID NO: 22914 - DNA, 20 bp, Artificial Sequence
  chemically synthesized
gttctgagcaagtgtgtgca

SEQ ID NO: 22915 - DNA, 20 bp, Artificial Sequence
  chemically synthesized
agtacttcccactactgtgg

SEQ ID NO: 22916 - DNA, 20 bp, Artificial Sequence
  chemically synthesized
caaacctctaggtaactagg

SEQ ID NO: 22917 - DNA, 20 bp, Artificial Sequence
  chemically synthesized
atttgtcaattcttgaagat

SEQ ID NO: 22918 - DNA, 20 bp, Artificial Sequence
  chemically synthesized
aaaaaggttattttgaagtc

SEQ ID NO: 22919 - DNA, 20 bp, Artificial Sequence
  chemically synthesized
gcagcaagggattcttctcc

SEQ ID NO: 22920 - DNA, 20 bp, Artificial Sequence
  chemically synthesized
tgaatacatttccttgtttg

SEQ ID NO: 22921 - DNA, 20 bp, Artificial Sequence
  chemically synthesized
ataacattcattttattcat

SEQ ID NO: 22922 - DNA, 20 bp, Artificial Sequence
  chemically synthesized
tcagtttaaggggttctttt

SEQ ID NO: 22923 - DNA, 20 bp, Artificial Sequence
  chemically synthesized
gggttctttttcagaaagtt

SEQ ID NO: 22924 - DNA, 20 bp, Artificial Sequence
  chemically synthesized
aaattcaaatcattaaattt

SEQ ID NO: 22925 - DNA, 20 bp, Artificial Sequence
  chemically synthesized
ttccccttgaaagggaaatg

SEQ ID NO: 22926 - DNA, 20 bp, Artificial Sequence
  chemically synthesized
cattaatgtttgttaaatga

SEQ ID NO: 22927 - DNA, 20 bp, Artificial Sequence
  chemically synthesized
tgagctcctgcccactctct

SEQ ID NO: 22928 - DNA, 20 bp, Artificial Sequence
  chemically synthesized
tggactggaaaaatttgtga

SEQ ID NO: 22929 - DNA, 20 bp, Artificial Sequence
  chemically synthesized
aggataaagatctctgagga

SEQ ID NO: 22930 - DNA, 20 bp, Artificial Sequence
  chemically synthesized
aagaatacaaaataatttaa

SEQ ID NO: 22931 - DNA, 20 bp, Artificial Sequence
  chemically synthesized
aaataatttaaaaagaaaca

SEQ ID NO: 22932 - DNA, 20 bp, Artificial Sequence
  chemically synthesized
attctttctcactaaactac

SEQ ID NO: 22933 - DNA, 20 bp, Artificial Sequence
  chemically synthesized
ataaggtgaattctgatttt

SEQ ID NO: 22934 - DNA, 20 bp, Artificial Sequence
  chemically synthesized
tcctacataagcatagcatt

SEQ ID NO: 22935 - DNA, 20 bp, Artificial Sequence
  chemically synthesized
agcatttcatataattacta

SEQ ID NO: 22936 - DNA, 20 bp, Artificial Sequence
  chemically synthesized
gtttaattatactattttgc

SEQ ID NO: 22937 - DNA, 20 bp, Artificial Sequence
  chemically synthesized
tgaaatcttatgtgcttccc

SEQ ID NO: 22938 - DNA, 20 bp, Artificial Sequence
  chemically synthesized
accgtcctcacaatacctgc

SEQ ID NO: 22939 - DNA, 20 bp, Artificial Sequence
  chemically synthesized
acaatacctgcccagaaaga

SEQ ID NO: 22940 - DNA, 20 bp, Artificial Sequence
  chemically synthesized
agaaagacgagaaagaggag

SEQ ID NO: 22941 - DNA, 20 bp, Artificial Sequence
  chemically synthesized
ggagtctcggaggactgtaa

SEQ ID NO: 22942 - DNA, 20 bp, Artificial Sequence
  chemically synthesized
cttgtgtatgtgttgaagag

SEQ ID NO: 22943 - DNA, 20 bp, Artificial Sequence
  chemically synthesized
aaaatccatattatgacaac

SEQ ID NO: 22944 - DNA, 20 bp, Artificial Sequence
  chemically synthesized
tagtaattatatgaaatgct

SEQ ID NO: 22945 - DNA, 20 bp, Artificial Sequence
  chemically synthesized
ggcaaaatactgtgctcctt

SEQ ID NO: 22946 - DNA, 20 bp, Artificial Sequence
  chemically synthesized
ttatgtaggaattataaaat

SEQ ID NO: 22947 - DNA, 20 bp, Artificial Sequence
  chemically synthesized
actattgaaggaacattagc

SEQ ID NO: 22948 - DNA, 20 bp, Artificial Sequence
  chemically synthesized
gctgagttcctcaagatctt

SEQ ID NO: 22949 - DNA, 20 bp, Artificial Sequence
  chemically synthesized
taaaggatctgaaataataa

SEQ ID NO: 22950 - DNA, 20 bp, Artificial Sequence
  chemically synthesized
atggcatgcattctgaaaaa

SEQ ID NO: 22951 - DNA, 20 bp, Artificial Sequence
  chemically synthesized
ttttgcctatgtagaagtgg

SEQ ID NO: 22952 - DNA, 20 bp, Artificial Sequence
  chemically synthesized
tcttattctctgtagtttag

SEQ ID NO: 22953 - DNA, 20 bp, Artificial Sequence
  chemically synthesized
attctctgtagtttagtgag

SEQ ID NO: 22954 - DNA, 20 bp, Artificial Sequence
  chemically synthesized
gtgagaaagaatctaggagg

SEQ ID NO: 22955 - DNA, 20 bp, Artificial Sequence
  chemically synthesized
tctagaacagtgcctggtac

SEQ ID NO: 22956 - DNA, 20 bp, Artificial Sequence
  chemically synthesized
ttcacttttttactattatg

SEQ ID NO: 22957 - DNA, 20 bp, Artificial Sequence
  chemically synthesized
caaggaaatgtattcacatc

SEQ ID NO: 22958 - DNA, 20 bp, Artificial Sequence
  chemically synthesized
aaacaaaaggtttcttagga

SEQ ID NO: 22959 - DNA, 20 bp, Artificial Sequence
  chemically synthesized
aggagaagaatcccttgctg

SEQ ID NO: 22960 - DNA, 20 bp, Artificial Sequence
  chemically synthesized
agaggcgagggagatagagt

SEQ ID NO: 22961 - DNA, 20 bp, Artificial Sequence
  chemically synthesized
cagaactgattcttaatctt

SEQ ID NO: 22962 - DNA, 20 bp, Artificial Sequence
  chemically synthesized
gaaggataaatagctaaagg

SEQ ID NO: 22963 - DNA, 20 bp, Artificial Sequence
  chemically synthesized
ctcagaacattacaaactct

SEQ ID NO: 22964 - DNA, 20 bp, Artificial Sequence
  chemically synthesized
acacataatgaaagttaatt

SEQ ID NO: 22965 - DNA, 20 bp, Artificial Sequence
  chemically synthesized
tgcttccctcttaaaatgga

SEQ ID NO: 22966 - DNA, 20 bp, Artificial Sequence
  chemically synthesized
catggtacaagtggcacagg

SEQ ID NO: 22967 - DNA, 20 bp, Artificial Sequence
  chemically synthesized
caagtggcacagggaagaat

SEQ ID NO: 22968 - DNA, 20 bp, Artificial Sequence
  chemically synthesized
ctagagtcaaagtggttatg

SEQ ID NO: 22969 - DNA, 20 bp, Artificial Sequence
  chemically synthesized
ctcaaggagtttctaaacct

SEQ ID NO: 22970 - DNA, 20 bp, Artificial Sequence
  chemically synthesized
cacttttcaaggctgaggtg

SEQ ID NO: 22971 - DNA, 20 bp, Artificial Sequence
  chemically synthesized
catagggagaccctgtttct

SEQ ID NO: 22972 - DNA, 20 bp, Artificial Sequence
  chemically synthesized
taataatgttgtgaaaatta

SEQ ID NO: 22973 - DNA, 20 bp, Artificial Sequence
  chemically synthesized
ttgcatttttaaacacaaaa

SEQ ID NO: 22974 - DNA, 20 bp, Artificial Sequence
  chemically synthesized
ctttgattttaactgaggat

SEQ ID NO: 22975 - DNA, 20 bp, Artificial Sequence
  chemically synthesized
agagagagcgagagagaggc

SEQ ID NO: 22976 - DNA, 20 bp, Artificial Sequence
  chemically synthesized
aagtattttcttttttaatg

SEQ ID NO: 22977 - DNA, 20 bp, Artificial Sequence
  chemically synthesized
gctaaaatggtgttggaata

SEQ ID NO: 22978 - DNA, 20 bp, Artificial Sequence
  chemically synthesized
tttggtgtgatgctggcttc

SEQ ID NO: 22979 - DNA, 20 bp, Artificial Sequence
  chemically synthesized
gttccttctttatctgtctt

SEQ ID NO: 22980 - DNA, 20 bp, Artificial Sequence
  chemically synthesized
aattcctctttgaatgtcta

SEQ ID NO: 22981 - DNA, 20 bp, Artificial Sequence
  chemically synthesized
cctatcatatggtctacctt

SEQ ID NO: 22982 - DNA, 20 bp, Artificial Sequence
  chemically synthesized
aaatttccacgcgctgttga

SEQ ID NO: 22983 - DNA, 20 bp, Artificial Sequence
  chemically synthesized
taactcaactccaggtaagg

SEQ ID NO: 22984 - DNA, 20 bp, Artificial Sequence
  chemically synthesized
gctattttgatagcggtcat

SEQ ID NO: 22985 - DNA, 20 bp, Artificial Sequence
  chemically synthesized
agctagtttattattggtgt

SEQ ID NO: 22986 - DNA, 20 bp, Artificial Sequence
  chemically synthesized
atcaggataatactggcctc

SEQ ID NO: 22987 - DNA, 20 bp, Artificial Sequence
  chemically synthesized
ggcctcagagaatgagttag

SEQ ID NO: 22988 - DNA, 20 bp, Artificial Sequence
  chemically synthesized
tccttcctgtttaattttta

SEQ ID NO: 22989 - DNA, 20 bp, Artificial Sequence
  chemically synthesized
tcttggtaggtggtatgtgt

SEQ ID NO: 22990 - DNA, 20 bp, Artificial Sequence
  chemically synthesized
tgatctatctgatgctgaga

SEQ ID NO: 22991 - DNA, 20 bp, Artificial Sequence
  chemically synthesized
ctggtgttgagtgtgaatgt

SEQ ID NO: 22992 - DNA, 20 bp, Artificial Sequence
  chemically synthesized
ttccttcaaatttttcttgc

SEQ ID NO: 22993 - DNA, 20 bp, Artificial Sequence
  chemically synthesized
ctggcctgtgaggtttctgc

SEQ ID NO: 22994 - DNA, 20 bp, Artificial Sequence
  chemically synthesized
tttcaataaactcttcagtt

SEQ ID NO: 22995 - DNA, 20 bp, Artificial Sequence
  chemically synthesized
aacattttggattctttttt

SEQ ID NO: 22996 - DNA, 20 bp, Artificial Sequence
  chemically synthesized
ttccactggcttatgttgct

SEQ ID NO: 22997 - DNA, 20 bp, Artificial Sequence
  chemically synthesized
tgatgaggttgtgctggaga

SEQ ID NO: 22998 - DNA, 20 bp, Artificial Sequence
  chemically synthesized
gagtgatcctcaggccccca

SEQ ID NO: 22999 - DNA, 20 bp, Artificial Sequence
  chemically synthesized
tgtcacttctctgttgaatt

SEQ ID NO: 23000 - DNA, 20 bp, Artificial Sequence
  chemically synthesized
aatcatttgtttcttcaaat

SEQ ID NO: 23001 - DNA, 20 bp, Artificial Sequence
  chemically synthesized
catctaataaatgtgtacca

SEQ ID NO: 23002 - DNA, 20 bp, Artificial Sequence
  chemically synthesized
ctcctggaaaagatgaagat

SEQ ID NO: 23003 - DNA, 20 bp, Artificial Sequence
  chemically synthesized
gaaaataagtctacagaaga

SEQ ID NO: 23004 - DNA, 20 bp, Artificial Sequence
  chemically synthesized
tttttgtggatagtggtttt

SEQ ID NO: 23005 - DNA, 20 bp, Artificial Sequence
  chemically synthesized
agatgtgactcccacacttt

SEQ ID NO: 23006 - DNA, 20 bp, Artificial Sequence
  chemically synthesized
ttgatggtttctaaaattgt

SEQ ID NO: 23007 - DNA, 20 bp, Artificial Sequence
  chemically synthesized
agttactggaataatacatt

SEQ ID NO: 23008 - DNA, 20 bp, Artificial Sequence
  chemically synthesized
aacttacaatcatggcagaa

SEQ ID NO: 23009 - DNA, 20 bp, Artificial Sequence
  chemically synthesized
tagttctgtttctagttctt

SEQ ID NO: 23010 - DNA, 20 bp, Artificial Sequence
  chemically synthesized
ggcaggaagcatccagcatg

SEQ ID NO: 23011 - DNA, 20 bp, Artificial Sequence
  chemically synthesized
acccgtgaatcctgtctatg

SEQ ID NO: 23012 - DNA, 20 bp, Artificial Sequence
  chemically synthesized
gaaaaggctgagtggtgtcc

SEQ ID NO: 23013 - DNA, 20 bp, Artificial Sequence
  chemically synthesized
cgttgtccttcagggatgtc

SEQ ID NO: 23014 - DNA, 20 bp, Artificial Sequence
  chemically synthesized
ccatcggtgcagtctcaggg

SEQ ID NO: 23015 - DNA, 20 bp, Artificial Sequence
  chemically synthesized
ccactttatggctagatgga

SEQ ID NO: 23016 - DNA, 20 bp, Artificial Sequence
  chemically synthesized
atcatattaagcagccaact

SEQ ID NO: 23017 - DNA, 20 bp, Artificial Sequence
  chemically synthesized
aatctgtattagggttctac

SEQ ID NO: 23018 - DNA, 20 bp, Artificial Sequence
  chemically synthesized
tattagggttctacagagaa

SEQ ID NO: 23019 - DNA, 20 bp, Artificial Sequence
  chemically synthesized
agttcaatgttccagggcag

SEQ ID NO: 23020 - DNA, 20 bp, Artificial Sequence
  chemically synthesized
ggcaggaagaatccagcatg

SEQ ID NO: 23021 - DNA, 20 bp, Artificial Sequence
  chemically synthesized
ggtagcagcaatattagagg

SEQ ID NO: 23022 - DNA, 20 bp, Artificial Sequence
  chemically synthesized
ggggctgcatgcactggtca

SEQ ID NO: 23023 - DNA, 20 bp, Artificial Sequence
  chemically synthesized
tacttcttctttctttggag

SEQ ID NO: 23024 - DNA, 20 bp, Artificial Sequence
  chemically synthesized
tctcctcccttactaggaag

SEQ ID NO: 23025 - DNA, 20 bp, Artificial Sequence
  chemically synthesized
aggaagagagaaataccatg

SEQ ID NO: 23026 - DNA, 20 bp, Artificial Sequence
  chemically synthesized
gaagggactttaaaacatgc

SEQ ID NO: 23027 - DNA, 20 bp, Artificial Sequence
  chemically synthesized
aattgctaacctgaatgata

SEQ ID NO: 23028 - DNA, 20 bp, Artificial Sequence
  chemically synthesized
cctccaaagaaagaagaagt

SEQ ID NO: 23029 - DNA, 20 bp, Artificial Sequence
  chemically synthesized
aatattgctgctacctctat

SEQ ID NO: 23030 - DNA, 20 bp, Artificial Sequence
  chemically synthesized
atccagcaagtccacatcta

SEQ ID NO: 23031 - DNA, 20 bp, Artificial Sequence
  chemically synthesized
agaatttatgaccaagtcct

SEQ ID NO: 23032 - DNA, 20 bp, Artificial Sequence
  chemically synthesized
tcctcaaaactaaacacaac

SEQ ID NO: 23033 - DNA, 20 bp, Artificial Sequence
  chemically synthesized
aaactaaacacaacaaaaac

SEQ ID NO: 23034 - DNA, 20 bp, Artificial Sequence
  chemically synthesized
tacaaggaactcaacaacaa

SEQ ID NO: 23035 - DNA, 20 bp, Artificial Sequence
  chemically synthesized
atggacctctatgattagtc

SEQ ID NO: 23036 - DNA, 20 bp, Artificial Sequence
  chemically synthesized
tatttcctccttcttttgtt

SEQ ID NO: 23037 - DNA, 20 bp, Artificial Sequence
  chemically synthesized
ggatataaagcaggcagaaa

SEQ ID NO: 23038 - DNA, 20 bp, Artificial Sequence
  chemically synthesized
aataatcagagaatgcaaat

SEQ ID NO: 23039 - DNA, 20 bp, Artificial Sequence
  chemically synthesized
tggctatcattataaagttc

SEQ ID NO: 23040 - DNA, 20 bp, Artificial Sequence
  chemically synthesized
taggagtatggtgaggactg

SEQ ID NO: 23041 - DNA, 20 bp, Artificial Sequence
  chemically synthesized
catttttcactgctgtcttt

SEQ ID NO: 23042 - DNA, 20 bp, Artificial Sequence
  chemically synthesized
aaatatatctaagctttctt

SEQ ID NO: 23043 - DNA, 20 bp, Artificial Sequence
  chemically synthesized
tatttacattttttatcctt

SEQ ID NO: 23044 - DNA, 20 bp, Artificial Sequence
  chemically synthesized
tgcatcttactcagagatct

SEQ ID NO: 23045 - DNA, 20 bp, Artificial Sequence
  chemically synthesized
ttgggaaatgaaatgaaaag

SEQ ID NO: 23046 - DNA, 20 bp, Artificial Sequence
  chemically synthesized
tctttcagtctattagaaat

SEQ ID NO: 23047 - DNA, 20 bp, Artificial Sequence
  chemically synthesized
agaaaaaagtcttcccctac

SEQ ID NO: 23048 - DNA, 20 bp, Artificial Sequence
  chemically synthesized
cccctacaaaaacaaattta

SEQ ID NO: 23049 - DNA, 20 bp, Artificial Sequence
  chemically synthesized
aaacaataaaaagaaatcag

SEQ ID NO: 23050 - DNA, 20 bp, Artificial Sequence
  chemically synthesized
aagaaatacaaaatacattc

SEQ ID NO: 23051 - DNA, 20 bp, Artificial Sequence
  chemically synthesized
tacgtaacaacacaatagct

SEQ ID NO: 23052 - DNA, 20 bp, Artificial Sequence
  chemically synthesized
aagccaaagagtaagaactc

SEQ ID NO: 23053 - DNA, 20 bp, Artificial Sequence
  chemically synthesized
tatacaactaactggtagag

SEQ ID NO: 23054 - DNA, 20 bp, Artificial Sequence
  chemically synthesized
gaaaaggaaggaaggaagaa

SEQ ID NO: 23055 - DNA, 20 bp, Artificial Sequence
  chemically synthesized
aaggaaggaagaaaaaaaca

SEQ ID NO: 23056 - DNA, 20 bp, Artificial Sequence
  chemically synthesized
caaaacaaacaaactaaaaa

SEQ ID NO: 23057 - DNA, 20 bp, Artificial Sequence
  chemically synthesized
caaacaaactaaaaaaaaaa

SEQ ID NO: 23058 - DNA, 20 bp, Artificial Sequence
  chemically synthesized
atagactggctaaatagatt

SEQ ID NO: 23059 - DNA, 20 bp, Artificial Sequence
  chemically synthesized
gataaaattgactttaaata

SEQ ID NO: 23060 - DNA, 20 bp, Artificial Sequence
  chemically synthesized
cttctcagaccacaatggaa

SEQ ID NO: 23061 - DNA, 20 bp, Artificial Sequence
  chemically synthesized
aactagaaatcaataacaag

SEQ ID NO: 23062 - DNA, 20 bp, Artificial Sequence
  chemically synthesized
atcaataacaagaaaaactt

SEQ ID NO: 23063 - DNA, 20 bp, Artificial Sequence
  chemically synthesized
tatcaataaacacttaaatt

SEQ ID NO: 23064 - DNA, 20 bp, Artificial Sequence
  chemically synthesized
acaagctagaaaagcaagaa

SEQ ID NO: 23065 - DNA, 20 bp, Artificial Sequence
  chemically synthesized
agaaaagcaagaacaaaacc

SEQ ID NO: 23066 - DNA, 20 bp, Artificial Sequence
  chemically synthesized
aagaacttaatgaaatagag

SEQ ID NO: 23067 - DNA, 20 bp, Artificial Sequence
  chemically synthesized
ttatgaacaaccatacacta

SEQ ID NO: 23068 - DNA, 20 bp, Artificial Sequence
  chemically synthesized
gattgaattaagaaagaata

SEQ ID NO: 23069 - DNA, 20 bp, Artificial Sequence
  chemically synthesized
aattttaccaaactttcaaa

SEQ ID NO: 23070 - DNA, 20 bp, Artificial Sequence
  chemically synthesized
gacaaggatgcaagtaaaaa

SEQ ID NO: 23071 - DNA, 20 bp, Artificial Sequence
  chemically synthesized
atcacatcaacaaaaagaac

SEQ ID NO: 23072 - DNA, 20 bp, Artificial Sequence
  chemically synthesized
atttaacattccttcatgat

SEQ ID NO: 23073 - DNA, 20 bp, Artificial Sequence
  chemically synthesized
tgacatgattttatacctag

SEQ ID NO: 23074 - DNA, 20 bp, Artificial Sequence
  chemically synthesized
taaatttaaccaaggaaccg

SEQ ID NO: 23075 - DNA, 20 bp, Artificial Sequence
  chemically synthesized
aaccgaaaaacctctattcg

SEQ ID NO: 23076 - DNA, 20 bp, Artificial Sequence
  chemically synthesized
aacctctattcggaaaacta

SEQ ID NO: 23077 - DNA, 20 bp, Artificial Sequence
  chemically synthesized
gtcatttttcacagaaatgg

SEQ ID NO: 23078 - DNA, 20 bp, Artificial Sequence
  chemically synthesized
gatatccatgtgcaaaagaa

SEQ ID NO: 23079 - DNA, 20 bp, Artificial Sequence
  chemically synthesized
ggccaccaaaagtgagtagg

SEQ ID NO: 23080 - DNA, 20 bp, Artificial Sequence
  chemically synthesized
ctatgaagccagcatcacac

SEQ ID NO: 23081 - DNA, 20 bp, Artificial Sequence
  chemically synthesized
ggaaggacataaccaaaaaa

SEQ ID NO: 23082 - DNA, 20 bp, Artificial Sequence
  chemically synthesized
tacaccacataaacagattt

SEQ ID NO: 23083 - DNA, 20 bp, Artificial Sequence
  chemically synthesized
tcctagccagggcaatcaga

SEQ ID NO: 23084 - DNA, 20 bp, Artificial Sequence
  chemically synthesized
atgatatgatcatttacctt

SEQ ID NO: 23085 - DNA, 20 bp, Artificial Sequence
  chemically synthesized
aacccctatttattgccata

SEQ ID NO: 23086 - DNA, 20 bp, Artificial Sequence
  chemically synthesized
atggattaaagacttaaata

SEQ ID NO: 23087 - DNA, 20 bp, Artificial Sequence
  chemically synthesized
aaagacttaaatataaaact

SEQ ID NO: 23088 - DNA, 20 bp, Artificial Sequence
  chemically synthesized
aaatataaaacttaaaacta

SEQ ID NO: 23089 - DNA, 20 bp, Artificial Sequence
  chemically synthesized
aaactataaaactactaaaa

SEQ ID NO: 23090 - DNA, 20 bp, Artificial Sequence
  chemically synthesized
ctcaaacaactcaacagtgg

SEQ ID NO: 23091 - DNA, 20 bp, Artificial Sequence
  chemically synthesized
atcatcagagaaatgcaaat

SEQ ID NO: 23092 - DNA, 20 bp, Artificial Sequence
  chemically synthesized
aaattagtatagccactatg

SEQ ID NO: 23093 - DNA, 20 bp, Artificial Sequence
  chemically synthesized
aaagtagggtgattatagtt

SEQ ID NO: 23094 - DNA, 20 bp, Artificial Sequence
  chemically synthesized
acatataacaatgaggtggt

SEQ ID NO: 23095 - DNA, 20 bp, Artificial Sequence
  chemically synthesized
ctaatctcaccctcctgttc

SEQ ID NO: 23096 - DNA, 20 bp, Artificial Sequence
  chemically synthesized
aggagaaaaagaggaagaac

SEQ ID NO: 23097 - DNA, 20 bp, Artificial Sequence
  chemically synthesized
ctctagagaaaagccatttg

SEQ ID NO: 23098 - DNA, 20 bp, Artificial Sequence
  chemically synthesized
ggaaaacttctgtgttaaca

SEQ ID NO: 23099 - DNA, 20 bp, Artificial Sequence
  chemically synthesized
agcaatacgttggcttaggc

SEQ ID NO: 23100 - DNA, 20 bp, Artificial Sequence
  chemically synthesized
atttttcccccacatttggg

SEQ ID NO: 23101 - DNA, 20 bp, Artificial Sequence
  chemically synthesized
actggtaacagtgcttcttc

SEQ ID NO: 23102 - DNA, 20 bp, Artificial Sequence
  chemically synthesized
cattgttcataccctggaga

SEQ ID NO: 23103 - DNA, 20 bp, Artificial Sequence
  chemically synthesized
gaagtctgagaattagtacc

SEQ ID NO: 23104 - DNA, 20 bp, Artificial Sequence
  chemically synthesized
atacatttccttgtttgcca

SEQ ID NO: 23105 - DNA, 20 bp, Artificial Sequence
  chemically synthesized
atctataggacatttccttt

SEQ ID NO: 23106 - DNA, 20 bp, Artificial Sequence
  chemically synthesized
cattgtggggacctctccac

SEQ ID NO: 23107 - DNA, 20 bp, Artificial Sequence
  chemically synthesized
taaaggcagcttaggggttg

SEQ ID NO: 23108 - DNA, 20 bp, Artificial Sequence
  chemically synthesized
gctcctgcccactctctaga

SEQ ID NO: 23109 - DNA, 20 bp, Artificial Sequence
  chemically synthesized
caggaactttgggcatattt

SEQ ID NO: 23110 - DNA, 20 bp, Artificial Sequence
  chemically synthesized
gtgactagaaaaaggacatt

SEQ ID NO: 23111 - DNA, 20 bp, Artificial Sequence
  chemically synthesized
atcttgaggaactcagcctt

SEQ ID NO: 23112 - DNA, 20 bp, Artificial Sequence
  chemically synthesized
cttttgagaagctcctgaat

SEQ ID NO: 23113 - DNA, 20 bp, Artificial Sequence
  chemically synthesized
tattttgctgagaaaaattt

SEQ ID NO: 23114 - DNA, 20 bp, Artificial Sequence
  chemically synthesized
aataaagaaaatcaaattga

SEQ ID NO: 23115 - DNA, 20 bp, Artificial Sequence
  chemically synthesized
taaagacatctgtaaaatta

SEQ ID NO: 23116 - DNA, 20 bp, Artificial Sequence
  chemically synthesized
ggacatagcttattggtgga

SEQ ID NO: 23117 - DNA, 20 bp, Artificial Sequence
  chemically synthesized
attatgtaagaattaaatat

SEQ ID NO: 23118 - DNA, 20 bp, Artificial Sequence
  chemically synthesized
ggaaatgtattcacatccaa

SEQ ID NO: 23119 - DNA, 20 bp, Artificial Sequence
  chemically synthesized
ccatgaacaatggaaacgtg

SEQ ID NO: 23120 - DNA, 20 bp, Artificial Sequence
  chemically synthesized
tagttacctagaggtttggg

SEQ ID NO: 23121 - DNA, 20 bp, Artificial Sequence
  chemically synthesized
gtggcacagggaagaattca

SEQ ID NO: 23122 - DNA, 20 bp, Artificial Sequence
  chemically synthesized
gtgaaacacacgatctatgt

SEQ ID NO: 23123 - DNA, 20 bp, Artificial Sequence
  chemically synthesized
ttcaatgacctacgctgtgg

SEQ ID NO: 23124 - DNA, 20 bp, Artificial Sequence
  chemically synthesized
tttcttttttaatgtcagaa

SEQ ID NO: 23125 - DNA, 20 bp, Artificial Sequence
  chemically synthesized
aaatgtgctttataaatagt

SEQ ID NO: 23126 - DNA, 20 bp, Artificial Sequence
  chemically synthesized
aagtgtgctatataaacagt

SEQ ID NO: 23127 - DNA, 20 bp, Artificial Sequence
  chemically synthesized
tcaaggataaaaaatgtaaa

SEQ ID NO: 23128 - DNA, 20 bp, Artificial Sequence
  chemically synthesized
aacttctttttgatacagta

SEQ ID NO: 23129 - DNA, 20 bp, Artificial Sequence
  chemically synthesized
ttaagaaatatagtagctat

SEQ ID NO: 23130 - DNA, 20 bp, Artificial Sequence
  chemically synthesized
gactgggtaatttataagga

SEQ ID NO: 23131 - DNA, 20 bp, Artificial Sequence
  chemically synthesized
aaagggggaaaagccgctta

SEQ ID NO: 23132 - DNA, 20 bp, Artificial Sequence
  chemically synthesized
cataattatgcctaacatac

SEQ ID NO: 23133 - DNA, 20 bp, Artificial Sequence
  chemically synthesized
accttaattccaggacatgg

SEQ ID NO: 23134 - DNA, 20 bp, Artificial Sequence
  chemically synthesized
cttctgttctggactccact

SEQ ID NO: 23135 - DNA, 20 bp, Artificial Sequence
  chemically synthesized
gcagccaactccagaaaccc

SEQ ID NO: 23136 - DNA, 20 bp, Artificial Sequence
  chemically synthesized
ctcacatgttcacaaggtcc

SEQ ID NO: 23137 - DNA, 20 bp, Artificial Sequence
  chemically synthesized
gtagcaggacaagctgcata

SEQ ID NO: 23138 - DNA, 20 bp, Artificial Sequence
  chemically synthesized
ttggaggcagaaattgggca

SEQ ID NO: 23139 - DNA, 20 bp, Artificial Sequence
  chemically synthesized
taggagatttcttcataatt

SEQ ID NO: 23140 - DNA, 20 bp, Artificial Sequence
  chemically synthesized
catgcacctagaagggactt

SEQ ID NO: 23141 - DNA, 20 bp, Artificial Sequence
  chemically synthesized
actgtgattcagacaaaggc

SEQ ID NO: 23142 - DNA, 20 bp, Artificial Sequence
  chemically synthesized
ttctctccccattcatctgc

SEQ ID NO: 23143 - DNA, 20 bp, Artificial Sequence
  chemically synthesized
cctccaactgttaaaaggaa

SEQ ID NO: 23144 - DNA, 20 bp, Artificial Sequence
  chemically synthesized
tattatcattcaggttagca

SEQ ID NO: 23145 - DNA, 20 bp, Artificial Sequence
  chemically synthesized
taataagggatggaaatgag

SEQ ID NO: 23146 - DNA, 20 bp, Artificial Sequence
  chemically synthesized
catttaggatccactaagcc

SEQ ID NO: 23147 - DNA, 20 bp, Artificial Sequence
  chemically synthesized
aagggacaccaacgaatggt

SEQ ID NO: 23148 - DNA, 20 bp, Artificial Sequence
  chemically synthesized
actgctttgttcaattctgt

SEQ ID NO: 23149 - DNA, 20 bp, Artificial Sequence
  chemically synthesized
tatgttcaaataacagctgc

SEQ ID NO: 23150 - DNA, 20 bp, Artificial Sequence
  chemically synthesized
agtaccttttgataaggaga

SEQ ID NO: 23151 - DNA, 20 bp, Artificial Sequence
  chemically synthesized
tgcttatagatgttcataga

SEQ ID NO: 23152 - DNA, 20 bp, Artificial Sequence
  chemically synthesized
agggaggagaccacccttca

SEQ ID NO: 23153 - DNA, 20 bp, Artificial Sequence
  chemically synthesized
acctggccagttatgttatc

SEQ ID NO: 23154 - DNA, 20 bp, Artificial Sequence
  chemically synthesized
ggacaggaattgctcactct

SEQ ID NO: 23155 - DNA, 20 bp, Artificial Sequence
  chemically synthesized
cttctttaactcggtgtctg

SEQ ID NO: 23156 - DNA, 20 bp, Artificial Sequence
  chemically synthesized
ggtgtctgaggggttttgta

SEQ ID NO: 23157 - DNA, 20 bp, Artificial Sequence
  chemically synthesized
aattaaggagagtatgaaaa

SEQ ID NO: 23158 - DNA, 20 bp, Artificial Sequence
  chemically synthesized
caaatgggggtaaaataata

SEQ ID NO: 23159 - DNA, 20 bp, Artificial Sequence
  chemically synthesized
agggaaagacaggctctaaa

SEQ ID NO: 23160 - DNA, 20 bp, Artificial Sequence
  chemically synthesized
aatgggacttaattaaacta

SEQ ID NO: 23161 - DNA, 20 bp, Artificial Sequence
  chemically synthesized
atggttaatactgagtgtca

SEQ ID NO: 23162 - DNA, 20 bp, Artificial Sequence
  chemically synthesized
gtctgtgagggtgttaccaa

SEQ ID NO: 23163 - DNA, 20 bp, Artificial Sequence
  chemically synthesized
aggcagaaaaatgtgaaaag

SEQ ID NO: 23164 - DNA, 20 bp, Artificial Sequence
  chemically synthesized
gaaaaatgtgaaaaggctag

SEQ ID NO: 23165 - DNA, 20 bp, Artificial Sequence
  chemically synthesized
agcctacatttttctcccat

SEQ ID NO: 23166 - DNA, 20 bp, Artificial Sequence
  chemically synthesized
gaacattgaactccaggttc

SEQ ID NO: 23167 - DNA, 20 bp, Artificial Sequence
  chemically synthesized
tcttcagctttgggactccg

SEQ ID NO: 23168 - DNA, 20 bp, Artificial Sequence
  chemically synthesized
tgttcctcagctggcagatg

SEQ ID NO: 23169 - DNA, 20 bp, Artificial Sequence
  chemically synthesized
agatatatatctcctattaa

SEQ ID NO: 23170 - DNA, 20 bp, Artificial Sequence
  chemically synthesized
gtttctctgtagaaccctaa

SEQ ID NO: 23171 - DNA, 20 bp, Artificial Sequence
  chemically synthesized
attaaggatggagttctttc

SEQ ID NO: 23172 - DNA, 20 bp, Artificial Sequence
  chemically synthesized
tggagttctttcattggttt

SEQ ID NO: 23173 - DNA, 20 bp, Artificial Sequence
  chemically synthesized
gttttggggtttctggagtt

SEQ ID NO: 23174 - DNA, 20 bp, Artificial Sequence
  chemically synthesized
tttctggagttggctgctta

SEQ ID NO: 23175 - DNA, 20 bp, Artificial Sequence
  chemically synthesized
cactgataatccttggcatc

SEQ ID NO: 23176 - DNA, 20 bp, Artificial Sequence
  chemically synthesized
aaaataaatgcatttgacac

SEQ ID NO: 23177 - DNA, 20 bp, Artificial Sequence
  chemically synthesized
tgcatttgacactcttgatt

SEQ ID NO: 23178 - DNA, 20 bp, Artificial Sequence
  chemically synthesized
ggaacatagtgaagttggtt

SEQ ID NO: 23179 - DNA, 20 bp, Artificial Sequence
  chemically synthesized
actcaggagtatatcaactc

SEQ ID NO: 23180 - DNA, 20 bp, Artificial Sequence
  chemically synthesized
gagcaagaagtagcaaacac

SEQ ID NO: 23181 - DNA, 20 bp, Artificial Sequence
  chemically synthesized
ggacagaggatgggaaataa

SEQ ID NO: 23182 - DNA, 20 bp, Artificial Sequence
  chemically synthesized
agtaaaatttataggggtcc

SEQ ID NO: 23183 - DNA, 20 bp, Artificial Sequence
  chemically synthesized
cacaacgcctagtgggccta

SEQ ID NO: 23184 - DNA, 20 bp, Artificial Sequence
  chemically synthesized
ggattttggaggcaacatat

SEQ ID NO: 23185 - DNA, 20 bp, Artificial Sequence
  chemically synthesized
atcgagtgatccaaaaggct

SEQ ID NO: 23186 - DNA, 20 bp, Artificial Sequence
  chemically synthesized
atatgacctagcagatccaa

SEQ ID NO: 23187 - DNA, 20 bp, Artificial Sequence
  chemically synthesized
gtgtcagtgccagataggga

SEQ ID NO: 23188 - DNA, 20 bp, Artificial Sequence
  chemically synthesized
ctgaatcacagcggaggcct

SEQ ID NO: 23189 - DNA, 20 bp, Artificial Sequence
  chemically synthesized
agaaagctcttggcctgtta

SEQ ID NO: 23190 - DNA, 20 bp, Artificial Sequence
  chemically synthesized
tgaactgcctatcatgaact

SEQ ID NO: 23191 - DNA, 20 bp, Artificial Sequence
  chemically synthesized
agcaaatggaagtggtatat

SEQ ID NO: 23192 - DNA, 20 bp, Artificial Sequence
  chemically synthesized
tggaagtggtatatatgcga

SEQ ID NO: 23193 - DNA, 20 bp, Artificial Sequence
  chemically synthesized
catggtctccactcctgaca

SEQ ID NO: 23194 - DNA, 20 bp, Artificial Sequence
  chemically synthesized
tttgcacagaaggagaaatg

SEQ ID NO: 23195 - DNA, 20 bp, Artificial Sequence
  chemically synthesized
agaaggagaaatggccagat

SEQ ID NO: 23196 - DNA, 20 bp, Artificial Sequence
  chemically synthesized
cttattcatgggctgtagcc

SEQ ID NO: 23197 - DNA, 20 bp, Artificial Sequence
  chemically synthesized
agaggtatgtggatggacct

SEQ ID NO: 23198 - DNA, 20 bp, Artificial Sequence
  chemically synthesized
caatgggtgacctcagcaga

SEQ ID NO: 23199 - DNA, 20 bp, Artificial Sequence
  chemically synthesized
cacagttgcagggatggaag

SEQ ID NO: 23200 - DNA, 20 bp, Artificial Sequence
  chemically synthesized
aaagctgacctggccacagc

SEQ ID NO: 23201 - DNA, 20 bp, Artificial Sequence
  chemically synthesized
cagccagctacctggtggca

SEQ ID NO: 23202 - DNA, 20 bp, Artificial Sequence
  chemically synthesized
tcttccatcatggaaagggc

SEQ ID NO: 23203 - DNA, 20 bp, Artificial Sequence
  chemically synthesized
aatagacacttactctggat

SEQ ID NO: 23204 - DNA, 20 bp, Artificial Sequence
  chemically synthesized
gggtttcccaatcctgaact

SEQ ID NO: 23205 - DNA, 20 bp, Artificial Sequence
  chemically synthesized
tgtcatggtattccacacag

SEQ ID NO: 23206 - DNA, 20 bp, Artificial Sequence
  chemically synthesized
catgatccctatcatcctga

SEQ ID NO: 23207 - DNA, 20 bp, Artificial Sequence
  chemically synthesized
ttttgaatggccttttgaag

SEQ ID NO: 23208 - DNA, 20 bp, Artificial Sequence
  chemically synthesized
aatcagtgtccaatatatgg

SEQ ID NO: 23209 - DNA, 20 bp, Artificial Sequence
  chemically synthesized
tggtactgtttctcccatag

SEQ ID NO: 23210 - DNA, 20 bp, Artificial Sequence
  chemically synthesized
tagtgttccactagcaaaat

SEQ ID NO: 23211 - DNA, 20 bp, Artificial Sequence
  chemically synthesized
ttcccatggcattatgttct

SEQ ID NO: 23212 - DNA, 20 bp, Artificial Sequence
  chemically synthesized
actgccgccaggtgacacaa

SEQ ID NO: 23213 - DNA, 20 bp, Artificial Sequence
  chemically synthesized
tgattccattaaactgcaaa

SEQ ID NO: 23214 - DNA, 20 bp, Artificial Sequence
  chemically synthesized
gagagttacagtgttggctg

SEQ ID NO: 23215 - DNA, 20 bp, Artificial Sequence
  chemically synthesized
ggagatccattagggtgtct

SEQ ID NO: 23216 - DNA, 20 bp, Artificial Sequence
  chemically synthesized
ttccaggcaggactacaaat

SEQ ID NO: 23217 - DNA, 20 bp, Artificial Sequence
  chemically synthesized
aaaaaagacaagacctgctg

SEQ ID NO: 23218 - DNA, 20 bp, Artificial Sequence
  chemically synthesized
tttttcctttatcatgtgac

SEQ ID NO: 23219 - DNA, 20 bp, Artificial Sequence
  chemically synthesized
atatcagcatttaagtattg

SEQ ID NO: 23220 - DNA, 20 bp, Artificial Sequence
  chemically synthesized
ttatgtaatagcatttgcaa

SEQ ID NO: 23221 - DNA, 20 bp, Artificial Sequence
  chemically synthesized
gcattttcaattgcacgaag

SEQ ID NO: 23222 - DNA, 20 bp, Artificial Sequence
  chemically synthesized
atggttaatactgagtgtca

SEQ ID NO: 23223 - DNA, 20 bp, Artificial Sequence
  chemically synthesized
taatactgagtgtcaacttg

SEQ ID NO: 23224 - DNA, 20 bp, Artificial Sequence
  chemically synthesized
gtctgtgagggtattgccaa

SEQ ID NO: 23225 - DNA, 20 bp, Artificial Sequence
  chemically synthesized
aaaacatgtgaaaatcctgg

SEQ ID NO: 23226 - DNA, 20 bp, Artificial Sequence
  chemically synthesized
ctacatctttctcccatgct

SEQ ID NO: 23227 - DNA, 20 bp, Artificial Sequence
  chemically synthesized
aaacattggactccaagtcc

SEQ ID NO: 23228 - DNA, 20 bp, Artificial Sequence
  chemically synthesized
ccttcagctttgggacttgg

SEQ ID NO: 23229 - DNA, 20 bp, Artificial Sequence
  chemically synthesized
ttggactggcttccttgctc

SEQ ID NO: 23230 - DNA, 20 bp, Artificial Sequence
  chemically synthesized
agatggcctattgtgggacc

SEQ ID NO: 23231 - DNA, 20 bp, Artificial Sequence
  chemically synthesized
gtgaggatgtggagacaaga

SEQ ID NO: 23232 - DNA, 20 bp, Artificial Sequence
  chemically synthesized
aaactttatggaagacagca

SEQ ID NO: 23233 - DNA, 20 bp, Artificial Sequence
  chemically synthesized
caacctaaatgtctaccaat

SEQ ID NO: 23234 - DNA, 20 bp, Artificial Sequence
  chemically synthesized
tatggtgaggactgaaaaac

SEQ ID NO: 23235 - DNA, 20 bp, Artificial Sequence
  chemically synthesized
aacatacatatgtaaggaac

SEQ ID NO: 23236 - DNA, 20 bp, Artificial Sequence
  chemically synthesized
aacccgagcttgtaccctga

SEQ ID NO: 23237 - DNA, 20 bp, Artificial Sequence
  chemically synthesized
ataatcctcacgtgttgtgg

SEQ ID NO: 23238 - DNA, 20 bp, Artificial Sequence
  chemically synthesized
agtgagttcttacaagatct

SEQ ID NO: 23239 - DNA, 20 bp, Artificial Sequence
  chemically synthesized
caagatctgatggttttata

SEQ ID NO: 23240 - DNA, 20 bp, Artificial Sequence
  chemically synthesized
ttataagcggcttttccccc

SEQ ID NO: 23241 - DNA, 20 bp, Artificial Sequence
  chemically synthesized
ctgctgccatgtgaagaagg

SEQ ID NO: 23242 - DNA, 20 bp, Artificial Sequence
  chemically synthesized
tgccatgtgaagaaggacat

SEQ ID NO: 23243 - DNA, 20 bp, Artificial Sequence
  chemically synthesized
catgtttgtttcttcttctg

SEQ ID NO: 23244 - DNA, 20 bp, Artificial Sequence
  chemically synthesized
tttcttcttctgccatgatt

SEQ ID NO: 23245 - DNA, 20 bp, Artificial Sequence
  chemically synthesized
tgtggaactgtgagacaatt

SEQ ID NO: 23246 - DNA, 20 bp, Artificial Sequence
  chemically synthesized
aaaaatataaaataaattag

SEQ ID NO: 23247 - DNA, 20 bp, Artificial Sequence
  chemically synthesized
gagtgtgcaaggaaagagta

SEQ ID NO: 23248 - DNA, 20 bp, Artificial Sequence
  chemically synthesized
gtgagaatacacaaataatc

SEQ ID NO: 23249 - DNA, 20 bp, Artificial Sequence
  chemically synthesized
atattccatttcatcagact

SEQ ID NO: 23250 - DNA, 20 bp, Artificial Sequence
  chemically synthesized
gatgctattatatggtacca

SEQ ID NO: 23251 - DNA, 20 bp, Artificial Sequence
  chemically synthesized
taagaatttcatctttaagg

SEQ ID NO: 23252 - DNA, 20 bp, Artificial Sequence
  chemically synthesized
agttttttactgtatcaaaa

SEQ ID NO: 23253 - DNA, 20 bp, Artificial Sequence
  chemically synthesized
tctagactggacaagaacag

SEQ ID NO: 23254 - DNA, 20 bp, Artificial Sequence
  chemically synthesized
agcaacatatttaaatatat

SEQ ID NO: 23255 - DNA, 20 bp, Artificial Sequence
  chemically synthesized
cttttccaggagaatatacc

SEQ ID NO: 23256 - DNA, 20 bp, Artificial Sequence
  chemically synthesized
tctgatggtacacatttatt

SEQ ID NO: 23257 - DNA, 20 bp, Artificial Sequence
  chemically synthesized
actcagagatcttaaaacat

SEQ ID NO: 23258 - DNA, 20 bp, Artificial Sequence
  chemically synthesized
atcttaaaacatccttgttt

SEQ ID NO: 23259 - DNA, 20 bp, Artificial Sequence
  chemically synthesized
tgaagaacataagggggaaa

SEQ ID NO: 23260 - DNA, 20 bp, Artificial Sequence
  chemically synthesized
gattctttatttgaagaaac

SEQ ID NO: 23261 - DNA, 20 bp, Artificial Sequence
  chemically synthesized
tttatttgaagaaacaaatg

SEQ ID NO: 23262 - DNA, 20 bp, Artificial Sequence
  chemically synthesized
tagtcccccatatagcctta

SEQ ID NO: 23263 - DNA, 20 bp, Artificial Sequence
  chemically synthesized
atagccttagagtgtttaaa

SEQ ID NO: 23264 - DNA, 20 bp, Artificial Sequence
  chemically synthesized
gtctattagaaataaaaaca

SEQ ID NO: 23265 - DNA, 20 bp, Artificial Sequence
  chemically synthesized
gcttaaaaaatttcaaggga

SEQ ID NO: 23266 - DNA, 20 bp, Artificial Sequence
  chemically synthesized
aaatttcaagggaaggggct

SEQ ID NO: 23267 - DNA, 20 bp, Artificial Sequence
  chemically synthesized
ctgaggtcaggaacacccag

SEQ ID NO: 23268 - DNA, 20 bp, Artificial Sequence
  chemically synthesized
ccaccaccaacaccagtgca

SEQ ID NO: 23269 - DNA, 20 bp, Artificial Sequence
  chemically synthesized
aaacagaaattctgtaactg

SEQ ID NO: 23270 - DNA, 20 bp, Artificial Sequence
  chemically synthesized
agtgaacaaatattcaaatt

SEQ ID NO: 23271 - DNA, 20 bp, Artificial Sequence
  chemically synthesized
tcacttataagggaacttcc

SEQ ID NO: 23272 - DNA, 20 bp, Artificial Sequence
  chemically synthesized
aagggaacttccacaagatt

SEQ ID NO: 23273 - DNA, 20 bp, Artificial Sequence
  chemically synthesized
cacaagattaacagattaac

SEQ ID NO: 23274 - DNA, 20 bp, Artificial Sequence
  chemically synthesized
aaggaattcactatcactag

SEQ ID NO: 23275 - DNA, 20 bp, Artificial Sequence
  chemically synthesized
caataatagccttgcatgta

SEQ ID NO: 23276 - DNA, 20 bp, Artificial Sequence
  chemically synthesized
tgaaagatatagactggcta

SEQ ID NO: 23277 - DNA, 20 bp, Artificial Sequence
  chemically synthesized
gaatccaatacaataatagt

SEQ ID NO: 23278 - DNA, 20 bp, Artificial Sequence
  chemically synthesized
cagaaaattaacaaagaaac

SEQ ID NO: 23279 - DNA, 20 bp, Artificial Sequence
  chemically synthesized
agcaaaagcagtgctaagag

SEQ ID NO: 23280 - DNA, 20 bp, Artificial Sequence
  chemically synthesized
acacttaaattaaaaacata

SEQ ID NO: 23281 - DNA, 20 bp, Artificial Sequence
  chemically synthesized
aaatagagaaaaacaacaac

SEQ ID NO: 23282 - DNA, 20 bp, Artificial Sequence
  chemically synthesized
aaccgataccacagaaatag

SEQ ID NO: 23283 - DNA, 20 bp, Artificial Sequence
  chemically synthesized
ttctggacacataccaccta

SEQ ID NO: 23284 - DNA, 20 bp, Artificial Sequence
  chemically synthesized
aaaagaaaatttcaagacca

SEQ ID NO: 23285 - DNA, 20 bp, Artificial Sequence
  chemically synthesized
attctctgaggccagtatta

SEQ ID NO: 23286 - DNA, 20 bp, Artificial Sequence
  chemically synthesized
agataatacaccatgatcaa

SEQ ID NO: 23287 - DNA, 20 bp, Artificial Sequence
  chemically synthesized
ataatactggaagtcctagc

SEQ ID NO: 23288 - DNA, 20 bp, Artificial Sequence
  chemically synthesized
actgtccatctttccagatg

SEQ ID NO: 23289 - DNA, 20 bp, Artificial Sequence
  chemically synthesized
aaatcagcatatgaaacaag

SEQ ID NO: 23290 - DNA, 20 bp, Artificial Sequence
  chemically synthesized
ccatactacccaaagcaatc

SEQ ID NO: 23291 - DNA, 20 bp, Artificial Sequence
  chemically synthesized
aatgctagaggtatcatact

SEQ ID NO: 23292 - DNA, 20 bp, Artificial Sequence
  chemically synthesized
gcatccacatatttatagcc

SEQ ID NO: 23293 - DNA, 20 bp, Artificial Sequence
  chemically synthesized
gaataaaactggactgctga

SEQ ID NO: 23294 - DNA, 20 bp, Artificial Sequence
  chemically synthesized
ctggactgctgatatggttt

SEQ ID NO: 23295 - DNA, 20 bp, Artificial Sequence
  chemically synthesized
cttggcggatgggaggtagg

SEQ ID NO: 23296 - DNA, 20 bp, Artificial Sequence
  chemically synthesized
cccacagaccctctgaagga

SEQ ID NO: 23297 - DNA, 20 bp, Artificial Sequence
  chemically synthesized
tcccactggagaaactgaag

SEQ ID NO: 23298 - DNA, 20 bp, Artificial Sequence
  chemically synthesized
actgaaggtctgtttgtggg

SEQ ID NO: 23299 - DNA, 20 bp, Artificial Sequence
  chemically synthesized
cagaaagtcaacaaaaaaat

SEQ ID NO: 23300 - DNA, 20 bp, Artificial Sequence
  chemically synthesized
taacagaccaataacaagca

SEQ ID NO: 23301 - DNA, 20 bp, Artificial Sequence
  chemically synthesized
caaaaaaaagttcaggacca

SEQ ID NO: 23302 - DNA, 20 bp, Artificial Sequence
  chemically synthesized
ttccatgccagggatgcagg

SEQ ID NO: 23303 - DNA, 20 bp, Artificial Sequence
  chemically synthesized
taagtgtgatacaccacata

SEQ ID NO: 23304 - DNA, 20 bp, Artificial Sequence
  chemically synthesized
caacaaaatccagcatacat

SEQ ID NO: 23305 - DNA, 20 bp, Artificial Sequence
  chemically synthesized
taaagaggaagtcaaactgt

SEQ ID NO: 23306 - DNA, 20 bp, Artificial Sequence
  chemically synthesized
gaactgataaaataattcag

SEQ ID NO: 23307 - DNA, 20 bp, Artificial Sequence
  chemically synthesized
catataaaacgtactctcaa

SEQ ID NO: 23308 - DNA, 20 bp, Artificial Sequence
  chemically synthesized
ataagggagacacttcaaga

SEQ ID NO: 23309 - DNA, 20 bp, Artificial Sequence
  chemically synthesized
cttcaagacatggctttggg

SEQ ID NO: 23310 - DNA, 20 bp, Artificial Sequence
  chemically synthesized
tcttatgccagttagaatca

SEQ ID NO: 23311 - DNA, 20 bp, Artificial Sequence
  chemically synthesized
agccactatggaaaacaata

SEQ ID NO: 23312 - DNA, 20 bp, Artificial Sequence
  chemically synthesized
ataaacagatactggtacca

SEQ ID NO: 23313 - DNA, 20 bp, Artificial Sequence
  chemically synthesized
gtaccacactgtttattgca

SEQ ID NO: 23314 - DNA, 20 bp, Artificial Sequence
  chemically synthesized
tgatgttcaatagcaaagta

SEQ ID NO: 23315 - DNA, 20 bp, Artificial Sequence
  chemically synthesized
tcgatctcatattggttgag

SEQ ID NO: 23316 - DNA, 20 bp, Artificial Sequence
  chemically synthesized
ccctgtactgtcttgctgtg

SEQ ID NO: 23317 - DNA, 20 bp, Artificial Sequence
  chemically synthesized
tgtcctccccatatttttac

SEQ ID NO: 23318 - DNA, 20 bp, Artificial Sequence
  chemically synthesized
catatttttacctcggtttt

SEQ ID NO: 23319 - DNA, 20 bp, Artificial Sequence
  chemically synthesized
ttatatagcacactttgtgc

SEQ ID NO: 23320 - DNA, 20 bp, Artificial Sequence
  chemically synthesized
cactttgtgctatagtttac

SEQ ID NO: 23321 - DNA, 20 bp, Artificial Sequence
  chemically synthesized
catatttgaggtataaacca

SEQ ID NO: 23322 - DNA, 20 bp, Artificial Sequence
  chemically synthesized
tatttttaaatctgcaaata

SEQ ID NO: 23323 - DNA, 20 bp, Artificial Sequence
  chemically synthesized
acttaatatcattaatgaat

SEQ ID NO: 23324 - DNA, 20 bp, Artificial Sequence
  chemically synthesized
ttcctggaacaacatggggg

SEQ ID NO: 23325 - DNA, 20 bp, Artificial Sequence
  chemically synthesized
gagaaatttcactattttgt

SEQ ID NO: 23326 - DNA, 20 bp, Artificial Sequence
  chemically synthesized
aggcagcaggtctggtagga

SEQ ID NO: 23327 - DNA, 20 bp, Artificial Sequence
  chemically synthesized
tgaaaaggaagtgagtagac

SEQ ID NO: 23328 - DNA, 20 bp, Artificial Sequence
  chemically synthesized
cttgaagctgtgcaaccaag

SEQ ID NO: 23329 - DNA, 20 bp, Artificial Sequence
  chemically synthesized
gcatagtttttacatagatc

SEQ ID NO: 23330 - DNA, 20 bp, Artificial Sequence
  chemically synthesized
tgtgtttcacatggtgtgat

SEQ ID NO: 23331 - DNA, 20 bp, Artificial Sequence
  chemically synthesized
agatgccattgacatggccc

SEQ ID NO: 23332 - DNA, 20 bp, Artificial Sequence
  chemically synthesized
aatcctaattactatgcatc

SEQ ID NO: 23333 - DNA, 20 bp, Artificial Sequence
  chemically synthesized
ttttcctattatttctcttt

SEQ ID NO: 23334 - DNA, 20 bp, Artificial Sequence
  chemically synthesized
gaaataagctaatacctaca

SEQ ID NO: 23335 - DNA, 20 bp, Artificial Sequence
  chemically synthesized
taaatgctaggcacagttct

SEQ ID NO: 23336 - DNA, 20 bp, Artificial Sequence
  chemically synthesized
attttcacaacattattaca

SEQ ID NO: 23337 - DNA, 20 bp, Artificial Sequence
  chemically synthesized
agcaacaaattgatggatct

SEQ ID NO: 23338 - DNA, 20 bp, Artificial Sequence
  chemically synthesized
aaattgatggatctttttgc

SEQ ID NO: 23339 - DNA, 20 bp, Artificial Sequence
  chemically synthesized
tgatggatctttttgctttt

SEQ ID NO: 23340 - DNA, 20 bp, Artificial Sequence
  chemically synthesized
ggatctttttgcttttgctt

SEQ ID NO: 23341 - DNA, 20 bp, Artificial Sequence
  chemically synthesized
actgaagcctcactagaacg

SEQ ID NO: 23342 - DNA, 20 bp, Artificial Sequence
  chemically synthesized
cgcctggattcaattgatcc

SEQ ID NO: 23343 - DNA, 20 bp, Artificial Sequence
  chemically synthesized
cacctcagccttgaaaagtg

SEQ ID NO: 23344 - DNA, 20 bp, Artificial Sequence
  chemically synthesized
aatttttagatataatttct

SEQ ID NO: 23345 - DNA, 20 bp, Artificial Sequence
  chemically synthesized
tcttccataaccactttgac

SEQ ID NO: 23346 - DNA, 20 bp, Artificial Sequence
  chemically synthesized
taaattatgtccagcaatac

SEQ ID NO: 23347 - DNA, 20 bp, Artificial Sequence
  chemically synthesized
cgttggcttaggcaaaaaca

SEQ ID NO: 23348 - DNA, 20 bp, Artificial Sequence
  chemically synthesized
ccttaacatgttaatttctc

SEQ ID NO: 23349 - DNA, 20 bp, Artificial Sequence
  chemically synthesized
tgagcaagtgtgtgcagaag

SEQ ID NO: 23350 - DNA, 20 bp, Artificial Sequence
  chemically synthesized
tcctctccctcaactggtaa

SEQ ID NO: 23351 - DNA, 20 bp, Artificial Sequence
  chemically synthesized
cttaaggctattaactcccc

SEQ ID NO: 23352 - DNA, 20 bp, Artificial Sequence
  chemically synthesized
atatatagttctctcacata

SEQ ID NO: 23353 - DNA, 20 bp, Artificial Sequence
  chemically synthesized
ctcaaacatctcatcattag

SEQ ID NO: 23354 - DNA, 20 bp, Artificial Sequence
  chemically synthesized
tctacaaatttgtcaattct

SEQ ID NO: 23355 - DNA, 20 bp, Artificial Sequence
  chemically synthesized
gaatccttactgaataataa

SEQ ID NO: 23356 - DNA, 20 bp, Artificial Sequence
  chemically synthesized
aactgtgactctctcatctg

SEQ ID NO: 23357 - DNA, 20 bp, Artificial Sequence
  chemically synthesized
tctctcatctgttatgtttt

SEQ ID NO: 23358 - DNA, 20 bp, Artificial Sequence
  chemically synthesized
atgggcaaaattctggcagc

SEQ ID NO: 23359 - DNA, 20 bp, Artificial Sequence
  chemically synthesized
gattcttctcctaagaaacc

SEQ ID NO: 23360 - DNA, 20 bp, Artificial Sequence
  chemically synthesized
tcttggatgtgaatacattt

SEQ ID NO: 23361 - DNA, 20 bp, Artificial Sequence
  chemically synthesized
tattcatgaagaaactgtta

SEQ ID NO: 23362 - DNA, 20 bp, Artificial Sequence
  chemically synthesized
gtttaaggggttctttttca

SEQ ID NO: 23363 - DNA, 20 bp, Artificial Sequence
  chemically synthesized
aggacatttcctttgaaaac

SEQ ID NO: 23364 - DNA, 20 bp, Artificial Sequence
  chemically synthesized
atcctggtcctaactctgcc

SEQ ID NO: 23365 - DNA, 20 bp, Artificial Sequence
  chemically synthesized
ttgctctatgaactggagga

SEQ ID NO: 23366 - DNA, 20 bp, Artificial Sequence
  chemically synthesized
gatagaaaataagtattaaa

SEQ ID NO: 23367 - DNA, 20 bp, Artificial Sequence
  chemically synthesized
cctgagatcaacacacatgc

SEQ ID NO: 23368 - DNA, 20 bp, Artificial Sequence
  chemically synthesized
ttataagatccataaaataa

SEQ ID NO: 23369 - DNA, 20 bp, Artificial Sequence
  chemically synthesized
cccaggtaacagtgctccat

SEQ ID NO: 23370 - DNA, 20 bp, Artificial Sequence
  chemically synthesized
acttgtgcagagatcttctg

SEQ ID NO: 23371 - DNA, 20 bp, Artificial Sequence
  chemically synthesized
cccagtgctaacaagtccct

SEQ ID NO: 23372 - DNA, 20 bp, Artificial Sequence
  chemically synthesized
cttttatttcaaggcatact

SEQ ID NO: 23373 - DNA, 20 bp, Artificial Sequence
  chemically synthesized
aatacttcacttctctgtaa

SEQ ID NO: 23374 - DNA, 20 bp, Artificial Sequence
  chemically synthesized
tgtaataaggtttctgtcct

SEQ ID NO: 23375 - DNA, 20 bp, Artificial Sequence
  chemically synthesized
ctaaactacagagaataaga

SEQ ID NO: 23376 - DNA, 20 bp, Artificial Sequence
  chemically synthesized
taggcaaaattgacttttaa

SEQ ID NO: 23377 - DNA, 20 bp, Artificial Sequence
  chemically synthesized
aacagttagtataaggtgaa

SEQ ID NO: 23378 - DNA, 20 bp, Artificial Sequence
  chemically synthesized
catatataatgcatttaatt

SEQ ID NO: 23379 - DNA, 20 bp, Artificial Sequence
  chemically synthesized
taattttgagattatgctgg

SEQ ID NO: 23380 - DNA, 20 bp, Artificial Sequence
  chemically synthesized
ctggttattatttcagatcc

SEQ ID NO: 23381 - DNA, 20 bp, Artificial Sequence
  chemically synthesized
caacacatgacataatttca

SEQ ID NO: 23382 - DNA, 20 bp, Artificial Sequence
  chemically synthesized
tgccatttacccagcaatca

SEQ ID NO: 23383 - DNA, 20 bp, Artificial Sequence
  chemically synthesized
atttacccagcaatcagttg

SEQ ID NO: 23384 - DNA, 20 bp, Artificial Sequence
  chemically synthesized
gagagtataaacccacaagg

SEQ ID NO: 23385 - DNA, 20 bp, Artificial Sequence
  chemically synthesized
gaggttatacctcactcgca

SEQ ID NO: 23386 - DNA, 20 bp, Artificial Sequence
  chemically synthesized
actcgcaaattgttttatca

SEQ ID NO: 23387 - DNA, 20 bp, Artificial Sequence
  chemically synthesized
ttactaacagaatgtagagt

SEQ ID NO: 23388 - DNA, 20 bp, Artificial Sequence
  chemically synthesized
atatacatcttcctaaaata

SEQ ID NO: 23389 - DNA, 20 bp, Artificial Sequence
  chemically synthesized
ttatttctatgttgtcataa

SEQ ID NO: 23390 - DNA, 20 bp, Artificial Sequence
  chemically synthesized
aaatgtagcctaaatatata

SEQ ID NO: 23391 - DNA, 20 bp, Artificial Sequence
  chemically synthesized
cctaaatatatattccgttt

SEQ ID NO: 23392 - DNA, 20 bp, Artificial Sequence
  chemically synthesized
cctccgagactcctttgaat

SEQ ID NO: 23393 - DNA, 20 bp, Artificial Sequence
  chemically synthesized
agttagagttggtagagtta

SEQ ID NO: 23394 - DNA, 20 bp, Artificial Sequence
  chemically synthesized
tggtagagttaccaggcttt

SEQ ID NO: 23395 - DNA, 20 bp, Artificial Sequence
  chemically synthesized
aactagtagcatgaaatctt

SEQ ID NO: 23396 - DNA, 20 bp, Artificial Sequence
  chemically synthesized
aggaattctgtgggaagcac

SEQ ID NO: 23397 - DNA, 20 bp, Artificial Sequence
  chemically synthesized
agcacataagatttcatgct

SEQ ID NO: 23398 - DNA, 20 bp, Artificial Sequence
  chemically synthesized
tgcctgtaagttctcttctc

SEQ ID NO: 23399 - DNA, 20 bp, Artificial Sequence
  chemically synthesized
gtctcggaggactgtaagaa

SEQ ID NO: 23400 - DNA, 20 bp, Artificial Sequence
  chemically synthesized
cctctctgtaacatccctgg

SEQ ID NO: 23401 - DNA, 20 bp, Artificial Sequence
  chemically synthesized
gaggagttactgctctttga

SEQ ID NO: 23402 - DNA, 20 bp, Artificial Sequence
  chemically synthesized
ttgcttgggaagtgaccaat

SEQ ID NO: 23403 - DNA, 20 bp, Artificial Sequence
  chemically synthesized
aggtgactgaggaatgtaga

SEQ ID NO: 23404 - DNA, 20 bp, Artificial Sequence
  chemically synthesized
aaaaagttaatatttacatt

SEQ ID NO: 23405 - DNA, 20 bp, Artificial Sequence
  chemically synthesized
tttattttaggaagatgtat

SEQ ID NO: 23406 - DNA, 20 bp, Artificial Sequence
  chemically synthesized
attctgttagtaattatatg

SEQ ID NO: 23407 - DNA, 20 bp, Artificial Sequence
  chemically synthesized
taattatatgaaatgcttaa

SEQ ID NO: 23408 - DNA, 20 bp, Artificial Sequence
  chemically synthesized
aagaatgtttcatattcaca

SEQ ID NO: 23409 - DNA, 20 bp, Artificial Sequence
  chemically synthesized
attcacaattagcttggaat

SEQ ID NO: 23410 - DNA, 20 bp, Artificial Sequence
  chemically synthesized
tggaattaatgttttaattc

SEQ ID NO: 23411 - DNA, 20 bp, Artificial Sequence
  chemically synthesized
agtaatttttttcttcaatg

SEQ ID NO: 23412 - DNA, 20 bp, Artificial Sequence
  chemically synthesized
aaggtagagaaccacaatgt

SEQ ID NO: 23413 - DNA, 20 bp, Artificial Sequence
  chemically synthesized
aaattataaaacaattcctt

SEQ ID NO: 23414 - DNA, 20 bp, Artificial Sequence
  chemically synthesized
ttccttgtgggtttatactc

SEQ ID NO: 23415 - DNA, 20 bp, Artificial Sequence
  chemically synthesized
aacattagcaaagaaaaagt

SEQ ID NO: 23416 - DNA, 20 bp, Artificial Sequence
  chemically synthesized
agatcttgaagaatcaagcc

SEQ ID NO: 23417 - DNA, 20 bp, Artificial Sequence
  chemically synthesized
gtaaatggcagtgatgactt

SEQ ID NO: 23418 - DNA, 20 bp, Artificial Sequence
  chemically synthesized
taacacatttatttttcatt

SEQ ID NO: 23419 - DNA, 20 bp, Artificial Sequence
  chemically synthesized
caaagcacggtcttattctc

SEQ ID NO: 23420 - DNA, 20 bp, Artificial Sequence
  chemically synthesized
aagtgaagtattttatgtgt

SEQ ID NO: 23421 - DNA, 20 bp, Artificial Sequence
  chemically synthesized
attttatgtgtacctgtttc

SEQ ID NO: 23422 - DNA, 20 bp, Artificial Sequence
  chemically synthesized
atctttatcctgaaatgagc

SEQ ID NO: 23423 - DNA, 20 bp, Artificial Sequence
  chemically synthesized
ctagtcacaaatttttccag

SEQ ID NO: 23424 - DNA, 20 bp, Artificial Sequence
  chemically synthesized
cccggagtatgccttgaaat

SEQ ID NO: 23425 - DNA, 20 bp, Artificial Sequence
  chemically synthesized
agtgggcaggagctcaagga

SEQ ID NO: 23426 - DNA, 20 bp, Artificial Sequence
  chemically synthesized
ctgcacctgagcagagcccc

SEQ ID NO: 23427 - DNA, 20 bp, Artificial Sequence
  chemically synthesized
ctggtacatagaaaatgctc

SEQ ID NO: 23428 - DNA, 20 bp, Artificial Sequence
  chemically synthesized
atggatttttttttgaaaaa

SEQ ID NO: 23429 - DNA, 20 bp, Artificial Sequence
  chemically synthesized
ttccctttcaaggggaaggg

SEQ ID NO: 23430 - DNA, 20 bp, Artificial Sequence
  chemically synthesized
tttgtggagaggtccccaca

SEQ ID NO: 23431 - DNA, 20 bp, Artificial Sequence
  chemically synthesized
ttaatattatcatagcctgg

SEQ ID NO: 23432 - DNA, 20 bp, Artificial Sequence
  chemically synthesized
ttatcatagcctggtatggt

SEQ ID NO: 23433 - DNA, 20 bp, Artificial Sequence
  chemically synthesized
ttcatatagatggataatta

SEQ ID NO: 23434 - DNA, 20 bp, Artificial Sequence
  chemically synthesized
tcctaataatacattgccac

SEQ ID NO: 23435 - DNA, 20 bp, Artificial Sequence
  chemically synthesized
cactatagtttctttaaatt

SEQ ID NO: 23436 - DNA, 20 bp, Artificial Sequence
  chemically synthesized
ctcctccagttcatagagca

SEQ ID NO: 23437 - DNA, 20 bp, Artificial Sequence
  chemically synthesized
agcaaatggcagagttagga

SEQ ID NO: 23438 - DNA, 20 bp, Artificial Sequence
  chemically synthesized
taagaattaaatattaaaac

SEQ ID NO: 23439 - DNA, 20 bp, Artificial Sequence
  chemically synthesized
cagtacttgcagtcaaaggt

SEQ ID NO: 23440 - DNA, 20 bp, Artificial Sequence
  chemically synthesized
aagaaccccttaaactgaat

SEQ ID NO: 23441 - DNA, 20 bp, Artificial Sequence
  chemically synthesized
tatactctccagttatctta

SEQ ID NO: 23442 - DNA, 20 bp, Artificial Sequence
  chemically synthesized
tattcacatccaagaaaaca

SEQ ID NO: 23443 - DNA, 20 bp, Artificial Sequence
  chemically synthesized
taacagatgagagagtcaca

SEQ ID NO: 23444 - DNA, 20 bp, Artificial Sequence
  chemically synthesized
ttaatattaaccttgaaatt

SEQ ID NO: 23445 - DNA, 20 bp, Artificial Sequence
  chemically synthesized
taatccattttattattcag

SEQ ID NO: 23446 - DNA, 20 bp, Artificial Sequence
  chemically synthesized
agatagagttaagaatacag

SEQ ID NO: 23447 - DNA, 20 bp, Artificial Sequence
  chemically synthesized
cagtgtaccgtggaatgggg

SEQ ID NO: 23448 - DNA, 20 bp, Artificial Sequence
  chemically synthesized
ggtttctaacctagttacct

SEQ ID NO: 23449 - DNA, 20 bp, Artificial Sequence
  chemically synthesized
gaaaaacctctctaatgatg

SEQ ID NO: 23450 - DNA, 20 bp, Artificial Sequence
  chemically synthesized
gatgggagagacctgcaggg

SEQ ID NO: 23451 - DNA, 20 bp, Artificial Sequence
  chemically synthesized
agggggagttaatagcctta

SEQ ID NO: 23452 - DNA, 20 bp, Artificial Sequence
  chemically synthesized
gggaagtactaagtagtcag

SEQ ID NO: 23453 - DNA, 20 bp, Artificial Sequence
  chemically synthesized
ctgtggtgtgacccaggatg

SEQ ID NO: 23454 - DNA, 20 bp, Artificial Sequence
  chemically synthesized
tttgcccaaatgtgggggaa

SEQ ID NO: 23455 - DNA, 20 bp, Artificial Sequence
  chemically synthesized
aggatatttaggatcattaa

SEQ ID NO: 23456 - DNA, 20 bp, Artificial Sequence
  chemically synthesized
gagcgatgtagtccctaaat

SEQ ID NO: 23457 - DNA, 20 bp, Artificial Sequence
  chemically synthesized
cttaaaatggactagaaaca

SEQ ID NO: 23458 - DNA, 20 bp, Artificial Sequence
  chemically synthesized
cgtattgctggacataattt

SEQ ID NO: 23459 - DNA, 20 bp, Artificial Sequence
  chemically synthesized
ctttgatataagtgaactca

SEQ ID NO: 23460 - DNA, 20 bp, Artificial Sequence
  chemically synthesized
gaagaggacttcacacttcc

SEQ ID NO: 23461 - DNA, 20 bp, Artificial Sequence
  chemically synthesized
gccgtaaagaacaactgctc

SEQ ID NO: 23462 - DNA, 20 bp, Artificial Sequence
  chemically synthesized
agtttaatactaggctactc

SEQ ID NO: 23463 - DNA, 20 bp, Artificial Sequence
  chemically synthesized
cggctgttttttgttaacac

SEQ ID NO: 23464 - DNA, 20 bp, Artificial Sequence
  chemically synthesized
gttaacacagaagttttcca

SEQ ID NO: 23465 - DNA, 20 bp, Artificial Sequence
  chemically synthesized
ccatccttcccgagacctaa

SEQ ID NO: 23466 - DNA, 20 bp, Artificial Sequence
  chemically synthesized
acgatgtttatctttcgtga

SEQ ID NO: 23467 - DNA, 20 bp, Artificial Sequence
  chemically synthesized
agatccatcaaggcccagca

SEQ ID NO: 23468 - DNA, 20 bp, Artificial Sequence
  chemically synthesized
tttcaaggctgaggtgggag

SEQ ID NO: 23469 - DNA, 20 bp, Artificial Sequence
  chemically synthesized
gcctggggaacatagggaga

SEQ ID NO: 23470 - DNA, 20 bp, Artificial Sequence
  chemically synthesized
attgaatccaggcgttctag

SEQ ID NO: 23471 - DNA, 20 bp, Artificial Sequence
  chemically synthesized
ttctagtgaggcttcagtga

SEQ ID NO: 23472 - DNA, 20 bp, Artificial Sequence
  chemically synthesized
gccggggtgacagagtgaga

SEQ ID NO: 23473 - DNA, 20 bp, Artificial Sequence
  chemically synthesized
tctacagctaaagtcagact

SEQ ID NO: 23474 - DNA, 20 bp, Artificial Sequence
  chemically synthesized
ccaccatcacctgggtaatg

SEQ ID NO: 23475 - DNA, 20 bp, Artificial Sequence
  chemically synthesized
attacatagcatctctgtgc

SEQ ID NO: 23476 - DNA, 20 bp, Artificial Sequence
  chemically synthesized
ttaataaacactctgtaggt

SEQ ID NO: 23477 - DNA, 20 bp, Artificial Sequence
  chemically synthesized
gttagctcatgtattgtcat

SEQ ID NO: 23478 - DNA, 20 bp, Artificial Sequence
  chemically synthesized
aatcacgggatgcatagtaa

SEQ ID NO: 23479 - DNA, 20 bp, Artificial Sequence
  chemically synthesized
acacacgatctatgtaaaaa

SEQ ID NO: 23480 - DNA, 20 bp, Artificial Sequence
  chemically synthesized
gtaaaaactatgcttggttg

SEQ ID NO: 23481 - DNA, 20 bp, Artificial Sequence
  chemically synthesized
cctcccactgccaagactgc

SEQ ID NO: 23482 - DNA, 20 bp, Artificial Sequence
  chemically synthesized
cactgccaagactgcagctg

SEQ ID NO: 23483 - DNA, 20 bp, Artificial Sequence
  chemically synthesized
tctaagtgtataatgacttc

SEQ ID NO: 23484 - DNA, 20 bp, Artificial Sequence
  chemically synthesized
gacttcctctgcttctgcaa

SEQ ID NO: 23485 - DNA, 20 bp, Artificial Sequence
  chemically synthesized
ctgtgttttggaacaggagg

SEQ ID NO: 23486 - DNA, 20 bp, Artificial Sequence
  chemically synthesized
tattctatacttctttgaaa

SEQ ID NO: 23487 - DNA, 20 bp, Artificial Sequence
  chemically synthesized
agtgttgccagatgacgact

SEQ ID NO: 23488 - DNA, 20 bp, Artificial Sequence
  chemically synthesized
agatcaataaaatacaaagt

SEQ ID NO: 23489 - DNA, 20 bp, Artificial Sequence
  chemically synthesized
tcagaataaaaccatttatt

SEQ ID NO: 23490 - DNA, 20 bp, Artificial Sequence
  chemically synthesized
tatatgtgtatgtaaatctc

SEQ ID NO: 23491 - DNA, 20 bp, Artificial Sequence
  chemically synthesized
gctcttgcattcacttatat

SEQ ID NO: 23492 - DNA, 20 bp, Artificial Sequence
  chemically synthesized
atattctagcttgttaagag

SEQ ID NO: 23493 - DNA, 20 bp, Artificial Sequence
  chemically synthesized
agagagaagtttggggcaaa

SEQ ID NO: 23494 - DNA, 20 bp, Artificial Sequence
  chemically synthesized
cagggaaatgtctggaggga

SEQ ID NO: 23495 - DNA, 20 bp, Artificial Sequence
  chemically synthesized
ctttcttttattgatatatg

SEQ ID NO: 23496 - DNA, 20 bp, Artificial Sequence
  chemically synthesized
tattcatcacctcaagtatt

SEQ ID NO: 23497 - DNA, 20 bp, Artificial Sequence
  chemically synthesized
ctattttgaaatatacaata

SEQ ID NO: 23498 - DNA, 20 bp, Artificial Sequence
  chemically synthesized
catattccttctatctaact

SEQ ID NO: 23499 - DNA, 20 bp, Artificial Sequence
  chemically synthesized
cgtacacacctttctctacc

SEQ ID NO: 23500 - DNA, 20 bp, Artificial Sequence
  chemically synthesized
gcaaaatttgtctttctatg

SEQ ID NO: 23501 - DNA, 20 bp, Artificial Sequence
  chemically synthesized
gtctttctatgcctggctta

SEQ ID NO: 23502 - DNA, 20 bp, Artificial Sequence
  chemically synthesized
tttcgtttaacataatgact

SEQ ID NO: 23503 - DNA, 20 bp, Artificial Sequence
  chemically synthesized
catccatgttgctgcaaatg

SEQ ID NO: 23504 - DNA, 20 bp, Artificial Sequence
  chemically synthesized
catccattgatggacactta

SEQ ID NO: 23505 - DNA, 20 bp, Artificial Sequence
  chemically synthesized
ataaacagtgtggtaccagt

SEQ ID NO: 23506 - DNA, 20 bp, Artificial Sequence
  chemically synthesized
ctttggataaatacccagta

SEQ ID NO: 23507 - DNA, 20 bp, Artificial Sequence
  chemically synthesized
gatcttatgatagttcaatt

SEQ ID NO: 23508 - DNA, 20 bp, Artificial Sequence
  chemically synthesized
agctttttggtaaatctaca

SEQ ID NO: 23509 - DNA, 20 bp, Artificial Sequence
  chemically synthesized
catagtggctatactaattt

SEQ ID NO: 23510 - DNA, 20 bp, Artificial Sequence
  chemically synthesized
ttattaatttatttaaatca

SEQ ID NO: 23511 - DNA, 20 bp, Artificial Sequence
  chemically synthesized
ggcataagatgatatctcat

SEQ ID NO: 23512 - DNA, 20 bp, Artificial Sequence
  chemically synthesized
aagatgatatctcattgtgg

SEQ ID NO: 23513 - DNA, 20 bp, Artificial Sequence
  chemically synthesized
ggttttgatttgcatttctc

SEQ ID NO: 23514 - DNA, 20 bp, Artificial Sequence
  chemically synthesized
tatcctttgccaatttttta

SEQ ID NO: 23515 - DNA, 20 bp, Artificial Sequence
  chemically synthesized
gccaattttttaatgagatt

SEQ ID NO: 23516 - DNA, 20 bp, Artificial Sequence
  chemically synthesized
tatttgtttttccactgttg

SEQ ID NO: 23517 - DNA, 20 bp, Artificial Sequence
  chemically synthesized
tttttccactgttgagttgt

SEQ ID NO: 23518 - DNA, 20 bp, Artificial Sequence
  chemically synthesized
tttgagtttcttatatattc

SEQ ID NO: 23519 - DNA, 20 bp, Artificial Sequence
  chemically synthesized
gcaaatattttctcgcattc

SEQ ID NO: 23520 - DNA, 20 bp, Artificial Sequence
  chemically synthesized
aacagcttgtctcttcactg

SEQ ID NO: 23521 - DNA, 20 bp, Artificial Sequence
  chemically synthesized
gcttgtctcttcactgtgtt

SEQ ID NO: 23522 - DNA, 20 bp, Artificial Sequence
  chemically synthesized
cctttactgtgcagatgtat

SEQ ID NO: 23523 - DNA, 20 bp, Artificial Sequence
  chemically synthesized
atatagtcccatttgtctat

SEQ ID NO: 23524 - DNA, 20 bp, Artificial Sequence
  chemically synthesized
tctatttttgcttttgttgc

SEQ ID NO: 23525 - DNA, 20 bp, Artificial Sequence
  chemically synthesized
catgtcttgaagtgtctccc

SEQ ID NO: 23526 - DNA, 20 bp, Artificial Sequence
  chemically synthesized
tctcccttatgttttctttt

SEQ ID NO: 23527 - DNA, 20 bp, Artificial Sequence
  chemically synthesized
atgttttcttttagtagttt

SEQ ID NO: 23528 - DNA, 20 bp, Artificial Sequence
  chemically synthesized
cttttagtagttttatagtt

SEQ ID NO: 23529 - DNA, 20 bp, Artificial Sequence
  chemically synthesized
gtctttaatccatcttgaga

SEQ ID NO: 23530 - DNA, 20 bp, Artificial Sequence
  chemically synthesized
tattgtacaaggggttgagt

SEQ ID NO: 23531 - DNA, 20 bp, Artificial Sequence
  chemically synthesized
tacaaggggttgagttcttg

SEQ ID NO: 23532 - DNA, 20 bp, Artificial Sequence
  chemically synthesized
ctgttggtgtatagaagagt

SEQ ID NO: 23533 - DNA, 20 bp, Artificial Sequence
  chemically synthesized
tgaattattttatcagttct

SEQ ID NO: 23534 - DNA, 20 bp, Artificial Sequence
  chemically synthesized
gagctttctggaggagtctt

SEQ ID NO: 23535 - DNA, 20 bp, Artificial Sequence
  chemically synthesized
tcatatcatcagcaaacagt

SEQ ID NO: 23536 - DNA, 20 bp, Artificial Sequence
  chemically synthesized
tgacagtttgacttcctctt

SEQ ID NO: 23537 - DNA, 20 bp, Artificial Sequence
  chemically synthesized
gatttgaatgccctttattt

SEQ ID NO: 23538 - DNA, 20 bp, Artificial Sequence
  chemically synthesized
gccctttatttctttgtttt

SEQ ID NO: 23539 - DNA, 20 bp, Artificial Sequence
  chemically synthesized
cttgttccagttctcagagg

SEQ ID NO: 23540 - DNA, 20 bp, Artificial Sequence
  chemically synthesized
cattcaatattatgttggct

SEQ ID NO: 23541 - DNA, 20 bp, Artificial Sequence
  chemically synthesized
ttggctgtgggtttgtcaca

SEQ ID NO: 23542 - DNA, 20 bp, Artificial Sequence
  chemically synthesized
actgaggtatgtctcttgta

SEQ ID NO: 23543 - DNA, 20 bp, Artificial Sequence
  chemically synthesized
cattttaatcataaatgtat

SEQ ID NO: 23544 - DNA, 20 bp, Artificial Sequence
  chemically synthesized
aatgtatgctggattttgtt

SEQ ID NO: 23545 - DNA, 20 bp, Artificial Sequence
  chemically synthesized
tattgagatgatcatgtaat

SEQ ID NO: 23546 - DNA, 20 bp, Artificial Sequence
  chemically synthesized
catgtaatttttgtttttaa

SEQ ID NO: 23547 - DNA, 20 bp, Artificial Sequence
  chemically synthesized
ccctgcatccctggcatgga

SEQ ID NO: 23548 - DNA, 20 bp, Artificial Sequence
  chemically synthesized
catggaacctgcttgatcat

SEQ ID NO: 23549 - DNA, 20 bp, Artificial Sequence
  chemically synthesized
ttggttatctagtattttgt

SEQ ID NO: 23550 - DNA, 20 bp, Artificial Sequence
  chemically synthesized
gttcatcaaggctatcagtc

SEQ ID NO: 23551 - DNA, 20 bp, Artificial Sequence
  chemically synthesized
cttttttggttatgtccttc

SEQ ID NO: 23552 - DNA, 20 bp, Artificial Sequence
  chemically synthesized
ttccctggttttggtgtgat

SEQ ID NO: 23553 - DNA, 20 bp, Artificial Sequence
  chemically synthesized
tttaattaccaattaaatct

SEQ ID NO: 23554 - DNA, 20 bp, Artificial Sequence
  chemically synthesized
agctccagtgttaggtgcat

SEQ ID NO: 23555 - DNA, 20 bp, Artificial Sequence
  chemically synthesized
agtgttaggtgcatatatgt

SEQ ID NO: 23556 - DNA, 20 bp, Artificial Sequence
  chemically synthesized
tctttgtctcttttaactgc

SEQ ID NO: 23557 - DNA, 20 bp, Artificial Sequence
  chemically synthesized
tcttttaactgctgttgctt

SEQ ID NO: 23558 - DNA, 20 bp, Artificial Sequence
  chemically synthesized
ttaactgctgttgctttaaa

SEQ ID NO: 23559 - DNA, 20 bp, Artificial Sequence
  chemically synthesized
tgagctcccagggcctttct

SEQ ID NO: 23560 - DNA, 20 bp, Artificial Sequence
  chemically synthesized
acttctcccacaaacagacc

SEQ ID NO: 23561 - DNA, 20 bp, Artificial Sequence
  chemically synthesized
tcagtttctccagtgggagt

SEQ ID NO: 23562 - DNA, 20 bp, Artificial Sequence
  chemically synthesized
cagagggtctgtgggtcctc

SEQ ID NO: 23563 - DNA, 20 bp, Artificial Sequence
  chemically synthesized
ctgtgggtcctctcaggatt

SEQ ID NO: 23564 - DNA, 20 bp, Artificial Sequence
  chemically synthesized
ccgccaagatcctgagaagt

SEQ ID NO: 23565 - DNA, 20 bp, Artificial Sequence
  chemically synthesized
gttggggattatatttcaac

SEQ ID NO: 23566 - DNA, 20 bp, Artificial Sequence
  chemically synthesized
catccaaaccatatcagcag

SEQ ID NO: 23567 - DNA, 20 bp, Artificial Sequence
  chemically synthesized
ctgttctaatgtcagtatca

SEQ ID NO: 23568 - DNA, 20 bp, Artificial Sequence
  chemically synthesized
ttttttaatttcatacaaat

SEQ ID NO: 23569 - DNA, 20 bp, Artificial Sequence
  chemically synthesized
taatttcatacaaattttag

SEQ ID NO: 23570 - DNA, 20 bp, Artificial Sequence
  chemically synthesized
gatagcggtcatatagaatc

SEQ ID NO: 23571 - DNA, 20 bp, Artificial Sequence
  chemically synthesized
gcggtcatatagaatctgta

SEQ ID NO: 23572 - DNA, 20 bp, Artificial Sequence
  chemically synthesized
tgaacataggatatctctcc

SEQ ID NO: 23573 - DNA, 20 bp, Artificial Sequence
  chemically synthesized
gtccttttcaattcttttat

SEQ ID NO: 23574 - DNA, 20 bp, Artificial Sequence
  chemically synthesized
caattcttttatcagtgttt

SEQ ID NO: 23575 - DNA, 20 bp, Artificial Sequence
  chemically synthesized
tgttttgtagttttccgaat

SEQ ID NO: 23576 - DNA, 20 bp, Artificial Sequence
  chemically synthesized
ttattttttagctattgtaa

SEQ ID NO: 23577 - DNA, 20 bp, Artificial Sequence
  chemically synthesized
ccttcttaatttccttctca

SEQ ID NO: 23578 - DNA, 20 bp, Artificial Sequence
  chemically synthesized
ttattattggtgtgtagaaa

SEQ ID NO: 23579 - DNA, 20 bp, Artificial Sequence
  chemically synthesized
tattggtgtgtagaaacatt

SEQ ID NO: 23580 - DNA, 20 bp, Artificial Sequence
  chemically synthesized
gaaacattgcttgtttcata

SEQ ID NO: 23581 - DNA, 20 bp, Artificial Sequence
  chemically synthesized
aatttatttttcagcgctaa

SEQ ID NO: 23582 - DNA, 20 bp, Artificial Sequence
  chemically synthesized
taagagtgctttggtggagt

SEQ ID NO: 23583 - DNA, 20 bp, Artificial Sequence
  chemically synthesized
tcatgtcatctggaaagatg

SEQ ID NO: 23584 - DNA, 20 bp, Artificial Sequence
  chemically synthesized
gatggaagtgggcatcctta

SEQ ID NO: 23585 - DNA, 20 bp, Artificial Sequence
  chemically synthesized
tttgtttcagttcttagagg

SEQ ID NO: 23586 - DNA, 20 bp, Artificial Sequence
  chemically synthesized
cagttcttagaggaaaggct

SEQ ID NO: 23587 - DNA, 20 bp, Artificial Sequence
  chemically synthesized
aattcagtatgatgttagct

SEQ ID NO: 23588 - DNA, 20 bp, Artificial Sequence
  chemically synthesized
tatattgagatatgttcctt

SEQ ID NO: 23589 - DNA, 20 bp, Artificial Sequence
  chemically synthesized
tccttctatgattggctgca

SEQ ID NO: 23590 - DNA, 20 bp, Artificial Sequence
  chemically synthesized
tgtatctattgagatgatca

SEQ ID NO: 23591 - DNA, 20 bp, Artificial Sequence
  chemically synthesized
ttgatgtgatgtatcacatt

SEQ ID NO: 23592 - DNA, 20 bp, Artificial Sequence
  chemically synthesized
tattatcttttggatgtact

SEQ ID NO: 23593 - DNA, 20 bp, Artificial Sequence
  chemically synthesized
cttttggatgtactgttgga

SEQ ID NO: 23594 - DNA, 20 bp, Artificial Sequence
  chemically synthesized
tcagtttgctagtattttgt

SEQ ID NO: 23595 - DNA, 20 bp, Artificial Sequence
  chemically synthesized
ttccatcagggatattgacc

SEQ ID NO: 23596 - DNA, 20 bp, Artificial Sequence
  chemically synthesized
atgagttagggagaattcct

SEQ ID NO: 23597 - DNA, 20 bp, Artificial Sequence
  chemically synthesized
aaaagaatttaaggagactt

SEQ ID NO: 23598 - DNA, 20 bp, Artificial Sequence
  chemically synthesized
gagacttgttagttttcttt

SEQ ID NO: 23599 - DNA, 20 bp, Artificial Sequence
  chemically synthesized
ttttttgggagactttttac

SEQ ID NO: 23600 - DNA, 20 bp, Artificial Sequence
  chemically synthesized
attattcattactggtctgt

SEQ ID NO: 23601 - DNA, 20 bp, Artificial Sequence
  chemically synthesized
ccagaaatttattaatttcc

SEQ ID NO: 23602 - DNA, 20 bp, Artificial Sequence
  chemically synthesized
tattaatttcctctagattt

SEQ ID NO: 23603 - DNA, 20 bp, Artificial Sequence
  chemically synthesized
taatatattttcttttttat

SEQ ID NO: 23604 - DNA, 20 bp, Artificial Sequence
  chemically synthesized
tcattttgctaatcccttgt

SEQ ID NO: 23605 - DNA, 20 bp, Artificial Sequence
  chemically synthesized
ttcattttttctttccttct

SEQ ID NO: 23606 - DNA, 20 bp, Artificial Sequence
  chemically synthesized
tttctttccttctgctagtt

SEQ ID NO: 23607 - DNA, 20 bp, Artificial Sequence
  chemically synthesized
ctgctagttttgggttttgt

SEQ ID NO: 23608 - DNA, 20 bp, Artificial Sequence
  chemically synthesized
ttgggttttgttcttgcttt

SEQ ID NO: 23609 - DNA, 20 bp, Artificial Sequence
  chemically synthesized
cttttctagcttgttgaggt

SEQ ID NO: 23610 - DNA, 20 bp, Artificial Sequence
  chemically synthesized
ctagcttgttgaggtacatg

SEQ ID NO: 23611 - DNA, 20 bp, Artificial Sequence
  chemically synthesized
attatatatttgaaatcttt

SEQ ID NO: 23612 - DNA, 20 bp, Artificial Sequence
  chemically synthesized
tctttctatgtttttaattt

SEQ ID NO: 23613 - DNA, 20 bp, Artificial Sequence
  chemically synthesized
tttaatttaagtgtttattg

SEQ ID NO: 23614 - DNA, 20 bp, Artificial Sequence
  chemically synthesized
ttgataagcttctctcttag

SEQ ID NO: 23615 - DNA, 20 bp, Artificial Sequence
  chemically synthesized
gcactgcttttgctgtatcc

SEQ ID NO: 23616 - DNA, 20 bp, Artificial Sequence
  chemically synthesized
tatgttgtatttcaattttc

SEQ ID NO: 23617 - DNA, 20 bp, Artificial Sequence
  chemically synthesized
tttcatttgtttcaaaaaat

SEQ ID NO: 23618 - DNA, 20 bp, Artificial Sequence
  chemically synthesized
ataacgttcattcaggagca

SEQ ID NO: 23619 - DNA, 20 bp, Artificial Sequence
  chemically synthesized
tttaatttccatgtatttgt

SEQ ID NO: 23620 - DNA, 20 bp, Artificial Sequence
  chemically synthesized
ccatgtatttgtataggttt

SEQ ID NO: 23621 - DNA, 20 bp, Artificial Sequence
  chemically synthesized
ggttttaaagtttttcttgt

SEQ ID NO: 23622 - DNA, 20 bp, Artificial Sequence
  chemically synthesized
agtttttcttgttattgatt

SEQ ID NO: 23623 - DNA, 20 bp, Artificial Sequence
  chemically synthesized
tattccattgtggtctgaga

SEQ ID NO: 23624 - DNA, 20 bp, Artificial Sequence
  chemically synthesized
gtggtctgagaagatgctta

SEQ ID NO: 23625 - DNA, 20 bp, Artificial Sequence
  chemically synthesized
tagatccatttggtctaaag

SEQ ID NO: 23626 - DNA, 20 bp, Artificial Sequence
  chemically synthesized
tctaaagtcaagtttaaatc

SEQ ID NO: 23627 - DNA, 20 bp, Artificial Sequence
  chemically synthesized
tctagatgatctatctgatg

SEQ ID NO: 23628 - DNA, 20 bp, Artificial Sequence
  chemically synthesized
aaatccccaactattattgt

SEQ ID NO: 23629 - DNA, 20 bp, Artificial Sequence
  chemically synthesized
caccctttatatctaataac

SEQ ID NO: 23630 - DNA, 20 bp, Artificial Sequence
  chemically synthesized
gatgctctggtgttgagtgt

SEQ ID NO: 23631 - DNA, 20 bp, Artificial Sequence
  chemically synthesized
atgtaatgacttttgtctct

SEQ ID NO: 23632 - DNA, 20 bp, Artificial Sequence
  chemically synthesized
tataactacttttgctcatt

SEQ ID NO: 23633 - DNA, 20 bp, Artificial Sequence
  chemically synthesized
tatttatctttacaagtgag

SEQ ID NO: 23634 - DNA, 20 bp, Artificial Sequence
  chemically synthesized
agtgagataagtttcttata

SEQ ID NO: 23635 - DNA, 20 bp, Artificial Sequence
  chemically synthesized
agcttacaactgggtcatat

SEQ ID NO: 23636 - DNA, 20 bp, Artificial Sequence
  chemically synthesized
caaggctattattgacatgt

SEQ ID NO: 23637 - DNA, 20 bp, Artificial Sequence
  chemically synthesized
cttattcctgccattttgtt

SEQ ID NO: 23638 - DNA, 20 bp, Artificial Sequence
  chemically synthesized
cattttgttaattgattcct

SEQ ID NO: 23639 - DNA, 20 bp, Artificial Sequence
  chemically synthesized
tgttaattgattcctggttg

SEQ ID NO: 23640 - DNA, 20 bp, Artificial Sequence
  chemically synthesized
cctggttgttttgttttttt

SEQ ID NO: 23641 - DNA, 20 bp, Artificial Sequence
  chemically synthesized
gttgttttgtttttttttta

SEQ ID NO: 23642 - DNA, 20 bp, Artificial Sequence
  chemically synthesized
ttttgttttttttttagttt

SEQ ID NO: 23643 - DNA, 20 bp, Artificial Sequence
  chemically synthesized
ttttttttagtttgtttgtt

SEQ ID NO: 23644 - DNA, 20 bp, Artificial Sequence
  chemically synthesized
ctttctttctttcttattat

SEQ ID NO: 23645 - DNA, 20 bp, Artificial Sequence
  chemically synthesized
tctttcttattatttatgat

SEQ ID NO: 23646 - DNA, 20 bp, Artificial Sequence
  chemically synthesized
tattatttatgattgtggtt

SEQ ID NO: 23647 - DNA, 20 bp, Artificial Sequence
  chemically synthesized
ttggtgattttctgtagtgg

SEQ ID NO: 23648 - DNA, 20 bp, Artificial Sequence
  chemically synthesized
gagttctttctcttctttat

SEQ ID NO: 23649 - DNA, 20 bp, Artificial Sequence
  chemically synthesized
ttcaaatttttcttgcccag

SEQ ID NO: 23650 - DNA, 20 bp, Artificial Sequence
  chemically synthesized
tcccatcttctcctggcctg

SEQ ID NO: 23651 - DNA, 20 bp, Artificial Sequence
  chemically synthesized
cccttataagtgactagaca

SEQ ID NO: 23652 - DNA, 20 bp, Artificial Sequence
  chemically synthesized
aagtgactagacattttgct

SEQ ID NO: 23653 - DNA, 20 bp, Artificial Sequence
  chemically synthesized
ctgttttagagttcttactc

SEQ ID NO: 23654 - DNA, 20 bp, Artificial Sequence
  chemically synthesized
gttcttactctttggctttt

SEQ ID NO: 23655 - DNA, 20 bp, Artificial Sequence
  chemically synthesized
gactataatgtgctgtggag

SEQ ID NO: 23656 - DNA, 20 bp, Artificial Sequence
  chemically synthesized
gcattatattatttgggaat

SEQ ID NO: 23657 - DNA, 20 bp, Artificial Sequence
  chemically synthesized
tacatttcttgctagacttg

SEQ ID NO: 23658 - DNA, 20 bp, Artificial Sequence
  chemically synthesized
ttcagctattgtgttgttac

SEQ ID NO: 23659 - DNA, 20 bp, Artificial Sequence
  chemically synthesized
ttcaagttctgaaatttttc

SEQ ID NO: 23660 - DNA, 20 bp, Artificial Sequence
  chemically synthesized
tgcttgatctgatctattgt

SEQ ID NO: 23661 - DNA, 20 bp, Artificial Sequence
  chemically synthesized
aaactcttcagttacagaat

SEQ ID NO: 23662 - DNA, 20 bp, Artificial Sequence
  chemically synthesized
aatttctcattcatatcctg

SEQ ID NO: 23663 - DNA, 20 bp, Artificial Sequence
  chemically synthesized
attcatatcctgaattgttt

SEQ ID NO: 23664 - DNA, 20 bp, Artificial Sequence
  chemically synthesized
ttgtttttctgatttctttt

SEQ ID NO: 23665 - DNA, 20 bp, Artificial Sequence
  chemically synthesized
ctgagttctcttgtgtctca

SEQ ID NO: 23666 - DNA, 20 bp, Artificial Sequence
  chemically synthesized
agcttccttaatatcaacat

SEQ ID NO: 23667 - DNA, 20 bp, Artificial Sequence
  chemically synthesized
tataaatgtcttttttttcc

SEQ ID NO: 23668 - DNA, 20 bp, Artificial Sequence
  chemically synthesized
tgtcatatttcttcaccttt

SEQ ID NO: 23669 - DNA, 20 bp, Artificial Sequence
  chemically synthesized
tgatatctctgcatctggtg

SEQ ID NO: 23670 - DNA, 20 bp, Artificial Sequence
  chemically synthesized
tctgcatctggtgtaatgat

SEQ ID NO: 23671 - DNA, 20 bp, Artificial Sequence
  chemically synthesized
ctggtgtaatgattgctgct

SEQ ID NO: 23672 - DNA, 20 bp, Artificial Sequence
  chemically synthesized
tgctgcttccagttttgtaa

SEQ ID NO: 23673 - DNA, 20 bp, Artificial Sequence
  chemically synthesized
tttctgaagatgtatcttgg

SEQ ID NO: 23674 - DNA, 20 bp, Artificial Sequence
  chemically synthesized
ggtgttgattgagtagggca

SEQ ID NO: 23675 - DNA, 20 bp, Artificial Sequence
  chemically synthesized
gattgagtagggcactttga

SEQ ID NO: 23676 - DNA, 20 bp, Artificial Sequence
  chemically synthesized
gccaacagtatcatcagtgt

SEQ ID NO: 23677 - DNA, 20 bp, Artificial Sequence
  chemically synthesized
tcagtgtctgtgattttttc

SEQ ID NO: 23678 - DNA, 20 bp, Artificial Sequence
  chemically synthesized
gatggtaatgagtctagttg

SEQ ID NO: 23679 - DNA, 20 bp, Artificial Sequence
  chemically synthesized
ggttgattctttggccttca

SEQ ID NO: 23680 - DNA, 20 bp, Artificial Sequence
  chemically synthesized
gattctttggccttcaggca

SEQ ID NO: 23681 - DNA, 20 bp, Artificial Sequence
  chemically synthesized
ctgggctggtgtgtgggtcc

SEQ ID NO: 23682 - DNA, 20 bp, Artificial Sequence
  chemically synthesized
gtgccagttgtgatggcagt

SEQ ID NO: 23683 - DNA, 20 bp, Artificial Sequence
  chemically synthesized
cagattgggtaggcccatca

SEQ ID NO: 23684 - DNA, 20 bp, Artificial Sequence
  chemically synthesized
catcatcaggcttctgggag

SEQ ID NO: 23685 - DNA, 20 bp, Artificial Sequence
  chemically synthesized
tgtctctgggttcccagaca

SEQ ID NO: 23686 - DNA, 20 bp, Artificial Sequence
  chemically synthesized
tcttgaaggggtgcggggtg

SEQ ID NO: 23687 - DNA, 20 bp, Artificial Sequence
  chemically synthesized
taaatgggttgctggtgggc

SEQ ID NO: 23688 - DNA, 20 bp, Artificial Sequence
  chemically synthesized
agtggggtagcattttctta

SEQ ID NO: 23689 - DNA, 20 bp, Artificial Sequence
  chemically synthesized
ctgtgggtgggggatgtcag

SEQ ID NO: 23690 - DNA, 20 bp, Artificial Sequence
  chemically synthesized
ttctctggagcaatgccttt

SEQ ID NO: 23691 - DNA, 20 bp, Artificial Sequence
  chemically synthesized
gtcaagggactctcctgtgg

SEQ ID NO: 23692 - DNA, 20 bp, Artificial Sequence
  chemically synthesized
tcacagaggatccctactgg

SEQ ID NO: 23693 - DNA, 20 bp, Artificial Sequence
  chemically synthesized
gatccctactgggtaggctt

SEQ ID NO: 23694 - DNA, 20 bp, Artificial Sequence
  chemically synthesized
tccctccccttcattgcctt

SEQ ID NO: 23695 - DNA, 20 bp, Artificial Sequence
  chemically synthesized
attccagaattctctcttat

SEQ ID NO: 23696 - DNA, 20 bp, Artificial Sequence
  chemically synthesized
gccccttcccttgaaatttt

SEQ ID NO: 23697 - DNA, 20 bp, Artificial Sequence
  chemically synthesized
cccttgaaattttttaagct

SEQ ID NO: 23698 - DNA, 20 bp, Artificial Sequence
  chemically synthesized
agaagtagcgaattagttaa

SEQ ID NO: 23699 - DNA, 20 bp, Artificial Sequence
  chemically synthesized
ttcatttcccaaatcaaatc

SEQ ID NO: 23700 - DNA, 20 bp, Artificial Sequence
  chemically synthesized
ttatgttcttcagcaaataa

SEQ ID NO: 23701 - DNA, 20 bp, Artificial Sequence
  chemically synthesized
atacgtaatctaacaaacaa

SEQ ID NO: 23702 - DNA, 20 bp, Artificial Sequence
  chemically synthesized
gatgcatagttgcaaataaa

SEQ ID NO: 23703 - DNA, 20 bp, Artificial Sequence
  chemically synthesized
aattttgcatttttgtggat

SEQ ID NO: 23704 - DNA, 20 bp, Artificial Sequence
  chemically synthesized
ttgtggatagtggttttgaa

SEQ ID NO: 23705 - DNA, 20 bp, Artificial Sequence
  chemically synthesized
tagttgcccttgcaaattgg

SEQ ID NO: 23706 - DNA, 20 bp, Artificial Sequence
  chemically synthesized
tttcctcaacaaataatttt

SEQ ID NO: 23707 - DNA, 20 bp, Artificial Sequence
  chemically synthesized
atgacatcaatttatgttaa

SEQ ID NO: 23708 - DNA, 20 bp, Artificial Sequence
  chemically synthesized
tgtctgttcttgtccagtct

SEQ ID NO: 23709 - DNA, 20 bp, Artificial Sequence
  chemically synthesized
ttcttgtccagtctagaagt

SEQ ID NO: 23710 - DNA, 20 bp, Artificial Sequence
  chemically synthesized
ctcatcacataacatctgaa

SEQ ID NO: 23711 - DNA, 20 bp, Artificial Sequence
  chemically synthesized
attatcagactctgctcaat

SEQ ID NO: 23712 - DNA, 20 bp, Artificial Sequence
  chemically synthesized
agatgaaattcttaaggaca

SEQ ID NO: 23713 - DNA, 20 bp, Artificial Sequence
  chemically synthesized
cttgtgtagactcatatgaa

SEQ ID NO: 23714 - DNA, 20 bp, Artificial Sequence
  chemically synthesized
atgaagttctactttgtgac

SEQ ID NO: 23715 - DNA, 20 bp, Artificial Sequence
  chemically synthesized
accattgattgtgactattg

SEQ ID NO: 23716 - DNA, 20 bp, Artificial Sequence
  chemically synthesized
ctgtagtctgatgaaatgga

SEQ ID NO: 23717 - DNA, 20 bp, Artificial Sequence
  chemically synthesized
aagtaatatataagtaataa

SEQ ID NO: 23718 - DNA, 20 bp, Artificial Sequence
  chemically synthesized
attgctttttgcaattgagt

SEQ ID NO: 23719 - DNA, 20 bp, Artificial Sequence
  chemically synthesized
atgccaggatcttattacct

SEQ ID NO: 23720 - DNA, 20 bp, Artificial Sequence
  chemically synthesized
tattacctccaggatttcac

SEQ ID NO: 23721 - DNA, 20 bp, Artificial Sequence
  chemically synthesized
aaagtattgctcaagtaatc

SEQ ID NO: 23722 - DNA, 20 bp, Artificial Sequence
  chemically synthesized
gattatttgtgtattctcac

SEQ ID NO: 23723 - DNA, 20 bp, Artificial Sequence
  chemically synthesized
tgtcacgggaaatatcctgc

SEQ ID NO: 23724 - DNA, 20 bp, Artificial Sequence
  chemically synthesized
tctttccttgcacactctac

SEQ ID NO: 23725 - DNA, 20 bp, Artificial Sequence
  chemically synthesized
aattaccccattaagtgata

SEQ ID NO: 23726 - DNA, 20 bp, Artificial Sequence
  chemically synthesized
tatgtactagttcgttatca

SEQ ID NO: 23727 - DNA, 20 bp, Artificial Sequence
  chemically synthesized
ctgggtaatttataaggaaa

SEQ ID NO: 23728 - DNA, 20 bp, Artificial Sequence
  chemically synthesized
tgccaagcaaaagggggaaa

SEQ ID NO: 23729 - DNA, 20 bp, Artificial Sequence
  chemically synthesized
gagcatgagagtaacctcct

SEQ ID NO: 23730 - DNA, 20 bp, Artificial Sequence
  chemically synthesized
caaatccctcccacaacacg

SEQ ID NO: 23731 - DNA, 20 bp, Artificial Sequence
  chemically synthesized
tatgggaactacaattcaag

SEQ ID NO: 23732 - DNA, 20 bp, Artificial Sequence
  chemically synthesized
atgttgcatagtggtgaagt

SEQ ID NO: 23733 - DNA, 20 bp, Artificial Sequence
  chemically synthesized
agtgaatgttgtatccaatc

SEQ ID NO: 23734 - DNA, 20 bp, Artificial Sequence
  chemically synthesized
tattatttcattctatatgt

SEQ ID NO: 23735 - DNA, 20 bp, Artificial Sequence
  chemically synthesized
tctatatgtctatgcttact

SEQ ID NO: 23736 - DNA, 20 bp, Artificial Sequence
  chemically synthesized
tctcactaaatgagaacata

SEQ ID NO: 23737 - DNA, 20 bp, Artificial Sequence
  chemically synthesized
agaacatactgtgtttgact

SEQ ID NO: 23738 - DNA, 20 bp, Artificial Sequence
  chemically synthesized
ataatgtcctccagttctaa

SEQ ID NO: 23739 - DNA, 20 bp, Artificial Sequence
  chemically synthesized
taaccatgtttctagagaag

SEQ ID NO: 23740 - DNA, 20 bp, Artificial Sequence
  chemically synthesized
cgtccattggtagacattta

SEQ ID NO: 23741 - DNA, 20 bp, Artificial Sequence
  chemically synthesized
ctttgggtccatacccagta

SEQ ID NO: 23742 - DNA, 20 bp, Artificial Sequence
  chemically synthesized
ccatacccagtagtgggatt

SEQ ID NO: 23743 - DNA, 20 bp, Artificial Sequence
  chemically synthesized
attgcaggattgaatggtag

SEQ ID NO: 23744 - DNA, 20 bp, Artificial Sequence
  chemically synthesized
aatcttcatgctgtcttcca

SEQ ID NO: 23745 - DNA, 20 bp, Artificial Sequence
  chemically synthesized
tccacatcctcaccaacatc

SEQ ID NO: 23746 - DNA, 20 bp, Artificial Sequence
  chemically synthesized
ggcataaggaggtatcatat

SEQ ID NO: 23747 - DNA, 20 bp, Artificial Sequence
  chemically synthesized
tggtggttttaatttgcatt

SEQ ID NO: 23748 - DNA, 20 bp, Artificial Sequence
  chemically synthesized
agtgatgttgaacttttttt

SEQ ID NO: 23749 - DNA, 20 bp, Artificial Sequence
  chemically synthesized
tagatagatagatagataga

SEQ ID NO: 23750 - DNA, 20 bp, Artificial Sequence
  chemically synthesized
atatagatttagatataaaa

SEQ ID NO: 23751 - DNA, 20 bp, Artificial Sequence
  chemically synthesized
aagctgaaggacttggagtc

SEQ ID NO: 23752 - DNA, 20 bp, Artificial Sequence
  chemically synthesized
atccagcatgggagaaagat

SEQ ID NO: 23753 - DNA, 20 bp, Artificial Sequence
  chemically synthesized
ggcttggaggctaagccagt

SEQ ID NO: 23754 - DNA, 20 bp, Artificial Sequence
  chemically synthesized
taagccagtccaggattttc

SEQ ID NO: 23755 - DNA, 20 bp, Artificial Sequence
  chemically synthesized
ttttcacatgttttttttct

SEQ ID NO: 23756 - DNA, 20 bp, Artificial Sequence
  chemically synthesized
tatatcctggccacactggc

SEQ ID NO: 23757 - DNA, 20 bp, Artificial Sequence
  chemically synthesized
aactgattagatggtgccca

SEQ ID NO: 23758 - DNA, 20 bp, Artificial Sequence
  chemically synthesized
agtattaaccatcacaagtc

SEQ ID NO: 23759 - DNA, 20 bp, Artificial Sequence
  chemically synthesized
acaagtgtatacagacacga

SEQ ID NO: 23760 - DNA, 20 bp, Artificial Sequence
  chemically synthesized
tcctgcctggaatggcctgt

SEQ ID NO: 23761 - DNA, 20 bp, Artificial Sequence
  chemically synthesized
ggatctcctatattccatgc

SEQ ID NO: 23762 - DNA, 20 bp, Artificial Sequence
  chemically synthesized
acctccattgtggagttgta

SEQ ID NO: 23763 - DNA, 20 bp, Artificial Sequence
  chemically synthesized
tccaggtggcaatcttaatt

SEQ ID NO: 23764 - DNA, 20 bp, Artificial Sequence
  chemically synthesized
cttccacttccacttccacc

SEQ ID NO: 23765 - DNA, 20 bp, Artificial Sequence
  chemically synthesized
aaacagtaccatatattgga

SEQ ID NO: 23766 - DNA, 20 bp, Artificial Sequence
  chemically synthesized
acttcaaaaggccattcaaa

SEQ ID NO: 23767 - DNA, 20 bp, Artificial Sequence
  chemically synthesized
acttctttagccataaagtg

SEQ ID NO: 23768 - DNA, 20 bp, Artificial Sequence
  chemically synthesized
atgacagtggatacggcatt

SEQ ID NO: 23769 - DNA, 20 bp, Artificial Sequence
  chemically synthesized
tcttggcataagcattgagt

SEQ ID NO: 23770 - DNA, 20 bp, Artificial Sequence
  chemically synthesized
ccgaggaatggtgccatatc

SEQ ID NO: 23771 - DNA, 20 bp, Artificial Sequence
  chemically synthesized
caagcagtggctgtggccag

SEQ ID NO: 23772 - DNA, 20 bp, Artificial Sequence
  chemically synthesized
cagaattgatcatcctatcc

SEQ ID NO: 23773 - DNA, 20 bp, Artificial Sequence
  chemically synthesized
acatgggatgaaaatatctt

SEQ ID NO: 23774 - DNA, 20 bp, Artificial Sequence
  chemically synthesized
ctttgtcatcaattttccag

SEQ ID NO: 23775 - DNA, 20 bp, Artificial Sequence
  chemically synthesized
gctcaaagttctgccaacta

SEQ ID NO: 23776 - DNA, 20 bp, Artificial Sequence
  chemically synthesized
tgatgactcatagtcaaata

SEQ ID NO: 23777 - DNA, 20 bp, Artificial Sequence
  chemically synthesized
ccaaagcccagtaacaggcc

SEQ ID NO: 23778 - DNA, 20 bp, Artificial Sequence
  chemically synthesized
caaaatcctagaggcctccg

SEQ ID NO: 23779 - DNA, 20 bp, Artificial Sequence
  chemically synthesized
tcatatggcccaagtggcat

SEQ ID NO: 23780 - DNA, 20 bp, Artificial Sequence
  chemically synthesized
gtagaaggtccctgaattta

SEQ ID NO: 23781 - DNA, 20 bp, Artificial Sequence
  chemically synthesized
atgtctcatcaataaatcca

SEQ ID NO: 23782 - DNA, 20 bp, Artificial Sequence
  chemically synthesized
ggtgagcaagttctctccaa

SEQ ID NO: 23783 - DNA, 20 bp, Artificial Sequence
  chemically synthesized
ccaaccaacttcactatgtt

SEQ ID NO: 23784 - DNA, 20 bp, Artificial Sequence
  chemically synthesized
actctctaaacaattgatgc

SEQ ID NO: 23785 - DNA, 20 bp, Artificial Sequence
  chemically synthesized
ctctatatctatatctatat

SEQ ID NO: 23786 - DNA, 20 bp, Artificial Sequence
  chemically synthesized
tagccttttcacatttttct

SEQ ID NO: 23787 - DNA, 20 bp, Artificial Sequence
  chemically synthesized
tatatcctggctgtgctggc

SEQ ID NO: 23788 - DNA, 20 bp, Artificial Sequence
  chemically synthesized
aactgattagatggtgccca

SEQ ID NO: 23789 - DNA, 20 bp, Artificial Sequence
  chemically synthesized
cacagtcactttctaatgag

SEQ ID NO: 23790 - DNA, 20 bp, Artificial Sequence
  chemically synthesized
ttttttgttgttgagttcct

SEQ ID NO: 23791 - DNA, 20 bp, Artificial Sequence
  chemically synthesized
tattagccttttgttgcatt

SEQ ID NO: 23792 - DNA, 20 bp, Artificial Sequence
  chemically synthesized
tttttctcattctgtaggtt

SEQ ID NO: 23793 - DNA, 20 bp, Artificial Sequence
  chemically synthesized
tgtaggttatccgtttactc

SEQ ID NO: 23794 - DNA, 20 bp, Artificial Sequence
  chemically synthesized
cttttgcggtgcagaagcat

SEQ ID NO: 23795 - DNA, 20 bp, Artificial Sequence
  chemically synthesized
agtttaattaagtcccattt

SEQ ID NO: 23796 - DNA, 20 bp, Artificial Sequence
  chemically synthesized
attaagtcccatttgtctgt

SEQ ID NO: 23797 - DNA, 20 bp, Artificial Sequence
  chemically synthesized
tttgtctgtttttgtttttg

SEQ ID NO: 23798 - DNA, 20 bp, Artificial Sequence
  chemically synthesized
ctgtttttgtttttgttgtg

SEQ ID NO: 23799 - DNA, 20 bp, Artificial Sequence
  chemically synthesized
aagttgactagttcagtgta

SEQ ID NO: 23800 - DNA, 20 bp, Artificial Sequence
  chemically synthesized
tttctaattttttgccatca

SEQ ID NO: 23801 - DNA, 20 bp, Artificial Sequence
  chemically synthesized
tctccttaattttcccccag

SEQ ID NO: 23802 - DNA, 20 bp, Artificial Sequence
  chemically synthesized
ttccaaatgtatccatatat

SEQ ID NO: 23803 - DNA, 20 bp, Artificial Sequence
  chemically synthesized
tgtatccatatattgtggct

SEQ ID NO: 23804 - DNA, 20 bp, Artificial Sequence
  chemically synthesized
tattagaggagagaattaag

SEQ ID NO: 23805 - DNA, 20 bp, Artificial Sequence
  chemically synthesized
agacaccgagttaaagaagg

SEQ ID NO: 23806 - DNA, 20 bp, Artificial Sequence
  chemically synthesized
aggaagggctttattcggct

SEQ ID NO: 23807 - DNA, 20 bp, Artificial Sequence
  chemically synthesized
gagcaattcctgtccctttt

SEQ ID NO: 23808 - DNA, 20 bp, Artificial Sequence
  chemically synthesized
cagaatggaacagaacagga

SEQ ID NO: 23809 - DNA, 20 bp, Artificial Sequence
  chemically synthesized
gaacaggacagggattttca

SEQ ID NO: 23810 - DNA, 20 bp, Artificial Sequence
  chemically synthesized
aggcccaggatgtggtctca

SEQ ID NO: 23811 - DNA, 20 bp, Artificial Sequence
  chemically synthesized
gtggtctcaggctgtttgcc

SEQ ID NO: 23812 - DNA, 20 bp, Artificial Sequence
  chemically synthesized
tgtggatttcatttctgcct

SEQ ID NO: 23813 - DNA, 20 bp, Artificial Sequence
  chemically synthesized
atgaaatacgtatttgtgtt

SEQ ID NO: 23814 - DNA, 20 bp, Artificial Sequence
  chemically synthesized
gttctccttatcaaaaggta

SEQ ID NO: 23815 - DNA, 20 bp, Artificial Sequence
  chemically synthesized
ttatcaaaaggtactttgct

SEQ ID NO: 23816 - DNA, 20 bp, Artificial Sequence
  chemically synthesized
ctttaaaagataaatgacta

SEQ ID NO: 23817 - DNA, 20 bp, Artificial Sequence
  chemically synthesized
gataaatgactatgtagctt

SEQ ID NO: 23818 - DNA, 20 bp, Artificial Sequence
  chemically synthesized
agaaggaggaagagaggtga

SEQ ID NO: 23819 - DNA, 20 bp, Artificial Sequence
  chemically synthesized
ctttgacactacaaagtgac

SEQ ID NO: 23820 - DNA, 20 bp, Artificial Sequence
  chemically synthesized
tttgaaaggtaaataaatcc

SEQ ID NO: 23821 - DNA, 20 bp, Artificial Sequence
  chemically synthesized
aacagttggaggcatctata

SEQ ID NO: 23822 - DNA, 22 bp, Artificial Sequence
  chemically synthesized
gcagccatgcttattcattgcg

SEQ ID NO: 23823 - DNA, 22 bp, Artificial Sequence
  chemically synthesized
attcattgcgtccactgctctt

SEQ ID NO: 23824 - DNA, 22 bp, Artificial Sequence
  chemically synthesized
ttcattgcgtccactgctcttc

SEQ ID NO: 23825 - DNA, 22 bp, Artificial Sequence
  chemically synthesized
attgcgtccactgctcttctga

SEQ ID NO: 23826 - DNA, 22 bp, Artificial Sequence
  chemically synthesized
cgtccactgctcttctgacagc

SEQ ID NO: 23827 - DNA, 22 bp, Artificial Sequence
  chemically synthesized
ctcttctgacagcatcatttac

SEQ ID NO: 23828 - DNA, 22 bp, Artificial Sequence
  chemically synthesized
ttctgacagcatcatttacagg

SEQ ID NO: 23829 - DNA, 22 bp, Artificial Sequence
  chemically synthesized
ctgacagcatcatttacaggtt

SEQ ID NO: 23830 - DNA, 22 bp, Artificial Sequence
  chemically synthesized
tgacagcatcatttacaggttc

SEQ ID NO: 23831 - DNA, 22 bp, Artificial Sequence
  chemically synthesized
acagcatcatttacaggttcac

SEQ ID NO: 23832 - DNA, 22 bp, Artificial Sequence
  chemically synthesized
acaggttcacactgttccacct

SEQ ID NO: 23833 - DNA, 22 bp, Artificial Sequence
  chemically synthesized
caggttcacactgttccacctg

SEQ ID NO: 23834 - DNA, 22 bp, Artificial Sequence
  chemically synthesized
acactgttccacctgagtcttc

SEQ ID NO: 23835 - DNA, 22 bp, Artificial Sequence
  chemically synthesized
ttccacctgagtcttcatatta

SEQ ID NO: 23836 - DNA, 22 bp, Artificial Sequence
  chemically synthesized
cacctgagtcttcatattatgc

SEQ ID NO: 23837 - DNA, 22 bp, Artificial Sequence
  chemically synthesized
agtcttcatattatgctcaaaa

SEQ ID NO: 23838 - DNA, 22 bp, Artificial Sequence
  chemically synthesized
catattatgctcaaaatatgga

SEQ ID NO: 23839 - DNA, 22 bp, Artificial Sequence
  chemically synthesized
atattatgctcaaaatatggac

SEQ ID NO: 23840 - DNA, 22 bp, Artificial Sequence
  chemically synthesized
tgctcaaaatatggacctatca

SEQ ID NO: 23841 - DNA, 22 bp, Artificial Sequence
  chemically synthesized
aaaatatggacctatcagaaaa

SEQ ID NO: 23842 - DNA, 22 bp, Artificial Sequence
  chemically synthesized
tcagaaaatagttctctcccca

SEQ ID NO: 23843 - DNA, 22 bp, Artificial Sequence
  chemically synthesized
tctccccattcatctgctgttg

SEQ ID NO: 23844 - DNA, 22 bp, Artificial Sequence
  chemically synthesized
tccccattcatctgctgttgtt

SEQ ID NO: 23845 - DNA, 22 bp, Artificial Sequence
  chemically synthesized
cccattcatctgctgttgtttt

SEQ ID NO: 23846 - DNA, 22 bp, Artificial Sequence
  chemically synthesized
atctgctgttgttttggccttt

SEQ ID NO: 23847 - DNA, 22 bp, Artificial Sequence
  chemically synthesized
ctgttgttttggcctttgtctg

SEQ ID NO: 23848 - DNA, 22 bp, Artificial Sequence
  chemically synthesized
ttgttttggcctttgtctgaat

SEQ ID NO: 23849 - DNA, 22 bp, Artificial Sequence
  chemically synthesized
ttttggcctttgtctgaatcac

SEQ ID NO: 23850 - DNA, 22 bp, Artificial Sequence
  chemically synthesized
tggcctttgtctgaatcacagt

SEQ ID NO: 23851 - DNA, 22 bp, Artificial Sequence
  chemically synthesized
ggcctttgtctgaatcacagta

SEQ ID NO: 23852 - DNA, 22 bp, Artificial Sequence
  chemically synthesized
gcctttgtctgaatcacagtat

SEQ ID NO: 23853 - DNA, 22 bp, Artificial Sequence
  chemically synthesized
tgtctgaatcacagtatagatg

SEQ ID NO: 23854 - DNA, 22 bp, Artificial Sequence
  chemically synthesized
gtctgaatcacagtatagatgc

SEQ ID NO: 23855 - DNA, 22 bp, Artificial Sequence
  chemically synthesized
tctgaatcacagtatagatgcc

SEQ ID NO: 23856 - DNA, 22 bp, Artificial Sequence
  chemically synthesized
aatcacagtatagatgcctcca

SEQ ID NO: 23857 - DNA, 22 bp, Artificial Sequence
  chemically synthesized
caactgttaaaaggaaaaaagt

SEQ ID NO: 23858 - DNA, 22 bp, Artificial Sequence
  chemically synthesized
ttaaaaggaaaaaagtttctat

SEQ ID NO: 23859 - DNA, 22 bp, Artificial Sequence
  chemically synthesized
aaaggaaaaaagtttctattat

SEQ ID NO: 23860 - DNA, 22 bp, Artificial Sequence
  chemically synthesized
ctattatcattcaggttagcaa

SEQ ID NO: 23861 - DNA, 22 bp, Artificial Sequence
  chemically synthesized
tattatcattcaggttagcaat

SEQ ID NO: 23862 - DNA, 22 bp, Artificial Sequence
  chemically synthesized
ttatcattcaggttagcaattt

SEQ ID NO: 23863 - DNA, 22 bp, Artificial Sequence
  chemically synthesized
tcattcaggttagcaatttgtt

SEQ ID NO: 23864 - DNA, 22 bp, Artificial Sequence
  chemically synthesized
aggttagcaatttgtttaaagt

SEQ ID NO: 23865 - DNA, 22 bp, Artificial Sequence
  chemically synthesized
gcaatttgtttaaagtaataag

SEQ ID NO: 23866 - DNA, 22 bp, Artificial Sequence
  chemically synthesized
gtttaaagtaataagggatgga

SEQ ID NO: 23867 - DNA, 22 bp, Artificial Sequence
  chemically synthesized
tttaaagtaataagggatggaa

SEQ ID NO: 23868 - DNA, 22 bp, Artificial Sequence
  chemically synthesized
aaagtaataagggatggaaatg

SEQ ID NO: 23869 - DNA, 22 bp, Artificial Sequence
  chemically synthesized
aagtaataagggatggaaatga

SEQ ID NO: 23870 - DNA, 22 bp, Artificial Sequence
  chemically synthesized
agatttttaaattagcatttag

SEQ ID NO: 23871 - DNA, 22 bp, Artificial Sequence
  chemically synthesized
ttaaattagcatttaggatcca

SEQ ID NO: 23872 - DNA, 22 bp, Artificial Sequence
  chemically synthesized
taaattagcatttaggatccac

SEQ ID NO: 23873 - DNA, 22 bp, Artificial Sequence
  chemically synthesized
aaattagcatttaggatccact

SEQ ID NO: 23874 - DNA, 22 bp, Artificial Sequence
  chemically synthesized
aattagcatttaggatccacta

SEQ ID NO: 23875 - DNA, 22 bp, Artificial Sequence
  chemically synthesized
gcatttaggatccactaagccc

SEQ ID NO: 23876 - DNA, 22 bp, Artificial Sequence
  chemically synthesized
aggatccactaagcccaaggat

SEQ ID NO: 23877 - DNA, 22 bp, Artificial Sequence
  chemically synthesized
ggatccactaagcccaaggatt

SEQ ID NO: 23878 - DNA, 22 bp, Artificial Sequence
  chemically synthesized
agcccaaggatttatttacctt

SEQ ID NO: 23879 - DNA, 22 bp, Artificial Sequence
  chemically synthesized
atttacctttcaaaaataatag

SEQ ID NO: 23880 - DNA, 22 bp, Artificial Sequence
  chemically synthesized
tttacctttcaaaaataatagt

SEQ ID NO: 23881 - DNA, 22 bp, Artificial Sequence
  chemically synthesized
acctttcaaaaataatagtatt

SEQ ID NO: 23882 - DNA, 22 bp, Artificial Sequence
  chemically synthesized
cctttcaaaaataatagtattt

SEQ ID NO: 23883 - DNA, 22 bp, Artificial Sequence
  chemically synthesized
tcaaaaataatagtatttgaca

SEQ ID NO: 23884 - DNA, 22 bp, Artificial Sequence
  chemically synthesized
caaaaataatagtatttgacat

SEQ ID NO: 23885 - DNA, 22 bp, Artificial Sequence
  chemically synthesized
aaaaataatagtatttgacata

SEQ ID NO: 23886 - DNA, 22 bp, Artificial Sequence
  chemically synthesized
gacatattgttaagggacacca

SEQ ID NO: 23887 - DNA, 22 bp, Artificial Sequence
  chemically synthesized
acatattgttaagggacaccaa

SEQ ID NO: 23888 - DNA, 22 bp, Artificial Sequence
  chemically synthesized
ttaagggacaccaacgaatggt

SEQ ID NO: 23889 - DNA, 22 bp, Artificial Sequence
  chemically synthesized
agggacaccaacgaatggttac

SEQ ID NO: 23890 - DNA, 22 bp, Artificial Sequence
  chemically synthesized
ctgctttgttcaattctgtgca

SEQ ID NO: 23891 - DNA, 22 bp, Artificial Sequence
  chemically synthesized
ctttgttcaattctgtgcatgt

SEQ ID NO: 23892 - DNA, 22 bp, Artificial Sequence
  chemically synthesized
tgttcaattctgtgcatgtttt

SEQ ID NO: 23893 - DNA, 22 bp, Artificial Sequence
  chemically synthesized
gttcaattctgtgcatgtttta

SEQ ID NO: 23894 - DNA, 22 bp, Artificial Sequence
  chemically synthesized
ttcaattctgtgcatgttttaa

SEQ ID NO: 23895 - DNA, 22 bp, Artificial Sequence
  chemically synthesized
aattctgtgcatgttttaaagt

SEQ ID NO: 23896 - DNA, 22 bp, Artificial Sequence
  chemically synthesized
tgtgcatgttttaaagtccctt

SEQ ID NO: 23897 - DNA, 22 bp, Artificial Sequence
  chemically synthesized
tgcatgttttaaagtcccttct

SEQ ID NO: 23898 - DNA, 22 bp, Artificial Sequence
  chemically synthesized
taaagtcccttctaggtgcatg

SEQ ID NO: 23899 - DNA, 22 bp, Artificial Sequence
  chemically synthesized
aaagtcccttctaggtgcatgt

SEQ ID NO: 23900 - DNA, 22 bp, Artificial Sequence
  chemically synthesized
aagtcccttctaggtgcatgtg

SEQ ID NO: 23901 - DNA, 22 bp, Artificial Sequence
  chemically synthesized
ctaggtgcatgtgaaatagcag

SEQ ID NO: 23902 - DNA, 22 bp, Artificial Sequence
  chemically synthesized
taggtgcatgtgaaatagcagc

SEQ ID NO: 23903 - DNA, 22 bp, Artificial Sequence
  chemically synthesized
ggtgcatgtgaaatagcagcag

SEQ ID NO: 23904 - DNA, 22 bp, Artificial Sequence
  chemically synthesized
atgccgcaaagaggtcaaatac

SEQ ID NO: 23905 - DNA, 22 bp, Artificial Sequence
  chemically synthesized
aaaaagaaagagtctgaaaaga

SEQ ID NO: 23906 - DNA, 22 bp, Artificial Sequence
  chemically synthesized
aaaagacaattggagtaactac

SEQ ID NO: 23907 - DNA, 22 bp, Artificial Sequence
  chemically synthesized
gagtaactacttgcctaaagct

SEQ ID NO: 23908 - DNA, 22 bp, Artificial Sequence
  chemically synthesized
cttgcctaaagctccagtcact

SEQ ID NO: 23909 - DNA, 22 bp, Artificial Sequence
  chemically synthesized
gcctaaagctccagtcactttg

SEQ ID NO: 23910 - DNA, 22 bp, Artificial Sequence
  chemically synthesized
cctaaagctccagtcactttgt

SEQ ID NO: 23911 - DNA, 22 bp, Artificial Sequence
  chemically synthesized
aagctccagtcactttgtagtg

SEQ ID NO: 23912 - DNA, 22 bp, Artificial Sequence
  chemically synthesized
cagtcactttgtagtgtcaaag

SEQ ID NO: 23913 - DNA, 22 bp, Artificial Sequence
  chemically synthesized
tgtagtgtcaaagttaggacaa

SEQ ID NO: 23914 - DNA, 22 bp, Artificial Sequence
  chemically synthesized
gtagtgtcaaagttaggacaaa

SEQ ID NO: 23915 - DNA, 22 bp, Artificial Sequence
  chemically synthesized
tagtgtcaaagttaggacaaat

SEQ ID NO: 23916 - DNA, 22 bp, Artificial Sequence
  chemically synthesized
ggacaaatacccattgtcatca

SEQ ID NO: 23917 - DNA, 22 bp, Artificial Sequence
  chemically synthesized
tcatcatacatgccctcagcag

SEQ ID NO: 23918 - DNA, 22 bp, Artificial Sequence
  chemically synthesized
agcagcagaaatcactttcacc

SEQ ID NO: 23919 - DNA, 22 bp, Artificial Sequence
  chemically synthesized
tcacctctcttcctccttctcc

SEQ ID NO: 23920 - DNA, 22 bp, Artificial Sequence
  chemically synthesized
cacctctcttcctccttctcct

SEQ ID NO: 23921 - DNA, 22 bp, Artificial Sequence
  chemically synthesized
acctctcttcctccttctccta

SEQ ID NO: 23922 - DNA, 22 bp, Artificial Sequence
  chemically synthesized
tcttcctccttctcctacagtg

SEQ ID NO: 23923 - DNA, 22 bp, Artificial Sequence
  chemically synthesized
ttcctccttctcctacagtggt

SEQ ID NO: 23924 - DNA, 22 bp, Artificial Sequence
  chemically synthesized
cctccttctcctacagtggtcc

SEQ ID NO: 23925 - DNA, 22 bp, Artificial Sequence
  chemically synthesized
ctccttctcctacagtggtcca

SEQ ID NO: 23926 - DNA, 22 bp, Artificial Sequence
  chemically synthesized
cttctcctacagtggtccagaa

SEQ ID NO: 23927 - DNA, 22 bp, Artificial Sequence
  chemically synthesized
ctcctacagtggtccagaaggg

SEQ ID NO: 23928 - DNA, 22 bp, Artificial Sequence
  chemically synthesized
tcctacagtggtccagaagggg

SEQ ID NO: 23929 - DNA, 22 bp, Artificial Sequence
  chemically synthesized
ctacagtggtccagaaggggct

SEQ ID NO: 23930 - DNA, 22 bp, Artificial Sequence
  chemically synthesized
cagtggtccagaaggggctcag

SEQ ID NO: 23931 - DNA, 22 bp, Artificial Sequence
  chemically synthesized
aggtatgttcaaataacagctg

SEQ ID NO: 23932 - DNA, 22 bp, Artificial Sequence
  chemically synthesized
aaataacagctgctgtggtttt

SEQ ID NO: 23933 - DNA, 22 bp, Artificial Sequence
  chemically synthesized
ctgtggttttcaattatgaaga

SEQ ID NO: 23934 - DNA, 22 bp, Artificial Sequence
  chemically synthesized
tggttttcaattatgaagaaat

SEQ ID NO: 23935 - DNA, 22 bp, Artificial Sequence
  chemically synthesized
tcaattatgaagaaatctccta

SEQ ID NO: 23936 - DNA, 22 bp, Artificial Sequence
  chemically synthesized
caattatgaagaaatctcctaa

SEQ ID NO: 23937 - DNA, 22 bp, Artificial Sequence
  chemically synthesized
aattatgaagaaatctcctaag

SEQ ID NO: 23938 - DNA, 22 bp, Artificial Sequence
  chemically synthesized
tgaagaaatctcctaagctaca

SEQ ID NO: 23939 - DNA, 22 bp, Artificial Sequence
  chemically synthesized
ctaagctacatagtcatttatc

SEQ ID NO: 23940 - DNA, 22 bp, Artificial Sequence
  chemically synthesized
agctacatagtcatttatcttt

SEQ ID NO: 23941 - DNA, 22 bp, Artificial Sequence
  chemically synthesized
catagtcatttatcttttaaag

SEQ ID NO: 23942 - DNA, 22 bp, Artificial Sequence
  chemically synthesized
atcttttaaagcaccaagcaaa

SEQ ID NO: 23943 - DNA, 22 bp, Artificial Sequence
  chemically synthesized
tcttttaaagcaccaagcaaag

SEQ ID NO: 23944 - DNA, 22 bp, Artificial Sequence
  chemically synthesized
ttaaagcaccaagcaaagtacc

SEQ ID NO: 23945 - DNA, 22 bp, Artificial Sequence
  chemically synthesized
taaagcaccaagcaaagtacct

SEQ ID NO: 23946 - DNA, 22 bp, Artificial Sequence
  chemically synthesized
aaagcaccaagcaaagtacctt

SEQ ID NO: 23947 - DNA, 22 bp, Artificial Sequence
  chemically synthesized
aagcaccaagcaaagtaccttt

SEQ ID NO: 23948 - DNA, 22 bp, Artificial Sequence
  chemically synthesized
ttgataaggagaacgtgcttat

SEQ ID NO: 23949 - DNA, 22 bp, Artificial Sequence
  chemically synthesized
tgataaggagaacgtgcttata

SEQ ID NO: 23950 - DNA, 22 bp, Artificial Sequence
  chemically synthesized
gataaggagaacgtgcttatag

SEQ ID NO: 23951 - DNA, 22 bp, Artificial Sequence
  chemically synthesized
ataaggagaacgtgcttataga

SEQ ID NO: 23952 - DNA, 22 bp, Artificial Sequence
  chemically synthesized
atagatgttcatagaagatgct

SEQ ID NO: 23953 - DNA, 22 bp, Artificial Sequence
  chemically synthesized
tagatgttcatagaagatgctt

SEQ ID NO: 23954 - DNA, 22 bp, Artificial Sequence
  chemically synthesized
atagaagatgcttggtccaacc

SEQ ID NO: 23955 - DNA, 22 bp, Artificial Sequence
  chemically synthesized
ggtccaaccccgatgtcaaatc

SEQ ID NO: 23956 - DNA, 22 bp, Artificial Sequence
  chemically synthesized
gtccaaccccgatgtcaaatcc

SEQ ID NO: 23957 - DNA, 22 bp, Artificial Sequence
  chemically synthesized
cattctcacatggtatttctct

SEQ ID NO: 23958 - DNA, 22 bp, Artificial Sequence
  chemically synthesized
attctcacatggtatttctctc

SEQ ID NO: 23959 - DNA, 22 bp, Artificial Sequence
  chemically synthesized
tcacatggtatttctctcttcc

SEQ ID NO: 23960 - DNA, 22 bp, Artificial Sequence
  chemically synthesized
acatggtatttctctcttccta

SEQ ID NO: 23961 - DNA, 22 bp, Artificial Sequence
  chemically synthesized
ctctcttcctagtaagggagga

SEQ ID NO: 23962 - DNA, 22 bp, Artificial Sequence
  chemically synthesized
tctcttcctagtaagggaggag

SEQ ID NO: 23963 - DNA, 22 bp, Artificial Sequence
  chemically synthesized
tcttcctagtaagggaggagac

SEQ ID NO: 23964 - DNA, 22 bp, Artificial Sequence
  chemically synthesized
ttcctagtaagggaggagacca

SEQ ID NO: 23965 - DNA, 22 bp, Artificial Sequence
  chemically synthesized
cctagtaagggaggagaccacc

SEQ ID NO: 23966 - DNA, 22 bp, Artificial Sequence
  chemically synthesized
ctagtaagggaggagaccaccc

SEQ ID NO: 23967 - DNA, 22 bp, Artificial Sequence
  chemically synthesized
gtaagggaggagaccacccttc

SEQ ID NO: 23968 - DNA, 22 bp, Artificial Sequence
  chemically synthesized
catattgttttatgcccaattt

SEQ ID NO: 23969 - DNA, 22 bp, Artificial Sequence
  chemically synthesized
atattgttttatgcccaatttc

SEQ ID NO: 23970 - DNA, 22 bp, Artificial Sequence
  chemically synthesized
ttttatgcccaatttctgcctc

SEQ ID NO: 23971 - DNA, 22 bp, Artificial Sequence
  chemically synthesized
tatgcccaatttctgcctccaa

SEQ ID NO: 23972 - DNA, 22 bp, Artificial Sequence
  chemically synthesized
atgcccaatttctgcctccaaa

SEQ ID NO: 23973 - DNA, 22 bp, Artificial Sequence
  chemically synthesized
tgcccaatttctgcctccaaag

SEQ ID NO: 23974 - DNA, 22 bp, Artificial Sequence
  chemically synthesized
ctgcctccaaagaaagaagaag

SEQ ID NO: 23975 - DNA, 22 bp, Artificial Sequence
  chemically synthesized
tgcctccaaagaaagaagaagt

SEQ ID NO: 23976 - DNA, 22 bp, Artificial Sequence
  chemically synthesized
cctccaaagaaagaagaagtaa

SEQ ID NO: 23977 - DNA, 22 bp, Artificial Sequence
  chemically synthesized
caaagaaagaagaagtaaaaac

SEQ ID NO: 23978 - DNA, 22 bp, Artificial Sequence
  chemically synthesized
aaaggcagaaatgaaatccaca

SEQ ID NO: 23979 - DNA, 22 bp, Artificial Sequence
  chemically synthesized
agaccacatcctgggcctggtt

SEQ ID NO: 23980 - DNA, 22 bp, Artificial Sequence
  chemically synthesized
ggcctggttaaagatagacccc

SEQ ID NO: 23981 - DNA, 22 bp, Artificial Sequence
  chemically synthesized
gttaaagatagacccctgacct

SEQ ID NO: 23982 - DNA, 22 bp, Artificial Sequence
  chemically synthesized
aagatagacccctgacctggcc

SEQ ID NO: 23983 - DNA, 22 bp, Artificial Sequence
  chemically synthesized
acctggccagttatgttatcta

SEQ ID NO: 23984 - DNA, 22 bp, Artificial Sequence
  chemically synthesized
gccagttatgttatctatagat

SEQ ID NO: 23985 - DNA, 22 bp, Artificial Sequence
  chemically synthesized
tgttatctatagattccagaca

SEQ ID NO: 23986 - DNA, 22 bp, Artificial Sequence
  chemically synthesized
tctatagattccagacactgta

SEQ ID NO: 23987 - DNA, 22 bp, Artificial Sequence
  chemically synthesized
tagattccagacactgtatgga

SEQ ID NO: 23988 - DNA, 22 bp, Artificial Sequence
  chemically synthesized
cagacactgtatggaaaagcag

SEQ ID NO: 23989 - DNA, 22 bp, Artificial Sequence
  chemically synthesized
tatggaaaagcagtgtgaaaat

SEQ ID NO: 23990 - DNA, 22 bp, Artificial Sequence
  chemically synthesized
tcctgttctgttccattctgat

SEQ ID NO: 23991 - DNA, 22 bp, Artificial Sequence
  chemically synthesized
ttctgttccattctgatgacca

SEQ ID NO: 23992 - DNA, 22 bp, Artificial Sequence
  chemically synthesized
tgttccattctgatgaccagtg

SEQ ID NO: 23993 - DNA, 22 bp, Artificial Sequence
  chemically synthesized
ttccattctgatgaccagtgca

SEQ ID NO: 23994 - DNA, 22 bp, Artificial Sequence
  chemically synthesized
cattctgatgaccagtgcatgc

SEQ ID NO: 23995 - DNA, 22 bp, Artificial Sequence
  chemically synthesized
tgatgaccagtgcatgcagccc

SEQ ID NO: 23996 - DNA, 22 bp, Artificial Sequence
  chemically synthesized
atgaccagtgcatgcagccccc

SEQ ID NO: 23997 - DNA, 22 bp, Artificial Sequence
  chemically synthesized
agagttgtaagcccttaaaagg

SEQ ID NO: 23998 - DNA, 22 bp, Artificial Sequence
  chemically synthesized
gagttgtaagcccttaaaaggg

SEQ ID NO: 23999 - DNA, 22 bp, Artificial Sequence
  chemically synthesized
taagcccttaaaagggacagga

SEQ ID NO: 24000 - DNA, 22 bp, Artificial Sequence
  chemically synthesized
aaaagggacaggaattgctcac

SEQ ID NO: 24001 - DNA, 22 bp, Artificial Sequence
  chemically synthesized
aaagggacaggaattgctcact

SEQ ID NO: 24002 - DNA, 22 bp, Artificial Sequence
  chemically synthesized
ctcactctgagagcttggttgt

SEQ ID NO: 24003 - DNA, 22 bp, Artificial Sequence
  chemically synthesized
actctgagagcttggttgttgg

SEQ ID NO: 24004 - DNA, 22 bp, Artificial Sequence
  chemically synthesized
tgagagcttggttgttggagat

SEQ ID NO: 24005 - DNA, 22 bp, Artificial Sequence
  chemically synthesized
agagcttggttgttggagatgt

SEQ ID NO: 24006 - DNA, 22 bp, Artificial Sequence
  chemically synthesized
ggttgttggagatgtgagtctt

SEQ ID NO: 24007 - DNA, 22 bp, Artificial Sequence
  chemically synthesized
gttgttggagatgtgagtcttg

SEQ ID NO: 24008 - DNA, 22 bp, Artificial Sequence
  chemically synthesized
ttggagatgtgagtcttgccca

SEQ ID NO: 24009 - DNA, 22 bp, Artificial Sequence
  chemically synthesized
gagatgtgagtcttgcccaagc

SEQ ID NO: 24010 - DNA, 22 bp, Artificial Sequence
  chemically synthesized
gcccaagctcccagccgaataa

SEQ ID NO: 24011 - DNA, 22 bp, Artificial Sequence
  chemically synthesized
cccaagctcccagccgaataaa

SEQ ID NO: 24012 - DNA, 22 bp, Artificial Sequence
  chemically synthesized
ccagccgaataaagcccttcct

SEQ ID NO: 24013 - DNA, 22 bp, Artificial Sequence
  chemically synthesized
ccttctttaactcggtgtctga

SEQ ID NO: 24014 - DNA, 22 bp, Artificial Sequence
  chemically synthesized
cttctttaactcggtgtctgag

SEQ ID NO: 24015 - DNA, 22 bp, Artificial Sequence
  chemically synthesized
ctttaactcggtgtctgagggg

SEQ ID NO: 24016 - DNA, 22 bp, Artificial Sequence
  chemically synthesized
tttaactcggtgtctgaggggt

SEQ ID NO: 24017 - DNA, 22 bp, Artificial Sequence
  chemically synthesized
taactcggtgtctgaggggttt

SEQ ID NO: 24018 - DNA, 22 bp, Artificial Sequence
  chemically synthesized
aactcggtgtctgaggggtttt

SEQ ID NO: 24019 - DNA, 22 bp, Artificial Sequence
  chemically synthesized
actcggtgtctgaggggttttg

SEQ ID NO: 24020 - DNA, 22 bp, Artificial Sequence
  chemically synthesized
ggtgtctgaggggttttgtatg

SEQ ID NO: 24021 - DNA, 22 bp, Artificial Sequence
  chemically synthesized
aggggttttgtatgcagcttgt

SEQ ID NO: 24022 - DNA, 22 bp, Artificial Sequence
  chemically synthesized
tgtatgcagcttgtcctgctac

SEQ ID NO: 24023 - DNA, 22 bp, Artificial Sequence
  chemically synthesized
gtatgcagcttgtcctgctaca

SEQ ID NO: 24024 - DNA, 22 bp, Artificial Sequence
  chemically synthesized
tatgcagcttgtcctgctacac

SEQ ID NO: 24025 - DNA, 22 bp, Artificial Sequence
  chemically synthesized
gtcctgctacactagaatcgtt

SEQ ID NO: 24026 - DNA, 22 bp, Artificial Sequence
  chemically synthesized
tcctgctacactagaatcgttc

SEQ ID NO: 24027 - DNA, 22 bp, Artificial Sequence
  chemically synthesized
ctacactagaatcgttccttaa

SEQ ID NO: 24028 - DNA, 22 bp, Artificial Sequence
  chemically synthesized
cactagaatcgttccttaattc

SEQ ID NO: 24029 - DNA, 22 bp, Artificial Sequence
  chemically synthesized
gaatcgttccttaattctctcc

SEQ ID NO: 24030 - DNA, 22 bp, Artificial Sequence
  chemically synthesized
cttaattctctcctctaatatt

SEQ ID NO: 24031 - DNA, 22 bp, Artificial Sequence
  chemically synthesized
aattctctcctctaatattgct

SEQ ID NO: 24032 - DNA, 22 bp, Artificial Sequence
  chemically synthesized
attctctcctctaatattgctg

SEQ ID NO: 24033 - DNA, 22 bp, Artificial Sequence
  chemically synthesized
tctcctctaatattgctgctac

SEQ ID NO: 24034 - DNA, 22 bp, Artificial Sequence
  chemically synthesized
tcctctaatattgctgctacct

SEQ ID NO: 24035 - DNA, 22 bp, Artificial Sequence
  chemically synthesized
ctctaatattgctgctacctct

SEQ ID NO: 24036 - DNA, 22 bp, Artificial Sequence
  chemically synthesized
taatattgctgctacctctatt

SEQ ID NO: 24037 - DNA, 22 bp, Artificial Sequence
  chemically synthesized
atattgctgctacctctattaa

SEQ ID NO: 24038 - DNA, 22 bp, Artificial Sequence
  chemically synthesized
ctgctacctctattaaaacaca

SEQ ID NO: 24039 - DNA, 22 bp, Artificial Sequence
  chemically synthesized
ctacctctattaaaacacaaag

SEQ ID NO: 24040 - DNA, 22 bp, Artificial Sequence
  chemically synthesized
cctctattaaaacacaaagcca

SEQ ID NO: 24041 - DNA, 22 bp, Artificial Sequence
  chemically synthesized
tattaaaacacaaagccacaat

SEQ ID NO: 24042 - DNA, 22 bp, Artificial Sequence
  chemically synthesized
ttaaaacacaaagccacaatat

SEQ ID NO: 24043 - DNA, 22 bp, Artificial Sequence
  chemically synthesized
aaacacaaagccacaatatatg

SEQ ID NO: 24044 - DNA, 22 bp, Artificial Sequence
  chemically synthesized
ggaaaatatgcacactttggat

SEQ ID NO: 24045 - DNA, 22 bp, Artificial Sequence
  chemically synthesized
gaaaatatgcacactttggatc

SEQ ID NO: 24046 - DNA, 22 bp, Artificial Sequence
  chemically synthesized
tggatccagcaagtccacatct

SEQ ID NO: 24047 - DNA, 22 bp, Artificial Sequence
  chemically synthesized
ggatccagcaagtccacatcta

SEQ ID NO: 24048 - DNA, 22 bp, Artificial Sequence
  chemically synthesized
gatccagcaagtccacatctag

SEQ ID NO: 24049 - DNA, 22 bp, Artificial Sequence
  chemically synthesized
gaaaaccatcctgggggaaaat

SEQ ID NO: 24050 - DNA, 22 bp, Artificial Sequence
  chemically synthesized
ggggaaaattaaggagagtatg

SEQ ID NO: 24051 - DNA, 22 bp, Artificial Sequence
  chemically synthesized
aggagagtatgaaaaggatgtt

SEQ ID NO: 24052 - DNA, 22 bp, Artificial Sequence
  chemically synthesized
actaaagcattatgatggcaaa

SEQ ID NO: 24053 - DNA, 22 bp, Artificial Sequence
  chemically synthesized
ctaaagcattatgatggcaaaa

SEQ ID NO: 24054 - DNA, 22 bp, Artificial Sequence
  chemically synthesized
aagcattatgatggcaaaaaat

SEQ ID NO: 24055 - DNA, 22 bp, Artificial Sequence
  chemically synthesized
tgatggcaaaaaattagaaaca

SEQ ID NO: 24056 - DNA, 22 bp, Artificial Sequence
  chemically synthesized
gaaacaacttacactgaactag

SEQ ID NO: 24057 - DNA, 22 bp, Artificial Sequence
  chemically synthesized
acactgaactagtcaacttact

SEQ ID NO: 24058 - DNA, 22 bp, Artificial Sequence
  chemically synthesized
cactgaactagtcaacttactt

SEQ ID NO: 24059 - DNA, 22 bp, Artificial Sequence
  chemically synthesized
aactagtcaacttacttaacag

SEQ ID NO: 24060 - DNA, 22 bp, Artificial Sequence
  chemically synthesized
gtcaacttacttaacagacaga

SEQ ID NO: 24061 - DNA, 22 bp, Artificial Sequence
  chemically synthesized
acttaacagacagaaggctcaa

SEQ ID NO: 24062 - DNA, 22 bp, Artificial Sequence
  chemically synthesized
cttaacagacagaaggctcaat

SEQ ID NO: 24063 - DNA, 22 bp, Artificial Sequence
  chemically synthesized
aacagacagaaggctcaattag

SEQ ID NO: 24064 - DNA, 22 bp, Artificial Sequence
  chemically synthesized
acagacagaaggctcaattagc

SEQ ID NO: 24065 - DNA, 22 bp, Artificial Sequence
  chemically synthesized
aattagctcatgtgtcaaatgg

SEQ ID NO: 24066 - DNA, 22 bp, Artificial Sequence
  chemically synthesized
gctcatgtgtcaaatgggggta

SEQ ID NO: 24067 - DNA, 22 bp, Artificial Sequence
  chemically synthesized
atgtgtcaaatgggggtaaaat

SEQ ID NO: 24068 - DNA, 22 bp, Artificial Sequence
  chemically synthesized
agtttggagggaaagacaggct

SEQ ID NO: 24069 - DNA, 22 bp, Artificial Sequence
  chemically synthesized
gtttggagggaaagacaggctc

SEQ ID NO: 24070 - DNA, 22 bp, Artificial Sequence
  chemically synthesized
ggagggaaagacaggctctaaa

SEQ ID NO: 24071 - DNA, 22 bp, Artificial Sequence
  chemically synthesized
gagggaaagacaggctctaaaa

SEQ ID NO: 24072 - DNA, 22 bp, Artificial Sequence
  chemically synthesized
taaaagaggattaaaaattaga

SEQ ID NO: 24073 - DNA, 22 bp, Artificial Sequence
  chemically synthesized
aaagaggattaaaaattagatg

SEQ ID NO: 24074 - DNA, 22 bp, Artificial Sequence
  chemically synthesized
aaaattagatgtggcctaggca

SEQ ID NO: 24075 - DNA, 22 bp, Artificial Sequence
  chemically synthesized
gatgtggcctaggcaaagaatt

SEQ ID NO: 24076 - DNA, 22 bp, Artificial Sequence
  chemically synthesized
ggcaaagaatttatgaccaagt

SEQ ID NO: 24077 - DNA, 22 bp, Artificial Sequence
  chemically synthesized
atgaccaagtcctcaaaactaa

SEQ ID NO: 24078 - DNA, 22 bp, Artificial Sequence
  chemically synthesized
tgaccaagtcctcaaaactaaa

SEQ ID NO: 24079 - DNA, 22 bp, Artificial Sequence
  chemically synthesized
aaaactaaacacaacaaaaaca

SEQ ID NO: 24080 - DNA, 22 bp, Artificial Sequence
  chemically synthesized
aacacaacaaaaacaaaaacag

SEQ ID NO: 24081 - DNA, 22 bp, Artificial Sequence
  chemically synthesized
aattaaactaaaatgcttctgc

SEQ ID NO: 24082 - DNA, 22 bp, Artificial Sequence
  chemically synthesized
attaaactaaaatgcttctgca

SEQ ID NO: 24083 - DNA, 22 bp, Artificial Sequence
  chemically synthesized
aactaaaatgcttctgcaccgc

SEQ ID NO: 24084 - DNA, 22 bp, Artificial Sequence
  chemically synthesized
aaatgcttctgcaccgcaaaag

SEQ ID NO: 24085 - DNA, 22 bp, Artificial Sequence
  chemically synthesized
ctgcaccgcaaaagaccgaatc

SEQ ID NO: 24086 - DNA, 22 bp, Artificial Sequence
  chemically synthesized
tgcaccgcaaaagaccgaatca

SEQ ID NO: 24087 - DNA, 22 bp, Artificial Sequence
  chemically synthesized
caccgcaaaagaccgaatcaac

SEQ ID NO: 24088 - DNA, 22 bp, Artificial Sequence
  chemically synthesized
cagaatgagaaaaaaaaattgc

SEQ ID NO: 24089 - DNA, 22 bp, Artificial Sequence
  chemically synthesized
caaactatgaatgcaacaaaag

SEQ ID NO: 24090 - DNA, 22 bp, Artificial Sequence
  chemically synthesized
tgaatgcaacaaaaggctaata

SEQ ID NO: 24091 - DNA, 22 bp, Artificial Sequence
  chemically synthesized
atatacagaatctacaaggaac

SEQ ID NO: 24092 - DNA, 22 bp, Artificial Sequence
  chemically synthesized
caaggaactcaacaacaaaaaa

SEQ ID NO: 24093 - DNA, 22 bp, Artificial Sequence
  chemically synthesized
aacaacaaaaaaaccaacctca

SEQ ID NO: 24094 - DNA, 22 bp, Artificial Sequence
  chemically synthesized
attagaaagtgactgtgatggt

SEQ ID NO: 24095 - DNA, 22 bp, Artificial Sequence
  chemically synthesized
gaaagtgactgtgatggttaat

SEQ ID NO: 24096 - DNA, 22 bp, Artificial Sequence
  chemically synthesized
tgatggttaatactgagtgtca

SEQ ID NO: 24097 - DNA, 22 bp, Artificial Sequence
  chemically synthesized
atactgagtgtcaacttgattg

SEQ ID NO: 24098 - DNA, 22 bp, Artificial Sequence
  chemically synthesized
agtgtcaacttgattggactga

SEQ ID NO: 24099 - DNA, 22 bp, Artificial Sequence
  chemically synthesized
gattggactgaaggatgcaaag

SEQ ID NO: 24100 - DNA, 22 bp, Artificial Sequence
  chemically synthesized
attggactgaaggatgcaaagt

SEQ ID NO: 24101 - DNA, 22 bp, Artificial Sequence
  chemically synthesized
gactgaaggatgcaaagtaatg

SEQ ID NO: 24102 - DNA, 22 bp, Artificial Sequence
  chemically synthesized
aaggatgcaaagtaatgatctt

SEQ ID NO: 24103 - DNA, 22 bp, Artificial Sequence
  chemically synthesized
gggtgtgtctgtgagggtgtta

SEQ ID NO: 24104 - DNA, 22 bp, Artificial Sequence
  chemically synthesized
ggtgtgtctgtgagggtgttac

SEQ ID NO: 24105 - DNA, 22 bp, Artificial Sequence
  chemically synthesized
tgagggtgttaccaaaggagat

SEQ ID NO: 24106 - DNA, 22 bp, Artificial Sequence
  chemically synthesized
ccaaaggagattaatatttcag

SEQ ID NO: 24107 - DNA, 22 bp, Artificial Sequence
  chemically synthesized
atatttcagtcagtgggctggg

SEQ ID NO: 24108 - DNA, 22 bp, Artificial Sequence
  chemically synthesized
cagtcagtgggctggggaaggc

SEQ ID NO: 24109 - DNA, 22 bp, Artificial Sequence
  chemically synthesized
agtcagtgggctggggaaggca

SEQ ID NO: 24110 - DNA, 22 bp, Artificial Sequence
  chemically synthesized
gggaaggcagacccacccttaa

SEQ ID NO: 24111 - DNA, 22 bp, Artificial Sequence
  chemically synthesized
aatctgggtgggcaccatctaa

SEQ ID NO: 24112 - DNA, 22 bp, Artificial Sequence
  chemically synthesized
atctgggtgggcaccatctaat

SEQ ID NO: 24113 - DNA, 22 bp, Artificial Sequence
  chemically synthesized
ggtgggcaccatctaatcagtt

SEQ ID NO: 24114 - DNA, 22 bp, Artificial Sequence
  chemically synthesized
atcagttgccagcacagccagg

SEQ ID NO: 24115 - DNA, 22 bp, Artificial Sequence
  chemically synthesized
ccagcacagccaggatataaag

SEQ ID NO: 24116 - DNA, 22 bp, Artificial Sequence
  chemically synthesized
gattggcttggcatcccagcct

SEQ ID NO: 24117 - DNA, 22 bp, Artificial Sequence
  chemically synthesized
gcttggcatcccagcctacatt

SEQ ID NO: 24118 - DNA, 22 bp, Artificial Sequence
  chemically synthesized
ggcatcccagcctacatttttc

SEQ ID NO: 24119 - DNA, 22 bp, Artificial Sequence
  chemically synthesized
gcatcccagcctacatttttct

SEQ ID NO: 24120 - DNA, 22 bp, Artificial Sequence
  chemically synthesized
catttttctcccatgctggatt

SEQ ID NO: 24121 - DNA, 22 bp, Artificial Sequence
  chemically synthesized
ttctcccatgctggattcttcc

SEQ ID NO: 24122 - DNA, 22 bp, Artificial Sequence
  chemically synthesized
tctcccatgctggattcttcct

SEQ ID NO: 24123 - DNA, 22 bp, Artificial Sequence
  chemically synthesized
ctcccatgctggattcttcctg

SEQ ID NO: 24124 - DNA, 22 bp, Artificial Sequence
  chemically synthesized
tcccatgctggattcttcctgc

SEQ ID NO: 24125 - DNA, 22 bp, Artificial Sequence
  chemically synthesized
ccatgctggattcttcctgccc

SEQ ID NO: 24126 - DNA, 22 bp, Artificial Sequence
  chemically synthesized
gattcttcctgccctggaacat

SEQ ID NO: 24127 - DNA, 22 bp, Artificial Sequence
  chemically synthesized
ttcctgccctggaacattgaac

SEQ ID NO: 24128 - DNA, 22 bp, Artificial Sequence
  chemically synthesized
cctgccctggaacattgaactc

SEQ ID NO: 24129 - DNA, 22 bp, Artificial Sequence
  chemically synthesized
ctgccctggaacattgaactcc

SEQ ID NO: 24130 - DNA, 22 bp, Artificial Sequence
  chemically synthesized
ccctggaacattgaactccagg

SEQ ID NO: 24131 - DNA, 22 bp, Artificial Sequence
  chemically synthesized
gaacattgaactccaggttctt

SEQ ID NO: 24132 - DNA, 22 bp, Artificial Sequence
  chemically synthesized
aactccaggttcttcagctttg

SEQ ID NO: 24133 - DNA, 22 bp, Artificial Sequence
  chemically synthesized
caggttcttcagctttgggact

SEQ ID NO: 24134 - DNA, 22 bp, Artificial Sequence
  chemically synthesized
ttcagctttgggactccgacta

SEQ ID NO: 24135 - DNA, 22 bp, Artificial Sequence
  chemically synthesized
cagctttgggactccgactagc

SEQ ID NO: 24136 - DNA, 22 bp, Artificial Sequence
  chemically synthesized
agctttgggactccgactagct

SEQ ID NO: 24137 - DNA, 22 bp, Artificial Sequence
  chemically synthesized
tgggactccgactagcttcctt

SEQ ID NO: 24138 - DNA, 22 bp, Artificial Sequence
  chemically synthesized
gggactccgactagcttccttg

SEQ ID NO: 24139 - DNA, 22 bp, Artificial Sequence
  chemically synthesized
ggactccgactagcttccttgt

SEQ ID NO: 24140 - DNA, 22 bp, Artificial Sequence
  chemically synthesized
cgactagcttccttgttcctca

SEQ ID NO: 24141 - DNA, 22 bp, Artificial Sequence
  chemically synthesized
gcttccttgttcctcagctggc

SEQ ID NO: 24142 - DNA, 22 bp, Artificial Sequence
  chemically synthesized
ccttgttcctcagctggcagat

SEQ ID NO: 24143 - DNA, 22 bp, Artificial Sequence
  chemically synthesized
cttgttcctcagctggcagatg

SEQ ID NO: 24144 - DNA, 22 bp, Artificial Sequence
  chemically synthesized
gttcctcagctggcagatggcc

SEQ ID NO: 24145 - DNA, 22 bp, Artificial Sequence
  chemically synthesized
ttcctcagctggcagatggcct

SEQ ID NO: 24146 - DNA, 22 bp, Artificial Sequence
  chemically synthesized
ctcagctggcagatggcctgtt

SEQ ID NO: 24147 - DNA, 22 bp, Artificial Sequence
  chemically synthesized
agctggcagatggcctgttttg

SEQ ID NO: 24148 - DNA, 22 bp, Artificial Sequence
  chemically synthesized
gcagatggcctgttttgggacc

SEQ ID NO: 24149 - DNA, 22 bp, Artificial Sequence
  chemically synthesized
ttttgggaccttgtgaacatgt

SEQ ID NO: 24150 - DNA, 22 bp, Artificial Sequence
  chemically synthesized
tgggaccttgtgaacatgtgag

SEQ ID NO: 24151 - DNA, 22 bp, Artificial Sequence
  chemically synthesized
gggaccttgtgaacatgtgagt

SEQ ID NO: 24152 - DNA, 22 bp, Artificial Sequence
  chemically synthesized
ggaccttgtgaacatgtgagtc

SEQ ID NO: 24153 - DNA, 22 bp, Artificial Sequence
  chemically synthesized
gtgaacatgtgagtcaatacta

SEQ ID NO: 24154 - DNA, 22 bp, Artificial Sequence
  chemically synthesized
tgaacatgtgagtcaatactac

SEQ ID NO: 24155 - DNA, 22 bp, Artificial Sequence
  chemically synthesized
cataataaactctcatatagat

SEQ ID NO: 24156 - DNA, 22 bp, Artificial Sequence
  chemically synthesized
tcatatagatatagatatagag

SEQ ID NO: 24157 - DNA, 22 bp, Artificial Sequence
  chemically synthesized
atatagatatagatatagagat

SEQ ID NO: 24158 - DNA, 22 bp, Artificial Sequence
  chemically synthesized
ctattaattctgtttctctgta

SEQ ID NO: 24159 - DNA, 22 bp, Artificial Sequence
  chemically synthesized
ttaattctgtttctctgtagaa

SEQ ID NO: 24160 - DNA, 22 bp, Artificial Sequence
  chemically synthesized
attctgtttctctgtagaaccc

SEQ ID NO: 24161 - DNA, 22 bp, Artificial Sequence
  chemically synthesized
tgtttctctgtagaaccctaat

SEQ ID NO: 24162 - DNA, 22 bp, Artificial Sequence
  chemically synthesized
tttctctgtagaaccctaatac

SEQ ID NO: 24163 - DNA, 22 bp, Artificial Sequence
  chemically synthesized
ctctgtagaaccctaatacaga

SEQ ID NO: 24164 - DNA, 22 bp, Artificial Sequence
  chemically synthesized
tctgtagaaccctaatacagat

SEQ ID NO: 24165 - DNA, 22 bp, Artificial Sequence
  chemically synthesized
tgtagaaccctaatacagattt

SEQ ID NO: 24166 - DNA, 22 bp, Artificial Sequence
  chemically synthesized
tagaaccctaatacagattttg

SEQ ID NO: 24167 - DNA, 22 bp, Artificial Sequence
  chemically synthesized
atacagattttggtaccaggag

SEQ ID NO: 24168 - DNA, 22 bp, Artificial Sequence
  chemically synthesized
tggtaccaggagtggttctaga

SEQ ID NO: 24169 - DNA, 22 bp, Artificial Sequence
  chemically synthesized
ggtaccaggagtggttctagag

SEQ ID NO: 24170 - DNA, 22 bp, Artificial Sequence
  chemically synthesized
gtaccaggagtggttctagagg

SEQ ID NO: 24171 - DNA, 22 bp, Artificial Sequence
  chemically synthesized
tagaggaacagaatattaagga

SEQ ID NO: 24172 - DNA, 22 bp, Artificial Sequence
  chemically synthesized
gaggaacagaatattaaggatg

SEQ ID NO: 24173 - DNA, 22 bp, Artificial Sequence
  chemically synthesized
aggatggagttctttcattggt

SEQ ID NO: 24174 - DNA, 22 bp, Artificial Sequence
  chemically synthesized
tttcattggttttggggtttct

SEQ ID NO: 24175 - DNA, 22 bp, Artificial Sequence
  chemically synthesized
tcattggttttggggtttctgg

SEQ ID NO: 24176 - DNA, 22 bp, Artificial Sequence
  chemically synthesized
cattggttttggggtttctgga

SEQ ID NO: 24177 - DNA, 22 bp, Artificial Sequence
  chemically synthesized
attggttttggggtttctggag

SEQ ID NO: 24178 - DNA, 22 bp, Artificial Sequence
  chemically synthesized
gttttggggtttctggagttgg

SEQ ID NO: 24179 - DNA, 22 bp, Artificial Sequence
  chemically synthesized
tggggtttctggagttggctgc

SEQ ID NO: 24180 - DNA, 22 bp, Artificial Sequence
  chemically synthesized
ggggtttctggagttggctgct

SEQ ID NO: 24181 - DNA, 22 bp, Artificial Sequence
  chemically synthesized
gggtttctggagttggctgctt

SEQ ID NO: 24182 - DNA, 22 bp, Artificial Sequence
  chemically synthesized
ctggagttggctgcttaatatg

SEQ ID NO: 24183 - DNA, 22 bp, Artificial Sequence
  chemically synthesized
tggagttggctgcttaatatga

SEQ ID NO: 24184 - DNA, 22 bp, Artificial Sequence
  chemically synthesized
gagttggctgcttaatatgatt

SEQ ID NO: 24185 - DNA, 22 bp, Artificial Sequence
  chemically synthesized
gctgcttaatatgattagaccc

SEQ ID NO: 24186 - DNA, 22 bp, Artificial Sequence
  chemically synthesized
cttaatatgattagacccaaat

SEQ ID NO: 24187 - DNA, 22 bp, Artificial Sequence
  chemically synthesized
aatatgattagacccaaatatg

SEQ ID NO: 24188 - DNA, 22 bp, Artificial Sequence
  chemically synthesized
atatgattagacccaaatatgc

SEQ ID NO: 24189 - DNA, 22 bp, Artificial Sequence
  chemically synthesized
gacccaaatatgctaaggactc

SEQ ID NO: 24190 - DNA, 22 bp, Artificial Sequence
  chemically synthesized
aggactcttcttctaatggtat

SEQ ID NO: 24191 - DNA, 22 bp, Artificial Sequence
  chemically synthesized
ttcttctaatggtatggagaac

SEQ ID NO: 24192 - DNA, 22 bp, Artificial Sequence
  chemically synthesized
cttctaatggtatggagaacac

SEQ ID NO: 24193 - DNA, 22 bp, Artificial Sequence
  chemically synthesized
ttctaatggtatggagaacact

SEQ ID NO: 24194 - DNA, 22 bp, Artificial Sequence
  chemically synthesized
ctaatggtatggagaacactga

SEQ ID NO: 24195 - DNA, 22 bp, Artificial Sequence
  chemically synthesized
taatggtatggagaacactgat

SEQ ID NO: 24196 - DNA, 22 bp, Artificial Sequence
  chemically synthesized
atggtatggagaacactgataa

SEQ ID NO: 24197 - DNA, 22 bp, Artificial Sequence
  chemically synthesized
ataatccttggcatcaattgtt

SEQ ID NO: 24198 - DNA, 22 bp, Artificial Sequence
  chemically synthesized
ggcatcaattgtttagagagtt

SEQ ID NO: 24199 - DNA, 22 bp, Artificial Sequence
  chemically synthesized
gcatcaattgtttagagagtta

SEQ ID NO: 24200 - DNA, 22 bp, Artificial Sequence
  chemically synthesized
tttagagagttatgcaaaataa

SEQ ID NO: 24201 - DNA, 22 bp, Artificial Sequence
  chemically synthesized
agagagttatgcaaaataaatg

SEQ ID NO: 24202 - DNA, 22 bp, Artificial Sequence
  chemically synthesized
gagagttatgcaaaataaatgc

SEQ ID NO: 24203 - DNA, 22 bp, Artificial Sequence
  chemically synthesized
tgcaaaataaatgcatttgaca

SEQ ID NO: 24204 - DNA, 22 bp, Artificial Sequence
  chemically synthesized
gacactcttgattcaacgcttg

SEQ ID NO: 24205 - DNA, 22 bp, Artificial Sequence
  chemically synthesized
acactcttgattcaacgcttgt

SEQ ID NO: 24206 - DNA, 22 bp, Artificial Sequence
  chemically synthesized
ttgattcaacgcttgtgagagg

SEQ ID NO: 24207 - DNA, 22 bp, Artificial Sequence
  chemically synthesized
gattcaacgcttgtgagaggca

SEQ ID NO: 24208 - DNA, 22 bp, Artificial Sequence
  chemically synthesized
attcaacgcttgtgagaggcaa

SEQ ID NO: 24209 - DNA, 22 bp, Artificial Sequence
  chemically synthesized
aacgcttgtgagaggcaaggaa

SEQ ID NO: 24210 - DNA, 22 bp, Artificial Sequence
  chemically synthesized
gtgagaggcaaggaatttagct

SEQ ID NO: 24211 - DNA, 22 bp, Artificial Sequence
  chemically synthesized
tgagaggcaaggaatttagcta

SEQ ID NO: 24212 - DNA, 22 bp, Artificial Sequence
  chemically synthesized
agctactgtatacataatactt

SEQ ID NO: 24213 - DNA, 22 bp, Artificial Sequence
  chemically synthesized
gctactgtatacataatacttt

SEQ ID NO: 24214 - DNA, 22 bp, Artificial Sequence
  chemically synthesized
ctgtatacataatacttttgac

SEQ ID NO: 24215 - DNA, 22 bp, Artificial Sequence
  chemically synthesized
tatacataatacttttgactat

SEQ ID NO: 24216 - DNA, 22 bp, Artificial Sequence
  chemically synthesized
ttgactatatgtggagaatcaa

SEQ ID NO: 24217 - DNA, 22 bp, Artificial Sequence
  chemically synthesized
tgactatatgtggagaatcaag

SEQ ID NO: 24218 - DNA, 22 bp, Artificial Sequence
  chemically synthesized
gactatatgtggagaatcaagg

SEQ ID NO: 24219 - DNA, 22 bp, Artificial Sequence
  chemically synthesized
actatatgtggagaatcaagga

SEQ ID NO: 24220 - DNA, 22 bp, Artificial Sequence
  chemically synthesized
tatgtggagaatcaaggaacat

SEQ ID NO: 24221 - DNA, 22 bp, Artificial Sequence
  chemically synthesized
gttggttgcttgtaagttcgct

SEQ ID NO: 24222 - DNA, 22 bp, Artificial Sequence
  chemically synthesized
gttgcttgtaagttcgctggac

SEQ ID NO: 24223 - DNA, 22 bp, Artificial Sequence
  chemically synthesized
cttgtaagttcgctggacaaag

SEQ ID NO: 24224 - DNA, 22 bp, Artificial Sequence
  chemically synthesized
gtaagttcgctggacaaagtga

SEQ ID NO: 24225 - DNA, 22 bp, Artificial Sequence
  chemically synthesized
taagttcgctggacaaagtgat

SEQ ID NO: 24226 - DNA, 22 bp, Artificial Sequence
  chemically synthesized
gctggacaaagtgatgaaagaa

SEQ ID NO: 24227 - DNA, 22 bp, Artificial Sequence
  chemically synthesized
gacaaagtgatgaaagaaaatg

SEQ ID NO: 24228 - DNA, 22 bp, Artificial Sequence
  chemically synthesized
aggagtatatcaactctccagc

SEQ ID NO: 24229 - DNA, 22 bp, Artificial Sequence
  chemically synthesized
tccagctttgtgccataatctt

SEQ ID NO: 24230 - DNA, 22 bp, Artificial Sequence
  chemically synthesized
cagctttgtgccataatcttat

SEQ ID NO: 24231 - DNA, 22 bp, Artificial Sequence
  chemically synthesized
tgtgccataatcttatttggag

SEQ ID NO: 24232 - DNA, 22 bp, Artificial Sequence
  chemically synthesized
gtgccataatcttatttggaga

SEQ ID NO: 24233 - DNA, 22 bp, Artificial Sequence
  chemically synthesized
tgccataatcttatttggagag

SEQ ID NO: 24234 - DNA, 22 bp, Artificial Sequence
  chemically synthesized
atttggagagaacttgctcacc

SEQ ID NO: 24235 - DNA, 22 bp, Artificial Sequence
  chemically synthesized
tttggagagaacttgctcacct

SEQ ID NO: 24236 - DNA, 22 bp, Artificial Sequence
  chemically synthesized
ggagagaacttgctcacctttc

SEQ ID NO: 24237 - DNA, 22 bp, Artificial Sequence
  chemically synthesized
gagagaacttgctcacctttca

SEQ ID NO: 24238 - DNA, 22 bp, Artificial Sequence
  chemically synthesized
gctcacctttcacttccacaag

SEQ ID NO: 24239 - DNA, 22 bp, Artificial Sequence
  chemically synthesized
ctcacctttcacttccacaaga

SEQ ID NO: 24240 - DNA, 22 bp, Artificial Sequence
  chemically synthesized
acctttcacttccacaagatat

SEQ ID NO: 24241 - DNA, 22 bp, Artificial Sequence
  chemically synthesized
tcacttccacaagatatcacag

SEQ ID NO: 24242 - DNA, 22 bp, Artificial Sequence
  chemically synthesized
cacttccacaagatatcacagt

SEQ ID NO: 24243 - DNA, 22 bp, Artificial Sequence
  chemically synthesized
acttccacaagatatcacagtg

SEQ ID NO: 24244 - DNA, 22 bp, Artificial Sequence
  chemically synthesized
ccacaagatatcacagtggtcc

SEQ ID NO: 24245 - DNA, 22 bp, Artificial Sequence
  chemically synthesized
cacaagatatcacagtggtcca

SEQ ID NO: 24246 - DNA, 22 bp, Artificial Sequence
  chemically synthesized
cattgatgacatgctgactgga

SEQ ID NO: 24247 - DNA, 22 bp, Artificial Sequence
  chemically synthesized
atgacatgctgactggaactag

SEQ ID NO: 24248 - DNA, 22 bp, Artificial Sequence
  chemically synthesized
actggaactagtgagcaagaag

SEQ ID NO: 24249 - DNA, 22 bp, Artificial Sequence
  chemically synthesized
gaactagtgagcaagaagtagc

SEQ ID NO: 24250 - DNA, 22 bp, Artificial Sequence
  chemically synthesized
gtgagcaagaagtagcaaacac

SEQ ID NO: 24251 - DNA, 22 bp, Artificial Sequence
  chemically synthesized
gatttattgatgagacatttgt

SEQ ID NO: 24252 - DNA, 22 bp, Artificial Sequence
  chemically synthesized
attgatgagacatttgtgggac

SEQ ID NO: 24253 - DNA, 22 bp, Artificial Sequence
  chemically synthesized
ttgatgagacatttgtgggaca

SEQ ID NO: 24254 - DNA, 22 bp, Artificial Sequence
  chemically synthesized
atgagacatttgtgggacagag

SEQ ID NO: 24255 - DNA, 22 bp, Artificial Sequence
  chemically synthesized
gtgggacagaggatgggaaata

SEQ ID NO: 24256 - DNA, 22 bp, Artificial Sequence
  chemically synthesized
tgggacagaggatgggaaataa

SEQ ID NO: 24257 - DNA, 22 bp, Artificial Sequence
  chemically synthesized
attaaattcagggaccttctac

SEQ ID NO: 24258 - DNA, 22 bp, Artificial Sequence
  chemically synthesized
aattcagggaccttctacctca

SEQ ID NO: 24259 - DNA, 22 bp, Artificial Sequence
  chemically synthesized
agggaccttctacctcagtaaa

SEQ ID NO: 24260 - DNA, 22 bp, Artificial Sequence
  chemically synthesized
ctacctcagtaaaatttatagg

SEQ ID NO: 24261 - DNA, 22 bp, Artificial Sequence
  chemically synthesized
tacctcagtaaaatttataggg

SEQ ID NO: 24262 - DNA, 22 bp, Artificial Sequence
  chemically synthesized
cctcagtaaaatttataggggt

SEQ ID NO: 24263 - DNA, 22 bp, Artificial Sequence
  chemically synthesized
agtaaaatttataggggtccaa

SEQ ID NO: 24264 - DNA, 22 bp, Artificial Sequence
  chemically synthesized
ataggggtccaatggtttgggg

SEQ ID NO: 24265 - DNA, 22 bp, Artificial Sequence
  chemically synthesized
taggggtccaatggtttggggc

SEQ ID NO: 24266 - DNA, 22 bp, Artificial Sequence
  chemically synthesized
ggggctctttgagatattcctt

SEQ ID NO: 24267 - DNA, 22 bp, Artificial Sequence
  chemically synthesized
gggctctttgagatattccttc

SEQ ID NO: 24268 - DNA, 22 bp, Artificial Sequence
  chemically synthesized
tttgagatattccttctaaagt

SEQ ID NO: 24269 - DNA, 22 bp, Artificial Sequence
  chemically synthesized
tgagatattccttctaaagtga

SEQ ID NO: 24270 - DNA, 22 bp, Artificial Sequence
  chemically synthesized
gagatattccttctaaagtgaa

SEQ ID NO: 24271 - DNA, 22 bp, Artificial Sequence
  chemically synthesized
agatattccttctaaagtgaag

SEQ ID NO: 24272 - DNA, 22 bp, Artificial Sequence
  chemically synthesized
cttctaaagtgaaggataattt

SEQ ID NO: 24273 - DNA, 22 bp, Artificial Sequence
  chemically synthesized
ctaaagtgaaggataatttgct

SEQ ID NO: 24274 - DNA, 22 bp, Artificial Sequence
  chemically synthesized
taaagtgaaggataatttgctg

SEQ ID NO: 24275 - DNA, 22 bp, Artificial Sequence
  chemically synthesized
aagtgaaggataatttgctgca

SEQ ID NO: 24276 - DNA, 22 bp, Artificial Sequence
  chemically synthesized
gctgcatttggccactcttaca

SEQ ID NO: 24277 - DNA, 22 bp, Artificial Sequence
  chemically synthesized
ctgcatttggccactcttacaa

SEQ ID NO: 24278 - DNA, 22 bp, Artificial Sequence
  chemically synthesized
catttggccactcttacaacca

SEQ ID NO: 24279 - DNA, 22 bp, Artificial Sequence
  chemically synthesized
ggccactcttacaaccaagaaa

SEQ ID NO: 24280 - DNA, 22 bp, Artificial Sequence
  chemically synthesized
gccactcttacaaccaagaaat

SEQ ID NO: 24281 - DNA, 22 bp, Artificial Sequence
  chemically synthesized
ttacaaccaagaaataggcaca

SEQ ID NO: 24282 - DNA, 22 bp, Artificial Sequence
  chemically synthesized
acaaccaagaaataggcacaac

SEQ ID NO: 24283 - DNA, 22 bp, Artificial Sequence
  chemically synthesized
caaccaagaaataggcacaacg

SEQ ID NO: 24284 - DNA, 22 bp, Artificial Sequence
  chemically synthesized
gtgggcctatttggattttgga

SEQ ID NO: 24285 - DNA, 22 bp, Artificial Sequence
  chemically synthesized
tttggattttggaggcaacata

SEQ ID NO: 24286 - DNA, 22 bp, Artificial Sequence
  chemically synthesized
ggattttggaggcaacatattc

SEQ ID NO: 24287 - DNA, 22 bp, Artificial Sequence
  chemically synthesized
gattttggaggcaacatattcc

SEQ ID NO: 24288 - DNA, 22 bp, Artificial Sequence
  chemically synthesized
tggaggcaacatattcctgatt

SEQ ID NO: 24289 - DNA, 22 bp, Artificial Sequence
  chemically synthesized
ggaggcaacatattcctgattt

SEQ ID NO: 24290 - DNA, 22 bp, Artificial Sequence
  chemically synthesized
gaggcaacatattcctgatttg

SEQ ID NO: 24291 - DNA, 22 bp, Artificial Sequence
  chemically synthesized
ctgatttgggtgtgttactctg

SEQ ID NO: 24292 - DNA, 22 bp, Artificial Sequence
  chemically synthesized
atttgggtgtgttactctggcc

SEQ ID NO: 24293 - DNA, 22 bp, Artificial Sequence
  chemically synthesized
gggtgtgttactctggcccatt

SEQ ID NO: 24294 - DNA, 22 bp, Artificial Sequence
  chemically synthesized
ggtgtgttactctggcccattt

SEQ ID NO: 24295 - DNA, 22 bp, Artificial Sequence
  chemically synthesized
ctctggcccatttatcgagtga

SEQ ID NO: 24296 - DNA, 22 bp, Artificial Sequence
  chemically synthesized
tggcccatttatcgagtgatcc

SEQ ID NO: 24297 - DNA, 22 bp, Artificial Sequence
  chemically synthesized
gcccatttatcgagtgatccaa

SEQ ID NO: 24298 - DNA, 22 bp, Artificial Sequence
  chemically synthesized
atcgagtgatccaaaaggctgc

SEQ ID NO: 24299 - DNA, 22 bp, Artificial Sequence
  chemically synthesized
tcgagtgatccaaaaggctgcc

SEQ ID NO: 24300 - DNA, 22 bp, Artificial Sequence
  chemically synthesized
ccagttttgagtggagtccaga

SEQ ID NO: 24301 - DNA, 22 bp, Artificial Sequence
  chemically synthesized
tgagtggagtccagaacagaag

SEQ ID NO: 24302 - DNA, 22 bp, Artificial Sequence
  chemically synthesized
gagtggagtccagaacagaagg

SEQ ID NO: 24303 - DNA, 22 bp, Artificial Sequence
  chemically synthesized
agtggagtccagaacagaaggc

SEQ ID NO: 24304 - DNA, 22 bp, Artificial Sequence
  chemically synthesized
tgccacaggtccaggctgctgt

SEQ ID NO: 24305 - DNA, 22 bp, Artificial Sequence
  chemically synthesized
ccacaggtccaggctgctgtgc

SEQ ID NO: 24306 - DNA, 22 bp, Artificial Sequence
  chemically synthesized
ctgtgcaagctgctatgccact

SEQ ID NO: 24307 - DNA, 22 bp, Artificial Sequence
  chemically synthesized
tgcaagctgctatgccacttgg

SEQ ID NO: 24308 - DNA, 22 bp, Artificial Sequence
  chemically synthesized
ctatgccacttgggccatatga

SEQ ID NO: 24309 - DNA, 22 bp, Artificial Sequence
  chemically synthesized
tgccacttgggccatatgacct

SEQ ID NO: 24310 - DNA, 22 bp, Artificial Sequence
  chemically synthesized
gggccatatgacctagcagatc

SEQ ID NO: 24311 - DNA, 22 bp, Artificial Sequence
  chemically synthesized
ggccatatgacctagcagatcc

SEQ ID NO: 24312 - DNA, 22 bp, Artificial Sequence
  chemically synthesized
gcagatccaatgatgcttgagg

SEQ ID NO: 24313 - DNA, 22 bp, Artificial Sequence
  chemically synthesized
gaggtgtcagtgccagataggg

SEQ ID NO: 24314 - DNA, 22 bp, Artificial Sequence
  chemically synthesized
aggtgtcagtgccagataggga

SEQ ID NO: 24315 - DNA, 22 bp, Artificial Sequence
  chemically synthesized
tttggagcatttggcaggctga

SEQ ID NO: 24316 - DNA, 22 bp, Artificial Sequence
  chemically synthesized
ggagcatttggcaggctgaatc

SEQ ID NO: 24317 - DNA, 22 bp, Artificial Sequence
  chemically synthesized
gagcatttggcaggctgaatca

SEQ ID NO: 24318 - DNA, 22 bp, Artificial Sequence
  chemically synthesized
ggcaggctgaatcacagcggag

SEQ ID NO: 24319 - DNA, 22 bp, Artificial Sequence
  chemically synthesized
gcaggctgaatcacagcggagg

SEQ ID NO: 24320 - DNA, 22 bp, Artificial Sequence
  chemically synthesized
aatcacagcggaggcctctagg

SEQ ID NO: 24321 - DNA, 22 bp, Artificial Sequence
  chemically synthesized
taggattttggagcaaggccct

SEQ ID NO: 24322 - DNA, 22 bp, Artificial Sequence
  chemically synthesized
ggattttggagcaaggccctgc

SEQ ID NO: 24323 - DNA, 22 bp, Artificial Sequence
  chemically synthesized
tggagcaaggccctgccatctt

SEQ ID NO: 24324 - DNA, 22 bp, Artificial Sequence
  chemically synthesized
ggagcaaggccctgccatcttc

SEQ ID NO: 24325 - DNA, 22 bp, Artificial Sequence
  chemically synthesized
gagcaaggccctgccatcttct

SEQ ID NO: 24326 - DNA, 22 bp, Artificial Sequence
  chemically synthesized
ccatcttctgcagataactact

SEQ ID NO: 24327 - DNA, 22 bp, Artificial Sequence
  chemically synthesized
ctgcagataactactctctttt

SEQ ID NO: 24328 - DNA, 22 bp, Artificial Sequence
  chemically synthesized
tgcagataactactctctttta

SEQ ID NO: 24329 - DNA, 22 bp, Artificial Sequence
  chemically synthesized
cagataactactctcttttagg

SEQ ID NO: 24330 - DNA, 22 bp, Artificial Sequence
  chemically synthesized
ctctcttttagggagaaagctc

SEQ ID NO: 24331 - DNA, 22 bp, Artificial Sequence
  chemically synthesized
tcttttagggagaaagctcttg

SEQ ID NO: 24332 - DNA, 22 bp, Artificial Sequence
  chemically synthesized
ttttagggagaaagctcttggc

SEQ ID NO: 24333 - DNA, 22 bp, Artificial Sequence
  chemically synthesized
ttagggagaaagctcttggcct

SEQ ID NO: 24334 - DNA, 22 bp, Artificial Sequence
  chemically synthesized
tagggagaaagctcttggcctg

SEQ ID NO: 24335 - DNA, 22 bp, Artificial Sequence
  chemically synthesized
agggagaaagctcttggcctgt

SEQ ID NO: 24336 - DNA, 22 bp, Artificial Sequence
  chemically synthesized
gggagaaagctcttggcctgtt

SEQ ID NO: 24337 - DNA, 22 bp, Artificial Sequence
  chemically synthesized
ttggcctgttactgggctttgg

SEQ ID NO: 24338 - DNA, 22 bp, Artificial Sequence
  chemically synthesized
ggcctgttactgggctttggtg

SEQ ID NO: 24339 - DNA, 22 bp, Artificial Sequence
  chemically synthesized
gcctgttactgggctttggtgg

SEQ ID NO: 24340 - DNA, 22 bp, Artificial Sequence
  chemically synthesized
ttactgggctttggtggaaacg

SEQ ID NO: 24341 - DNA, 22 bp, Artificial Sequence
  chemically synthesized
ctgggctttggtggaaacgaaa

SEQ ID NO: 24342 - DNA, 22 bp, Artificial Sequence
  chemically synthesized
ggctttggtggaaacgaaatat

SEQ ID NO: 24343 - DNA, 22 bp, Artificial Sequence
  chemically synthesized
tggtggaaacgaaatatttgac

SEQ ID NO: 24344 - DNA, 22 bp, Artificial Sequence
  chemically synthesized
ggtggaaacgaaatatttgact

SEQ ID NO: 24345 - DNA, 22 bp, Artificial Sequence
  chemically synthesized
gtggaaacgaaatatttgacta

SEQ ID NO: 24346 - DNA, 22 bp, Artificial Sequence
  chemically synthesized
gactatgagtcatcaagtcacc

SEQ ID NO: 24347 - DNA, 22 bp, Artificial Sequence
  chemically synthesized
actatgagtcatcaagtcacca

SEQ ID NO: 24348 - DNA, 22 bp, Artificial Sequence
  chemically synthesized
tgagtcatcaagtcaccatgtg

SEQ ID NO: 24349 - DNA, 22 bp, Artificial Sequence
  chemically synthesized
aactgcctatcatgaactgggt

SEQ ID NO: 24350 - DNA, 22 bp, Artificial Sequence
  chemically synthesized
cctatcatgaactgggtgcttt

SEQ ID NO: 24351 - DNA, 22 bp, Artificial Sequence
  chemically synthesized
tcatgaactgggtgctttctga

SEQ ID NO: 24352 - DNA, 22 bp, Artificial Sequence
  chemically synthesized
ggtgctttctgatccatctagc

SEQ ID NO: 24353 - DNA, 22 bp, Artificial Sequence
  chemically synthesized
tctgatccatctagccataaag

SEQ ID NO: 24354 - DNA, 22 bp, Artificial Sequence
  chemically synthesized
ctgatccatctagccataaagt

SEQ ID NO: 24355 - DNA, 22 bp, Artificial Sequence
  chemically synthesized
tgatccatctagccataaagtg

SEQ ID NO: 24356 - DNA, 22 bp, Artificial Sequence
  chemically synthesized
atccatctagccataaagtggg

SEQ ID NO: 24357 - DNA, 22 bp, Artificial Sequence
  chemically synthesized
gccataaagtgggctgtgcaca

SEQ ID NO: 24358 - DNA, 22 bp, Artificial Sequence
  chemically synthesized
tgcacagcagcattgcatcagc

SEQ ID NO: 24359 - DNA, 22 bp, Artificial Sequence
  chemically synthesized
catcagcaaatggaagtggtat

SEQ ID NO: 24360 - DNA, 22 bp, Artificial Sequence
  chemically synthesized
ggcttgagcagatcctgaaggc

SEQ ID NO: 24361 - DNA, 22 bp, Artificial Sequence
  chemically synthesized
gagcagatcctgaaggcactag

SEQ ID NO: 24362 - DNA, 22 bp, Artificial Sequence
  chemically synthesized
agcagatcctgaaggcactagt

SEQ ID NO: 24363 - DNA, 22 bp, Artificial Sequence
  chemically synthesized
aaggcactagtaagttacatga

SEQ ID NO: 24364 - DNA, 22 bp, Artificial Sequence
  chemically synthesized
gtaagttacatgagaaaggggc

SEQ ID NO: 24365 - DNA, 22 bp, Artificial Sequence
  chemically synthesized
catgagaaaggggctcaaatgc

SEQ ID NO: 24366 - DNA, 22 bp, Artificial Sequence
  chemically synthesized
aaatgcccatggtctccactcc

SEQ ID NO: 24367 - DNA, 22 bp, Artificial Sequence
  chemically synthesized
cactcctgacacactgctttct

SEQ ID NO: 24368 - DNA, 22 bp, Artificial Sequence
  chemically synthesized
ctgacacactgctttctctccc

SEQ ID NO: 24369 - DNA, 22 bp, Artificial Sequence
  chemically synthesized
acacactgctttctctccctga

SEQ ID NO: 24370 - DNA, 22 bp, Artificial Sequence
  chemically synthesized
ctttctctccctgagactgcac

SEQ ID NO: 24371 - DNA, 22 bp, Artificial Sequence
  chemically synthesized
tctctccctgagactgcaccga

SEQ ID NO: 24372 - DNA, 22 bp, Artificial Sequence
  chemically synthesized
ctctccctgagactgcaccgat

SEQ ID NO: 24373 - DNA, 22 bp, Artificial Sequence
  chemically synthesized
tctccctgagactgcaccgatg

SEQ ID NO: 24374 - DNA, 22 bp, Artificial Sequence
  chemically synthesized
tccctgagactgcaccgatggt

SEQ ID NO: 24375 - DNA, 22 bp, Artificial Sequence
  chemically synthesized
cctgagactgcaccgatggtct

SEQ ID NO: 24376 - DNA, 22 bp, Artificial Sequence
  chemically synthesized
agactgcaccgatggtctcatg

SEQ ID NO: 24377 - DNA, 22 bp, Artificial Sequence
  chemically synthesized
caccgatggtctcatggggagt

SEQ ID NO: 24378 - DNA, 22 bp, Artificial Sequence
  chemically synthesized
atggggagttccctatgatcag

SEQ ID NO: 24379 - DNA, 22 bp, Artificial Sequence
  chemically synthesized
cctatgatcagctgacagagga

SEQ ID NO: 24380 - DNA, 22 bp, Artificial Sequence
  chemically synthesized
tgatcagctgacagaggaagag

SEQ ID NO: 24381 - DNA, 22 bp, Artificial Sequence
  chemically synthesized
acagaggaagagaagactaggt

SEQ ID NO: 24382 - DNA, 22 bp, Artificial Sequence
  chemically synthesized
ggtcctggttcacagatagttc

SEQ ID NO: 24383 - DNA, 22 bp, Artificial Sequence
  chemically synthesized
gttcacagatagttctgcacga

SEQ ID NO: 24384 - DNA, 22 bp, Artificial Sequence
  chemically synthesized
acagatagttctgcacgatatg

SEQ ID NO: 24385 - DNA, 22 bp, Artificial Sequence
  chemically synthesized
tgcacgatatgcaggcaccacc

SEQ ID NO: 24386 - DNA, 22 bp, Artificial Sequence
  chemically synthesized
cacgatatgcaggcaccaccca

SEQ ID NO: 24387 - DNA, 22 bp, Artificial Sequence
  chemically synthesized
cagcccctttctaggacatccc

SEQ ID NO: 24388 - DNA, 22 bp, Artificial Sequence
  chemically synthesized
tctaggacatccctgaaggaca

SEQ ID NO: 24389 - DNA, 22 bp, Artificial Sequence
  chemically synthesized
ctaggacatccctgaaggacaa

SEQ ID NO: 24390 - DNA, 22 bp, Artificial Sequence
  chemically synthesized
taggacatccctgaaggacaac

SEQ ID NO: 24391 - DNA, 22 bp, Artificial Sequence
  chemically synthesized
ggacatccctgaaggacaacgg

SEQ ID NO: 24392 - DNA, 22 bp, Artificial Sequence
  chemically synthesized
aaggacaacggtgaagggaaat

SEQ ID NO: 24393 - DNA, 22 bp, Artificial Sequence
  chemically synthesized
cctagttggcagaactttgagc

SEQ ID NO: 24394 - DNA, 22 bp, Artificial Sequence
  chemically synthesized
ctagttggcagaactttgagca

SEQ ID NO: 24395 - DNA, 22 bp, Artificial Sequence
  chemically synthesized
gttggcagaactttgagcagtg

SEQ ID NO: 24396 - DNA, 22 bp, Artificial Sequence
  chemically synthesized
gcagaactttgagcagtgtgcc

SEQ ID NO: 24397 - DNA, 22 bp, Artificial Sequence
  chemically synthesized
tgagcagtgtgcctggttgtgc

SEQ ID NO: 24398 - DNA, 22 bp, Artificial Sequence
  chemically synthesized
gagcagtgtgcctggttgtgca

SEQ ID NO: 24399 - DNA, 22 bp, Artificial Sequence
  chemically synthesized
agcagtgtgcctggttgtgcac

SEQ ID NO: 24400 - DNA, 22 bp, Artificial Sequence
  chemically synthesized
gttgtgcactttgcacagaagg

SEQ ID NO: 24401 - DNA, 22 bp, Artificial Sequence
  chemically synthesized
tgcactttgcacagaaggagaa

SEQ ID NO: 24402 - DNA, 22 bp, Artificial Sequence
  chemically synthesized
tgcacagaaggagaaatggcca

SEQ ID NO: 24403 - DNA, 22 bp, Artificial Sequence
  chemically synthesized
gcacagaaggagaaatggccag

SEQ ID NO: 24404 - DNA, 22 bp, Artificial Sequence
  chemically synthesized
cacagaaggagaaatggccaga

SEQ ID NO: 24405 - DNA, 22 bp, Artificial Sequence
  chemically synthesized
gcgattatatacttattcatgg

SEQ ID NO: 24406 - DNA, 22 bp, Artificial Sequence
  chemically synthesized
cgattatatacttattcatggg

SEQ ID NO: 24407 - DNA, 22 bp, Artificial Sequence
  chemically synthesized
tatacttattcatgggctgtag

SEQ ID NO: 24408 - DNA, 22 bp, Artificial Sequence
  chemically synthesized
attcatgggctgtagccaaagg

SEQ ID NO: 24409 - DNA, 22 bp, Artificial Sequence
  chemically synthesized
ttcatgggctgtagccaaaggt

SEQ ID NO: 24410 - DNA, 22 bp, Artificial Sequence
  chemically synthesized
atgggctgtagccaaaggtttg

SEQ ID NO: 24411 - DNA, 22 bp, Artificial Sequence
  chemically synthesized
tagccaaaggtttggctagatg

SEQ ID NO: 24412 - DNA, 22 bp, Artificial Sequence
  chemically synthesized
ggctagatggtcagggacttgg

SEQ ID NO: 24413 - DNA, 22 bp, Artificial Sequence
  chemically synthesized
gctagatggtcagggacttgga

SEQ ID NO: 24414 - DNA, 22 bp, Artificial Sequence
  chemically synthesized
gatggtcagggacttggaaaaa

SEQ ID NO: 24415 - DNA, 22 bp, Artificial Sequence
  chemically synthesized
ggaaaaagcatgactggaaaat

SEQ ID NO: 24416 - DNA, 22 bp, Artificial Sequence
  chemically synthesized
gaaaaagcatgactggaaaatt

SEQ ID NO: 24417 - DNA, 22 bp, Artificial Sequence
  chemically synthesized
gaaaattgatgacaaagaaatt

SEQ ID NO: 24418 - DNA, 22 bp, Artificial Sequence
  chemically synthesized
atgacaaagaaatttggggaag

SEQ ID NO: 24419 - DNA, 22 bp, Artificial Sequence
  chemically synthesized
ggggaagaggtatgtggatgga

SEQ ID NO: 24420 - DNA, 22 bp, Artificial Sequence
  chemically synthesized
gggaagaggtatgtggatggac

SEQ ID NO: 24421 - DNA, 22 bp, Artificial Sequence
  chemically synthesized
tatgattagtcaaaaactacaa

SEQ ID NO: 24422 - DNA, 22 bp, Artificial Sequence
  chemically synthesized
tgattagtcaaaaactacaaag

SEQ ID NO: 24423 - DNA, 22 bp, Artificial Sequence
  chemically synthesized
gtcaaaaactacaaagatattt

SEQ ID NO: 24424 - DNA, 22 bp, Artificial Sequence
  chemically synthesized
caaagatattttcatcccatgt

SEQ ID NO: 24425 - DNA, 22 bp, Artificial Sequence
  chemically synthesized
tcatcccatgtgagtgctcacc

SEQ ID NO: 24426 - DNA, 22 bp, Artificial Sequence
  chemically synthesized
catcccatgtgagtgctcacca

SEQ ID NO: 24427 - DNA, 22 bp, Artificial Sequence
  chemically synthesized
atcccatgtgagtgctcaccaa

SEQ ID NO: 24428 - DNA, 22 bp, Artificial Sequence
  chemically synthesized
accaatgggtgacctcagcaga

SEQ ID NO: 24429 - DNA, 22 bp, Artificial Sequence
  chemically synthesized
agcagaagaggattttaataat

SEQ ID NO: 24430 - DNA, 22 bp, Artificial Sequence
  chemically synthesized
taataatcaagtggataggatg

SEQ ID NO: 24431 - DNA, 22 bp, Artificial Sequence
  chemically synthesized
aataatcaagtggataggatga

SEQ ID NO: 24432 - DNA, 22 bp, Artificial Sequence
  chemically synthesized
ataatcaagtggataggatgat

SEQ ID NO: 24433 - DNA, 22 bp, Artificial Sequence
  chemically synthesized
tgtggacaccactcagcctttt

SEQ ID NO: 24434 - DNA, 22 bp, Artificial Sequence
  chemically synthesized
tggacaccactcagccttttcc

SEQ ID NO: 24435 - DNA, 22 bp, Artificial Sequence
  chemically synthesized
agccttttcccaggccactcat

SEQ ID NO: 24436 - DNA, 22 bp, Artificial Sequence
  chemically synthesized
ttcccaggccactcatgtcatc

SEQ ID NO: 24437 - DNA, 22 bp, Artificial Sequence
  chemically synthesized
tcccaggccactcatgtcatcg

SEQ ID NO: 24438 - DNA, 22 bp, Artificial Sequence
  chemically synthesized
cccaggccactcatgtcatcgt

SEQ ID NO: 24439 - DNA, 22 bp, Artificial Sequence
  chemically synthesized
ccaggccactcatgtcatcgtc

SEQ ID NO: 24440 - DNA, 22 bp, Artificial Sequence
  chemically synthesized
atgtcatcgtccaatggaccca

SEQ ID NO: 24441 - DNA, 22 bp, Artificial Sequence
  chemically synthesized
cagggatggaagttatgcttgg

SEQ ID NO: 24442 - DNA, 22 bp, Artificial Sequence
  chemically synthesized
tgcttgggctcagcaacatgga

SEQ ID NO: 24443 - DNA, 22 bp, Artificial Sequence
  chemically synthesized
gggctcagcaacatggacttcc

SEQ ID NO: 24444 - DNA, 22 bp, Artificial Sequence
  chemically synthesized
ggctcagcaacatggacttcca

SEQ ID NO: 24445 - DNA, 22 bp, Artificial Sequence
  chemically synthesized
agcaacatggacttccactcac

SEQ ID NO: 24446 - DNA, 22 bp, Artificial Sequence
  chemically synthesized
ccactcaccaaagctgacctgg

SEQ ID NO: 24447 - DNA, 22 bp, Artificial Sequence
  chemically synthesized
cactcaccaaagctgacctggc

SEQ ID NO: 24448 - DNA, 22 bp, Artificial Sequence
  chemically synthesized
accaaagctgacctggccacag

SEQ ID NO: 24449 - DNA, 22 bp, Artificial Sequence
  chemically synthesized
acctggccacagccactgcttg

SEQ ID NO: 24450 - DNA, 22 bp, Artificial Sequence
  chemically synthesized
gccacagccactgcttgccagc

SEQ ID NO: 24451 - DNA, 22 bp, Artificial Sequence
  chemically synthesized
cttgccagcatcagagaccaac

SEQ ID NO: 24452 - DNA, 22 bp, Artificial Sequence
  chemically synthesized
gccagcatcagagaccaacact

SEQ ID NO: 24453 - DNA, 22 bp, Artificial Sequence
  chemically synthesized
ccagcatcagagaccaacacta

SEQ ID NO: 24454 - DNA, 22 bp, Artificial Sequence
  chemically synthesized
agcccttgatatggcaccattc

SEQ ID NO: 24455 - DNA, 22 bp, Artificial Sequence
  chemically synthesized
gatatggcaccattcctcgggg

SEQ ID NO: 24456 - DNA, 22 bp, Artificial Sequence
  chemically synthesized
atatggcaccattcctcggggt

SEQ ID NO: 24457 - DNA, 22 bp, Artificial Sequence
  chemically synthesized
ctcggggtgatcagccagctac

SEQ ID NO: 24458 - DNA, 22 bp, Artificial Sequence
  chemically synthesized
ggggtgatcagccagctacctg

SEQ ID NO: 24459 - DNA, 22 bp, Artificial Sequence
  chemically synthesized
cctggtggcaggttgattatat

SEQ ID NO: 24460 - DNA, 22 bp, Artificial Sequence
  chemically synthesized
gtggcaggttgattatattgga

SEQ ID NO: 24461 - DNA, 22 bp, Artificial Sequence
  chemically synthesized
attatattggacctcttccatc

SEQ ID NO: 24462 - DNA, 22 bp, Artificial Sequence
  chemically synthesized
tattggacctcttccatcatgg

SEQ ID NO: 24463 - DNA, 22 bp, Artificial Sequence
  chemically synthesized
gacctcttccatcatggaaagg

SEQ ID NO: 24464 - DNA, 22 bp, Artificial Sequence
  chemically synthesized
ttccatcatggaaagggcagag

SEQ ID NO: 24465 - DNA, 22 bp, Artificial Sequence
  chemically synthesized
ccatcatggaaagggcagaggc

SEQ ID NO: 24466 - DNA, 22 bp, Artificial Sequence
  chemically synthesized
catcatggaaagggcagaggct

SEQ ID NO: 24467 - DNA, 22 bp, Artificial Sequence
  chemically synthesized
gtcctcactggaatagacactt

SEQ ID NO: 24468 - DNA, 22 bp, Artificial Sequence
  chemically synthesized
tcctcactggaatagacactta

SEQ ID NO: 24469 - DNA, 22 bp, Artificial Sequence
  chemically synthesized
actggaatagacacttactctg

SEQ ID NO: 24470 - DNA, 22 bp, Artificial Sequence
  chemically synthesized
gaatagacacttactctggata

SEQ ID NO: 24471 - DNA, 22 bp, Artificial Sequence
  chemically synthesized
actctggatatgggtttcccaa

SEQ ID NO: 24472 - DNA, 22 bp, Artificial Sequence
  chemically synthesized
ctctggatatgggtttcccaat

SEQ ID NO: 24473 - DNA, 22 bp, Artificial Sequence
  chemically synthesized
tggatatgggtttcccaatcct

SEQ ID NO: 24474 - DNA, 22 bp, Artificial Sequence
  chemically synthesized
gatatgggtttcccaatcctga

SEQ ID NO: 24475 - DNA, 22 bp, Artificial Sequence
  chemically synthesized
cccaatcctgaactcaatgctt

SEQ ID NO: 24476 - DNA, 22 bp, Artificial Sequence
  chemically synthesized
ccaatcctgaactcaatgctta

SEQ ID NO: 24477 - DNA, 22 bp, Artificial Sequence
  chemically synthesized
aactcaatgcttatgccaagac

SEQ ID NO: 24478 - DNA, 22 bp, Artificial Sequence
  chemically synthesized
aatgcttatgccaagactacca

SEQ ID NO: 24479 - DNA, 22 bp, Artificial Sequence
  chemically synthesized
atgccaagactaccatccatgg

SEQ ID NO: 24480 - DNA, 22 bp, Artificial Sequence
  chemically synthesized
tgccaagactaccatccatgga

SEQ ID NO: 24481 - DNA, 22 bp, Artificial Sequence
  chemically synthesized
ccatccatggaatcacagaatg

SEQ ID NO: 24482 - DNA, 22 bp, Artificial Sequence
  chemically synthesized
tcatggtattccacacagcatt

SEQ ID NO: 24483 - DNA, 22 bp, Artificial Sequence
  chemically synthesized
cacacagcattgcttctgacca

SEQ ID NO: 24484 - DNA, 22 bp, Artificial Sequence
  chemically synthesized
cttctgaccaagccactcactt

SEQ ID NO: 24485 - DNA, 22 bp, Artificial Sequence
  chemically synthesized
ctgaccaagccactcactttat

SEQ ID NO: 24486 - DNA, 22 bp, Artificial Sequence
  chemically synthesized
tgaccaagccactcactttatg

SEQ ID NO: 24487 - DNA, 22 bp, Artificial Sequence
  chemically synthesized
accaagccactcactttatggc

SEQ ID NO: 24488 - DNA, 22 bp, Artificial Sequence
  chemically synthesized
actttatggctaaagaagtgtg

SEQ ID NO: 24489 - DNA, 22 bp, Artificial Sequence
  chemically synthesized
tatggctaaagaagtgtgacag

SEQ ID NO: 24490 - DNA, 22 bp, Artificial Sequence
  chemically synthesized
atggctaaagaagtgtgacagt

SEQ ID NO: 24491 - DNA, 22 bp, Artificial Sequence
  chemically synthesized
tggctaaagaagtgtgacagtg

SEQ ID NO: 24492 - DNA, 22 bp, Artificial Sequence
  chemically synthesized
aagaagtgtgacagtgggctca

SEQ ID NO: 24493 - DNA, 22 bp, Artificial Sequence
  chemically synthesized
atgctcatggaatttactggtc

SEQ ID NO: 24494 - DNA, 22 bp, Artificial Sequence
  chemically synthesized
atggaatttactggtcttacca

SEQ ID NO: 24495 - DNA, 22 bp, Artificial Sequence
  chemically synthesized
actggtcttaccatgatcccta

SEQ ID NO: 24496 - DNA, 22 bp, Artificial Sequence
  chemically synthesized
ctggtcttaccatgatccctat

SEQ ID NO: 24497 - DNA, 22 bp, Artificial Sequence
  chemically synthesized
gtcttaccatgatccctatcat

SEQ ID NO: 24498 - DNA, 22 bp, Artificial Sequence
  chemically synthesized
accatgatccctatcatcctga

SEQ ID NO: 24499 - DNA, 22 bp, Artificial Sequence
  chemically synthesized
ccatgatccctatcatcctgaa

SEQ ID NO: 24500 - DNA, 22 bp, Artificial Sequence
  chemically synthesized
tcatcctgaagcagcttttgaa

SEQ ID NO: 24501 - DNA, 22 bp, Artificial Sequence
  chemically synthesized
aagcagcttttgaatggccttt

SEQ ID NO: 24502 - DNA, 22 bp, Artificial Sequence
  chemically synthesized
ttgaatggccttttgaagtcac

SEQ ID NO: 24503 - DNA, 22 bp, Artificial Sequence
  chemically synthesized
tgaatggccttttgaagtcacg

SEQ ID NO: 24504 - DNA, 22 bp, Artificial Sequence
  chemically synthesized
gaatggccttttgaagtcacga

SEQ ID NO: 24505 - DNA, 22 bp, Artificial Sequence
  chemically synthesized
aatggccttttgaagtcacgat

SEQ ID NO: 24506 - DNA, 22 bp, Artificial Sequence
  chemically synthesized
ttgaagtcacgattacaatgcc

SEQ ID NO: 24507 - DNA, 22 bp, Artificial Sequence
  chemically synthesized
tgaagtcacgattacaatgcca

SEQ ID NO: 24508 - DNA, 22 bp, Artificial Sequence
  chemically synthesized
gaagtcacgattacaatgccaa

SEQ ID NO: 24509 - DNA, 22 bp, Artificial Sequence
  chemically synthesized
aagtcacgattacaatgccaac

SEQ ID NO: 24510 - DNA, 22 bp, Artificial Sequence
  chemically synthesized
caatgccaactaggtgacaata

SEQ ID NO: 24511 - DNA, 22 bp, Artificial Sequence
  chemically synthesized
ggtgacaatactttgcaggcct

SEQ ID NO: 24512 - DNA, 22 bp, Artificial Sequence
  chemically synthesized
tgcaggcctggggcaaagttct

SEQ ID NO: 24513 - DNA, 22 bp, Artificial Sequence
  chemically synthesized
gcaggcctggggcaaagttctc

SEQ ID NO: 24514 - DNA, 22 bp, Artificial Sequence
  chemically synthesized
caggcctggggcaaagttctcc

SEQ ID NO: 24515 - DNA, 22 bp, Artificial Sequence
  chemically synthesized
gggcaaagttctccagaaggct

SEQ ID NO: 24516 - DNA, 22 bp, Artificial Sequence
  chemically synthesized
tccagaaggctgtgtatgctct

SEQ ID NO: 24517 - DNA, 22 bp, Artificial Sequence
  chemically synthesized
cagaaggctgtgtatgctctga

SEQ ID NO: 24518 - DNA, 22 bp, Artificial Sequence
  chemically synthesized
tgtatgctctgaatcagtgtcc

SEQ ID NO: 24519 - DNA, 22 bp, Artificial Sequence
  chemically synthesized
tgaatcagtgtccaatatatgg

SEQ ID NO: 24520 - DNA, 22 bp, Artificial Sequence
  chemically synthesized
aatcagtgtccaatatatggta

SEQ ID NO: 24521 - DNA, 22 bp, Artificial Sequence
  chemically synthesized
tttctcccatagacaggattca

SEQ ID NO: 24522 - DNA, 22 bp, Artificial Sequence
  chemically synthesized
ctcccatagacaggattcacgg

SEQ ID NO: 24523 - DNA, 22 bp, Artificial Sequence
  chemically synthesized
tcccatagacaggattcacggg

SEQ ID NO: 24524 - DNA, 22 bp, Artificial Sequence
  chemically synthesized
ccatagacaggattcacgggtc

SEQ ID NO: 24525 - DNA, 22 bp, Artificial Sequence
  chemically synthesized
acgggtccaggaatcaaagggt

SEQ ID NO: 24526 - DNA, 22 bp, Artificial Sequence
  chemically synthesized
accatcacccctagtgttccac

SEQ ID NO: 24527 - DNA, 22 bp, Artificial Sequence
  chemically synthesized
gtgttccactagcaaaattttt

SEQ ID NO: 24528 - DNA, 22 bp, Artificial Sequence
  chemically synthesized
cactagcaaaatttttgcttcc

SEQ ID NO: 24529 - DNA, 22 bp, Artificial Sequence
  chemically synthesized
gcaaaatttttgcttcctgttc

SEQ ID NO: 24530 - DNA, 22 bp, Artificial Sequence
  chemically synthesized
ttgcttcctgttcccatggcat

SEQ ID NO: 24531 - DNA, 22 bp, Artificial Sequence
  chemically synthesized
tgcttcctgttcccatggcatt

SEQ ID NO: 24532 - DNA, 22 bp, Artificial Sequence
  chemically synthesized
gcttcctgttcccatggcatta

SEQ ID NO: 24533 - DNA, 22 bp, Artificial Sequence
  chemically synthesized
cttcctgttcccatggcattat

SEQ ID NO: 24534 - DNA, 22 bp, Artificial Sequence
  chemically synthesized
cctgttcccatggcattatgtt

SEQ ID NO: 24535 - DNA, 22 bp, Artificial Sequence
  chemically synthesized
ctgttcccatggcattatgttc

SEQ ID NO: 24536 - DNA, 22 bp, Artificial Sequence
  chemically synthesized
ttcccatggcattatgttctgc

SEQ ID NO: 24537 - DNA, 22 bp, Artificial Sequence
  chemically synthesized
ccatggcattatgttctgctgg

SEQ ID NO: 24538 - DNA, 22 bp, Artificial Sequence
  chemically synthesized
tgttctgctggcttagaggtct

SEQ ID NO: 24539 - DNA, 22 bp, Artificial Sequence
  chemically synthesized
tgctggcttagaggtcttagtt

SEQ ID NO: 24540 - DNA, 22 bp, Artificial Sequence
  chemically synthesized
ctggcttagaggtcttagttcc

SEQ ID NO: 24541 - DNA, 22 bp, Artificial Sequence
  chemically synthesized
gcttagaggtcttagttccaga

SEQ ID NO: 24542 - DNA, 22 bp, Artificial Sequence
  chemically synthesized
agaggtcttagttccagaggga

SEQ ID NO: 24543 - DNA, 22 bp, Artificial Sequence
  chemically synthesized
gaggtcttagttccagagggag

SEQ ID NO: 24544 - DNA, 22 bp, Artificial Sequence
  chemically synthesized
agttccagagggaggaacactg

SEQ ID NO: 24545 - DNA, 22 bp, Artificial Sequence
  chemically synthesized
gttccagagggaggaacactgc

SEQ ID NO: 24546 - DNA, 22 bp, Artificial Sequence
  chemically synthesized
cagagggaggaacactgccgcc

SEQ ID NO: 24547 - DNA, 22 bp, Artificial Sequence
  chemically synthesized
ccgccaggtgacacaataatga

SEQ ID NO: 24548 - DNA, 22 bp, Artificial Sequence
  chemically synthesized
cattaaactgcaaattaagatt

SEQ ID NO: 24549 - DNA, 22 bp, Artificial Sequence
  chemically synthesized
aactgcaaattaagattgccac

SEQ ID NO: 24550 - DNA, 22 bp, Artificial Sequence
  chemically synthesized
caaattaagattgccacctgga

SEQ ID NO: 24551 - DNA, 22 bp, Artificial Sequence
  chemically synthesized
agattgccacctggacactttg

SEQ ID NO: 24552 - DNA, 22 bp, Artificial Sequence
  chemically synthesized
ccacctggacactttgggctcc

SEQ ID NO: 24553 - DNA, 22 bp, Artificial Sequence
  chemically synthesized
gacactttgggctcctcccacc

SEQ ID NO: 24554 - DNA, 22 bp, Artificial Sequence
  chemically synthesized
tgggctcctcccacctttaagt

SEQ ID NO: 24555 - DNA, 22 bp, Artificial Sequence
  chemically synthesized
gggctcctcccacctttaagtc

SEQ ID NO: 24556 - DNA, 22 bp, Artificial Sequence
  chemically synthesized
ggctcctcccacctttaagtca

SEQ ID NO: 24557 - DNA, 22 bp, Artificial Sequence
  chemically synthesized
ctcccacctttaagtcaacagg

SEQ ID NO: 24558 - DNA, 22 bp, Artificial Sequence
  chemically synthesized
ccacctttaagtcaacaggcta

SEQ ID NO: 24559 - DNA, 22 bp, Artificial Sequence
  chemically synthesized
taagtcaacaggctaagaagag

SEQ ID NO: 24560 - DNA, 22 bp, Artificial Sequence
  chemically synthesized
aagtcaacaggctaagaagaga

SEQ ID NO: 24561 - DNA, 22 bp, Artificial Sequence
  chemically synthesized
agtcaacaggctaagaagagag

SEQ ID NO: 24562 - DNA, 22 bp, Artificial Sequence
  chemically synthesized
agaagagagttacagtgttggc

SEQ ID NO: 24563 - DNA, 22 bp, Artificial Sequence
  chemically synthesized
cagtgttggctgcggtgattaa

SEQ ID NO: 24564 - DNA, 22 bp, Artificial Sequence
  chemically synthesized
gctgcggtgattaacccagact

SEQ ID NO: 24565 - DNA, 22 bp, Artificial Sequence
  chemically synthesized
cggtgattaacccagactatca

SEQ ID NO: 24566 - DNA, 22 bp, Artificial Sequence
  chemically synthesized
acccagactatcaagatgaaat

SEQ ID NO: 24567 - DNA, 22 bp, Artificial Sequence
  chemically synthesized
tcaagatgaaatcagtctacaa

SEQ ID NO: 24568 - DNA, 22 bp, Artificial Sequence
  chemically synthesized
caactccacaatggaggtaagg

SEQ ID NO: 24569 - DNA, 22 bp, Artificial Sequence
  chemically synthesized
cacaatggaggtaaggaagcgt

SEQ ID NO: 24570 - DNA, 22 bp, Artificial Sequence
  chemically synthesized
gggtgtctcttagttttaccat

SEQ ID NO: 24571 - DNA, 22 bp, Artificial Sequence
  chemically synthesized
ttagttttaccatgtcctggaa

SEQ ID NO: 24572 - DNA, 22 bp, Artificial Sequence
  chemically synthesized
agttttaccatgtcctggaatt

SEQ ID NO: 24573 - DNA, 22 bp, Artificial Sequence
  chemically synthesized
gttttaccatgtcctggaatta

SEQ ID NO: 24574 - DNA, 22 bp, Artificial Sequence
  chemically synthesized
taccatgtcctggaattaaggt

SEQ ID NO: 24575 - DNA, 22 bp, Artificial Sequence
  chemically synthesized
accatgtcctggaattaaggtc

SEQ ID NO: 24576 - DNA, 22 bp, Artificial Sequence
  chemically synthesized
ccatgtcctggaattaaggtca

SEQ ID NO: 24577 - DNA, 22 bp, Artificial Sequence
  chemically synthesized
gaattaaggtcagtgggaaact

SEQ ID NO: 24578 - DNA, 22 bp, Artificial Sequence
  chemically synthesized
aggtcagtgggaaactactaca

SEQ ID NO: 24579 - DNA, 22 bp, Artificial Sequence
  chemically synthesized
ctacaggccattccaggcagga

SEQ ID NO: 24580 - DNA, 22 bp, Artificial Sequence
  chemically synthesized
caggccattccaggcaggacta

SEQ ID NO: 24581 - DNA, 22 bp, Artificial Sequence
  chemically synthesized
caggcaggactacaaataaagg

SEQ ID NO: 24582 - DNA, 22 bp, Artificial Sequence
  chemically synthesized
caaataaaggtttgggtcactc

SEQ ID NO: 24583 - DNA, 22 bp, Artificial Sequence
  chemically synthesized
gggtcactccaccaggaaaaaa

SEQ ID NO: 24584 - DNA, 22 bp, Artificial Sequence
  chemically synthesized
ggtcactccaccaggaaaaaaa

SEQ ID NO: 24585 - DNA, 22 bp, Artificial Sequence
  chemically synthesized
caccaggaaaaaaaaaaaaaaa

SEQ ID NO: 24586 - DNA, 22 bp, Artificial Sequence
  chemically synthesized
ctgaggtgcttgctgagggcaa

SEQ ID NO: 24587 - DNA, 22 bp, Artificial Sequence
  chemically synthesized
aggtgcttgctgagggcaaagg

SEQ ID NO: 24588 - DNA, 22 bp, Artificial Sequence
  chemically synthesized
gctgagggcaaagggaatacag

SEQ ID NO: 24589 - DNA, 22 bp, Artificial Sequence
  chemically synthesized
ctgagggcaaagggaatacaga

SEQ ID NO: 24590 - DNA, 22 bp, Artificial Sequence
  chemically synthesized
agggcaaagggaatacagaata

SEQ ID NO: 24591 - DNA, 22 bp, Artificial Sequence
  chemically synthesized
cgatcacgtgaccaattgcaga

SEQ ID NO: 24592 - DNA, 22 bp, Artificial Sequence
  chemically synthesized
cagatacaaggactgtaattgt

SEQ ID NO: 24593 - DNA, 22 bp, Artificial Sequence
  chemically synthesized
taattgtcatgagtatttcctc

SEQ ID NO: 24594 - DNA, 22 bp, Artificial Sequence
  chemically synthesized
tcatgagtatttcctccttctt

SEQ ID NO: 24595 - DNA, 22 bp, Artificial Sequence
  chemically synthesized
cctccttcttttgttaaaaaca

SEQ ID NO: 24596 - DNA, 22 bp, Artificial Sequence
  chemically synthesized
ctccttcttttgttaaaaacac

SEQ ID NO: 24597 - DNA, 22 bp, Artificial Sequence
  chemically synthesized
cttcttttgttaaaaacacctt

SEQ ID NO: 24598 - DNA, 22 bp, Artificial Sequence
  chemically synthesized
cttttgttaaaaacaccttcgt

SEQ ID NO: 24599 - DNA, 22 bp, Artificial Sequence
  chemically synthesized
ttttgttaaaaacaccttcgtg

SEQ ID NO: 24600 - DNA, 22 bp, Artificial Sequence
  chemically synthesized
ttgttaaaaacaccttcgtgtc

SEQ ID NO: 24601 - DNA, 22 bp, Artificial Sequence
  chemically synthesized
tgttaaaaacaccttcgtgtct

SEQ ID NO: 24602 - DNA, 22 bp, Artificial Sequence
  chemically synthesized
gttaaaaacaccttcgtgtctg

SEQ ID NO: 24603 - DNA, 22 bp, Artificial Sequence
  chemically synthesized
ttaaaaacaccttcgtgtctgt

SEQ ID NO: 24604 - DNA, 22 bp, Artificial Sequence
  chemically synthesized
aaaacaccttcgtgtctgtata

SEQ ID NO: 24605 - DNA, 22 bp, Artificial Sequence
  chemically synthesized
cgtgtctgtatacacttgtact

SEQ ID NO: 24606 - DNA, 22 bp, Artificial Sequence
  chemically synthesized
gtgtctgtatacacttgtacta

SEQ ID NO: 24607 - DNA, 22 bp, Artificial Sequence
  chemically synthesized
tatacacttgtactaagaaaat

SEQ ID NO: 24608 - DNA, 22 bp, Artificial Sequence
  chemically synthesized
gtactaagaaaatatatacatt

SEQ ID NO: 24609 - DNA, 22 bp, Artificial Sequence
  chemically synthesized
tactaagaaaatatatacattt

SEQ ID NO: 24610 - DNA, 22 bp, Artificial Sequence
  chemically synthesized
agaaaatatatacattttactt

SEQ ID NO: 24611 - DNA, 22 bp, Artificial Sequence
  chemically synthesized
tacttcctttttcctttatcat

SEQ ID NO: 24612 - DNA, 22 bp, Artificial Sequence
  chemically synthesized
acttcctttttcctttatcatg

SEQ ID NO: 24613 - DNA, 22 bp, Artificial Sequence
  chemically synthesized
cttcctttttcctttatcatgt

SEQ ID NO: 24614 - DNA, 22 bp, Artificial Sequence
  chemically synthesized
cctttttcctttatcatgtgac

SEQ ID NO: 24615 - DNA, 22 bp, Artificial Sequence
  chemically synthesized
ctttttcctttatcatgtgaca

SEQ ID NO: 24616 - DNA, 22 bp, Artificial Sequence
  chemically synthesized
tttcctttatcatgtgacataa

SEQ ID NO: 24617 - DNA, 22 bp, Artificial Sequence
  chemically synthesized
ttcctttatcatgtgacataag

SEQ ID NO: 24618 - DNA, 22 bp, Artificial Sequence
  chemically synthesized
tcctttatcatgtgacataaga

SEQ ID NO: 24619 - DNA, 22 bp, Artificial Sequence
  chemically synthesized
cctttatcatgtgacataagat

SEQ ID NO: 24620 - DNA, 22 bp, Artificial Sequence
  chemically synthesized
ctttatcatgtgacataagatt

SEQ ID NO: 24621 - DNA, 22 bp, Artificial Sequence
  chemically synthesized
tatcatgtgacataagatttat

SEQ ID NO: 24622 - DNA, 22 bp, Artificial Sequence
  chemically synthesized
atcatgtgacataagatttatt

SEQ ID NO: 24623 - DNA, 22 bp, Artificial Sequence
  chemically synthesized
tcatgtgacataagatttattg

SEQ ID NO: 24624 - DNA, 22 bp, Artificial Sequence
  chemically synthesized
attgacttcatatcagcattta

SEQ ID NO: 24625 - DNA, 22 bp, Artificial Sequence
  chemically synthesized
ttgacttcatatcagcatttaa

SEQ ID NO: 24626 - DNA, 22 bp, Artificial Sequence
  chemically synthesized
acttcatatcagcatttaagta

SEQ ID NO: 24627 - DNA, 22 bp, Artificial Sequence
  chemically synthesized
catatcagcatttaagtattgt

SEQ ID NO: 24628 - DNA, 22 bp, Artificial Sequence
  chemically synthesized
atatcagcatttaagtattgtt

SEQ ID NO: 24629 - DNA, 22 bp, Artificial Sequence
  chemically synthesized
aagtattgttaagtttatgtaa

SEQ ID NO: 24630 - DNA, 22 bp, Artificial Sequence
  chemically synthesized
agtattgttaagtttatgtaat

SEQ ID NO: 24631 - DNA, 22 bp, Artificial Sequence
  chemically synthesized
ttaagtttatgtaatagcattt

SEQ ID NO: 24632 - DNA, 22 bp, Artificial Sequence
  chemically synthesized
agtttatgtaatagcatttgca

SEQ ID NO: 24633 - DNA, 22 bp, Artificial Sequence
  chemically synthesized
atgtaatagcatttgcaatggg

SEQ ID NO: 24634 - DNA, 22 bp, Artificial Sequence
  chemically synthesized
tgtaatagcatttgcaatgggg

SEQ ID NO: 24635 - DNA, 22 bp, Artificial Sequence
  chemically synthesized
gcaatggggattggtgcatttt

SEQ ID NO: 24636 - DNA, 22 bp, Artificial Sequence
  chemically synthesized
caatggggattggtgcattttc

SEQ ID NO: 24637 - DNA, 22 bp, Artificial Sequence
  chemically synthesized
gtgcattttcaattgcacgaag

SEQ ID NO: 24638 - DNA, 22 bp, Artificial Sequence
  chemically synthesized
tcaattgcacgaaggatagttt

SEQ ID NO: 24639 - DNA, 22 bp, Artificial Sequence
  chemically synthesized
caattgcacgaaggatagtttt

SEQ ID NO: 24640 - DNA, 22 bp, Artificial Sequence
  chemically synthesized
aattgcacgaaggatagtttta

SEQ ID NO: 24641 - DNA, 22 bp, Artificial Sequence
  chemically synthesized
cacgaaggatagttttagtatg

SEQ ID NO: 24642 - DNA, 22 bp, Artificial Sequence
  chemically synthesized
tagtatgttaggcataattatg

SEQ ID NO: 24643 - DNA, 22 bp, Artificial Sequence
  chemically synthesized
agtatgttaggcataattatga

SEQ ID NO: 24644 - DNA, 22 bp, Artificial Sequence
  chemically synthesized
gtatgttaggcataattatgac

SEQ ID NO: 24645 - DNA, 22 bp, Artificial Sequence
  chemically synthesized
ggcataattatgacttattgtt

SEQ ID NO: 24646 - DNA, 22 bp, Artificial Sequence
  chemically synthesized
tgacttattgttgtctttattt

SEQ ID NO: 24647 - DNA, 22 bp, Artificial Sequence
  chemically synthesized
attgttgtctttatttgaagat

SEQ ID NO: 24648 - DNA, 22 bp, Artificial Sequence
  chemically synthesized
ttgttgtctttatttgaagata

SEQ ID NO: 24649 - DNA, 22 bp, Artificial Sequence
  chemically synthesized
ttgtctttatttgaagataatg

SEQ ID NO: 24650 - DNA, 22 bp, Artificial Sequence
  chemically synthesized
tctttatttgaagataatgtat

SEQ ID NO: 24651 - DNA, 22 bp, Artificial Sequence
  chemically synthesized
tatttgaagataatgtatgacc

SEQ ID NO: 24652 - DNA, 22 bp, Artificial Sequence
  chemically synthesized
atttgaagataatgtatgacct

SEQ ID NO: 24653 - DNA, 22 bp, Artificial Sequence
  chemically synthesized
tttgaagataatgtatgacctc

SEQ ID NO: 24654 - DNA, 22 bp, Artificial Sequence
  chemically synthesized
gaagataatgtatgacctcagg

SEQ ID NO: 24655 - DNA, 22 bp, Artificial Sequence
  chemically synthesized
aagataatgtatgacctcaggg

SEQ ID NO: 24656 - DNA, 22 bp, Artificial Sequence
  chemically synthesized
aggggatgtgtataggctcaag

SEQ ID NO: 24657 - DNA, 22 bp, Artificial Sequence
  chemically synthesized
aagttgacaagcgatggacttg

SEQ ID NO: 24658 - DNA, 22 bp, Artificial Sequence
  chemically synthesized
acaagcgatggacttgtgatgg

SEQ ID NO: 24659 - DNA, 22 bp, Artificial Sequence
  chemically synthesized
gtgatggttaatactgagtgtc

SEQ ID NO: 24660 - DNA, 22 bp, Artificial Sequence
  chemically synthesized
tgatggttaatactgagtgtca

SEQ ID NO: 24661 - DNA, 22 bp, Artificial Sequence
  chemically synthesized
atactgagtgtcaacttgattg

SEQ ID NO: 24662 - DNA, 22 bp, Artificial Sequence
  chemically synthesized
agtgtcaacttgattggattga

SEQ ID NO: 24663 - DNA, 22 bp, Artificial Sequence
  chemically synthesized
gattggattgaagtgtgcaaag

SEQ ID NO: 24664 - DNA, 22 bp, Artificial Sequence
  chemically synthesized
attggattgaagtgtgcaaagt

SEQ ID NO: 24665 - DNA, 22 bp, Artificial Sequence
  chemically synthesized
gattgaagtgtgcaaagtattg

SEQ ID NO: 24666 - DNA, 22 bp, Artificial Sequence
  chemically synthesized
aagtgtgcaaagtattgatcct

SEQ ID NO: 24667 - DNA, 22 bp, Artificial Sequence
  chemically synthesized
atcctgagtgtgtctgtgaggg

SEQ ID NO: 24668 - DNA, 22 bp, Artificial Sequence
  chemically synthesized
agtgtgtctgtgagggtattgc

SEQ ID NO: 24669 - DNA, 22 bp, Artificial Sequence
  chemically synthesized
tgagggtattgccaaaggagat

SEQ ID NO: 24670 - DNA, 22 bp, Artificial Sequence
  chemically synthesized
ccaaaggagattaacattttag

SEQ ID NO: 24671 - DNA, 22 bp, Artificial Sequence
  chemically synthesized
acattttagtcagtgggctggg

SEQ ID NO: 24672 - DNA, 22 bp, Artificial Sequence
  chemically synthesized
tagtcagtgggctgggaaaggc

SEQ ID NO: 24673 - DNA, 22 bp, Artificial Sequence
  chemically synthesized
agtcagtgggctgggaaaggca

SEQ ID NO: 24674 - DNA, 22 bp, Artificial Sequence
  chemically synthesized
gtcagtgggctgggaaaggcag

SEQ ID NO: 24675 - DNA, 22 bp, Artificial Sequence
  chemically synthesized
ggaaaggcagacccacccttaa

SEQ ID NO: 24676 - DNA, 22 bp, Artificial Sequence
  chemically synthesized
aatctgggtgggcaccatctaa

SEQ ID NO: 24677 - DNA, 22 bp, Artificial Sequence
  chemically synthesized
atctgggtgggcaccatctaat

SEQ ID NO: 24678 - DNA, 22 bp, Artificial Sequence
  chemically synthesized
ggtgggcaccatctaatcagtt

SEQ ID NO: 24679 - DNA, 22 bp, Artificial Sequence
  chemically synthesized
atcagttgccagtgtggccagg

SEQ ID NO: 24680 - DNA, 22 bp, Artificial Sequence
  chemically synthesized
ccagtgtggccaggatataaag

SEQ ID NO: 24681 - DNA, 22 bp, Artificial Sequence
  chemically synthesized
gactggcttagcctccaagcct

SEQ ID NO: 24682 - DNA, 22 bp, Artificial Sequence
  chemically synthesized
gcttagcctccaagcctacatc

SEQ ID NO: 24683 - DNA, 22 bp, Artificial Sequence
  chemically synthesized
agcctccaagcctacatctttc

SEQ ID NO: 24684 - DNA, 22 bp, Artificial Sequence
  chemically synthesized
gcctccaagcctacatctttct

SEQ ID NO: 24685 - DNA, 22 bp, Artificial Sequence
  chemically synthesized
caagcctacatctttctcccat

SEQ ID NO: 24686 - DNA, 22 bp, Artificial Sequence
  chemically synthesized
catctttctcccatgctggatg

SEQ ID NO: 24687 - DNA, 22 bp, Artificial Sequence
  chemically synthesized
tctcccatgctggatgcttcct

SEQ ID NO: 24688 - DNA, 22 bp, Artificial Sequence
  chemically synthesized
ctcccatgctggatgcttcctg

SEQ ID NO: 24689 - DNA, 22 bp, Artificial Sequence
  chemically synthesized
tcccatgctggatgcttcctgc

SEQ ID NO: 24690 - DNA, 22 bp, Artificial Sequence
  chemically synthesized
ccatgctggatgcttcctgccc

SEQ ID NO: 24691 - DNA, 22 bp, Artificial Sequence
  chemically synthesized
gatgcttcctgccctcaaacat

SEQ ID NO: 24692 - DNA, 22 bp, Artificial Sequence
  chemically synthesized
cctgccctcaaacattggactc

SEQ ID NO: 24693 - DNA, 22 bp, Artificial Sequence
  chemically synthesized
ctgccctcaaacattggactcc

SEQ ID NO: 24694 - DNA, 22 bp, Artificial Sequence
  chemically synthesized
ccctcaaacattggactccaag

SEQ ID NO: 24695 - DNA, 22 bp, Artificial Sequence
  chemically synthesized
aaacattggactccaagtcctt

SEQ ID NO: 24696 - DNA, 22 bp, Artificial Sequence
  chemically synthesized
gactccaagtccttcagctttg

SEQ ID NO: 24697 - DNA, 22 bp, Artificial Sequence
  chemically synthesized
caagtccttcagctttgggact

SEQ ID NO: 24698 - DNA, 22 bp, Artificial Sequence
  chemically synthesized
cagctttgggacttggactggc

SEQ ID NO: 24699 - DNA, 22 bp, Artificial Sequence
  chemically synthesized
agctttgggacttggactggct

SEQ ID NO: 24700 - DNA, 22 bp, Artificial Sequence
  chemically synthesized
tgggacttggactggcttcctt

SEQ ID NO: 24701 - DNA, 22 bp, Artificial Sequence
  chemically synthesized
gggacttggactggcttccttg

SEQ ID NO: 24702 - DNA, 22 bp, Artificial Sequence
  chemically synthesized
ggacttggactggcttccttgc

SEQ ID NO: 24703 - DNA, 22 bp, Artificial Sequence
  chemically synthesized
ggactggcttccttgctcctct

SEQ ID NO: 24704 - DNA, 22 bp, Artificial Sequence
  chemically synthesized
gactggcttccttgctcctctg

SEQ ID NO: 24705 - DNA, 22 bp, Artificial Sequence
  chemically synthesized
gcttccttgctcctctgcttgc

SEQ ID NO: 24706 - DNA, 22 bp, Artificial Sequence
  chemically synthesized
ccttgctcctctgcttgcagat

SEQ ID NO: 24707 - DNA, 22 bp, Artificial Sequence
  chemically synthesized
cttgctcctctgcttgcagatg

SEQ ID NO: 24708 - DNA, 22 bp, Artificial Sequence
  chemically synthesized
gctcctctgcttgcagatggcc

SEQ ID NO: 24709 - DNA, 22 bp, Artificial Sequence
  chemically synthesized
ctcctctgcttgcagatggcct

SEQ ID NO: 24710 - DNA, 22 bp, Artificial Sequence
  chemically synthesized
ctctgcttgcagatggcctatt

SEQ ID NO: 24711 - DNA, 22 bp, Artificial Sequence
  chemically synthesized
tgcttgcagatggcctattgtg

SEQ ID NO: 24712 - DNA, 22 bp, Artificial Sequence
  chemically synthesized
cttgcagatggcctattgtggg

SEQ ID NO: 24713 - DNA, 22 bp, Artificial Sequence
  chemically synthesized
gcagatggcctattgtgggacc

SEQ ID NO: 24714 - DNA, 22 bp, Artificial Sequence
  chemically synthesized
cagatggcctattgtgggacct

SEQ ID NO: 24715 - DNA, 22 bp, Artificial Sequence
  chemically synthesized
ttgtgggaccttgtgattgtgt

SEQ ID NO: 24716 - DNA, 22 bp, Artificial Sequence
  chemically synthesized
tgggaccttgtgattgtgtaag

SEQ ID NO: 24717 - DNA, 22 bp, Artificial Sequence
  chemically synthesized
gtgattgtgtaagttaacacta

SEQ ID NO: 24718 - DNA, 22 bp, Artificial Sequence
  chemically synthesized
tgattgtgtaagttaacactac

SEQ ID NO: 24719 - DNA, 22 bp, Artificial Sequence
  chemically synthesized
tgtaagttaacactacttaata

SEQ ID NO: 24720 - DNA, 22 bp, Artificial Sequence
  chemically synthesized
acactacttaataaactccctt

SEQ ID NO: 24721 - DNA, 22 bp, Artificial Sequence
  chemically synthesized
cttaataaactcccttttatat

SEQ ID NO: 24722 - DNA, 22 bp, Artificial Sequence
  chemically synthesized
aataaactcccttttatatcta

SEQ ID NO: 24723 - DNA, 22 bp, Artificial Sequence
  chemically synthesized
ataaactcccttttatatctaa

SEQ ID NO: 24724 - DNA, 22 bp, Artificial Sequence
  chemically synthesized
ccttttatatctaaatctatat

SEQ ID NO: 24725 - DNA, 22 bp, Artificial Sequence
  chemically synthesized
ttatatctaaatctatatctat

SEQ ID NO: 24726 - DNA, 22 bp, Artificial Sequence
  chemically synthesized
tatatctaaatctatatctatc

SEQ ID NO: 24727 - DNA, 22 bp, Artificial Sequence
  chemically synthesized
atatctaaatctatatctatct

SEQ ID NO: 24728 - DNA, 22 bp, Artificial Sequence
  chemically synthesized
tatctaaatctatatctatcta

SEQ ID NO: 24729 - DNA, 22 bp, Artificial Sequence
  chemically synthesized
aatctatatctatctatctatc

SEQ ID NO: 24730 - DNA, 22 bp, Artificial Sequence
  chemically synthesized
tatctatctatctatctatcta

SEQ ID NO: 24731 - DNA, 22 bp, Artificial Sequence
  chemically synthesized
tctatctatctatctatctatc

SEQ ID NO: 24732 - DNA, 22 bp, Artificial Sequence
  chemically synthesized
tctatctatctatctatctatc

SEQ ID NO: 24733 - DNA, 22 bp, Artificial Sequence
  chemically synthesized
tctatctatctatctatctatc

SEQ ID NO: 24734 - DNA, 22 bp, Artificial Sequence
  chemically synthesized
tctatctatctatctatctatc

SEQ ID NO: 24735 - DNA, 22 bp, Artificial Sequence
  chemically synthesized
tctatctatctatctatctatc

SEQ ID NO: 24736 - DNA, 22 bp, Artificial Sequence
  chemically synthesized
tctatctatctatctatctcct

SEQ ID NO: 24737 - DNA, 22 bp, Artificial Sequence
  chemically synthesized
tctatctatctatctcctatta

SEQ ID NO: 24738 - DNA, 22 bp, Artificial Sequence
  chemically synthesized
tctatctatctcctattagttc

SEQ ID NO: 24739 - DNA, 22 bp, Artificial Sequence
  chemically synthesized
tctatctcctattagttctgtc

SEQ ID NO: 24740 - DNA, 22 bp, Artificial Sequence
  chemically synthesized
tctcctattagttctgtctctc

SEQ ID NO: 24741 - DNA, 22 bp, Artificial Sequence
  chemically synthesized
ctattagttctgtctctctagg

SEQ ID NO: 24742 - DNA, 22 bp, Artificial Sequence
  chemically synthesized
ttagttctgtctctctagggaa

SEQ ID NO: 24743 - DNA, 22 bp, Artificial Sequence
  chemically synthesized
gttctgtctctctagggaaccc

SEQ ID NO: 24744 - DNA, 22 bp, Artificial Sequence
  chemically synthesized
tgtctctctagggaaccctgac

SEQ ID NO: 24745 - DNA, 22 bp, Artificial Sequence
  chemically synthesized
tctctctagggaaccctgacaa

SEQ ID NO: 24746 - DNA, 22 bp, Artificial Sequence
  chemically synthesized
tctagggaaccctgacaaatac

SEQ ID NO: 24747 - DNA, 22 bp, Artificial Sequence
  chemically synthesized
tagggaaccctgacaaatacag

SEQ ID NO: 24748 - DNA, 22 bp, Artificial Sequence
  chemically synthesized
gggaaccctgacaaatacagtg

SEQ ID NO: 24749 - DNA, 22 bp, Artificial Sequence
  chemically synthesized
acaaatacagtgagctcaggtc

SEQ ID NO: 24750 - DNA, 22 bp, Artificial Sequence
  chemically synthesized
aggtcctgagcagacattttcc

SEQ ID NO: 24751 - DNA, 22 bp, Artificial Sequence
  chemically synthesized
agcagacattttccaaaagaag

SEQ ID NO: 24752 - DNA, 22 bp, Artificial Sequence
  chemically synthesized
tccaaaagaagacatacaagtg

SEQ ID NO: 24753 - DNA, 22 bp, Artificial Sequence
  chemically synthesized
ccaaaagaagacatacaagtgg

SEQ ID NO: 24754 - DNA, 22 bp, Artificial Sequence
  chemically synthesized
caaaagaagacatacaagtggc

SEQ ID NO: 24755 - DNA, 22 bp, Artificial Sequence
  chemically synthesized
aacatcactaataatcagagaa

SEQ ID NO: 24756 - DNA, 22 bp, Artificial Sequence
  chemically synthesized
ataatcagagaatgcaaattaa

SEQ ID NO: 24757 - DNA, 22 bp, Artificial Sequence
  chemically synthesized
aaaccaccatatgatacctcct

SEQ ID NO: 24758 - DNA, 22 bp, Artificial Sequence
  chemically synthesized
cttatgccagtcagaatggcta

SEQ ID NO: 24759 - DNA, 22 bp, Artificial Sequence
  chemically synthesized
atgccagtcagaatggctatca

SEQ ID NO: 24760 - DNA, 22 bp, Artificial Sequence
  chemically synthesized
tgccagtcagaatggctatcat

SEQ ID NO: 24761 - DNA, 22 bp, Artificial Sequence
  chemically synthesized
tcattataaagttcaaaaacag

SEQ ID NO: 24762 - DNA, 22 bp, Artificial Sequence
  chemically synthesized
taaagttcaaaaacagcagatg

SEQ ID NO: 24763 - DNA, 22 bp, Artificial Sequence
  chemically synthesized
aaaaacagcagatgttggtgag

SEQ ID NO: 24764 - DNA, 22 bp, Artificial Sequence
  chemically synthesized
gtgaggatgtggagacaagaaa

SEQ ID NO: 24765 - DNA, 22 bp, Artificial Sequence
  chemically synthesized
atacactgttggtaagaatgta

SEQ ID NO: 24766 - DNA, 22 bp, Artificial Sequence
  chemically synthesized
tacactgttggtaagaatgtaa

SEQ ID NO: 24767 - DNA, 22 bp, Artificial Sequence
  chemically synthesized
ttggtaagaatgtaaattagta

SEQ ID NO: 24768 - DNA, 22 bp, Artificial Sequence
  chemically synthesized
gtaagaatgtaaattagtacaa

SEQ ID NO: 24769 - DNA, 22 bp, Artificial Sequence
  chemically synthesized
gtacaaactttatggaagacag

SEQ ID NO: 24770 - DNA, 22 bp, Artificial Sequence
  chemically synthesized
tatggaagacagcatgaagatt

SEQ ID NO: 24771 - DNA, 22 bp, Artificial Sequence
  chemically synthesized
atggaagacagcatgaagattt

SEQ ID NO: 24772 - DNA, 22 bp, Artificial Sequence
  chemically synthesized
tggaagacagcatgaagatttc

SEQ ID NO: 24773 - DNA, 22 bp, Artificial Sequence
  chemically synthesized
cttaaagaactagaaacagaac

SEQ ID NO: 24774 - DNA, 22 bp, Artificial Sequence
  chemically synthesized
ttaaagaactagaaacagaact

SEQ ID NO: 24775 - DNA, 22 bp, Artificial Sequence
  chemically synthesized
aaagaactagaaacagaactac

SEQ ID NO: 24776 - DNA, 22 bp, Artificial Sequence
  chemically synthesized
aagaactagaaacagaactacc

SEQ ID NO: 24777 - DNA, 22 bp, Artificial Sequence
  chemically synthesized
gaaacagaactaccattcaatc

SEQ ID NO: 24778 - DNA, 22 bp, Artificial Sequence
  chemically synthesized
ccattcaatcctgcaatcccac

SEQ ID NO: 24779 - DNA, 22 bp, Artificial Sequence
  chemically synthesized
aatcctgcaatcccactactgg

SEQ ID NO: 24780 - DNA, 22 bp, Artificial Sequence
  chemically synthesized
caatcccactactgggtatgga

SEQ ID NO: 24781 - DNA, 22 bp, Artificial Sequence
  chemically synthesized
ctgggtatggacccaaagtgaa

SEQ ID NO: 24782 - DNA, 22 bp, Artificial Sequence
  chemically synthesized
ggtatggacccaaagtgaaaga

SEQ ID NO: 24783 - DNA, 22 bp, Artificial Sequence
  chemically synthesized
aaaaagatatctgcattagtat

SEQ ID NO: 24784 - DNA, 22 bp, Artificial Sequence
  chemically synthesized
cattagtatgttcaaagtagca

SEQ ID NO: 24785 - DNA, 22 bp, Artificial Sequence
  chemically synthesized
gtatgttcaaagtagcactgtt

SEQ ID NO: 24786 - DNA, 22 bp, Artificial Sequence
  chemically synthesized
aaagtagcactgttcccaatag

SEQ ID NO: 24787 - DNA, 22 bp, Artificial Sequence
  chemically synthesized
ttcccaatagcaaagatatgga

SEQ ID NO: 24788 - DNA, 22 bp, Artificial Sequence
  chemically synthesized
ccaatagcaaagatatggaatc

SEQ ID NO: 24789 - DNA, 22 bp, Artificial Sequence
  chemically synthesized
aatgtctaccaatggacgattg

SEQ ID NO: 24790 - DNA, 22 bp, Artificial Sequence
  chemically synthesized
ccaatggacgattggataaaga

SEQ ID NO: 24791 - DNA, 22 bp, Artificial Sequence
  chemically synthesized
gataaagaaaatgtggtgtata

SEQ ID NO: 24792 - DNA, 22 bp, Artificial Sequence
  chemically synthesized
atatacatatatattactcagc

SEQ ID NO: 24793 - DNA, 22 bp, Artificial Sequence
  chemically synthesized
tatacatatatattactcagcc

SEQ ID NO: 24794 - DNA, 22 bp, Artificial Sequence
  chemically synthesized
ctcagccataaaaaagaatgaa

SEQ ID NO: 24795 - DNA, 22 bp, Artificial Sequence
  chemically synthesized
agccataaaaaagaatgaaatc

SEQ ID NO: 24796 - DNA, 22 bp, Artificial Sequence
  chemically synthesized
ctctagaaacatggttagaact

SEQ ID NO: 24797 - DNA, 22 bp, Artificial Sequence
  chemically synthesized
tctagaaacatggttagaactg

SEQ ID NO: 24798 - DNA, 22 bp, Artificial Sequence
  chemically synthesized
tagaaacatggttagaactgga

SEQ ID NO: 24799 - DNA, 22 bp, Artificial Sequence
  chemically synthesized
gaaacatggttagaactggagg

SEQ ID NO: 24800 - DNA, 22 bp, Artificial Sequence
  chemically synthesized
gaactggaggacattatcctca

SEQ ID NO: 24801 - DNA, 22 bp, Artificial Sequence
  chemically synthesized
gaggacattatcctcagtgaaa

SEQ ID NO: 24802 - DNA, 22 bp, Artificial Sequence
  chemically synthesized
tcctcagtgaaataactcagaa

SEQ ID NO: 24803 - DNA, 22 bp, Artificial Sequence
  chemically synthesized
agtgaaataactcagaaacaga

SEQ ID NO: 24804 - DNA, 22 bp, Artificial Sequence
  chemically synthesized
agaaacagaaagtcaaacacag

SEQ ID NO: 24805 - DNA, 22 bp, Artificial Sequence
  chemically synthesized
tcatttagtgagagccaagtgg

SEQ ID NO: 24806 - DNA, 22 bp, Artificial Sequence
  chemically synthesized
atttagtgagagccaagtggga

SEQ ID NO: 24807 - DNA, 22 bp, Artificial Sequence
  chemically synthesized
agtgagagccaagtgggagcta

SEQ ID NO: 24808 - DNA, 22 bp, Artificial Sequence
  chemically synthesized
gtgagagccaagtgggagctaa

SEQ ID NO: 24809 - DNA, 22 bp, Artificial Sequence
  chemically synthesized
aacgatgagtaagcatagacat

SEQ ID NO: 24810 - DNA, 22 bp, Artificial Sequence
  chemically synthesized
gagactagagaaaggtgggagg

SEQ ID NO: 24811 - DNA, 22 bp, Artificial Sequence
  chemically synthesized
agactagagaaaggtgggagga

SEQ ID NO: 24812 - DNA, 22 bp, Artificial Sequence
  chemically synthesized
gagaaaggtgggaggataggag

SEQ ID NO: 24813 - DNA, 22 bp, Artificial Sequence
  chemically synthesized
aaaaactacggattggatacaa

SEQ ID NO: 24814 - DNA, 22 bp, Artificial Sequence
  chemically synthesized
cggattggatacaacattcact

SEQ ID NO: 24815 - DNA, 22 bp, Artificial Sequence
  chemically synthesized
gatacaacattcacttttcagg

SEQ ID NO: 24816 - DNA, 22 bp, Artificial Sequence
  chemically synthesized
acttttcaggtgatggtccact

SEQ ID NO: 24817 - DNA, 22 bp, Artificial Sequence
  chemically synthesized
ttcaggtgatggtccactaaaa

SEQ ID NO: 24818 - DNA, 22 bp, Artificial Sequence
  chemically synthesized
tcaggtgatggtccactaaaag

SEQ ID NO: 24819 - DNA, 22 bp, Artificial Sequence
  chemically synthesized
caggtgatggtccactaaaagc

SEQ ID NO: 24820 - DNA, 22 bp, Artificial Sequence
  chemically synthesized
aggtgatggtccactaaaagct

SEQ ID NO: 24821 - DNA, 22 bp, Artificial Sequence
  chemically synthesized
aaagctcagacttcaccactat

SEQ ID NO: 24822 - DNA, 22 bp, Artificial Sequence
  chemically synthesized
agacttcaccactatgcaacat

SEQ ID NO: 24823 - DNA, 22 bp, Artificial Sequence
  chemically synthesized
caccactatgcaacatacatat

SEQ ID NO: 24824 - DNA, 22 bp, Artificial Sequence
  chemically synthesized
accactatgcaacatacatatg

SEQ ID NO: 24825 - DNA, 22 bp, Artificial Sequence
  chemically synthesized
tgcaacatacatatgtaaggaa

SEQ ID NO: 24826 - DNA, 22 bp, Artificial Sequence
  chemically synthesized
gtaccctgatacagcttgactg

SEQ ID NO: 24827 - DNA, 22 bp, Artificial Sequence
  chemically synthesized
taccctgatacagcttgactgt

SEQ ID NO: 24828 - DNA, 22 bp, Artificial Sequence
  chemically synthesized
atacagcttgactgtgtcccca

SEQ ID NO: 24829 - DNA, 22 bp, Artificial Sequence
  chemically synthesized
gactgtgtccccacccaaatct

SEQ ID NO: 24830 - DNA, 22 bp, Artificial Sequence
  chemically synthesized
actgtgtccccacccaaatctc

SEQ ID NO: 24831 - DNA, 22 bp, Artificial Sequence
  chemically synthesized
tgtccccacccaaatctcatct

SEQ ID NO: 24832 - DNA, 22 bp, Artificial Sequence
  chemically synthesized
atcttgaattgtagttcccata

SEQ ID NO: 24833 - DNA, 22 bp, Artificial Sequence
  chemically synthesized
gaattgtagttcccataatcct

SEQ ID NO: 24834 - DNA, 22 bp, Artificial Sequence
  chemically synthesized
aattgtagttcccataatcctc

SEQ ID NO: 24835 - DNA, 22 bp, Artificial Sequence
  chemically synthesized
tagttcccataatcctcacgtg

SEQ ID NO: 24836 - DNA, 22 bp, Artificial Sequence
  chemically synthesized
ccataatcctcacgtgttgtgg

SEQ ID NO: 24837 - DNA, 22 bp, Artificial Sequence
  chemically synthesized
acgtgttgtgggagggatttgg

SEQ ID NO: 24838 - DNA, 22 bp, Artificial Sequence
  chemically synthesized
tgggagggatttggagggaggt

SEQ ID NO: 24839 - DNA, 22 bp, Artificial Sequence
  chemically synthesized
ggagggaggtaattgaatcata

SEQ ID NO: 24840 - DNA, 22 bp, Artificial Sequence
  chemically synthesized
gagggaggtaattgaatcatag

SEQ ID NO: 24841 - DNA, 22 bp, Artificial Sequence
  chemically synthesized
aatcatagaggaggttactctc

SEQ ID NO: 24842 - DNA, 22 bp, Artificial Sequence
  chemically synthesized
ctctcatgctcttctcgtgata

SEQ ID NO: 24843 - DNA, 22 bp, Artificial Sequence
  chemically synthesized
tcatgctcttctcgtgatagtg

SEQ ID NO: 24844 - DNA, 22 bp, Artificial Sequence
  chemically synthesized
atgctcttctcgtgatagtgag

SEQ ID NO: 24845 - DNA, 22 bp, Artificial Sequence
  chemically synthesized
ttctcgtgatagtgagttctta

SEQ ID NO: 24846 - DNA, 22 bp, Artificial Sequence
  chemically synthesized
ctcgtgatagtgagttcttaca

SEQ ID NO: 24847 - DNA, 22 bp, Artificial Sequence
  chemically synthesized
tcgtgatagtgagttcttacaa

SEQ ID NO: 24848 - DNA, 22 bp, Artificial Sequence
  chemically synthesized
gtgatagtgagttcttacaaga

SEQ ID NO: 24849 - DNA, 22 bp, Artificial Sequence
  chemically synthesized
ttacaagatctgatggttttat

SEQ ID NO: 24850 - DNA, 22 bp, Artificial Sequence
  chemically synthesized
acaagatctgatggttttataa

SEQ ID NO: 24851 - DNA, 22 bp, Artificial Sequence
  chemically synthesized
caagatctgatggttttataag

SEQ ID NO: 24852 - DNA, 22 bp, Artificial Sequence
  chemically synthesized
atggttttataagcggcttttc

SEQ ID NO: 24853 - DNA, 22 bp, Artificial Sequence
  chemically synthesized
tataagcggcttttcccccttt

SEQ ID NO: 24854 - DNA, 22 bp, Artificial Sequence
  chemically synthesized
ataagcggcttttccccctttt

SEQ ID NO: 24855 - DNA, 22 bp, Artificial Sequence
  chemically synthesized
taagcggcttttcccccttttg

SEQ ID NO: 24856 - DNA, 22 bp, Artificial Sequence
  chemically synthesized
ttcccccttttgcttggcactt

SEQ ID NO: 24857 - DNA, 22 bp, Artificial Sequence
  chemically synthesized
tcccccttttgcttggcacttc

SEQ ID NO: 24858 - DNA, 22 bp, Artificial Sequence
  chemically synthesized
cccccttttgcttggcacttct

SEQ ID NO: 24859 - DNA, 22 bp, Artificial Sequence
  chemically synthesized
ccccttttgcttggcacttcta

SEQ ID NO: 24860 - DNA, 22 bp, Artificial Sequence
  chemically synthesized
ttgcttggcacttctacttgct

SEQ ID NO: 24861 - DNA, 22 bp, Artificial Sequence
  chemically synthesized
tgcttggcacttctacttgctg

SEQ ID NO: 24862 - DNA, 22 bp, Artificial Sequence
  chemically synthesized
gcttggcacttctacttgctgc

SEQ ID NO: 24863 - DNA, 22 bp, Artificial Sequence
  chemically synthesized
cttggcacttctacttgctgct

SEQ ID NO: 24864 - DNA, 22 bp, Artificial Sequence
  chemically synthesized
ggcacttctacttgctgctgcc

SEQ ID NO: 24865 - DNA, 22 bp, Artificial Sequence
  chemically synthesized
gcacttctacttgctgctgcca

SEQ ID NO: 24866 - DNA, 22 bp, Artificial Sequence
  chemically synthesized
ctacttgctgctgccatgtgaa

SEQ ID NO: 24867 - DNA, 22 bp, Artificial Sequence
  chemically synthesized
tacttgctgctgccatgtgaag

SEQ ID NO: 24868 - DNA, 22 bp, Artificial Sequence
  chemically synthesized
cttgctgctgccatgtgaagaa

SEQ ID NO: 24869 - DNA, 22 bp, Artificial Sequence
  chemically synthesized
gctgctgccatgtgaagaagga

SEQ ID NO: 24870 - DNA, 22 bp, Artificial Sequence
  chemically synthesized
ctgctgccatgtgaagaaggac

SEQ ID NO: 24871 - DNA, 22 bp, Artificial Sequence
  chemically synthesized
ctgccatgtgaagaaggacatg

SEQ ID NO: 24872 - DNA, 22 bp, Artificial Sequence
  chemically synthesized
ccatgtgaagaaggacatgttt

SEQ ID NO: 24873 - DNA, 22 bp, Artificial Sequence
  chemically synthesized
gtttcttcttctgccatgattg

SEQ ID NO: 24874 - DNA, 22 bp, Artificial Sequence
  chemically synthesized
tttcttcttctgccatgattgt

SEQ ID NO: 24875 - DNA, 22 bp, Artificial Sequence
  chemically synthesized
cttcttctgccatgattgtaag

SEQ ID NO: 24876 - DNA, 22 bp, Artificial Sequence
  chemically synthesized
ttcttctgccatgattgtaagt

SEQ ID NO: 24877 - DNA, 22 bp, Artificial Sequence
  chemically synthesized
cttctgccatgattgtaagttt

SEQ ID NO: 24878 - DNA, 22 bp, Artificial Sequence
  chemically synthesized
ttctgccatgattgtaagtttc

SEQ ID NO: 24879 - DNA, 22 bp, Artificial Sequence
  chemically synthesized
ctgccatgattgtaagtttccc

SEQ ID NO: 24880 - DNA, 22 bp, Artificial Sequence
  chemically synthesized
tgccatgattgtaagtttcccg

SEQ ID NO: 24881 - DNA, 22 bp, Artificial Sequence
  chemically synthesized
ccatgattgtaagtttcccgag

SEQ ID NO: 24882 - DNA, 22 bp, Artificial Sequence
  chemically synthesized
taagtttcccgaggcctcccca

SEQ ID NO: 24883 - DNA, 22 bp, Artificial Sequence
  chemically synthesized
cccgaggcctccccagccctgt

SEQ ID NO: 24884 - DNA, 22 bp, Artificial Sequence
  chemically synthesized
ccgaggcctccccagccctgtg

SEQ ID NO: 24885 - DNA, 22 bp, Artificial Sequence
  chemically synthesized
cccagccctgtggaactgtgag

SEQ ID NO: 24886 - DNA, 22 bp, Artificial Sequence
  chemically synthesized
tggaactgtgagacaattaaac

SEQ ID NO: 24887 - DNA, 22 bp, Artificial Sequence
  chemically synthesized
tgagacaattaaacgttttttc

SEQ ID NO: 24888 - DNA, 22 bp, Artificial Sequence
  chemically synthesized
aacgttttttccttataaatta

SEQ ID NO: 24889 - DNA, 22 bp, Artificial Sequence
  chemically synthesized
tttccttataaattacccagtc

SEQ ID NO: 24890 - DNA, 22 bp, Artificial Sequence
  chemically synthesized
ttccttataaattacccagtct

SEQ ID NO: 24891 - DNA, 22 bp, Artificial Sequence
  chemically synthesized
tccttataaattacccagtctc

SEQ ID NO: 24892 - DNA, 22 bp, Artificial Sequence
  chemically synthesized
ccttataaattacccagtctca

SEQ ID NO: 24893 - DNA, 22 bp, Artificial Sequence
  chemically synthesized
cttataaattacccagtctcag

SEQ ID NO: 24894 - DNA, 22 bp, Artificial Sequence
  chemically synthesized
ataaattacccagtctcaggta

SEQ ID NO: 24895 - DNA, 22 bp, Artificial Sequence
  chemically synthesized
taaattacccagtctcaggtat

SEQ ID NO: 24896 - DNA, 22 bp, Artificial Sequence
  chemically synthesized
cccagtctcaggtatgtcttta

SEQ ID NO: 24897 - DNA, 22 bp, Artificial Sequence
  chemically synthesized
aggtatgtctttataagcagca

SEQ ID NO: 24898 - DNA, 22 bp, Artificial Sequence
  chemically synthesized
tataagcagcatgataacgaac

SEQ ID NO: 24899 - DNA, 22 bp, Artificial Sequence
  chemically synthesized
ataagcagcatgataacgaact

SEQ ID NO: 24900 - DNA, 22 bp, Artificial Sequence
  chemically synthesized
taagcagcatgataacgaacta

SEQ ID NO: 24901 - DNA, 22 bp, Artificial Sequence
  chemically synthesized
gtacataccttctaaatatata

SEQ ID NO: 24902 - DNA, 22 bp, Artificial Sequence
  chemically synthesized
ctaaatatatataaataaattt

SEQ ID NO: 24903 - DNA, 22 bp, Artificial Sequence
  chemically synthesized
taaatatatataaataaatttt

SEQ ID NO: 24904 - DNA, 22 bp, Artificial Sequence
  chemically synthesized
aatatatataaataaattttaa

SEQ ID NO: 24905 - DNA, 22 bp, Artificial Sequence
  chemically synthesized
taaaaatataaaataaattaga

SEQ ID NO: 24906 - DNA, 22 bp, Artificial Sequence
  chemically synthesized
aaaaatataaaataaattagat

SEQ ID NO: 24907 - DNA, 22 bp, Artificial Sequence
  chemically synthesized
aaaatataaaataaattagatc

SEQ ID NO: 24908 - DNA, 22 bp, Artificial Sequence
  chemically synthesized
gatctgattgaaaaggcaaaaa

SEQ ID NO: 24909 - DNA, 22 bp, Artificial Sequence
  chemically synthesized
attgaaaaggcaaaaattgagc

SEQ ID NO: 24910 - DNA, 22 bp, Artificial Sequence
  chemically synthesized
aaaaggcaaaaattgagcaagc

SEQ ID NO: 24911 - DNA, 22 bp, Artificial Sequence
  chemically synthesized
agcaagcaaaatatcacttaat

SEQ ID NO: 24912 - DNA, 22 bp, Artificial Sequence
  chemically synthesized
aatggggtaattaaaagggtga

SEQ ID NO: 24913 - DNA, 22 bp, Artificial Sequence
  chemically synthesized
atggggtaattaaaagggtgaa

SEQ ID NO: 24914 - DNA, 22 bp, Artificial Sequence
  chemically synthesized
aaagggtgaagaaattgggcaa

SEQ ID NO: 24915 - DNA, 22 bp, Artificial Sequence
  chemically synthesized
ggcaaatggatgtcatgaggag

SEQ ID NO: 24916 - DNA, 22 bp, Artificial Sequence
  chemically synthesized
ttaggcagaggtaatggtcaga

SEQ ID NO: 24917 - DNA, 22 bp, Artificial Sequence
  chemically synthesized
taggcagaggtaatggtcagag

SEQ ID NO: 24918 - DNA, 22 bp, Artificial Sequence
  chemically synthesized
aggcagaggtaatggtcagagc

SEQ ID NO: 24919 - DNA, 22 bp, Artificial Sequence
  chemically synthesized
ggcagaggtaatggtcagagcc

SEQ ID NO: 24920 - DNA, 22 bp, Artificial Sequence
  chemically synthesized
agctggagtagagtgtgcaagg

SEQ ID NO: 24921 - DNA, 22 bp, Artificial Sequence
  chemically synthesized
gagtagagtgtgcaaggaaaga

SEQ ID NO: 24922 - DNA, 22 bp, Artificial Sequence
  chemically synthesized
aaaaggataaccaggtaggagg

SEQ ID NO: 24923 - DNA, 22 bp, Artificial Sequence
  chemically synthesized
cagtaaacttaggcaggatatt

SEQ ID NO: 24924 - DNA, 22 bp, Artificial Sequence
  chemically synthesized
aggcaggatatttcccgtgaca

SEQ ID NO: 24925 - DNA, 22 bp, Artificial Sequence
  chemically synthesized
ggcaggatatttcccgtgacag

SEQ ID NO: 24926 - DNA, 22 bp, Artificial Sequence
  chemically synthesized
cccgtgacagcactaaataata

SEQ ID NO: 24927 - DNA, 22 bp, Artificial Sequence
  chemically synthesized
ccgtgacagcactaaataataa

SEQ ID NO: 24928 - DNA, 22 bp, Artificial Sequence
  chemically synthesized
aataataatcacatgtgagaat

SEQ ID NO: 24929 - DNA, 22 bp, Artificial Sequence
  chemically synthesized
tcgattacttgagcaatacttt

SEQ ID NO: 24930 - DNA, 22 bp, Artificial Sequence
  chemically synthesized
cttgagcaatactttgttcatg

SEQ ID NO: 24931 - DNA, 22 bp, Artificial Sequence
  chemically synthesized
gagcaatactttgttcatgagc

SEQ ID NO: 24932 - DNA, 22 bp, Artificial Sequence
  chemically synthesized
agcaatactttgttcatgagct

SEQ ID NO: 24933 - DNA, 22 bp, Artificial Sequence
  chemically synthesized
tgttcatgagctagagcaaggg

SEQ ID NO: 24934 - DNA, 22 bp, Artificial Sequence
  chemically synthesized
gttcatgagctagagcaagggg

SEQ ID NO: 24935 - DNA, 22 bp, Artificial Sequence
  chemically synthesized
ttcatgagctagagcaagggga

SEQ ID NO: 24936 - DNA, 22 bp, Artificial Sequence
  chemically synthesized
atgagctagagcaaggggatga

SEQ ID NO: 24937 - DNA, 22 bp, Artificial Sequence
  chemically synthesized
gagcaaggggatgactcaagaa

SEQ ID NO: 24938 - DNA, 22 bp, Artificial Sequence
  chemically synthesized
aagaaatcctttgtgaaatcct

SEQ ID NO: 24939 - DNA, 22 bp, Artificial Sequence
  chemically synthesized
tgtgaaatcctggaggtaataa

SEQ ID NO: 24940 - DNA, 22 bp, Artificial Sequence
  chemically synthesized
gtgaaatcctggaggtaataag

SEQ ID NO: 24941 - DNA, 22 bp, Artificial Sequence
  chemically synthesized
tgaaatcctggaggtaataaga

SEQ ID NO: 24942 - DNA, 22 bp, Artificial Sequence
  chemically synthesized
gaggtaataagatcctggcatc

SEQ ID NO: 24943 - DNA, 22 bp, Artificial Sequence
  chemically synthesized
gcatcaatcttcaactcaattg

SEQ ID NO: 24944 - DNA, 22 bp, Artificial Sequence
  chemically synthesized
caactcaattgcaaaaagcaat

SEQ ID NO: 24945 - DNA, 22 bp, Artificial Sequence
  chemically synthesized
aactcaattgcaaaaagcaatt

SEQ ID NO: 24946 - DNA, 22 bp, Artificial Sequence
  chemically synthesized
aattgcaaaaagcaattttatt

SEQ ID NO: 24947 - DNA, 22 bp, Artificial Sequence
  chemically synthesized
caaaaagcaattttattactta

SEQ ID NO: 24948 - DNA, 22 bp, Artificial Sequence
  chemically synthesized
tattacttatatattacttctc

SEQ ID NO: 24949 - DNA, 22 bp, Artificial Sequence
  chemically synthesized
attacttatatattacttctca

SEQ ID NO: 24950 - DNA, 22 bp, Artificial Sequence
  chemically synthesized
ttacttatatattacttctcat

SEQ ID NO: 24951 - DNA, 22 bp, Artificial Sequence
  chemically synthesized
cttatatattacttctcatttt

SEQ ID NO: 24952 - DNA, 22 bp, Artificial Sequence
  chemically synthesized
atatattacttctcatttttca

SEQ ID NO: 24953 - DNA, 22 bp, Artificial Sequence
  chemically synthesized
tatattacttctcatttttcac

SEQ ID NO: 24954 - DNA, 22 bp, Artificial Sequence
  chemically synthesized
cttctcatttttcactgctgtc

SEQ ID NO: 24955 - DNA, 22 bp, Artificial Sequence
  chemically synthesized
ctcatttttcactgctgtcttt

SEQ ID NO: 24956 - DNA, 22 bp, Artificial Sequence
  chemically synthesized
tcatttttcactgctgtctttc

SEQ ID NO: 24957 - DNA, 22 bp, Artificial Sequence
  chemically synthesized
atttttcactgctgtctttcaa

SEQ ID NO: 24958 - DNA, 22 bp, Artificial Sequence
  chemically synthesized
ttcactgctgtctttcaaaaca

SEQ ID NO: 24959 - DNA, 22 bp, Artificial Sequence
  chemically synthesized
tcactgctgtctttcaaaacat

SEQ ID NO: 24960 - DNA, 22 bp, Artificial Sequence
  chemically synthesized
cactgctgtctttcaaaacata

SEQ ID NO: 24961 - DNA, 22 bp, Artificial Sequence
  chemically synthesized
actgctgtctttcaaaacatat

SEQ ID NO: 24962 - DNA, 22 bp, Artificial Sequence
  chemically synthesized
ctgtctttcaaaacatattcca

SEQ ID NO: 24963 - DNA, 22 bp, Artificial Sequence
  chemically synthesized
tctttcaaaacatattccattt

SEQ ID NO: 24964 - DNA, 22 bp, Artificial Sequence
  chemically synthesized
tcaaaacatattccatttcatc

SEQ ID NO: 24965 - DNA, 22 bp, Artificial Sequence
  chemically synthesized
caaaacatattccatttcatca

SEQ ID NO: 24966 - DNA, 22 bp, Artificial Sequence
  chemically synthesized
aaaacatattccatttcatcag

SEQ ID NO: 24967 - DNA, 22 bp, Artificial Sequence
  chemically synthesized
catttcatcagactacaggttt

SEQ ID NO: 24968 - DNA, 22 bp, Artificial Sequence
  chemically synthesized
catcagactacaggttttaata

SEQ ID NO: 24969 - DNA, 22 bp, Artificial Sequence
  chemically synthesized
atcagactacaggttttaatag

SEQ ID NO: 24970 - DNA, 22 bp, Artificial Sequence
  chemically synthesized
caggttttaatagctactatat

SEQ ID NO: 24971 - DNA, 22 bp, Artificial Sequence
  chemically synthesized
taatagctactatatttcttaa

SEQ ID NO: 24972 - DNA, 22 bp, Artificial Sequence
  chemically synthesized
aatagctactatatttcttaaa

SEQ ID NO: 24973 - DNA, 22 bp, Artificial Sequence
  chemically synthesized
atagctactatatttcttaaat

SEQ ID NO: 24974 - DNA, 22 bp, Artificial Sequence
  chemically synthesized
ctatatttcttaaatgtattat

SEQ ID NO: 24975 - DNA, 22 bp, Artificial Sequence
  chemically synthesized
tatttcttaaatgtattattcc

SEQ ID NO: 24976 - DNA, 22 bp, Artificial Sequence
  chemically synthesized
cttaaatgtattattccagtaa

SEQ ID NO: 24977 - DNA, 22 bp, Artificial Sequence
  chemically synthesized
ttaaatgtattattccagtaac

SEQ ID NO: 24978 - DNA, 22 bp, Artificial Sequence
  chemically synthesized
aaatgtattattccagtaactt

SEQ ID NO: 24979 - DNA, 22 bp, Artificial Sequence
  chemically synthesized
aatgtattattccagtaactta

SEQ ID NO: 24980 - DNA, 22 bp, Artificial Sequence
  chemically synthesized
ttccagtaacttatactttaca

SEQ ID NO: 24981 - DNA, 22 bp, Artificial Sequence
  chemically synthesized
cagtaacttatactttacatag

SEQ ID NO: 24982 - DNA, 22 bp, Artificial Sequence
  chemically synthesized
atactttacatagtaaatctta

SEQ ID NO: 24983 - DNA, 22 bp, Artificial Sequence
  chemically synthesized
tactttacatagtaaatcttat

SEQ ID NO: 24984 - DNA, 22 bp, Artificial Sequence
  chemically synthesized
tacatagtaaatcttatcaata

SEQ ID NO: 24985 - DNA, 22 bp, Artificial Sequence
  chemically synthesized
acatagtaaatcttatcaatag

SEQ ID NO: 24986 - DNA, 22 bp, Artificial Sequence
  chemically synthesized
catagtaaatcttatcaatagt

SEQ ID NO: 24987 - DNA, 22 bp, Artificial Sequence
  chemically synthesized
atcaatagtcacaatcaatggt

SEQ ID NO: 24988 - DNA, 22 bp, Artificial Sequence
  chemically synthesized
tcaatagtcacaatcaatggtc

SEQ ID NO: 24989 - DNA, 22 bp, Artificial Sequence
  chemically synthesized
catctggagacattacttttag

SEQ ID NO: 24990 - DNA, 22 bp, Artificial Sequence
  chemically synthesized
atctggagacattacttttagc

SEQ ID NO: 24991 - DNA, 22 bp, Artificial Sequence
  chemically synthesized
gagacattacttttagcctgag

SEQ ID NO: 24992 - DNA, 22 bp, Artificial Sequence
  chemically synthesized
cttttagcctgagccatgcaaa

SEQ ID NO: 24993 - DNA, 22 bp, Artificial Sequence
  chemically synthesized
ttagcctgagccatgcaaaata

SEQ ID NO: 24994 - DNA, 22 bp, Artificial Sequence
  chemically synthesized
tagcctgagccatgcaaaatat

SEQ ID NO: 24995 - DNA, 22 bp, Artificial Sequence
  chemically synthesized
agcctgagccatgcaaaatata

SEQ ID NO: 24996 - DNA, 22 bp, Artificial Sequence
  chemically synthesized
gcctgagccatgcaaaatatac

SEQ ID NO: 24997 - DNA, 22 bp, Artificial Sequence
  chemically synthesized
agccatgcaaaatatacttttt

SEQ ID NO: 24998 - DNA, 22 bp, Artificial Sequence
  chemically synthesized
tttggaaaattgccctttgaaa

SEQ ID NO: 24999 - DNA, 22 bp, Artificial Sequence
  chemically synthesized
ttggaaaattgccctttgaaag

SEQ ID NO: 25000 - DNA, 22 bp, Artificial Sequence
  chemically synthesized
tggaaaattgccctttgaaagg

SEQ ID NO: 25001 - DNA, 22 bp, Artificial Sequence
  chemically synthesized
ggaaaattgccctttgaaaggc

SEQ ID NO: 25002 - DNA, 22 bp, Artificial Sequence
  chemically synthesized
gaaaattgccctttgaaaggcg

SEQ ID NO: 25003 - DNA, 22 bp, Artificial Sequence
  chemically synthesized
ccctttgaaaggcgagacacaa

SEQ ID NO: 25004 - DNA, 22 bp, Artificial Sequence
  chemically synthesized
tgaaaggcgagacacaaaaggc

SEQ ID NO: 25005 - DNA, 22 bp, Artificial Sequence
  chemically synthesized
gaaaggcgagacacaaaaggca

SEQ ID NO: 25006 - DNA, 22 bp, Artificial Sequence
  chemically synthesized
aaaggcgagacacaaaaggcaa

SEQ ID NO: 25007 - DNA, 22 bp, Artificial Sequence
  chemically synthesized
atgctattatatggtaccaata

SEQ ID NO: 25008 - DNA, 22 bp, Artificial Sequence
  chemically synthesized
ttatatggtaccaataggattc

SEQ ID NO: 25009 - DNA, 22 bp, Artificial Sequence
  chemically synthesized
tatggtaccaataggattcatt

SEQ ID NO: 25010 - DNA, 22 bp, Artificial Sequence
  chemically synthesized
attaatttataaaggagaagag

SEQ ID NO: 25011 - DNA, 22 bp, Artificial Sequence
  chemically synthesized
atttataaaggagaagagctaa

SEQ ID NO: 25012 - DNA, 22 bp, Artificial Sequence
  chemically synthesized
ataaaggagaagagctaatgta

SEQ ID NO: 25013 - DNA, 22 bp, Artificial Sequence
  chemically synthesized
taaaggagaagagctaatgtaa

SEQ ID NO: 25014 - DNA, 22 bp, Artificial Sequence
  chemically synthesized
atgtaactccaaaatgcaagca

SEQ ID NO: 25015 - DNA, 22 bp, Artificial Sequence
  chemically synthesized
caaaatgcaagcaattttcata

SEQ ID NO: 25016 - DNA, 22 bp, Artificial Sequence
  chemically synthesized
tcatatgagtctacacaagcta

SEQ ID NO: 25017 - DNA, 22 bp, Artificial Sequence
  chemically synthesized
catatgagtctacacaagctaa

SEQ ID NO: 25018 - DNA, 22 bp, Artificial Sequence
  chemically synthesized
atatgagtctacacaagctaat

SEQ ID NO: 25019 - DNA, 22 bp, Artificial Sequence
  chemically synthesized
cacaagctaattgtccttaaga

SEQ ID NO: 25020 - DNA, 22 bp, Artificial Sequence
  chemically synthesized
attgtccttaagaatttcatct

SEQ ID NO: 25021 - DNA, 22 bp, Artificial Sequence
  chemically synthesized
tccttaagaatttcatctttaa

SEQ ID NO: 25022 - DNA, 22 bp, Artificial Sequence
  chemically synthesized
aagaatttcatctttaaggaaa

SEQ ID NO: 25023 - DNA, 22 bp, Artificial Sequence
  chemically synthesized
agaatttcatctttaaggaaaa

SEQ ID NO: 25024 - DNA, 22 bp, Artificial Sequence
  chemically synthesized
catctttaaggaaaagtttttt

SEQ ID NO: 25025 - DNA, 22 bp, Artificial Sequence
  chemically synthesized
atctttaaggaaaagtttttta

SEQ ID NO: 25026 - DNA, 22 bp, Artificial Sequence
  chemically synthesized
taaggaaaagttttttactgta

SEQ ID NO: 25027 - DNA, 22 bp, Artificial Sequence
  chemically synthesized
aaggaaaagttttttactgtat

SEQ ID NO: 25028 - DNA, 22 bp, Artificial Sequence
  chemically synthesized
aggaaaagttttttactgtatc

SEQ ID NO: 25029 - DNA, 22 bp, Artificial Sequence
  chemically synthesized
tttactgtatcaaaaagaagtt

SEQ ID NO: 25030 - DNA, 22 bp, Artificial Sequence
  chemically synthesized
ttactgtatcaaaaagaagttt

SEQ ID NO: 25031 - DNA, 22 bp, Artificial Sequence
  chemically synthesized
tactgtatcaaaaagaagttta

SEQ ID NO: 25032 - DNA, 22 bp, Artificial Sequence
  chemically synthesized
actgtatcaaaaagaagtttaa

SEQ ID NO: 25033 - DNA, 22 bp, Artificial Sequence
  chemically synthesized
ctgtatcaaaaagaagtttaaa

SEQ ID NO: 25034 - DNA, 22 bp, Artificial Sequence
  chemically synthesized
tatcaaaaagaagtttaaactg

SEQ ID NO: 25035 - DNA, 22 bp, Artificial Sequence
  chemically synthesized
aaactgtcattgagcagagtct

SEQ ID NO: 25036 - DNA, 22 bp, Artificial Sequence
  chemically synthesized
aactgtcattgagcagagtctg

SEQ ID NO: 25037 - DNA, 22 bp, Artificial Sequence
  chemically synthesized
tcattgagcagagtctgataat

SEQ ID NO: 25038 - DNA, 22 bp, Artificial Sequence
  chemically synthesized
agcagagtctgataataaggac

SEQ ID NO: 25039 - DNA, 22 bp, Artificial Sequence
  chemically synthesized
ataataaggacactgtcaaatc

SEQ ID NO: 25040 - DNA, 22 bp, Artificial Sequence
  chemically synthesized
tcaaatcacagttcagatgtta

SEQ ID NO: 25041 - DNA, 22 bp, Artificial Sequence
  chemically synthesized
agatgttatgtgatgaggacag

SEQ ID NO: 25042 - DNA, 22 bp, Artificial Sequence
  chemically synthesized
tgtgatgaggacagaatagaac

SEQ ID NO: 25043 - DNA, 22 bp, Artificial Sequence
  chemically synthesized
ctagactggacaagaacagaca

SEQ ID NO: 25044 - DNA, 22 bp, Artificial Sequence
  chemically synthesized
tagactggacaagaacagacat

SEQ ID NO: 25045 - DNA, 22 bp, Artificial Sequence
  chemically synthesized
gactggacaagaacagacatga

SEQ ID NO: 25046 - DNA, 22 bp, Artificial Sequence
  chemically synthesized
gacaagaacagacatgattaac

SEQ ID NO: 25047 - DNA, 22 bp, Artificial Sequence
  chemically synthesized
acttaaccatccaacaataaat

SEQ ID NO: 25048 - DNA, 22 bp, Artificial Sequence
  chemically synthesized
aaccatccaacaataaatctaa

SEQ ID NO: 25049 - DNA, 22 bp, Artificial Sequence
  chemically synthesized
accatccaacaataaatctaag

SEQ ID NO: 25050 - DNA, 22 bp, Artificial Sequence
  chemically synthesized
agttaacataaattgatgtcat

SEQ ID NO: 25051 - DNA, 22 bp, Artificial Sequence
  chemically synthesized
acataaattgatgtcatctact

SEQ ID NO: 25052 - DNA, 22 bp, Artificial Sequence
  chemically synthesized
atgtcatctactacatctaagt

SEQ ID NO: 25053 - DNA, 22 bp, Artificial Sequence
  chemically synthesized
ctacatctaagtatttcctcaa

SEQ ID NO: 25054 - DNA, 22 bp, Artificial Sequence
  chemically synthesized
catctaagtatttcctcaaatt

SEQ ID NO: 25055 - DNA, 22 bp, Artificial Sequence
  chemically synthesized
agtatttcctcaaattctggac

SEQ ID NO: 25056 - DNA, 22 bp, Artificial Sequence
  chemically synthesized
cctcaaattctggacaatttta

SEQ ID NO: 25057 - DNA, 22 bp, Artificial Sequence
  chemically synthesized
ctcaaattctggacaattttag

SEQ ID NO: 25058 - DNA, 22 bp, Artificial Sequence
  chemically synthesized
aaattctggacaattttagaaa

SEQ ID NO: 25059 - DNA, 22 bp, Artificial Sequence
  chemically synthesized
tggacaattttagaaaccatca

SEQ ID NO: 25060 - DNA, 22 bp, Artificial Sequence
  chemically synthesized
gacaattttagaaaccatcaaa

SEQ ID NO: 25061 - DNA, 22 bp, Artificial Sequence
  chemically synthesized
tagaaaccatcaaaattatttg

SEQ ID NO: 25062 - DNA, 22 bp, Artificial Sequence
  chemically synthesized
agaaaccatcaaaattatttgt

SEQ ID NO: 25063 - DNA, 22 bp, Artificial Sequence
  chemically synthesized
gaaaccatcaaaattatttgtt

SEQ ID NO: 25064 - DNA, 22 bp, Artificial Sequence
  chemically synthesized
tttgttgaggaaaaataaactt

SEQ ID NO: 25065 - DNA, 22 bp, Artificial Sequence
  chemically synthesized
gttgaggaaaaataaacttagc

SEQ ID NO: 25066 - DNA, 22 bp, Artificial Sequence
  chemically synthesized
ttgaggaaaaataaacttagcc

SEQ ID NO: 25067 - DNA, 22 bp, Artificial Sequence
  chemically synthesized
aggaaaaataaacttagccaat

SEQ ID NO: 25068 - DNA, 22 bp, Artificial Sequence
  chemically synthesized
agccaatttgcaagggcaacta

SEQ ID NO: 25069 - DNA, 22 bp, Artificial Sequence
  chemically synthesized
gccaatttgcaagggcaactaa

SEQ ID NO: 25070 - DNA, 22 bp, Artificial Sequence
  chemically synthesized
gcaagggcaactaaaatgaaga

SEQ ID NO: 25071 - DNA, 22 bp, Artificial Sequence
  chemically synthesized
caagggcaactaaaatgaagaa

SEQ ID NO: 25072 - DNA, 22 bp, Artificial Sequence
  chemically synthesized
aaatgaagaacttttctttaaa

SEQ ID NO: 25073 - DNA, 22 bp, Artificial Sequence
  chemically synthesized
ttctttaaagtgtgggagtcac

SEQ ID NO: 25074 - DNA, 22 bp, Artificial Sequence
  chemically synthesized
tctttaaagtgtgggagtcaca

SEQ ID NO: 25075 - DNA, 22 bp, Artificial Sequence
  chemically synthesized
ctttaaagtgtgggagtcacat

SEQ ID NO: 25076 - DNA, 22 bp, Artificial Sequence
  chemically synthesized
tttaaagtgtgggagtcacatc

SEQ ID NO: 25077 - DNA, 22 bp, Artificial Sequence
  chemically synthesized
taaagtgtgggagtcacatctt

SEQ ID NO: 25078 - DNA, 22 bp, Artificial Sequence
  chemically synthesized
aaagtgtgggagtcacatctta

SEQ ID NO: 25079 - DNA, 22 bp, Artificial Sequence
  chemically synthesized
aagtgtgggagtcacatcttag

SEQ ID NO: 25080 - DNA, 22 bp, Artificial Sequence
  chemically synthesized
agcaacatatttaaatatatct

SEQ ID NO: 25081 - DNA, 22 bp, Artificial Sequence
  chemically synthesized
gcaacatatttaaatatatcta

SEQ ID NO: 25082 - DNA, 22 bp, Artificial Sequence
  chemically synthesized
aaatatatctaagctttcttca

SEQ ID NO: 25083 - DNA, 22 bp, Artificial Sequence
  chemically synthesized
aatatatctaagctttcttcaa

SEQ ID NO: 25084 - DNA, 22 bp, Artificial Sequence
  chemically synthesized
agctttcttcaaaaccactatc

SEQ ID NO: 25085 - DNA, 22 bp, Artificial Sequence
  chemically synthesized
tcttcaaaaccactatccacaa

SEQ ID NO: 25086 - DNA, 22 bp, Artificial Sequence
  chemically synthesized
cttcaaaaccactatccacaaa

SEQ ID NO: 25087 - DNA, 22 bp, Artificial Sequence
  chemically synthesized
ttcaaaaccactatccacaaaa

SEQ ID NO: 25088 - DNA, 22 bp, Artificial Sequence
  chemically synthesized
caaaaccactatccacaaaaat

SEQ ID NO: 25089 - DNA, 22 bp, Artificial Sequence
  chemically synthesized
aaaaccactatccacaaaaatg

SEQ ID NO: 25090 - DNA, 22 bp, Artificial Sequence
  chemically synthesized
tccacaaaaatgcaaaatttcc

SEQ ID NO: 25091 - DNA, 22 bp, Artificial Sequence
  chemically synthesized
ccaaagaatttctcctcttctg

SEQ ID NO: 25092 - DNA, 22 bp, Artificial Sequence
  chemically synthesized
caaagaatttctcctcttctgt

SEQ ID NO: 25093 - DNA, 22 bp, Artificial Sequence
  chemically synthesized
ctcctcttctgtagacttattt

SEQ ID NO: 25094 - DNA, 22 bp, Artificial Sequence
  chemically synthesized
tcctcttctgtagacttatttt

SEQ ID NO: 25095 - DNA, 22 bp, Artificial Sequence
  chemically synthesized
ctcttctgtagacttattttct

SEQ ID NO: 25096 - DNA, 22 bp, Artificial Sequence
  chemically synthesized
ttctgtagacttattttcttca

SEQ ID NO: 25097 - DNA, 22 bp, Artificial Sequence
  chemically synthesized
ctgtagacttattttcttcatc

SEQ ID NO: 25098 - DNA, 22 bp, Artificial Sequence
  chemically synthesized
tgtagacttattttcttcatct

SEQ ID NO: 25099 - DNA, 22 bp, Artificial Sequence
  chemically synthesized
tagacttattttcttcatcttc

SEQ ID NO: 25100 - DNA, 22 bp, Artificial Sequence
  chemically synthesized
attttcttcatcttcatctttt

SEQ ID NO: 25101 - DNA, 22 bp, Artificial Sequence
  chemically synthesized
ttttcttcatcttcatcttttc

SEQ ID NO: 25102 - DNA, 22 bp, Artificial Sequence
  chemically synthesized
tcttcatcttcatcttttccag

SEQ ID NO: 25103 - DNA, 22 bp, Artificial Sequence
  chemically synthesized
cttcatcttcatcttttccagg

SEQ ID NO: 25104 - DNA, 22 bp, Artificial Sequence
  chemically synthesized
ttcatcttcatcttttccagga

SEQ ID NO: 25105 - DNA, 22 bp, Artificial Sequence
  chemically synthesized
catcttcatcttttccaggaga

SEQ ID NO: 25106 - DNA, 22 bp, Artificial Sequence
  chemically synthesized
atcttcatcttttccaggagaa

SEQ ID NO: 25107 - DNA, 22 bp, Artificial Sequence
  chemically synthesized
catcttttccaggagaatatac

SEQ ID NO: 25108 - DNA, 22 bp, Artificial Sequence
  chemically synthesized
atcttttccaggagaatatacc

SEQ ID NO: 25109 - DNA, 22 bp, Artificial Sequence
  chemically synthesized
ttccaggagaatataccataag

SEQ ID NO: 25110 - DNA, 22 bp, Artificial Sequence
  chemically synthesized
tccaggagaatataccataagt

SEQ ID NO: 25111 - DNA, 22 bp, Artificial Sequence
  chemically synthesized
ccaggagaatataccataagtt

SEQ ID NO: 25112 - DNA, 22 bp, Artificial Sequence
  chemically synthesized
caggagaatataccataagttt

SEQ ID NO: 25113 - DNA, 22 bp, Artificial Sequence
  chemically synthesized
ctgatggtacacatttattaga

SEQ ID NO: 25114 - DNA, 22 bp, Artificial Sequence
  chemically synthesized
tgatggtacacatttattagat

SEQ ID NO: 25115 - DNA, 22 bp, Artificial Sequence
  chemically synthesized
atggtacacatttattagatgt

SEQ ID NO: 25116 - DNA, 22 bp, Artificial Sequence
  chemically synthesized
attagatgttttatttacattt

SEQ ID NO: 25117 - DNA, 22 bp, Artificial Sequence
  chemically synthesized
ttagatgttttatttacatttt

SEQ ID NO: 25118 - DNA, 22 bp, Artificial Sequence
  chemically synthesized
gatgttttatttacatttttta

SEQ ID NO: 25119 - DNA, 22 bp, Artificial Sequence
  chemically synthesized
tatttacattttttatccttga

SEQ ID NO: 25120 - DNA, 22 bp, Artificial Sequence
  chemically synthesized
atttacattttttatccttgaa

SEQ ID NO: 25121 - DNA, 22 bp, Artificial Sequence
  chemically synthesized
tttacattttttatccttgaaa

SEQ ID NO: 25122 - DNA, 22 bp, Artificial Sequence
  chemically synthesized
acattttttatccttgaaaact

SEQ ID NO: 25123 - DNA, 22 bp, Artificial Sequence
  chemically synthesized
cattttttatccttgaaaactc

SEQ ID NO: 25124 - DNA, 22 bp, Artificial Sequence
  chemically synthesized
tttatccttgaaaactcctttt

SEQ ID NO: 25125 - DNA, 22 bp, Artificial Sequence
  chemically synthesized
ttatccttgaaaactcctttta

SEQ ID NO: 25126 - DNA, 22 bp, Artificial Sequence
  chemically synthesized
tatccttgaaaactccttttat

SEQ ID NO: 25127 - DNA, 22 bp, Artificial Sequence
  chemically synthesized
atccttgaaaactccttttatt

SEQ ID NO: 25128 - DNA, 22 bp, Artificial Sequence
  chemically synthesized
tccttgaaaactccttttattt

SEQ ID NO: 25129 - DNA, 22 bp, Artificial Sequence
  chemically synthesized
gaaaactccttttatttgcaac

SEQ ID NO: 25130 - DNA, 22 bp, Artificial Sequence
  chemically synthesized
aaaactccttttatttgcaact

SEQ ID NO: 25131 - DNA, 22 bp, Artificial Sequence
  chemically synthesized
cttttatttgcaactatgcatc

SEQ ID NO: 25132 - DNA, 22 bp, Artificial Sequence
  chemically synthesized
ttatttgcaactatgcatctta

SEQ ID NO: 25133 - DNA, 22 bp, Artificial Sequence
  chemically synthesized
tatttgcaactatgcatcttac

SEQ ID NO: 25134 - DNA, 22 bp, Artificial Sequence
  chemically synthesized
atttgcaactatgcatcttact

SEQ ID NO: 25135 - DNA, 22 bp, Artificial Sequence
  chemically synthesized
tttgcaactatgcatcttactc

SEQ ID NO: 25136 - DNA, 22 bp, Artificial Sequence
  chemically synthesized
gcaactatgcatcttactcaga

SEQ ID NO: 25137 - DNA, 22 bp, Artificial Sequence
  chemically synthesized
caactatgcatcttactcagag

SEQ ID NO: 25138 - DNA, 22 bp, Artificial Sequence
  chemically synthesized
tgcatcttactcagagatctta

SEQ ID NO: 25139 - DNA, 22 bp, Artificial Sequence
  chemically synthesized
actcagagatcttaaaacatcc

SEQ ID NO: 25140 - DNA, 22 bp, Artificial Sequence
  chemically synthesized
ctcagagatcttaaaacatcct

SEQ ID NO: 25141 - DNA, 22 bp, Artificial Sequence
  chemically synthesized
agagatcttaaaacatccttgt

SEQ ID NO: 25142 - DNA, 22 bp, Artificial Sequence
  chemically synthesized
aaaacatccttgtttgttagat

SEQ ID NO: 25143 - DNA, 22 bp, Artificial Sequence
  chemically synthesized
aaacatccttgtttgttagatt

SEQ ID NO: 25144 - DNA, 22 bp, Artificial Sequence
  chemically synthesized
gtttgttagattacgtatttca

SEQ ID NO: 25145 - DNA, 22 bp, Artificial Sequence
  chemically synthesized
tttgttagattacgtatttcaa

SEQ ID NO: 25146 - DNA, 22 bp, Artificial Sequence
  chemically synthesized
gttagattacgtatttcaaatt

SEQ ID NO: 25147 - DNA, 22 bp, Artificial Sequence
  chemically synthesized
ttagattacgtatttcaaattc

SEQ ID NO: 25148 - DNA, 22 bp, Artificial Sequence
  chemically synthesized
gattacgtatttcaaattcata

SEQ ID NO: 25149 - DNA, 22 bp, Artificial Sequence
  chemically synthesized
cgtatttcaaattcatatacac

SEQ ID NO: 25150 - DNA, 22 bp, Artificial Sequence
  chemically synthesized
caaattcatatacactttggta

SEQ ID NO: 25151 - DNA, 22 bp, Artificial Sequence
  chemically synthesized
aaattcatatacactttggtag

SEQ ID NO: 25152 - DNA, 22 bp, Artificial Sequence
  chemically synthesized
atatacactttggtagatgcaa

SEQ ID NO: 25153 - DNA, 22 bp, Artificial Sequence
  chemically synthesized
tggtagatgcaaacatttttat

SEQ ID NO: 25154 - DNA, 22 bp, Artificial Sequence
  chemically synthesized
ggtagatgcaaacatttttatt

SEQ ID NO: 25155 - DNA, 22 bp, Artificial Sequence
  chemically synthesized
gtagatgcaaacatttttattt

SEQ ID NO: 25156 - DNA, 22 bp, Artificial Sequence
  chemically synthesized
ttatttgctgaagaacataagg

SEQ ID NO: 25157 - DNA, 22 bp, Artificial Sequence
  chemically synthesized
tatttgctgaagaacataaggg

SEQ ID NO: 25158 - DNA, 22 bp, Artificial Sequence
  chemically synthesized
atttgctgaagaacataagggg

SEQ ID NO: 25159 - DNA, 22 bp, Artificial Sequence
  chemically synthesized
tttgctgaagaacataaggggg

SEQ ID NO: 25160 - DNA, 22 bp, Artificial Sequence
  chemically synthesized
gctgaagaacataagggggaaa

SEQ ID NO: 25161 - DNA, 22 bp, Artificial Sequence
  chemically synthesized
ctgaagaacataagggggaaat

SEQ ID NO: 25162 - DNA, 22 bp, Artificial Sequence
  chemically synthesized
aagaacataagggggaaataga

SEQ ID NO: 25163 - DNA, 22 bp, Artificial Sequence
  chemically synthesized
tttatttgaagaaacaaatgat

SEQ ID NO: 25164 - DNA, 22 bp, Artificial Sequence
  chemically synthesized
tatttgaagaaacaaatgattt

SEQ ID NO: 25165 - DNA, 22 bp, Artificial Sequence
  chemically synthesized
atttgaagaaacaaatgatttg

SEQ ID NO: 25166 - DNA, 22 bp, Artificial Sequence
  chemically synthesized
tttgaagaaacaaatgatttga

SEQ ID NO: 25167 - DNA, 22 bp, Artificial Sequence
  chemically synthesized
gaagaaacaaatgatttgattt

SEQ ID NO: 25168 - DNA, 22 bp, Artificial Sequence
  chemically synthesized
aagaaacaaatgatttgatttg

SEQ ID NO: 25169 - DNA, 22 bp, Artificial Sequence
  chemically synthesized
gatttgggaaatgaaatgaaaa

SEQ ID NO: 25170 - DNA, 22 bp, Artificial Sequence
  chemically synthesized
atttgggaaatgaaatgaaaag

SEQ ID NO: 25171 - DNA, 22 bp, Artificial Sequence
  chemically synthesized
gggaaatgaaatgaaaagaaaa

SEQ ID NO: 25172 - DNA, 22 bp, Artificial Sequence
  chemically synthesized
ggaaatgaaatgaaaagaaaaa

SEQ ID NO: 25173 - DNA, 22 bp, Artificial Sequence
  chemically synthesized
actaattcgctacttcttttac

SEQ ID NO: 25174 - DNA, 22 bp, Artificial Sequence
  chemically synthesized
attcgctacttcttttactcat

SEQ ID NO: 25175 - DNA, 22 bp, Artificial Sequence
  chemically synthesized
gctacttcttttactcatctga

SEQ ID NO: 25176 - DNA, 22 bp, Artificial Sequence
  chemically synthesized
cttcttttactcatctgaggcc

SEQ ID NO: 25177 - DNA, 22 bp, Artificial Sequence
  chemically synthesized
cttttactcatctgaggccttc

SEQ ID NO: 25178 - DNA, 22 bp, Artificial Sequence
  chemically synthesized
ttttactcatctgaggccttca

SEQ ID NO: 25179 - DNA, 22 bp, Artificial Sequence
  chemically synthesized
ttactcatctgaggccttcaga

SEQ ID NO: 25180 - DNA, 22 bp, Artificial Sequence
  chemically synthesized
tactcatctgaggccttcagat

SEQ ID NO: 25181 - DNA, 22 bp, Artificial Sequence
  chemically synthesized
actcatctgaggccttcagata

SEQ ID NO: 25182 - DNA, 22 bp, Artificial Sequence
  chemically synthesized
ctcatctgaggccttcagatag

SEQ ID NO: 25183 - DNA, 22 bp, Artificial Sequence
  chemically synthesized
atctgaggccttcagatagtcc

SEQ ID NO: 25184 - DNA, 22 bp, Artificial Sequence
  chemically synthesized
aggccttcagatagtcccccat

SEQ ID NO: 25185 - DNA, 22 bp, Artificial Sequence
  chemically synthesized
cagatagtcccccatatagcct

SEQ ID NO: 25186 - DNA, 22 bp, Artificial Sequence
  chemically synthesized
agatagtcccccatatagcctt

SEQ ID NO: 25187 - DNA, 22 bp, Artificial Sequence
  chemically synthesized
agagtgtttaaaatatgattat

SEQ ID NO: 25188 - DNA, 22 bp, Artificial Sequence
  chemically synthesized
gagtgtttaaaatatgattatg

SEQ ID NO: 25189 - DNA, 22 bp, Artificial Sequence
  chemically synthesized
aaaatatgattatgctctttca

SEQ ID NO: 25190 - DNA, 22 bp, Artificial Sequence
  chemically synthesized
aaatatgattatgctctttcag

SEQ ID NO: 25191 - DNA, 22 bp, Artificial Sequence
  chemically synthesized
tgctctttcagtctattagaaa

SEQ ID NO: 25192 - DNA, 22 bp, Artificial Sequence
  chemically synthesized
tttcagtctattagaaataaaa

SEQ ID NO: 25193 - DNA, 22 bp, Artificial Sequence
  chemically synthesized
tcagtctattagaaataaaaac

SEQ ID NO: 25194 - DNA, 22 bp, Artificial Sequence
  chemically synthesized
cagtctattagaaataaaaaca

SEQ ID NO: 25195 - DNA, 22 bp, Artificial Sequence
  chemically synthesized
agtctattagaaataaaaacat

SEQ ID NO: 25196 - DNA, 22 bp, Artificial Sequence
  chemically synthesized
ttagaaataaaaacataaagct

SEQ ID NO: 25197 - DNA, 22 bp, Artificial Sequence
  chemically synthesized
gaaataaaaacataaagcttaa

SEQ ID NO: 25198 - DNA, 22 bp, Artificial Sequence
  chemically synthesized
aaaaaatttcaagggaaggggc

SEQ ID NO: 25199 - DNA, 22 bp, Artificial Sequence
  chemically synthesized
aaaaatttcaagggaaggggct

SEQ ID NO: 25200 - DNA, 22 bp, Artificial Sequence
  chemically synthesized
caagggaaggggcttgaagatt

SEQ ID NO: 25201 - DNA, 22 bp, Artificial Sequence
  chemically synthesized
aagggaaggggcttgaagatta

SEQ ID NO: 25202 - DNA, 22 bp, Artificial Sequence
  chemically synthesized
gaagattactgactaagggcag

SEQ ID NO: 25203 - DNA, 22 bp, Artificial Sequence
  chemically synthesized
aagattactgactaagggcagc

SEQ ID NO: 25204 - DNA, 22 bp, Artificial Sequence
  chemically synthesized
ctgactaagggcagctgacact

SEQ ID NO: 25205 - DNA, 22 bp, Artificial Sequence
  chemically synthesized
actaagggcagctgacactcac

SEQ ID NO: 25206 - DNA, 22 bp, Artificial Sequence
  chemically synthesized
agggcagctgacactcacctcc

SEQ ID NO: 25207 - DNA, 22 bp, Artificial Sequence
  chemically synthesized
acactcacctcctccacaaaga

SEQ ID NO: 25208 - DNA, 22 bp, Artificial Sequence
  chemically synthesized
acctcctccacaaagaaccaaa

SEQ ID NO: 25209 - DNA, 22 bp, Artificial Sequence
  chemically synthesized
ctccacaaagaaccaaaatagt

SEQ ID NO: 25210 - DNA, 22 bp, Artificial Sequence
  chemically synthesized
cacaaagaaccaaaatagtaag

SEQ ID NO: 25211 - DNA, 22 bp, Artificial Sequence
  chemically synthesized
tggaattcaacagagaagtgac

SEQ ID NO: 25212 - DNA, 22 bp, Artificial Sequence
  chemically synthesized
gaattcaacagagaagtgacag

SEQ ID NO: 25213 - DNA, 22 bp, Artificial Sequence
  chemically synthesized
aacagagaagtgacaggaagca

SEQ ID NO: 25214 - DNA, 22 bp, Artificial Sequence
  chemically synthesized
aggcaatgaaggggagggaagc

SEQ ID NO: 25215 - DNA, 22 bp, Artificial Sequence
  chemically synthesized
cccagtagggatcctctgtgag

SEQ ID NO: 25216 - DNA, 22 bp, Artificial Sequence
  chemically synthesized
tgtgaggccagagaggctcccc

SEQ ID NO: 25217 - DNA, 22 bp, Artificial Sequence
  chemically synthesized
tgaggccagagaggctccccag

SEQ ID NO: 25218 - DNA, 22 bp, Artificial Sequence
  chemically synthesized
cccagtgcatcgaaagttaagt

SEQ ID NO: 25219 - DNA, 22 bp, Artificial Sequence
  chemically synthesized
agtgactgactcccagtggtcc

SEQ ID NO: 25220 - DNA, 22 bp, Artificial Sequence
  chemically synthesized
actcccagtggtccacatctgc

SEQ ID NO: 25221 - DNA, 22 bp, Artificial Sequence
  chemically synthesized
ccagtggtccacatctgcatta

SEQ ID NO: 25222 - DNA, 22 bp, Artificial Sequence
  chemically synthesized
cattatggactccaggaatcct

SEQ ID NO: 25223 - DNA, 22 bp, Artificial Sequence
  chemically synthesized
tggactccaggaatcctagcca

SEQ ID NO: 25224 - DNA, 22 bp, Artificial Sequence
  chemically synthesized
caggaatcctagccacaggaga

SEQ ID NO: 25225 - DNA, 22 bp, Artificial Sequence
  chemically synthesized
gccacaggagagtcccttgacc

SEQ ID NO: 25226 - DNA, 22 bp, Artificial Sequence
  chemically synthesized
gaccatgcaggccttgagacta

SEQ ID NO: 25227 - DNA, 22 bp, Artificial Sequence
  chemically synthesized
accatgcaggccttgagactat

SEQ ID NO: 25228 - DNA, 22 bp, Artificial Sequence
  chemically synthesized
gagactatcataaggaactgcc

SEQ ID NO: 25229 - DNA, 22 bp, Artificial Sequence
  chemically synthesized
agactatcataaggaactgccc

SEQ ID NO: 25230 - DNA, 22 bp, Artificial Sequence
  chemically synthesized
tcataaggaactgcccagcaat

SEQ ID NO: 25231 - DNA, 22 bp, Artificial Sequence
  chemically synthesized
cccagcaatcgcacaaaggcat

SEQ ID NO: 25232 - DNA, 22 bp, Artificial Sequence
  chemically synthesized
ctccagagaaggagctctcact

SEQ ID NO: 25233 - DNA, 22 bp, Artificial Sequence
  chemically synthesized
cagagaaggagctctcactggg

SEQ ID NO: 25234 - DNA, 22 bp, Artificial Sequence
  chemically synthesized
tcactgggtcccacccctgcca

SEQ ID NO: 25235 - DNA, 22 bp, Artificial Sequence
  chemically synthesized
actgggtcccacccctgccatc

SEQ ID NO: 25236 - DNA, 22 bp, Artificial Sequence
  chemically synthesized
ggtcccacccctgccatcccca

SEQ ID NO: 25237 - DNA, 22 bp, Artificial Sequence
  chemically synthesized
ccatccccattactgagcagca

SEQ ID NO: 25238 - DNA, 22 bp, Artificial Sequence
  chemically synthesized
ctgagcagcaaggtgccatttt

SEQ ID NO: 25239 - DNA, 22 bp, Artificial Sequence
  chemically synthesized
agcagcaaggtgccattttgag

SEQ ID NO: 25240 - DNA, 22 bp, Artificial Sequence
  chemically synthesized
tgagagcccaacacccaccaga

SEQ ID NO: 25241 - DNA, 22 bp, Artificial Sequence
  chemically synthesized
gagagcccaacacccaccagat

SEQ ID NO: 25242 - DNA, 22 bp, Artificial Sequence
  chemically synthesized
agagcccaacacccaccagatg

SEQ ID NO: 25243 - DNA, 22 bp, Artificial Sequence
  chemically synthesized
ctcagaccccaacatcatctgc

SEQ ID NO: 25244 - DNA, 22 bp, Artificial Sequence
  chemically synthesized
agaccccaacatcatctgcatc

SEQ ID NO: 25245 - DNA, 22 bp, Artificial Sequence
  chemically synthesized
catctctacatccctgaagctc

SEQ ID NO: 25246 - DNA, 22 bp, Artificial Sequence
  chemically synthesized
tacatccctgaagctctgctga

SEQ ID NO: 25247 - DNA, 22 bp, Artificial Sequence
  chemically synthesized
catccctgaagctctgctgaca

SEQ ID NO: 25248 - DNA, 22 bp, Artificial Sequence
  chemically synthesized
aagctctgctgacatcccccac

SEQ ID NO: 25249 - DNA, 22 bp, Artificial Sequence
  chemically synthesized
tgctgacatcccccacccacag

SEQ ID NO: 25250 - DNA, 22 bp, Artificial Sequence
  chemically synthesized
ctgacatcccccacccacagct

SEQ ID NO: 25251 - DNA, 22 bp, Artificial Sequence
  chemically synthesized
acatcccccacccacagctgag

SEQ ID NO: 25252 - DNA, 22 bp, Artificial Sequence
  chemically synthesized
agtgctactgctggctgctgtc

SEQ ID NO: 25253 - DNA, 22 bp, Artificial Sequence
  chemically synthesized
ctgctggctgctgtcaccaggg

SEQ ID NO: 25254 - DNA, 22 bp, Artificial Sequence
  chemically synthesized
ctggctgctgtcaccagggata

SEQ ID NO: 25255 - DNA, 22 bp, Artificial Sequence
  chemically synthesized
gctgctgtcaccagggataaag

SEQ ID NO: 25256 - DNA, 22 bp, Artificial Sequence
  chemically synthesized
ctgtcaccagggataaagtgtg

SEQ ID NO: 25257 - DNA, 22 bp, Artificial Sequence
  chemically synthesized
tcaccagggataaagtgtgtca

SEQ ID NO: 25258 - DNA, 22 bp, Artificial Sequence
  chemically synthesized
gaagtggactcccccaccccca

SEQ ID NO: 25259 - DNA, 22 bp, Artificial Sequence
  chemically synthesized
ccccacccccagtagcagggct

SEQ ID NO: 25260 - DNA, 22 bp, Artificial Sequence
  chemically synthesized
ctacacatttataagctcccta

SEQ ID NO: 25261 - DNA, 22 bp, Artificial Sequence
  chemically synthesized
cacatttataagctccctaaga

SEQ ID NO: 25262 - DNA, 22 bp, Artificial Sequence
  chemically synthesized
ataagctccctaagaaaatgct

SEQ ID NO: 25263 - DNA, 22 bp, Artificial Sequence
  chemically synthesized
taagctccctaagaaaatgcta

SEQ ID NO: 25264 - DNA, 22 bp, Artificial Sequence
  chemically synthesized
cctaagaaaatgctaccccact

SEQ ID NO: 25265 - DNA, 22 bp, Artificial Sequence
  chemically synthesized
agaaaatgctaccccacttgca

SEQ ID NO: 25266 - DNA, 22 bp, Artificial Sequence
  chemically synthesized
ccccacttgcagccaccatctg

SEQ ID NO: 25267 - DNA, 22 bp, Artificial Sequence
  chemically synthesized
gcagccaccatctggggctgaa

SEQ ID NO: 25268 - DNA, 22 bp, Artificial Sequence
  chemically synthesized
cagccaccatctggggctgaaa

SEQ ID NO: 25269 - DNA, 22 bp, Artificial Sequence
  chemically synthesized
gggctgaaacacatgcccacca

SEQ ID NO: 25270 - DNA, 22 bp, Artificial Sequence
  chemically synthesized
aaacacatgcccaccagcaacc

SEQ ID NO: 25271 - DNA, 22 bp, Artificial Sequence
  chemically synthesized
atagctgctgccactgaaagca

SEQ ID NO: 25272 - DNA, 22 bp, Artificial Sequence
  chemically synthesized
tagctgctgccactgaaagcaa

SEQ ID NO: 25273 - DNA, 22 bp, Artificial Sequence
  chemically synthesized
ctgccactgaaagcaacacacc

SEQ ID NO: 25274 - DNA, 22 bp, Artificial Sequence
  chemically synthesized
ccactgaaagcaacacaccccg

SEQ ID NO: 25275 - DNA, 22 bp, Artificial Sequence
  chemically synthesized
aaagcaacacaccccgcacccc

SEQ ID NO: 25276 - DNA, 22 bp, Artificial Sequence
  chemically synthesized
caagagcagggcaacaatgcag

SEQ ID NO: 25277 - DNA, 22 bp, Artificial Sequence
  chemically synthesized
aagagcagggcaacaatgcagt

SEQ ID NO: 25278 - DNA, 22 bp, Artificial Sequence
  chemically synthesized
ctaattcactcaggcattctgc

SEQ ID NO: 25279 - DNA, 22 bp, Artificial Sequence
  chemically synthesized
attcactcaggcattctgctgg

SEQ ID NO: 25280 - DNA, 22 bp, Artificial Sequence
  chemically synthesized
actcaggcattctgctgggggc

SEQ ID NO: 25281 - DNA, 22 bp, Artificial Sequence
  chemically synthesized
aggcattctgctgggggcctga

SEQ ID NO: 25282 - DNA, 22 bp, Artificial Sequence
  chemically synthesized
tgctgggggcctgaggatcact

SEQ ID NO: 25283 - DNA, 22 bp, Artificial Sequence
  chemically synthesized
ctgggggcctgaggatcactcc

SEQ ID NO: 25284 - DNA, 22 bp, Artificial Sequence
  chemically synthesized
ggggcctgaggatcactccact

SEQ ID NO: 25285 - DNA, 22 bp, Artificial Sequence
  chemically synthesized
aggatcactccactccagccta

SEQ ID NO: 25286 - DNA, 22 bp, Artificial Sequence
  chemically synthesized
cactccagcctatgatagccgg

SEQ ID NO: 25287 - DNA, 22 bp, Artificial Sequence
  chemically synthesized
cagcctatgatagccggtgtcc

SEQ ID NO: 25288 - DNA, 22 bp, Artificial Sequence
  chemically synthesized
tgatagccggtgtccacacaca

SEQ ID NO: 25289 - DNA, 22 bp, Artificial Sequence
  chemically synthesized
agtggcctgaggtcaggaacac

SEQ ID NO: 25290 - DNA, 22 bp, Artificial Sequence
  chemically synthesized
aggtcaggaacacccagcctgg

SEQ ID NO: 25291 - DNA, 22 bp, Artificial Sequence
  chemically synthesized
gctttgccttcctcaatgccta

SEQ ID NO: 25292 - DNA, 22 bp, Artificial Sequence
  chemically synthesized
tgccttcctcaatgcctaagca

SEQ ID NO: 25293 - DNA, 22 bp, Artificial Sequence
  chemically synthesized
gccttcctcaatgcctaagcaa

SEQ ID NO: 25294 - DNA, 22 bp, Artificial Sequence
  chemically synthesized
ccttcctcaatgcctaagcaag

SEQ ID NO: 25295 - DNA, 22 bp, Artificial Sequence
  chemically synthesized
cctcaatgcctaagcaagttgt

SEQ ID NO: 25296 - DNA, 22 bp, Artificial Sequence
  chemically synthesized
ctcaatgcctaagcaagttgtc

SEQ ID NO: 25297 - DNA, 22 bp, Artificial Sequence
  chemically synthesized
aatgcctaagcaagttgtctgg

SEQ ID NO: 25298 - DNA, 22 bp, Artificial Sequence
  chemically synthesized
agcaagttgtctgggaacccag

SEQ ID NO: 25299 - DNA, 22 bp, Artificial Sequence
  chemically synthesized
tctgggaacccagagacagcct

SEQ ID NO: 25300 - DNA, 22 bp, Artificial Sequence
  chemically synthesized
ggaacccagagacagccttgtg

SEQ ID NO: 25301 - DNA, 22 bp, Artificial Sequence
  chemically synthesized
gtgccatccaccatgactggta

SEQ ID NO: 25302 - DNA, 22 bp, Artificial Sequence
  chemically synthesized
tgccatccaccatgactggtac

SEQ ID NO: 25303 - DNA, 22 bp, Artificial Sequence
  chemically synthesized
gtacctaagcaaccctcccaga

SEQ ID NO: 25304 - DNA, 22 bp, Artificial Sequence
  chemically synthesized
agcaaccctcccagaagcctga

SEQ ID NO: 25305 - DNA, 22 bp, Artificial Sequence
  chemically synthesized
ccagaagcctgatgatgggcct

SEQ ID NO: 25306 - DNA, 22 bp, Artificial Sequence
  chemically synthesized
atgatgggcctacccaatctgc

SEQ ID NO: 25307 - DNA, 22 bp, Artificial Sequence
  chemically synthesized
cccaatctgccactgccatcac

SEQ ID NO: 25308 - DNA, 22 bp, Artificial Sequence
  chemically synthesized
ccactgccatcacaactggcac

SEQ ID NO: 25309 - DNA, 22 bp, Artificial Sequence
  chemically synthesized
ccatcacaactggcacctcctg

SEQ ID NO: 25310 - DNA, 22 bp, Artificial Sequence
  chemically synthesized
gcacctcctgcatgtgccacct

SEQ ID NO: 25311 - DNA, 22 bp, Artificial Sequence
  chemically synthesized
ctgcatgtgccacctgtgggtc

SEQ ID NO: 25312 - DNA, 22 bp, Artificial Sequence
  chemically synthesized
catgtgccacctgtgggtctga

SEQ ID NO: 25313 - DNA, 22 bp, Artificial Sequence
  chemically synthesized
tgggtctgaagactggctcatt

SEQ ID NO: 25314 - DNA, 22 bp, Artificial Sequence
  chemically synthesized
aagactggctcattcagccctt

SEQ ID NO: 25315 - DNA, 22 bp, Artificial Sequence
  chemically synthesized
gctcattcagcccttgcagcca

SEQ ID NO: 25316 - DNA, 22 bp, Artificial Sequence
  chemically synthesized
attcagcccttgcagccaccac

SEQ ID NO: 25317 - DNA, 22 bp, Artificial Sequence
  chemically synthesized
agcccttgcagccaccaccaac

SEQ ID NO: 25318 - DNA, 22 bp, Artificial Sequence
  chemically synthesized
gcagccaccaccaacaccagtg

SEQ ID NO: 25319 - DNA, 22 bp, Artificial Sequence
  chemically synthesized
cagccaccaccaacaccagtgc

SEQ ID NO: 25320 - DNA, 22 bp, Artificial Sequence
  chemically synthesized
cttgggagccagagggttgtcc

SEQ ID NO: 25321 - DNA, 22 bp, Artificial Sequence
  chemically synthesized
gggagccagagggttgtcctgc

SEQ ID NO: 25322 - DNA, 22 bp, Artificial Sequence
  chemically synthesized
ggagccagagggttgtcctgca

SEQ ID NO: 25323 - DNA, 22 bp, Artificial Sequence
  chemically synthesized
tcctgcagttgctacagccatc

SEQ ID NO: 25324 - DNA, 22 bp, Artificial Sequence
  chemically synthesized
cagttgctacagccatcaccca

SEQ ID NO: 25325 - DNA, 22 bp, Artificial Sequence
  chemically synthesized
ctacagccatcacccacaccac

SEQ ID NO: 25326 - DNA, 22 bp, Artificial Sequence
  chemically synthesized
cagccatcacccacaccacacc

SEQ ID NO: 25327 - DNA, 22 bp, Artificial Sequence
  chemically synthesized
tccagaagcctgaggacccaca

SEQ ID NO: 25328 - DNA, 22 bp, Artificial Sequence
  chemically synthesized
aggacccacacaccagcccagt

SEQ ID NO: 25329 - DNA, 22 bp, Artificial Sequence
  chemically synthesized
ctatggccactactgacaccca

SEQ ID NO: 25330 - DNA, 22 bp, Artificial Sequence
  chemically synthesized
tggccactactgacacccaagc

SEQ ID NO: 25331 - DNA, 22 bp, Artificial Sequence
  chemically synthesized
ctgacacccaagcaaactgcct

SEQ ID NO: 25332 - DNA, 22 bp, Artificial Sequence
  chemically synthesized
acacccaagcaaactgcctgaa

SEQ ID NO: 25333 - DNA, 22 bp, Artificial Sequence
  chemically synthesized
cctgaaggccaaagaatcaacc

SEQ ID NO: 25334 - DNA, 22 bp, Artificial Sequence
  chemically synthesized
aaggccaaagaatcaacccaac

SEQ ID NO: 25335 - DNA, 22 bp, Artificial Sequence
  chemically synthesized
gactcattaccatcagtgccaa

SEQ ID NO: 25336 - DNA, 22 bp, Artificial Sequence
  chemically synthesized
attaccatcagtgccaatgtac

SEQ ID NO: 25337 - DNA, 22 bp, Artificial Sequence
  chemically synthesized
ccatcagtgccaatgtacacag

SEQ ID NO: 25338 - DNA, 22 bp, Artificial Sequence
  chemically synthesized
ggcccaccaccaccactggggc

SEQ ID NO: 25339 - DNA, 22 bp, Artificial Sequence
  chemically synthesized
gggccaaggactggcccacttg

SEQ ID NO: 25340 - DNA, 22 bp, Artificial Sequence
  chemically synthesized
gcccacttgatattcttgtctc

SEQ ID NO: 25341 - DNA, 22 bp, Artificial Sequence
  chemically synthesized
gatattcttgtctccagcacaa

SEQ ID NO: 25342 - DNA, 22 bp, Artificial Sequence
  chemically synthesized
atattcttgtctccagcacaac

SEQ ID NO: 25343 - DNA, 22 bp, Artificial Sequence
  chemically synthesized
ttgtctccagcacaacctcatc

SEQ ID NO: 25344 - DNA, 22 bp, Artificial Sequence
  chemically synthesized
gtctccagcacaacctcatcac

SEQ ID NO: 25345 - DNA, 22 bp, Artificial Sequence
  chemically synthesized
tctccagcacaacctcatcacc

SEQ ID NO: 25346 - DNA, 22 bp, Artificial Sequence
  chemically synthesized
cagcacaacctcatcaccacct

SEQ ID NO: 25347 - DNA, 22 bp, Artificial Sequence
  chemically synthesized
atcaccaccttcactaacaaat

SEQ ID NO: 25348 - DNA, 22 bp, Artificial Sequence
  chemically synthesized
cactaacaaatgcaccctaagc

SEQ ID NO: 25349 - DNA, 22 bp, Artificial Sequence
  chemically synthesized
actaacaaatgcaccctaagcc

SEQ ID NO: 25350 - DNA, 22 bp, Artificial Sequence
  chemically synthesized
acaaatgcaccctaagccactg

SEQ ID NO: 25351 - DNA, 22 bp, Artificial Sequence
  chemically synthesized
agccactgaaaaaatcacagac

SEQ ID NO: 25352 - DNA, 22 bp, Artificial Sequence
  chemically synthesized
aaaaaatcacagacactgatga

SEQ ID NO: 25353 - DNA, 22 bp, Artificial Sequence
  chemically synthesized
atgatactgttggcagctgaaa

SEQ ID NO: 25354 - DNA, 22 bp, Artificial Sequence
  chemically synthesized
ttggcagctgaaaaaaaataat

SEQ ID NO: 25355 - DNA, 22 bp, Artificial Sequence
  chemically synthesized
gcagctgaaaaaaaataatatg

SEQ ID NO: 25356 - DNA, 22 bp, Artificial Sequence
  chemically synthesized
aaaaaaaataatatgaagacta

SEQ ID NO: 25357 - DNA, 22 bp, Artificial Sequence
  chemically synthesized
tgctgctgtatgcacctagaaa

SEQ ID NO: 25358 - DNA, 22 bp, Artificial Sequence
  chemically synthesized
ctgtatgcacctagaaatcaaa

SEQ ID NO: 25359 - DNA, 22 bp, Artificial Sequence
  chemically synthesized
tatgcacctagaaatcaaaatc

SEQ ID NO: 25360 - DNA, 22 bp, Artificial Sequence
  chemically synthesized
gaaatcaaaatcaaagtgccct

SEQ ID NO: 25361 - DNA, 22 bp, Artificial Sequence
  chemically synthesized
ctcaatcaacaccaagatacat

SEQ ID NO: 25362 - DNA, 22 bp, Artificial Sequence
  chemically synthesized
aatcaacaccaagatacatctt

SEQ ID NO: 25363 - DNA, 22 bp, Artificial Sequence
  chemically synthesized
cagaaaaaagtcttcccctaca

SEQ ID NO: 25364 - DNA, 22 bp, Artificial Sequence
  chemically synthesized
agaaaaaagtcttcccctacaa

SEQ ID NO: 25365 - DNA, 22 bp, Artificial Sequence
  chemically synthesized
cccctacaaaaacaaatttaca

SEQ ID NO: 25366 - DNA, 22 bp, Artificial Sequence
  chemically synthesized
ccctacaaaaacaaatttacaa

SEQ ID NO: 25367 - DNA, 22 bp, Artificial Sequence
  chemically synthesized
caaaaacaaatttacaaaactg

SEQ ID NO: 25368 - DNA, 22 bp, Artificial Sequence
  chemically synthesized
acaaaactggaagcagcaatca

SEQ ID NO: 25369 - DNA, 22 bp, Artificial Sequence
  chemically synthesized
caaaactggaagcagcaatcat

SEQ ID NO: 25370 - DNA, 22 bp, Artificial Sequence
  chemically synthesized
gaagcagcaatcattacaccag

SEQ ID NO: 25371 - DNA, 22 bp, Artificial Sequence
  chemically synthesized
caccagatgcagagatatcaat

SEQ ID NO: 25372 - DNA, 22 bp, Artificial Sequence
  chemically synthesized
ccaaaggaatttaataattctt

SEQ ID NO: 25373 - DNA, 22 bp, Artificial Sequence
  chemically synthesized
caaaggaatttaataattcttc

SEQ ID NO: 25374 - DNA, 22 bp, Artificial Sequence
  chemically synthesized
aataattcttcagcaacataag

SEQ ID NO: 25375 - DNA, 22 bp, Artificial Sequence
  chemically synthesized
ataattcttcagcaacataagc

SEQ ID NO: 25376 - DNA, 22 bp, Artificial Sequence
  chemically synthesized
ttcagcaacataagccagtgga

SEQ ID NO: 25377 - DNA, 22 bp, Artificial Sequence
  chemically synthesized
cagcaacataagccagtggaaa

SEQ ID NO: 25378 - DNA, 22 bp, Artificial Sequence
  chemically synthesized
agcaacataagccagtggaaaa

SEQ ID NO: 25379 - DNA, 22 bp, Artificial Sequence
  chemically synthesized
ataaaattctggaaaaaagaat

SEQ ID NO: 25380 - DNA, 22 bp, Artificial Sequence
  chemically synthesized
taaaattctggaaaaaagaatc

SEQ ID NO: 25381 - DNA, 22 bp, Artificial Sequence
  chemically synthesized
tggaaaaaagaatccaaaatgt

SEQ ID NO: 25382 - DNA, 22 bp, Artificial Sequence
  chemically synthesized
gaaaaaagaatccaaaatgttg

SEQ ID NO: 25383 - DNA, 22 bp, Artificial Sequence
  chemically synthesized
atattaaggaagctcagtgaga

SEQ ID NO: 25384 - DNA, 22 bp, Artificial Sequence
  chemically synthesized
aggaagctcagtgagacacaag

SEQ ID NO: 25385 - DNA, 22 bp, Artificial Sequence
  chemically synthesized
agtgagacacaagagaactcag

SEQ ID NO: 25386 - DNA, 22 bp, Artificial Sequence
  chemically synthesized
agataaacaataaaaagaaatc

SEQ ID NO: 25387 - DNA, 22 bp, Artificial Sequence
  chemically synthesized
aggatatgaatgagaaatttac

SEQ ID NO: 25388 - DNA, 22 bp, Artificial Sequence
  chemically synthesized
acccaagagatagatacaacaa

SEQ ID NO: 25389 - DNA, 22 bp, Artificial Sequence
  chemically synthesized
cccaagagatagatacaacaag

SEQ ID NO: 25390 - DNA, 22 bp, Artificial Sequence
  chemically synthesized
tgtaactgaagagtttattgaa

SEQ ID NO: 25391 - DNA, 22 bp, Artificial Sequence
  chemically synthesized
taactgaagagtttattgaaag

SEQ ID NO: 25392 - DNA, 22 bp, Artificial Sequence
  chemically synthesized
aagagtttattgaaagaaatac

SEQ ID NO: 25393 - DNA, 22 bp, Artificial Sequence
  chemically synthesized
attgaaagaaatacaaaataca

SEQ ID NO: 25394 - DNA, 22 bp, Artificial Sequence
  chemically synthesized
ttgaaagaaatacaaaatacat

SEQ ID NO: 25395 - DNA, 22 bp, Artificial Sequence
  chemically synthesized
aaagaaatacaaaatacattca

SEQ ID NO: 25396 - DNA, 22 bp, Artificial Sequence
  chemically synthesized
aaaaacttcaacaatagatcag

SEQ ID NO: 25397 - DNA, 22 bp, Artificial Sequence
  chemically synthesized
caacaatagatcagatcaagca

SEQ ID NO: 25398 - DNA, 22 bp, Artificial Sequence
  chemically synthesized
aacaatagatcagatcaagcag

SEQ ID NO: 25399 - DNA, 22 bp, Artificial Sequence
  chemically synthesized
cagaacttgaagacaggtcttt

SEQ ID NO: 25400 - DNA, 22 bp, Artificial Sequence
  chemically synthesized
agaacttgaagacaggtctttt

SEQ ID NO: 25401 - DNA, 22 bp, Artificial Sequence
  chemically synthesized
gaagacaggtcttttaaaatta

SEQ ID NO: 25402 - DNA, 22 bp, Artificial Sequence
  chemically synthesized
aagacaggtcttttaaaattag

SEQ ID NO: 25403 - DNA, 22 bp, Artificial Sequence
  chemically synthesized
ttaaaattagctggtcaaatga

SEQ ID NO: 25404 - DNA, 22 bp, Artificial Sequence
  chemically synthesized
taaaattagctggtcaaatgat

SEQ ID NO: 25405 - DNA, 22 bp, Artificial Sequence
  chemically synthesized
aaaattagctggtcaaatgata

SEQ ID NO: 25406 - DNA, 22 bp, Artificial Sequence
  chemically synthesized
aaattagctggtcaaatgatag

SEQ ID NO: 25407 - DNA, 22 bp, Artificial Sequence
  chemically synthesized
gctggtcaaatgatagaaagga

SEQ ID NO: 25408 - DNA, 22 bp, Artificial Sequence
  chemically synthesized
gtcaaatgatagaaaggaaaaa

SEQ ID NO: 25409 - DNA, 22 bp, Artificial Sequence
  chemically synthesized
taaagtgaacaaatattcaaat

SEQ ID NO: 25410 - DNA, 22 bp, Artificial Sequence
  chemically synthesized
aaatttgcagtttcccagaagg

SEQ ID NO: 25411 - DNA, 22 bp, Artificial Sequence
  chemically synthesized
gcagtttcccagaaggtaaaga

SEQ ID NO: 25412 - DNA, 22 bp, Artificial Sequence
  chemically synthesized
cagtttcccagaaggtaaagag

SEQ ID NO: 25413 - DNA, 22 bp, Artificial Sequence
  chemically synthesized
cccagaaggtaaagagaacatg

SEQ ID NO: 25414 - DNA, 22 bp, Artificial Sequence
  chemically synthesized
ccagaaggtaaagagaacatga

SEQ ID NO: 25415 - DNA, 22 bp, Artificial Sequence
  chemically synthesized
cgtaacaacacaatagctgaaa

SEQ ID NO: 25416 - DNA, 22 bp, Artificial Sequence
  chemically synthesized
aaaacttgtcaagtctagcaag

SEQ ID NO: 25417 - DNA, 22 bp, Artificial Sequence
  chemically synthesized
gtcaagtctagcaagaaatgta

SEQ ID NO: 25418 - DNA, 22 bp, Artificial Sequence
  chemically synthesized
tcaagtctagcaagaaatgtag

SEQ ID NO: 25419 - DNA, 22 bp, Artificial Sequence
  chemically synthesized
gcaagaaatgtagacatccaga

SEQ ID NO: 25420 - DNA, 22 bp, Artificial Sequence
  chemically synthesized
ccaaataatataatgcaaaaag

SEQ ID NO: 25421 - DNA, 22 bp, Artificial Sequence
  chemically synthesized
ttctccacagcacattatagtc

SEQ ID NO: 25422 - DNA, 22 bp, Artificial Sequence
  chemically synthesized
ctccacagcacattatagtcaa

SEQ ID NO: 25423 - DNA, 22 bp, Artificial Sequence
  chemically synthesized
tccacagcacattatagtcaaa

SEQ ID NO: 25424 - DNA, 22 bp, Artificial Sequence
  chemically synthesized
cacagcacattatagtcaaact

SEQ ID NO: 25425 - DNA, 22 bp, Artificial Sequence
  chemically synthesized
tagtcaaactgtcaaaagccaa

SEQ ID NO: 25426 - DNA, 22 bp, Artificial Sequence
  chemically synthesized
tcaaaagccaaagagtaagaac

SEQ ID NO: 25427 - DNA, 22 bp, Artificial Sequence
  chemically synthesized
taaaacagcaagcaaaatgtct

SEQ ID NO: 25428 - DNA, 22 bp, Artificial Sequence
  chemically synthesized
aaacagcaagcaaaatgtctag

SEQ ID NO: 25429 - DNA, 22 bp, Artificial Sequence
  chemically synthesized
gtcacttataagggaacttcca

SEQ ID NO: 25430 - DNA, 22 bp, Artificial Sequence
  chemically synthesized
ataagggaacttccacaagatt

SEQ ID NO: 25431 - DNA, 22 bp, Artificial Sequence
  chemically synthesized
taagggaacttccacaagatta

SEQ ID NO: 25432 - DNA, 22 bp, Artificial Sequence
  chemically synthesized
ccacaagattaacagattaaca

SEQ ID NO: 25433 - DNA, 22 bp, Artificial Sequence
  chemically synthesized
cacaagattaacagattaacag

SEQ ID NO: 25434 - DNA, 22 bp, Artificial Sequence
  chemically synthesized
acagattaacagcagatttctc

SEQ ID NO: 25435 - DNA, 22 bp, Artificial Sequence
  chemically synthesized
acagcagatttctcagcagaaa

SEQ ID NO: 25436 - DNA, 22 bp, Artificial Sequence
  chemically synthesized
ctcagcagaaacctcacaggcc

SEQ ID NO: 25437 - DNA, 22 bp, Artificial Sequence
  chemically synthesized
tcagcagaaacctcacaggcca

SEQ ID NO: 25438 - DNA, 22 bp, Artificial Sequence
  chemically synthesized
agcagaaacctcacaggccagg

SEQ ID NO: 25439 - DNA, 22 bp, Artificial Sequence
  chemically synthesized
acaggccaggagaagatgggat

SEQ ID NO: 25440 - DNA, 22 bp, Artificial Sequence
  chemically synthesized
aaaatagtgaaagaaaaaaatg

SEQ ID NO: 25441 - DNA, 22 bp, Artificial Sequence
  chemically synthesized
tacccagcaacattgttcttca

SEQ ID NO: 25442 - DNA, 22 bp, Artificial Sequence
  chemically synthesized
ttcttcaaaaatgaaggataaa

SEQ ID NO: 25443 - DNA, 22 bp, Artificial Sequence
  chemically synthesized
ttcaaaaatgaaggataaataa

SEQ ID NO: 25444 - DNA, 22 bp, Artificial Sequence
  chemically synthesized
caaaaatgaaggataaataaaa

SEQ ID NO: 25445 - DNA, 22 bp, Artificial Sequence
  chemically synthesized
aaaaatgaaggataaataaaat

SEQ ID NO: 25446 - DNA, 22 bp, Artificial Sequence
  chemically synthesized
ttctgggcaagaaaaatttgaa

SEQ ID NO: 25447 - DNA, 22 bp, Artificial Sequence
  chemically synthesized
tctgggcaagaaaaatttgaag

SEQ ID NO: 25448 - DNA, 22 bp, Artificial Sequence
  chemically synthesized
ctgggcaagaaaaatttgaagg

SEQ ID NO: 25449 - DNA, 22 bp, Artificial Sequence
  chemically synthesized
tgggcaagaaaaatttgaagga

SEQ ID NO: 25450 - DNA, 22 bp, Artificial Sequence
  chemically synthesized
ggcaagaaaaatttgaaggaat

SEQ ID NO: 25451 - DNA, 22 bp, Artificial Sequence
  chemically synthesized
gaaggaattcactatcactaga

SEQ ID NO: 25452 - DNA, 22 bp, Artificial Sequence
  chemically synthesized
aaggaattcactatcactagac

SEQ ID NO: 25453 - DNA, 22 bp, Artificial Sequence
  chemically synthesized
actatcactagactggctttac

SEQ ID NO: 25454 - DNA, 22 bp, Artificial Sequence
  chemically synthesized
tcactagactggctttacaaga

SEQ ID NO: 25455 - DNA, 22 bp, Artificial Sequence
  chemically synthesized
gactggctttacaagaaatatt

SEQ ID NO: 25456 - DNA, 22 bp, Artificial Sequence
  chemically synthesized
gctttacaagaaatatttaagg

SEQ ID NO: 25457 - DNA, 22 bp, Artificial Sequence
  chemically synthesized
tacaagaaatatttaagggagt

SEQ ID NO: 25458 - DNA, 22 bp, Artificial Sequence
  chemically synthesized
acaagaaatatttaagggagtc

SEQ ID NO: 25459 - DNA, 22 bp, Artificial Sequence
  chemically synthesized
caagaaatatttaagggagtcc

SEQ ID NO: 25460 - DNA, 22 bp, Artificial Sequence
  chemically synthesized
aagggagtcctacacatgaaag

SEQ ID NO: 25461 - DNA, 22 bp, Artificial Sequence
  chemically synthesized
agggagtcctacacatgaaagt

SEQ ID NO: 25462 - DNA, 22 bp, Artificial Sequence
  chemically synthesized
cacatgaaagtgacaggacact

SEQ ID NO: 25463 - DNA, 22 bp, Artificial Sequence
  chemically synthesized
ccattatgaagacacacaaagg

SEQ ID NO: 25464 - DNA, 22 bp, Artificial Sequence
  chemically synthesized
tgaagacacacaaaggtataca

SEQ ID NO: 25465 - DNA, 22 bp, Artificial Sequence
  chemically synthesized
actggtagagcaaaacacaaat

SEQ ID NO: 25466 - DNA, 22 bp, Artificial Sequence
  chemically synthesized
gtagagcaaaacacaaataaag

SEQ ID NO: 25467 - DNA, 22 bp, Artificial Sequence
  chemically synthesized
aaacgttaccactacagaaaat

SEQ ID NO: 25468 - DNA, 22 bp, Artificial Sequence
  chemically synthesized
ccactacagaaaatcaccaaac

SEQ ID NO: 25469 - DNA, 22 bp, Artificial Sequence
  chemically synthesized
cagaaaatcaccaaaccacaat

SEQ ID NO: 25470 - DNA, 22 bp, Artificial Sequence
  chemically synthesized
aaaaaaaaacaaaacaaccagg

SEQ ID NO: 25471 - DNA, 22 bp, Artificial Sequence
  chemically synthesized
acaaaatggcaggaataagctc

SEQ ID NO: 25472 - DNA, 22 bp, Artificial Sequence
  chemically synthesized
tcacatgtcaataatagccttg

SEQ ID NO: 25473 - DNA, 22 bp, Artificial Sequence
  chemically synthesized
acatgtcaataatagccttgca

SEQ ID NO: 25474 - DNA, 22 bp, Artificial Sequence
  chemically synthesized
gcatgtaaatggattaaattgt

SEQ ID NO: 25475 - DNA, 22 bp, Artificial Sequence
  chemically synthesized
catgtaaatggattaaattgtt

SEQ ID NO: 25476 - DNA, 22 bp, Artificial Sequence
  chemically synthesized
aattgttacttgaaagatatag

SEQ ID NO: 25477 - DNA, 22 bp, Artificial Sequence
  chemically synthesized
ttacttgaaagatatagactgg

SEQ ID NO: 25478 - DNA, 22 bp, Artificial Sequence
  chemically synthesized
cttgaaagatatagactggcta

SEQ ID NO: 25479 - DNA, 22 bp, Artificial Sequence
  chemically synthesized
gaaagatatagactggctaaat

SEQ ID NO: 25480 - DNA, 22 bp, Artificial Sequence
  chemically synthesized
aaagatatagactggctaaata

SEQ ID NO: 25481 - DNA, 22 bp, Artificial Sequence
  chemically synthesized
gctaaatagatttaaaacaaaa

SEQ ID NO: 25482 - DNA, 22 bp, Artificial Sequence
  chemically synthesized
aatagatttaaaacaaaaatat

SEQ ID NO: 25483 - DNA, 22 bp, Artificial Sequence
  chemically synthesized
aaaacaaaaatatgacccagtt

SEQ ID NO: 25484 - DNA, 22 bp, Artificial Sequence
  chemically synthesized
aaacaaaaatatgacccagttg

SEQ ID NO: 25485 - DNA, 22 bp, Artificial Sequence
  chemically synthesized
taagctgcctataagaaactta

SEQ ID NO: 25486 - DNA, 22 bp, Artificial Sequence
  chemically synthesized
cctataagaaacttatctcact

SEQ ID NO: 25487 - DNA, 22 bp, Artificial Sequence
  chemically synthesized
taagaaacttatctcacttgta

SEQ ID NO: 25488 - DNA, 22 bp, Artificial Sequence
  chemically synthesized
atctcacttgtaaagataaata

SEQ ID NO: 25489 - DNA, 22 bp, Artificial Sequence
  chemically synthesized
tctcacttgtaaagataaatat

SEQ ID NO: 25490 - DNA, 22 bp, Artificial Sequence
  chemically synthesized
acttgtaaagataaatatagac

SEQ ID NO: 25491 - DNA, 22 bp, Artificial Sequence
  chemically synthesized
gtaaagataaatatagactgaa

SEQ ID NO: 25492 - DNA, 22 bp, Artificial Sequence
  chemically synthesized
taaagataaatatagactgaaa

SEQ ID NO: 25493 - DNA, 22 bp, Artificial Sequence
  chemically synthesized
aaagtaaaaagatgaaagatct

SEQ ID NO: 25494 - DNA, 22 bp, Artificial Sequence
  chemically synthesized
ccatacaaagagaaaccaaaaa

SEQ ID NO: 25495 - DNA, 22 bp, Artificial Sequence
  chemically synthesized
catacaaagagaaaccaaaaat

SEQ ID NO: 25496 - DNA, 22 bp, Artificial Sequence
  chemically synthesized
tacctataacagataaaattga

SEQ ID NO: 25497 - DNA, 22 bp, Artificial Sequence
  chemically synthesized
taacagataaaattgactttaa

SEQ ID NO: 25498 - DNA, 22 bp, Artificial Sequence
  chemically synthesized
actttaaataaaaaacactaag

SEQ ID NO: 25499 - DNA, 22 bp, Artificial Sequence
  chemically synthesized
taaataaaaaacactaagagac

SEQ ID NO: 25500 - DNA, 22 bp, Artificial Sequence
  chemically synthesized
aaataaaaaacactaagagaca

SEQ ID NO: 25501 - DNA, 22 bp, Artificial Sequence
  chemically synthesized
aataaaaaacactaagagacaa

SEQ ID NO: 25502 - DNA, 22 bp, Artificial Sequence
  chemically synthesized
agagacaaaagtcattacataa

SEQ ID NO: 25503 - DNA, 22 bp, Artificial Sequence
  chemically synthesized
cataatgataaaaggaacaatt

SEQ ID NO: 25504 - DNA, 22 bp, Artificial Sequence
  chemically synthesized
agcaagagtatataacaattct

SEQ ID NO: 25505 - DNA, 22 bp, Artificial Sequence
  chemically synthesized
taaacattcacactcaacacca

SEQ ID NO: 25506 - DNA, 22 bp, Artificial Sequence
  chemically synthesized
aacattcacactcaacaccaga

SEQ ID NO: 25507 - DNA, 22 bp, Artificial Sequence
  chemically synthesized
acactcaacaccagagcatcca

SEQ ID NO: 25508 - DNA, 22 bp, Artificial Sequence
  chemically synthesized
aacaccagagcatccagatatg

SEQ ID NO: 25509 - DNA, 22 bp, Artificial Sequence
  chemically synthesized
ttagatataaagggtgaaatag

SEQ ID NO: 25510 - DNA, 22 bp, Artificial Sequence
  chemically synthesized
gatataaagggtgaaatagaat

SEQ ID NO: 25511 - DNA, 22 bp, Artificial Sequence
  chemically synthesized
gggatttcaacattctaatctc

SEQ ID NO: 25512 - DNA, 22 bp, Artificial Sequence
  chemically synthesized
caacattctaatctcagcatca

SEQ ID NO: 25513 - DNA, 22 bp, Artificial Sequence
  chemically synthesized
aacattctaatctcagcatcag

SEQ ID NO: 25514 - DNA, 22 bp, Artificial Sequence
  chemically synthesized
taatctcagcatcagatagatc

SEQ ID NO: 25515 - DNA, 22 bp, Artificial Sequence
  chemically synthesized
atctcagcatcagatagatcat

SEQ ID NO: 25516 - DNA, 22 bp, Artificial Sequence
  chemically synthesized
agcatcagatagatcatctaga

SEQ ID NO: 25517 - DNA, 22 bp, Artificial Sequence
  chemically synthesized
gacagaaaattaacaaagaaac

SEQ ID NO: 25518 - DNA, 22 bp, Artificial Sequence
  chemically synthesized
acaaagaaacattggatttaaa

SEQ ID NO: 25519 - DNA, 22 bp, Artificial Sequence
  chemically synthesized
gatttaaacttgactttagacc

SEQ ID NO: 25520 - DNA, 22 bp, Artificial Sequence
  chemically synthesized
aaacttgactttagaccaaatg

SEQ ID NO: 25521 - DNA, 22 bp, Artificial Sequence
  chemically synthesized
aacttgactttagaccaaatgg

SEQ ID NO: 25522 - DNA, 22 bp, Artificial Sequence
  chemically synthesized
gactttagaccaaatggatcta

SEQ ID NO: 25523 - DNA, 22 bp, Artificial Sequence
  chemically synthesized
actttagaccaaatggatctaa

SEQ ID NO: 25524 - DNA, 22 bp, Artificial Sequence
  chemically synthesized
tagaccaaatggatctaacatt

SEQ ID NO: 25525 - DNA, 22 bp, Artificial Sequence
  chemically synthesized
agaccaaatggatctaacattt

SEQ ID NO: 25526 - DNA, 22 bp, Artificial Sequence
  chemically synthesized
gaccaaatggatctaacattta

SEQ ID NO: 25527 - DNA, 22 bp, Artificial Sequence
  chemically synthesized
acatttacacaatatttcatcc

SEQ ID NO: 25528 - DNA, 22 bp, Artificial Sequence
  chemically synthesized
acacaatatttcatccaacagc

SEQ ID NO: 25529 - DNA, 22 bp, Artificial Sequence
  chemically synthesized
cacaatatttcatccaacagct

SEQ ID NO: 25530 - DNA, 22 bp, Artificial Sequence
  chemically synthesized
catccaacagctacagaatata

SEQ ID NO: 25531 - DNA, 22 bp, Artificial Sequence
  chemically synthesized
atccaacagctacagaatatat

SEQ ID NO: 25532 - DNA, 22 bp, Artificial Sequence
  chemically synthesized
cagaatatatttatctcatcag

SEQ ID NO: 25533 - DNA, 22 bp, Artificial Sequence
  chemically synthesized
atctcatcagcacatgacgcat

SEQ ID NO: 25534 - DNA, 22 bp, Artificial Sequence
  chemically synthesized
tctcatcagcacatgacgcatt

SEQ ID NO: 25535 - DNA, 22 bp, Artificial Sequence
  chemically synthesized
atcagcacatgacgcattcccc

SEQ ID NO: 25536 - DNA, 22 bp, Artificial Sequence
  chemically synthesized
cccaggatacaccatatgttag

SEQ ID NO: 25537 - DNA, 22 bp, Artificial Sequence
  chemically synthesized
gaacacaaaagaagtctcaact

SEQ ID NO: 25538 - DNA, 22 bp, Artificial Sequence
  chemically synthesized
aactaatttgaaatatttgaaa

SEQ ID NO: 25539 - DNA, 22 bp, Artificial Sequence
  chemically synthesized
atttgaaatatttgaaatcata

SEQ ID NO: 25540 - DNA, 22 bp, Artificial Sequence
  chemically synthesized
gaaatatttgaaatcatattaa

SEQ ID NO: 25541 - DNA, 22 bp, Artificial Sequence
  chemically synthesized
aaatatttgaaatcatattaag

SEQ ID NO: 25542 - DNA, 22 bp, Artificial Sequence
  chemically synthesized
gaaatcatattaagcatcttct

SEQ ID NO: 25543 - DNA, 22 bp, Artificial Sequence
  chemically synthesized
aaatcatattaagcatcttctc

SEQ ID NO: 25544 - DNA, 22 bp, Artificial Sequence
  chemically synthesized
agcatcttctcagaccacaatg

SEQ ID NO: 25545 - DNA, 22 bp, Artificial Sequence
  chemically synthesized
ctcagaccacaatggaataaaa

SEQ ID NO: 25546 - DNA, 22 bp, Artificial Sequence
  chemically synthesized
tcagaccacaatggaataaaac

SEQ ID NO: 25547 - DNA, 22 bp, Artificial Sequence
  chemically synthesized
agaccacaatggaataaaacta

SEQ ID NO: 25548 - DNA, 22 bp, Artificial Sequence
  chemically synthesized
gaaatcaataacaagaaaaact

SEQ ID NO: 25549 - DNA, 22 bp, Artificial Sequence
  chemically synthesized
taaaacctatacaaatacatgg

SEQ ID NO: 25550 - DNA, 22 bp, Artificial Sequence
  chemically synthesized
aaaacctatacaaatacatgga

SEQ ID NO: 25551 - DNA, 22 bp, Artificial Sequence
  chemically synthesized
aaacctatacaaatacatggaa

SEQ ID NO: 25552 - DNA, 22 bp, Artificial Sequence
  chemically synthesized
tacaaatacatggaaattaaac

SEQ ID NO: 25553 - DNA, 22 bp, Artificial Sequence
  chemically synthesized
aacaacatgctcctgaatgaac

SEQ ID NO: 25554 - DNA, 22 bp, Artificial Sequence
  chemically synthesized
ctgaatgaacgttatgtcaaga

SEQ ID NO: 25555 - DNA, 22 bp, Artificial Sequence
  chemically synthesized
aatgaacgttatgtcaagaaga

SEQ ID NO: 25556 - DNA, 22 bp, Artificial Sequence
  chemically synthesized
tgtcaagaagaaaattaagaag

SEQ ID NO: 25557 - DNA, 22 bp, Artificial Sequence
  chemically synthesized
agaaggaaatcaaaaatttttt

SEQ ID NO: 25558 - DNA, 22 bp, Artificial Sequence
  chemically synthesized
tttgaaacaaatgaaaattgaa

SEQ ID NO: 25559 - DNA, 22 bp, Artificial Sequence
  chemically synthesized
ttgaaacaaatgaaaattgaaa

SEQ ID NO: 25560 - DNA, 22 bp, Artificial Sequence
  chemically synthesized
tgaaacaaatgaaaattgaaat

SEQ ID NO: 25561 - DNA, 22 bp, Artificial Sequence
  chemically synthesized
gaaacaaatgaaaattgaaata

SEQ ID NO: 25562 - DNA, 22 bp, Artificial Sequence
  chemically synthesized
aaacaaatgaaaattgaaatac

SEQ ID NO: 25563 - DNA, 22 bp, Artificial Sequence
  chemically synthesized
aaatacaacataggaaaagcca

SEQ ID NO: 25564 - DNA, 22 bp, Artificial Sequence
  chemically synthesized
agagagaagcttatcaataaac

SEQ ID NO: 25565 - DNA, 22 bp, Artificial Sequence
  chemically synthesized
atcaataaacacttaaattaaa

SEQ ID NO: 25566 - DNA, 22 bp, Artificial Sequence
  chemically synthesized
tcaataaacacttaaattaaaa

SEQ ID NO: 25567 - DNA, 22 bp, Artificial Sequence
  chemically synthesized
aaattaaaaacatagaaagatt

SEQ ID NO: 25568 - DNA, 22 bp, Artificial Sequence
  chemically synthesized
aattaaaaacatagaaagattt

SEQ ID NO: 25569 - DNA, 22 bp, Artificial Sequence
  chemically synthesized
aaaacatagaaagatttcaaat

SEQ ID NO: 25570 - DNA, 22 bp, Artificial Sequence
  chemically synthesized
caaatatataatctaatcatgt

SEQ ID NO: 25571 - DNA, 22 bp, Artificial Sequence
  chemically synthesized
aaatatataatctaatcatgta

SEQ ID NO: 25572 - DNA, 22 bp, Artificial Sequence
  chemically synthesized
atcatgtacctcaacaagctag

SEQ ID NO: 25573 - DNA, 22 bp, Artificial Sequence
  chemically synthesized
aacaagctagaaaagcaagaac

SEQ ID NO: 25574 - DNA, 22 bp, Artificial Sequence
  chemically synthesized
gaaaagcaagaacaaaacccaa

SEQ ID NO: 25575 - DNA, 22 bp, Artificial Sequence
  chemically synthesized
gcagaaggaaagaaaaaatgaa

SEQ ID NO: 25576 - DNA, 22 bp, Artificial Sequence
  chemically synthesized
aatgaaatagagaaaaacaaca

SEQ ID NO: 25577 - DNA, 22 bp, Artificial Sequence
  chemically synthesized
atgaaatagagaaaaacaacaa

SEQ ID NO: 25578 - DNA, 22 bp, Artificial Sequence
  chemically synthesized
gcaaaatgaaaagttgttattt

SEQ ID NO: 25579 - DNA, 22 bp, Artificial Sequence
  chemically synthesized
ttatttaaaaaagataaaatgg

SEQ ID NO: 25580 - DNA, 22 bp, Artificial Sequence
  chemically synthesized
tttaaaaaagataaaatggata

SEQ ID NO: 25581 - DNA, 22 bp, Artificial Sequence
  chemically synthesized
aaaaaagataaaatggatatag

SEQ ID NO: 25582 - DNA, 22 bp, Artificial Sequence
  chemically synthesized
aaaaagataaaatggatatagc

SEQ ID NO: 25583 - DNA, 22 bp, Artificial Sequence
  chemically synthesized
tagctagactaaccaagaaaaa

SEQ ID NO: 25584 - DNA, 22 bp, Artificial Sequence
  chemically synthesized
gctagactaaccaagaaaaaga

SEQ ID NO: 25585 - DNA, 22 bp, Artificial Sequence
  chemically synthesized
gactaaccaagaaaaagagaag

SEQ ID NO: 25586 - DNA, 22 bp, Artificial Sequence
  chemically synthesized
accaagaaaaagagaagagact

SEQ ID NO: 25587 - DNA, 22 bp, Artificial Sequence
  chemically synthesized
aaataaagaaaatcagaaataa

SEQ ID NO: 25588 - DNA, 22 bp, Artificial Sequence
  chemically synthesized
caaccgataccacagaaataga

SEQ ID NO: 25589 - DNA, 22 bp, Artificial Sequence
  chemically synthesized
tcagagactattatgaacaacc

SEQ ID NO: 25590 - DNA, 22 bp, Artificial Sequence
  chemically synthesized
ttatgaacaaccatacactaaa

SEQ ID NO: 25591 - DNA, 22 bp, Artificial Sequence
  chemically synthesized
tgaacaaccatacactaaaaaa

SEQ ID NO: 25592 - DNA, 22 bp, Artificial Sequence
  chemically synthesized
aaaaactgaaaaatctagagga

SEQ ID NO: 25593 - DNA, 22 bp, Artificial Sequence
  chemically synthesized
aaaaatctagaggaaattaata

SEQ ID NO: 25594 - DNA, 22 bp, Artificial Sequence
  chemically synthesized
gaggaaattaataaatttctgg

SEQ ID NO: 25595 - DNA, 22 bp, Artificial Sequence
  chemically synthesized
ataaatttctggacacatacca

SEQ ID NO: 25596 - DNA, 22 bp, Artificial Sequence
  chemically synthesized
ctggacacataccacctaccaa

SEQ ID NO: 25597 - DNA, 22 bp, Artificial Sequence
  chemically synthesized
tggacacataccacctaccaag

SEQ ID NO: 25598 - DNA, 22 bp, Artificial Sequence
  chemically synthesized
gacacataccacctaccaagat

SEQ ID NO: 25599 - DNA, 22 bp, Artificial Sequence
  chemically synthesized
ccaagattgaattaagaaagaa

SEQ ID NO: 25600 - DNA, 22 bp, Artificial Sequence
  chemically synthesized
aattaagaaagaatagaaaacc

SEQ ID NO: 25601 - DNA, 22 bp, Artificial Sequence
  chemically synthesized
agaaagaatagaaaacctgaac

SEQ ID NO: 25602 - DNA, 22 bp, Artificial Sequence
  chemically synthesized
aacagaccagtaatgaataatg

SEQ ID NO: 25603 - DNA, 22 bp, Artificial Sequence
  chemically synthesized
aatcagtagtaaaaagtctccc

SEQ ID NO: 25604 - DNA, 22 bp, Artificial Sequence
  chemically synthesized
ccaaaaaagaaaatttcaagac

SEQ ID NO: 25605 - DNA, 22 bp, Artificial Sequence
  chemically synthesized
caagaccagatggctttactgt

SEQ ID NO: 25606 - DNA, 22 bp, Artificial Sequence
  chemically synthesized
aagaccagatggctttactgtc

SEQ ID NO: 25607 - DNA, 22 bp, Artificial Sequence
  chemically synthesized
tactgtcaaattttaccaaact

SEQ ID NO: 25608 - DNA, 22 bp, Artificial Sequence
  chemically synthesized
actgtcaaattttaccaaactt

SEQ ID NO: 25609 - DNA, 22 bp, Artificial Sequence
  chemically synthesized
ctgtcaaattttaccaaacttt

SEQ ID NO: 25610 - DNA, 22 bp, Artificial Sequence
  chemically synthesized
tcaaattttaccaaactttcaa

SEQ ID NO: 25611 - DNA, 22 bp, Artificial Sequence
  chemically synthesized
taccaaactttcaaagaaaact

SEQ ID NO: 25612 - DNA, 22 bp, Artificial Sequence
  chemically synthesized
accaaactttcaaagaaaacta

SEQ ID NO: 25613 - DNA, 22 bp, Artificial Sequence
  chemically synthesized
ccaaactttcaaagaaaactaa

SEQ ID NO: 25614 - DNA, 22 bp, Artificial Sequence
  chemically synthesized
tcaaagaaaactaacaagtctc

SEQ ID NO: 25615 - DNA, 22 bp, Artificial Sequence
  chemically synthesized
caaagaaaactaacaagtctcc

SEQ ID NO: 25616 - DNA, 22 bp, Artificial Sequence
  chemically synthesized
aaagaaaactaacaagtctcct

SEQ ID NO: 25617 - DNA, 22 bp, Artificial Sequence
  chemically synthesized
acaagtctccttaaattctttt

SEQ ID NO: 25618 - DNA, 22 bp, Artificial Sequence
  chemically synthesized
cttaaattcttttaaaaattaa

SEQ ID NO: 25619 - DNA, 22 bp, Artificial Sequence
  chemically synthesized
aaattcttttaaaaattaaaca

SEQ ID NO: 25620 - DNA, 22 bp, Artificial Sequence
  chemically synthesized
aattcttttaaaaattaaacag

SEQ ID NO: 25621 - DNA, 22 bp, Artificial Sequence
  chemically synthesized
ttttaaaaattaaacaggaagg

SEQ ID NO: 25622 - DNA, 22 bp, Artificial Sequence
  chemically synthesized
ttaaaaattaaacaggaaggaa

SEQ ID NO: 25623 - DNA, 22 bp, Artificial Sequence
  chemically synthesized
taaaaattaaacaggaaggaat

SEQ ID NO: 25624 - DNA, 22 bp, Artificial Sequence
  chemically synthesized
aaaaattaaacaggaaggaatt

SEQ ID NO: 25625 - DNA, 22 bp, Artificial Sequence
  chemically synthesized
aaaattaaacaggaaggaattc

SEQ ID NO: 25626 - DNA, 22 bp, Artificial Sequence
  chemically synthesized
aacaggaaggaattctccctaa

SEQ ID NO: 25627 - DNA, 22 bp, Artificial Sequence
  chemically synthesized
tccctaactcattctctgaggc

SEQ ID NO: 25628 - DNA, 22 bp, Artificial Sequence
  chemically synthesized
cctaactcattctctgaggcca

SEQ ID NO: 25629 - DNA, 22 bp, Artificial Sequence
  chemically synthesized
actcattctctgaggccagtat

SEQ ID NO: 25630 - DNA, 22 bp, Artificial Sequence
  chemically synthesized
attctctgaggccagtattatc

SEQ ID NO: 25631 - DNA, 22 bp, Artificial Sequence
  chemically synthesized
tctgaggccagtattatcctga

SEQ ID NO: 25632 - DNA, 22 bp, Artificial Sequence
  chemically synthesized
tgaggccagtattatcctgatt

SEQ ID NO: 25633 - DNA, 22 bp, Artificial Sequence
  chemically synthesized
aggccagtattatcctgattcc

SEQ ID NO: 25634 - DNA, 22 bp, Artificial Sequence
  chemically synthesized
tcctgattccataaccagacaa

SEQ ID NO: 25635 - DNA, 22 bp, Artificial Sequence
  chemically synthesized
attccataaccagacaaggatg

SEQ ID NO: 25636 - DNA, 22 bp, Artificial Sequence
  chemically synthesized
cataaccagacaaggatgcaag

SEQ ID NO: 25637 - DNA, 22 bp, Artificial Sequence
  chemically synthesized
caggtcaatatccctgatggaa

SEQ ID NO: 25638 - DNA, 22 bp, Artificial Sequence
  chemically synthesized
atggaacataggtgtgaaaatc

SEQ ID NO: 25639 - DNA, 22 bp, Artificial Sequence
  chemically synthesized
aacaaaatactagcaaactgaa

SEQ ID NO: 25640 - DNA, 22 bp, Artificial Sequence
  chemically synthesized
gcaaactgaatccaacagtaca

SEQ ID NO: 25641 - DNA, 22 bp, Artificial Sequence
  chemically synthesized
aatccaacagtacatccaaaag

SEQ ID NO: 25642 - DNA, 22 bp, Artificial Sequence
  chemically synthesized
atactagggttgcaagaacagt

SEQ ID NO: 25643 - DNA, 22 bp, Artificial Sequence
  chemically synthesized
tactagggttgcaagaacagtt

SEQ ID NO: 25644 - DNA, 22 bp, Artificial Sequence
  chemically synthesized
gggttgcaagaacagttcaaat

SEQ ID NO: 25645 - DNA, 22 bp, Artificial Sequence
  chemically synthesized
caagaacagttcaaatcaataa

SEQ ID NO: 25646 - DNA, 22 bp, Artificial Sequence
  chemically synthesized
aaatcaataaatgtgatacatc

SEQ ID NO: 25647 - DNA, 22 bp, Artificial Sequence
  chemically synthesized
aatagatacagaaaaagtattt

SEQ ID NO: 25648 - DNA, 22 bp, Artificial Sequence
  chemically synthesized
gataaaatttaacattccttca

SEQ ID NO: 25649 - DNA, 22 bp, Artificial Sequence
  chemically synthesized
ataaaatttaacattccttcat

SEQ ID NO: 25650 - DNA, 22 bp, Artificial Sequence
  chemically synthesized
aacattccttcatgataaaaac

SEQ ID NO: 25651 - DNA, 22 bp, Artificial Sequence
  chemically synthesized
acattccttcatgataaaaact

SEQ ID NO: 25652 - DNA, 22 bp, Artificial Sequence
  chemically synthesized
cttcatgataaaaactatctgc

SEQ ID NO: 25653 - DNA, 22 bp, Artificial Sequence
  chemically synthesized
catgataaaaactatctgcagc

SEQ ID NO: 25654 - DNA, 22 bp, Artificial Sequence
  chemically synthesized
atgataaaaactatctgcagcc

SEQ ID NO: 25655 - DNA, 22 bp, Artificial Sequence
  chemically synthesized
tctgcagccaatcatagaagga

SEQ ID NO: 25656 - DNA, 22 bp, Artificial Sequence
  chemically synthesized
cagccaatcatagaaggaacat

SEQ ID NO: 25657 - DNA, 22 bp, Artificial Sequence
  chemically synthesized
aatataataaaagtcatatatg

SEQ ID NO: 25658 - DNA, 22 bp, Artificial Sequence
  chemically synthesized
acatcatactgaattgggaaaa

SEQ ID NO: 25659 - DNA, 22 bp, Artificial Sequence
  chemically synthesized
aattgggaaaagctggaagcct

SEQ ID NO: 25660 - DNA, 22 bp, Artificial Sequence
  chemically synthesized
ggaaaagctggaagcctttcct

SEQ ID NO: 25661 - DNA, 22 bp, Artificial Sequence
  chemically synthesized
gaagcctttcctctaagaactg

SEQ ID NO: 25662 - DNA, 22 bp, Artificial Sequence
  chemically synthesized
tcctctaagaactgaaacaaaa

SEQ ID NO: 25663 - DNA, 22 bp, Artificial Sequence
  chemically synthesized
cctctaagaactgaaacaaaat

SEQ ID NO: 25664 - DNA, 22 bp, Artificial Sequence
  chemically synthesized
ctctaagaactgaaacaaaata

SEQ ID NO: 25665 - DNA, 22 bp, Artificial Sequence
  chemically synthesized
taagaactgaaacaaaataagg

SEQ ID NO: 25666 - DNA, 22 bp, Artificial Sequence
  chemically synthesized
agaactgaaacaaaataaggat

SEQ ID NO: 25667 - DNA, 22 bp, Artificial Sequence
  chemically synthesized
aaacaaaataaggatgcccact

SEQ ID NO: 25668 - DNA, 22 bp, Artificial Sequence
  chemically synthesized
ccatcactcctattcaatataa

SEQ ID NO: 25669 - DNA, 22 bp, Artificial Sequence
  chemically synthesized
catcactcctattcaatataat

SEQ ID NO: 25670 - DNA, 22 bp, Artificial Sequence
  chemically synthesized
ctattcaatataatactggaag

SEQ ID NO: 25671 - DNA, 22 bp, Artificial Sequence
  chemically synthesized
ttcaatataatactggaagtcc

SEQ ID NO: 25672 - DNA, 22 bp, Artificial Sequence
  chemically synthesized
aatataatactggaagtcctag

SEQ ID NO: 25673 - DNA, 22 bp, Artificial Sequence
  chemically synthesized
gaagtcctagccacagctttca

SEQ ID NO: 25674 - DNA, 22 bp, Artificial Sequence
  chemically synthesized
gccacagctttcaggtcagaga

SEQ ID NO: 25675 - DNA, 22 bp, Artificial Sequence
  chemically synthesized
tcaggtcagagaaagaaagaaa

SEQ ID NO: 25676 - DNA, 22 bp, Artificial Sequence
  chemically synthesized
caggtcagagaaagaaagaaag

SEQ ID NO: 25677 - DNA, 22 bp, Artificial Sequence
  chemically synthesized
aggtcagagaaagaaagaaaga

SEQ ID NO: 25678 - DNA, 22 bp, Artificial Sequence
  chemically synthesized
tccatctttccagatgacatga

SEQ ID NO: 25679 - DNA, 22 bp, Artificial Sequence
  chemically synthesized
tccagatgacatgattttatac

SEQ ID NO: 25680 - DNA, 22 bp, Artificial Sequence
  chemically synthesized
ccagatgacatgattttatacc

SEQ ID NO: 25681 - DNA, 22 bp, Artificial Sequence
  chemically synthesized
cagatgacatgattttatacct

SEQ ID NO: 25682 - DNA, 22 bp, Artificial Sequence
  chemically synthesized
tatacctagaaaaaccaagact

SEQ ID NO: 25683 - DNA, 22 bp, Artificial Sequence
  chemically synthesized
atacctagaaaaaccaagactc

SEQ ID NO: 25684 - DNA, 22 bp, Artificial Sequence
  chemically synthesized
tacctagaaaaaccaagactcc

SEQ ID NO: 25685 - DNA, 22 bp, Artificial Sequence
  chemically synthesized
gaaaaaccaagactccaccaaa

SEQ ID NO: 25686 - DNA, 22 bp, Artificial Sequence
  chemically synthesized
caccaaagcactcttagcgctg

SEQ ID NO: 25687 - DNA, 22 bp, Artificial Sequence
  chemically synthesized
ttagcgctgaaaaataaattca

SEQ ID NO: 25688 - DNA, 22 bp, Artificial Sequence
  chemically synthesized
agcgctgaaaaataaattcagt

SEQ ID NO: 25689 - DNA, 22 bp, Artificial Sequence
  chemically synthesized
gcgctgaaaaataaattcagta

SEQ ID NO: 25690 - DNA, 22 bp, Artificial Sequence
  chemically synthesized
aaaaataaattcagtaaagtta

SEQ ID NO: 25691 - DNA, 22 bp, Artificial Sequence
  chemically synthesized
agtaaagttacaggagacaaaa

SEQ ID NO: 25692 - DNA, 22 bp, Artificial Sequence
  chemically synthesized
caggagacaaaatcagcatatg

SEQ ID NO: 25693 - DNA, 22 bp, Artificial Sequence
  chemically synthesized
ctacacaccaataataaactag

SEQ ID NO: 25694 - DNA, 22 bp, Artificial Sequence
  chemically synthesized
tacacaccaataataaactagc

SEQ ID NO: 25695 - DNA, 22 bp, Artificial Sequence
  chemically synthesized
cacaccaataataaactagctg

SEQ ID NO: 25696 - DNA, 22 bp, Artificial Sequence
  chemically synthesized
gctgagaaggaaattaagaagg

SEQ ID NO: 25697 - DNA, 22 bp, Artificial Sequence
  chemically synthesized
agaaggaaattaagaaggcaat

SEQ ID NO: 25698 - DNA, 22 bp, Artificial Sequence
  chemically synthesized
agaaggcaatcccatttacaat

SEQ ID NO: 25699 - DNA, 22 bp, Artificial Sequence
  chemically synthesized
acaatagctaaaaaataaaata

SEQ ID NO: 25700 - DNA, 22 bp, Artificial Sequence
  chemically synthesized
caatagctaaaaaataaaatat

SEQ ID NO: 25701 - DNA, 22 bp, Artificial Sequence
  chemically synthesized
aaaaataaaatatttagggata

SEQ ID NO: 25702 - DNA, 22 bp, Artificial Sequence
  chemically synthesized
agggataaatttaaccaaggaa

SEQ ID NO: 25703 - DNA, 22 bp, Artificial Sequence
  chemically synthesized
gggataaatttaaccaaggaac

SEQ ID NO: 25704 - DNA, 22 bp, Artificial Sequence
  chemically synthesized
aaccaaggaaccgaaaaacctc

SEQ ID NO: 25705 - DNA, 22 bp, Artificial Sequence
  chemically synthesized
accaaggaaccgaaaaacctct

SEQ ID NO: 25706 - DNA, 22 bp, Artificial Sequence
  chemically synthesized
tattcggaaaactacaaaacac

SEQ ID NO: 25707 - DNA, 22 bp, Artificial Sequence
  chemically synthesized
ttcggaaaactacaaaacactg

SEQ ID NO: 25708 - DNA, 22 bp, Artificial Sequence
  chemically synthesized
ggaaaactacaaaacactgata

SEQ ID NO: 25709 - DNA, 22 bp, Artificial Sequence
  chemically synthesized
caaaacactgataaaagaattg

SEQ ID NO: 25710 - DNA, 22 bp, Artificial Sequence
  chemically synthesized
ataaaagaattgaaaaggacag

SEQ ID NO: 25711 - DNA, 22 bp, Artificial Sequence
  chemically synthesized
aaaaggacagaaacaaatggag

SEQ ID NO: 25712 - DNA, 22 bp, Artificial Sequence
  chemically synthesized
tgttcatggatcagaaaaatta

SEQ ID NO: 25713 - DNA, 22 bp, Artificial Sequence
  chemically synthesized
atggatcagaaaaattaatatt

SEQ ID NO: 25714 - DNA, 22 bp, Artificial Sequence
  chemically synthesized
atattgttaaaatggccatact

SEQ ID NO: 25715 - DNA, 22 bp, Artificial Sequence
  chemically synthesized
ttaaaatggccatactacccaa

SEQ ID NO: 25716 - DNA, 22 bp, Artificial Sequence
  chemically synthesized
aaatggccatactacccaaagc

SEQ ID NO: 25717 - DNA, 22 bp, Artificial Sequence
  chemically synthesized
cccaaagcaatctacagattct

SEQ ID NO: 25718 - DNA, 22 bp, Artificial Sequence
  chemically synthesized
cagattctatatgaccgctatc

SEQ ID NO: 25719 - DNA, 22 bp, Artificial Sequence
  chemically synthesized
tatatgaccgctatcaaaatag

SEQ ID NO: 25720 - DNA, 22 bp, Artificial Sequence
  chemically synthesized
tatgaccgctatcaaaatagca

SEQ ID NO: 25721 - DNA, 22 bp, Artificial Sequence
  chemically synthesized
tcaaaatagcaatgtcattttt

SEQ ID NO: 25722 - DNA, 22 bp, Artificial Sequence
  chemically synthesized
ttcacagaaatggaaaaaccaa

SEQ ID NO: 25723 - DNA, 22 bp, Artificial Sequence
  chemically synthesized
tcacagaaatggaaaaaccaat

SEQ ID NO: 25724 - DNA, 22 bp, Artificial Sequence
  chemically synthesized
cacagaaatggaaaaaccaatc

SEQ ID NO: 25725 - DNA, 22 bp, Artificial Sequence
  chemically synthesized
acagaaatggaaaaaccaatct

SEQ ID NO: 25726 - DNA, 22 bp, Artificial Sequence
  chemically synthesized
aaatttgtatgaaattaaaaaa

SEQ ID NO: 25727 - DNA, 22 bp, Artificial Sequence
  chemically synthesized
gtatgaaattaaaaaatagctc

SEQ ID NO: 25728 - DNA, 22 bp, Artificial Sequence
  chemically synthesized
tatgaaattaaaaaatagctcc

SEQ ID NO: 25729 - DNA, 22 bp, Artificial Sequence
  chemically synthesized
aaaaatagctccagtagccaaa

SEQ ID NO: 25730 - DNA, 22 bp, Artificial Sequence
  chemically synthesized
cagtagccaaagtcatcctgtg

SEQ ID NO: 25731 - DNA, 22 bp, Artificial Sequence
  chemically synthesized
tgaaaaaagaacaatgctagag

SEQ ID NO: 25732 - DNA, 22 bp, Artificial Sequence
  chemically synthesized
gaggtatcatactacctgattt

SEQ ID NO: 25733 - DNA, 22 bp, Artificial Sequence
  chemically synthesized
cctgatttcaaagtatattaca

SEQ ID NO: 25734 - DNA, 22 bp, Artificial Sequence
  chemically synthesized
atttcaaagtatattacaaaag

SEQ ID NO: 25735 - DNA, 22 bp, Artificial Sequence
  chemically synthesized
caaagtatattacaaaagtata

SEQ ID NO: 25736 - DNA, 22 bp, Artificial Sequence
  chemically synthesized
aaagtatattacaaaagtatag

SEQ ID NO: 25737 - DNA, 22 bp, Artificial Sequence
  chemically synthesized
caaaagtataggaacctaaaca

SEQ ID NO: 25738 - DNA, 22 bp, Artificial Sequence
  chemically synthesized
aacagcatgatactgacattag

SEQ ID NO: 25739 - DNA, 22 bp, Artificial Sequence
  chemically synthesized
acattagaacagacacttagac

SEQ ID NO: 25740 - DNA, 22 bp, Artificial Sequence
  chemically synthesized
gaacagacacttagaccaatgg

SEQ ID NO: 25741 - DNA, 22 bp, Artificial Sequence
  chemically synthesized
agaccaatggaagagaatagag

SEQ ID NO: 25742 - DNA, 22 bp, Artificial Sequence
  chemically synthesized
gaccaatggaagagaatagaga

SEQ ID NO: 25743 - DNA, 22 bp, Artificial Sequence
  chemically synthesized
gaaatgcatccacatatttata

SEQ ID NO: 25744 - DNA, 22 bp, Artificial Sequence
  chemically synthesized
atagccaacagattttcaacaa

SEQ ID NO: 25745 - DNA, 22 bp, Artificial Sequence
  chemically synthesized
tagccaacagattttcaacaaa

SEQ ID NO: 25746 - DNA, 22 bp, Artificial Sequence
  chemically synthesized
tcaacaaaggtgacaagaatat

SEQ ID NO: 25747 - DNA, 22 bp, Artificial Sequence
  chemically synthesized
caacaaaggtgacaagaatata

SEQ ID NO: 25748 - DNA, 22 bp, Artificial Sequence
  chemically synthesized
aacaaaggtgacaagaatatac

SEQ ID NO: 25749 - DNA, 22 bp, Artificial Sequence
  chemically synthesized
aggaaaggacacagtgttcaag

SEQ ID NO: 25750 - DNA, 22 bp, Artificial Sequence
  chemically synthesized
aagaaatggtgctgaaaaaatt

SEQ ID NO: 25751 - DNA, 22 bp, Artificial Sequence
  chemically synthesized
aaaaaattggatatccattgga

SEQ ID NO: 25752 - DNA, 22 bp, Artificial Sequence
  chemically synthesized
gatatccattggatatccatgt

SEQ ID NO: 25753 - DNA, 22 bp, Artificial Sequence
  chemically synthesized
gatatccatgtgcaaaagaata

SEQ ID NO: 25754 - DNA, 22 bp, Artificial Sequence
  chemically synthesized
gactgctgatatggtttggatg

SEQ ID NO: 25755 - DNA, 22 bp, Artificial Sequence
  chemically synthesized
ctgatatggtttggatgtttgt

SEQ ID NO: 25756 - DNA, 22 bp, Artificial Sequence
  chemically synthesized
atatggtttggatgtttgttcc

SEQ ID NO: 25757 - DNA, 22 bp, Artificial Sequence
  chemically synthesized
ggatgtttgttccctccaaatc

SEQ ID NO: 25758 - DNA, 22 bp, Artificial Sequence
  chemically synthesized
gatgtttgttccctccaaatct

SEQ ID NO: 25759 - DNA, 22 bp, Artificial Sequence
  chemically synthesized
gttccctccaaatctcatgttg

SEQ ID NO: 25760 - DNA, 22 bp, Artificial Sequence
  chemically synthesized
ttccctccaaatctcatgttga

SEQ ID NO: 25761 - DNA, 22 bp, Artificial Sequence
  chemically synthesized
cctccaaatctcatgttgaaat

SEQ ID NO: 25762 - DNA, 22 bp, Artificial Sequence
  chemically synthesized
caaatctcatgttgaaatataa

SEQ ID NO: 25763 - DNA, 22 bp, Artificial Sequence
  chemically synthesized
atgttgaaatataatccccaac

SEQ ID NO: 25764 - DNA, 22 bp, Artificial Sequence
  chemically synthesized
aaatataatccccaacttctca

SEQ ID NO: 25765 - DNA, 22 bp, Artificial Sequence
  chemically synthesized
ctcaggatcttggcggatggga

SEQ ID NO: 25766 - DNA, 22 bp, Artificial Sequence
  chemically synthesized
tcaggatcttggcggatgggag

SEQ ID NO: 25767 - DNA, 22 bp, Artificial Sequence
  chemically synthesized
aggatcttggcggatgggaggt

SEQ ID NO: 25768 - DNA, 22 bp, Artificial Sequence
  chemically synthesized
ggcggatgggaggtaggcctag

SEQ ID NO: 25769 - DNA, 22 bp, Artificial Sequence
  chemically synthesized
gcggatgggaggtaggcctaga

SEQ ID NO: 25770 - DNA, 22 bp, Artificial Sequence
  chemically synthesized
gattgcagctccaactcagatg

SEQ ID NO: 25771 - DNA, 22 bp, Artificial Sequence
  chemically synthesized
cagctccaactcagatggacag

SEQ ID NO: 25772 - DNA, 22 bp, Artificial Sequence
  chemically synthesized
caactcagatggacagagcagc

SEQ ID NO: 25773 - DNA, 22 bp, Artificial Sequence
  chemically synthesized
agatggacagagcagcatgtgg

SEQ ID NO: 25774 - DNA, 22 bp, Artificial Sequence
  chemically synthesized
gcattgtgaattttagctgcag

SEQ ID NO: 25775 - DNA, 22 bp, Artificial Sequence
  chemically synthesized
tgaattttagctgcagatagac

SEQ ID NO: 25776 - DNA, 22 bp, Artificial Sequence
  chemically synthesized
tagctgcagatagactgcaaga

SEQ ID NO: 25777 - DNA, 22 bp, Artificial Sequence
  chemically synthesized
agctgcagatagactgcaagaa

SEQ ID NO: 25778 - DNA, 22 bp, Artificial Sequence
  chemically synthesized
gctgcagatagactgcaagaac

SEQ ID NO: 25779 - DNA, 22 bp, Artificial Sequence
  chemically synthesized
cagatagactgcaagaacaaac

SEQ ID NO: 25780 - DNA, 22 bp, Artificial Sequence
  chemically synthesized
caagaacaaaccagcaatcctg

SEQ ID NO: 25781 - DNA, 22 bp, Artificial Sequence
  chemically synthesized
agaggacccacagaccctctga

SEQ ID NO: 25782 - DNA, 22 bp, Artificial Sequence
  chemically synthesized
tgaaggaagtagattgctcctg

SEQ ID NO: 25783 - DNA, 22 bp, Artificial Sequence
  chemically synthesized
aaggaagtagattgctcctgca

SEQ ID NO: 25784 - DNA, 22 bp, Artificial Sequence
  chemically synthesized
ctcctgcaggacccaggagaca

SEQ ID NO: 25785 - DNA, 22 bp, Artificial Sequence
  chemically synthesized
ctgcaggacccaggagacaccc

SEQ ID NO: 25786 - DNA, 22 bp, Artificial Sequence
  chemically synthesized
caggacccaggagacaccccaa

SEQ ID NO: 25787 - DNA, 22 bp, Artificial Sequence
  chemically synthesized
tgagtgccccaactgcggaagt

SEQ ID NO: 25788 - DNA, 22 bp, Artificial Sequence
  chemically synthesized
cggaagtgggaaagggagatcc

SEQ ID NO: 25789 - DNA, 22 bp, Artificial Sequence
  chemically synthesized
ctctcctaaacacacactccca

SEQ ID NO: 25790 - DNA, 22 bp, Artificial Sequence
  chemically synthesized
tcctaaacacacactcccactg

SEQ ID NO: 25791 - DNA, 22 bp, Artificial Sequence
  chemically synthesized
ctaaacacacactcccactgga

SEQ ID NO: 25792 - DNA, 22 bp, Artificial Sequence
  chemically synthesized
aacacacactcccactggagaa

SEQ ID NO: 25793 - DNA, 22 bp, Artificial Sequence
  chemically synthesized
ccactggagaaactgaaggtct

SEQ ID NO: 25794 - DNA, 22 bp, Artificial Sequence
  chemically synthesized
gagaaactgaaggtctgtttgt

SEQ ID NO: 25795 - DNA, 22 bp, Artificial Sequence
  chemically synthesized
aaggtctgtttgtgggagaagt

SEQ ID NO: 25796 - DNA, 22 bp, Artificial Sequence
  chemically synthesized
tttgtgggagaagtttctgacc

SEQ ID NO: 25797 - DNA, 22 bp, Artificial Sequence
  chemically synthesized
gtgggagaagtttctgacctta

SEQ ID NO: 25798 - DNA, 22 bp, Artificial Sequence
  chemically synthesized
tgggagaagtttctgaccttac

SEQ ID NO: 25799 - DNA, 22 bp, Artificial Sequence
  chemically synthesized
ctgaccttacctggagttgagt

SEQ ID NO: 25800 - DNA, 22 bp, Artificial Sequence
  chemically synthesized
tgaccttacctggagttgagtt

SEQ ID NO: 25801 - DNA, 22 bp, Artificial Sequence
  chemically synthesized
accttacctggagttgagttaa

SEQ ID NO: 25802 - DNA, 22 bp, Artificial Sequence
  chemically synthesized
acctggagttgagttaacttag

SEQ ID NO: 25803 - DNA, 22 bp, Artificial Sequence
  chemically synthesized
cctggagttgagttaacttaga

SEQ ID NO: 25804 - DNA, 22 bp, Artificial Sequence
  chemically synthesized
gagttgagttaacttagagagc

SEQ ID NO: 25805 - DNA, 22 bp, Artificial Sequence
  chemically synthesized
agttaacttagagagctgagca

SEQ ID NO: 25806 - DNA, 22 bp, Artificial Sequence
  chemically synthesized
acttagagagctgagcaaaata

SEQ ID NO: 25807 - DNA, 22 bp, Artificial Sequence
  chemically synthesized
agagagctgagcaaaatacagg

SEQ ID NO: 25808 - DNA, 22 bp, Artificial Sequence
  chemically synthesized
gagagctgagcaaaatacaggt

SEQ ID NO: 25809 - DNA, 22 bp, Artificial Sequence
  chemically synthesized
agcaaaatacaggtgtagagga

SEQ ID NO: 25810 - DNA, 22 bp, Artificial Sequence
  chemically synthesized
ggagctcactgggtccctgagc

SEQ ID NO: 25811 - DNA, 22 bp, Artificial Sequence
  chemically synthesized
actgggtccctgagcaggccat

SEQ ID NO: 25812 - DNA, 22 bp, Artificial Sequence
  chemically synthesized
ggtccctgagcaggccattcct

SEQ ID NO: 25813 - DNA, 22 bp, Artificial Sequence
  chemically synthesized
agcaggccattcctgcctggca

SEQ ID NO: 25814 - DNA, 22 bp, Artificial Sequence
  chemically synthesized
ctgcctggcatagccaggcatt

SEQ ID NO: 25815 - DNA, 22 bp, Artificial Sequence
  chemically synthesized
cctggcatagccaggcatttac

SEQ ID NO: 25816 - DNA, 22 bp, Artificial Sequence
  chemically synthesized
gcatagccaggcatttacatta

SEQ ID NO: 25817 - DNA, 22 bp, Artificial Sequence
  chemically synthesized
acattactaacattgaatgtaa

SEQ ID NO: 25818 - DNA, 22 bp, Artificial Sequence
  chemically synthesized
cattactaacattgaatgtaaa

SEQ ID NO: 25819 - DNA, 22 bp, Artificial Sequence
  chemically synthesized
ctaacattgaatgtaaatggcc

SEQ ID NO: 25820 - DNA, 22 bp, Artificial Sequence
  chemically synthesized
acattgaatgtaaatggcctaa

SEQ ID NO: 25821 - DNA, 22 bp, Artificial Sequence
  chemically synthesized
aatgtaaatggcctaaatgctc

SEQ ID NO: 25822 - DNA, 22 bp, Artificial Sequence
  chemically synthesized
aatgctccacttaaaagggtga

SEQ ID NO: 25823 - DNA, 22 bp, Artificial Sequence
  chemically synthesized
cacttaaaagggtgaaaaaggt

SEQ ID NO: 25824 - DNA, 22 bp, Artificial Sequence
  chemically synthesized
aaaagggtgaaaaaggtatttc

SEQ ID NO: 25825 - DNA, 22 bp, Artificial Sequence
  chemically synthesized
aaagggtgaaaaaggtatttca

SEQ ID NO: 25826 - DNA, 22 bp, Artificial Sequence
  chemically synthesized
catgcaaatggccaccaaaagt

SEQ ID NO: 25827 - DNA, 22 bp, Artificial Sequence
  chemically synthesized
atgcaaatggccaccaaaagtg

SEQ ID NO: 25828 - DNA, 22 bp, Artificial Sequence
  chemically synthesized
taaagcaacagcagttaaaaga

SEQ ID NO: 25829 - DNA, 22 bp, Artificial Sequence
  chemically synthesized
aaagcaacagcagttaaaagag

SEQ ID NO: 25830 - DNA, 22 bp, Artificial Sequence
  chemically synthesized
aagcaacagcagttaaaagaga

SEQ ID NO: 25831 - DNA, 22 bp, Artificial Sequence
  chemically synthesized
aaagagacaaagagggacatta

SEQ ID NO: 25832 - DNA, 22 bp, Artificial Sequence
  chemically synthesized
tataatggtaaaaggccttgtc

SEQ ID NO: 25833 - DNA, 22 bp, Artificial Sequence
  chemically synthesized
gtccaacaggaaaatatcacaa

SEQ ID NO: 25834 - DNA, 22 bp, Artificial Sequence
  chemically synthesized
tccaacaggaaaatatcacaat

SEQ ID NO: 25835 - DNA, 22 bp, Artificial Sequence
  chemically synthesized
aaacatatatgcacctaacact

SEQ ID NO: 25836 - DNA, 22 bp, Artificial Sequence
  chemically synthesized
aacatatatgcacctaacactg

SEQ ID NO: 25837 - DNA, 22 bp, Artificial Sequence
  chemically synthesized
acactggagctcccaaatttat

SEQ ID NO: 25838 - DNA, 22 bp, Artificial Sequence
  chemically synthesized
gagctcccaaatttatagaaca

SEQ ID NO: 25839 - DNA, 22 bp, Artificial Sequence
  chemically synthesized
ccaaatttatagaacaattact

SEQ ID NO: 25840 - DNA, 22 bp, Artificial Sequence
  chemically synthesized
atagaacaattactaatagacc

SEQ ID NO: 25841 - DNA, 22 bp, Artificial Sequence
  chemically synthesized
tagaacaattactaatagacct

SEQ ID NO: 25842 - DNA, 22 bp, Artificial Sequence
  chemically synthesized
ctaatagacctaagaaatgaga

SEQ ID NO: 25843 - DNA, 22 bp, Artificial Sequence
  chemically synthesized
atagacctaagaaatgagatag

SEQ ID NO: 25844 - DNA, 22 bp, Artificial Sequence
  chemically synthesized
agaaatgagatagacagcaaca

SEQ ID NO: 25845 - DNA, 22 bp, Artificial Sequence
  chemically synthesized
caatacttcattgacagcacta

SEQ ID NO: 25846 - DNA, 22 bp, Artificial Sequence
  chemically synthesized
aatacttcattgacagcactag

SEQ ID NO: 25847 - DNA, 22 bp, Artificial Sequence
  chemically synthesized
cattgacagcactagacagttc

SEQ ID NO: 25848 - DNA, 22 bp, Artificial Sequence
  chemically synthesized
attgacagcactagacagttca

SEQ ID NO: 25849 - DNA, 22 bp, Artificial Sequence
  chemically synthesized
acagcactagacagttcatcaa

SEQ ID NO: 25850 - DNA, 22 bp, Artificial Sequence
  chemically synthesized
gacagttcatcaagacagaaag

SEQ ID NO: 25851 - DNA, 22 bp, Artificial Sequence
  chemically synthesized
atcaagacagaaagtcaacaaa

SEQ ID NO: 25852 - DNA, 22 bp, Artificial Sequence
  chemically synthesized
aaattataccttagaacaaatg

SEQ ID NO: 25853 - DNA, 22 bp, Artificial Sequence
  chemically synthesized
aattataccttagaacaaatgg

SEQ ID NO: 25854 - DNA, 22 bp, Artificial Sequence
  chemically synthesized
taccttagaacaaatggactta

SEQ ID NO: 25855 - DNA, 22 bp, Artificial Sequence
  chemically synthesized
agaacaaatggacttaacagtt

SEQ ID NO: 25856 - DNA, 22 bp, Artificial Sequence
  chemically synthesized
gaacaaatggacttaacagtta

SEQ ID NO: 25857 - DNA, 22 bp, Artificial Sequence
  chemically synthesized
aacagttatatacagaacattt

SEQ ID NO: 25858 - DNA, 22 bp, Artificial Sequence
  chemically synthesized
acagttatatacagaacatttc

SEQ ID NO: 25859 - DNA, 22 bp, Artificial Sequence
  chemically synthesized
tatacagaacatttcatccaat

SEQ ID NO: 25860 - DNA, 22 bp, Artificial Sequence
  chemically synthesized
catccaataaccacagaacaca

SEQ ID NO: 25861 - DNA, 22 bp, Artificial Sequence
  chemically synthesized
atccaataaccacagaacacac

SEQ ID NO: 25862 - DNA, 22 bp, Artificial Sequence
  chemically synthesized
tattcaacagcgcgtggaaatt

SEQ ID NO: 25863 - DNA, 22 bp, Artificial Sequence
  chemically synthesized
ttcaacagcgcgtggaaatttc

SEQ ID NO: 25864 - DNA, 22 bp, Artificial Sequence
  chemically synthesized
aacagcgcgtggaaatttctcc

SEQ ID NO: 25865 - DNA, 22 bp, Artificial Sequence
  chemically synthesized
ctccaaggtagaccatatgata

SEQ ID NO: 25866 - DNA, 22 bp, Artificial Sequence
  chemically synthesized
tccaaggtagaccatatgatag

SEQ ID NO: 25867 - DNA, 22 bp, Artificial Sequence
  chemically synthesized
caaggtagaccatatgataggc

SEQ ID NO: 25868 - DNA, 22 bp, Artificial Sequence
  chemically synthesized
aataaatttactaacagaccaa

SEQ ID NO: 25869 - DNA, 22 bp, Artificial Sequence
  chemically synthesized
actaacagaccaataacaagca

SEQ ID NO: 25870 - DNA, 22 bp, Artificial Sequence
  chemically synthesized
ctaacagaccaataacaagcag

SEQ ID NO: 25871 - DNA, 22 bp, Artificial Sequence
  chemically synthesized
acagaccaataacaagcagtga

SEQ ID NO: 25872 - DNA, 22 bp, Artificial Sequence
  chemically synthesized
aattggtaattaaaaaattacc

SEQ ID NO: 25873 - DNA, 22 bp, Artificial Sequence
  chemically synthesized
attggtaattaaaaaattacca

SEQ ID NO: 25874 - DNA, 22 bp, Artificial Sequence
  chemically synthesized
gtaattaaaaaattaccaacca

SEQ ID NO: 25875 - DNA, 22 bp, Artificial Sequence
  chemically synthesized
aaaaattaccaaccaaaaaaaa

SEQ ID NO: 25876 - DNA, 22 bp, Artificial Sequence
  chemically synthesized
ccaaccaaaaaaaagttcagga

SEQ ID NO: 25877 - DNA, 22 bp, Artificial Sequence
  chemically synthesized
aggaccagatggattcacaaca

SEQ ID NO: 25878 - DNA, 22 bp, Artificial Sequence
  chemically synthesized
acaacagaattctactagacat

SEQ ID NO: 25879 - DNA, 22 bp, Artificial Sequence
  chemically synthesized
tactagacattcaaagaggaat

SEQ ID NO: 25880 - DNA, 22 bp, Artificial Sequence
  chemically synthesized
ctagacattcaaagaggaattg

SEQ ID NO: 25881 - DNA, 22 bp, Artificial Sequence
  chemically synthesized
gacattcaaagaggaattggtc

SEQ ID NO: 25882 - DNA, 22 bp, Artificial Sequence
  chemically synthesized
aaagaggaattggtccccatct

SEQ ID NO: 25883 - DNA, 22 bp, Artificial Sequence
  chemically synthesized
gtccccatctttttgacactat

SEQ ID NO: 25884 - DNA, 22 bp, Artificial Sequence
  chemically synthesized
tttgacactattctacaagaca

SEQ ID NO: 25885 - DNA, 22 bp, Artificial Sequence
  chemically synthesized
ttgacactattctacaagacag

SEQ ID NO: 25886 - DNA, 22 bp, Artificial Sequence
  chemically synthesized
tgacactattctacaagacaga

SEQ ID NO: 25887 - DNA, 22 bp, Artificial Sequence
  chemically synthesized
gacactattctacaagacagat

SEQ ID NO: 25888 - DNA, 22 bp, Artificial Sequence
  chemically synthesized
acactattctacaagacagata

SEQ ID NO: 25889 - DNA, 22 bp, Artificial Sequence
  chemically synthesized
ttctacaagacagataaagaag

SEQ ID NO: 25890 - DNA, 22 bp, Artificial Sequence
  chemically synthesized
tacaagacagataaagaaggaa

SEQ ID NO: 25891 - DNA, 22 bp, Artificial Sequence
  chemically synthesized
caagacagataaagaaggaacc

SEQ ID NO: 25892 - DNA, 22 bp, Artificial Sequence
  chemically synthesized
ccctaattcattctatgaagcc

SEQ ID NO: 25893 - DNA, 22 bp, Artificial Sequence
  chemically synthesized
attcattctatgaagccagcat

SEQ ID NO: 25894 - DNA, 22 bp, Artificial Sequence
  chemically synthesized
attctatgaagccagcatcaca

SEQ ID NO: 25895 - DNA, 22 bp, Artificial Sequence
  chemically synthesized
tatgaagccagcatcacaccaa

SEQ ID NO: 25896 - DNA, 22 bp, Artificial Sequence
  chemically synthesized
tgaagccagcatcacaccaaaa

SEQ ID NO: 25897 - DNA, 22 bp, Artificial Sequence
  chemically synthesized
cagactgatagccttgatgaac

SEQ ID NO: 25898 - DNA, 22 bp, Artificial Sequence
  chemically synthesized
atagccttgatgaacatagatg

SEQ ID NO: 25899 - DNA, 22 bp, Artificial Sequence
  chemically synthesized
gatgaacatagatgctaaaatc

SEQ ID NO: 25900 - DNA, 22 bp, Artificial Sequence
  chemically synthesized
atgaacatagatgctaaaatcc

SEQ ID NO: 25901 - DNA, 22 bp, Artificial Sequence
  chemically synthesized
aaatccttaacaaaatactaga

SEQ ID NO: 25902 - DNA, 22 bp, Artificial Sequence
  chemically synthesized
aacaaaatactagataaccaaa

SEQ ID NO: 25903 - DNA, 22 bp, Artificial Sequence
  chemically synthesized
acaaaatactagataaccaaat

SEQ ID NO: 25904 - DNA, 22 bp, Artificial Sequence
  chemically synthesized
gataaccaaattcaacaacata

SEQ ID NO: 25905 - DNA, 22 bp, Artificial Sequence
  chemically synthesized
aacaacataacaaaaagataat

SEQ ID NO: 25906 - DNA, 22 bp, Artificial Sequence
  chemically synthesized
catgccagggatgcagggttgg

SEQ ID NO: 25907 - DNA, 22 bp, Artificial Sequence
  chemically synthesized
gtttgacatctgcaagtcaata

SEQ ID NO: 25908 - DNA, 22 bp, Artificial Sequence
  chemically synthesized
gacatctgcaagtcaataagtg

SEQ ID NO: 25909 - DNA, 22 bp, Artificial Sequence
  chemically synthesized
acatctgcaagtcaataagtgt

SEQ ID NO: 25910 - DNA, 22 bp, Artificial Sequence
  chemically synthesized
caagtcaataagtgtgatacac

SEQ ID NO: 25911 - DNA, 22 bp, Artificial Sequence
  chemically synthesized
aaaaacaaaaattacatgatca

SEQ ID NO: 25912 - DNA, 22 bp, Artificial Sequence
  chemically synthesized
aaaacaaaaattacatgatcat

SEQ ID NO: 25913 - DNA, 22 bp, Artificial Sequence
  chemically synthesized
catgatcatctcaatagatgca

SEQ ID NO: 25914 - DNA, 22 bp, Artificial Sequence
  chemically synthesized
aatagatgcagaaaaagcattc

SEQ ID NO: 25915 - DNA, 22 bp, Artificial Sequence
  chemically synthesized
aacaaaatccagcatacattta

SEQ ID NO: 25916 - DNA, 22 bp, Artificial Sequence
  chemically synthesized
atgattaaaatgctcagcaaaa

SEQ ID NO: 25917 - DNA, 22 bp, Artificial Sequence
  chemically synthesized
tgattaaaatgctcagcaaaat

SEQ ID NO: 25918 - DNA, 22 bp, Artificial Sequence
  chemically synthesized
aaatgctcagcaaaatcagcat

SEQ ID NO: 25919 - DNA, 22 bp, Artificial Sequence
  chemically synthesized
agcaaaatcagcatacaagaga

SEQ ID NO: 25920 - DNA, 22 bp, Artificial Sequence
  chemically synthesized
agtgtaataaaagccatctgtg

SEQ ID NO: 25921 - DNA, 22 bp, Artificial Sequence
  chemically synthesized
tgacaaacccacagccaacata

SEQ ID NO: 25922 - DNA, 22 bp, Artificial Sequence
  chemically synthesized
aatggggaaaagttgaaagcat

SEQ ID NO: 25923 - DNA, 22 bp, Artificial Sequence
  chemically synthesized
aaagcattccctctgagaactg

SEQ ID NO: 25924 - DNA, 22 bp, Artificial Sequence
  chemically synthesized
cctctgagaactggaacaagac

SEQ ID NO: 25925 - DNA, 22 bp, Artificial Sequence
  chemically synthesized
tgagaactggaacaagacaagg

SEQ ID NO: 25926 - DNA, 22 bp, Artificial Sequence
  chemically synthesized
agaactggaacaagacaaggat

SEQ ID NO: 25927 - DNA, 22 bp, Artificial Sequence
  chemically synthesized
gaacaagacaaggatgcccact

SEQ ID NO: 25928 - DNA, 22 bp, Artificial Sequence
  chemically synthesized
tcaccactcctcttcaacatag

SEQ ID NO: 25929 - DNA, 22 bp, Artificial Sequence
  chemically synthesized
accactcctcttcaacatagta

SEQ ID NO: 25930 - DNA, 22 bp, Artificial Sequence
  chemically synthesized
ctcttcaacatagtactggaag

SEQ ID NO: 25931 - DNA, 22 bp, Artificial Sequence
  chemically synthesized
ttcaacatagtactggaagtcc

SEQ ID NO: 25932 - DNA, 22 bp, Artificial Sequence
  chemically synthesized
caacatagtactggaagtccta

SEQ ID NO: 25933 - DNA, 22 bp, Artificial Sequence
  chemically synthesized
aacatagtactggaagtcctag

SEQ ID NO: 25934 - DNA, 22 bp, Artificial Sequence
  chemically synthesized
gaagtcctagccagggcaatca

SEQ ID NO: 25935 - DNA, 22 bp, Artificial Sequence
  chemically synthesized
gccagggcaatcagacaaaaca

SEQ ID NO: 25936 - DNA, 22 bp, Artificial Sequence
  chemically synthesized
aaatcagtaaagaggaagtcaa

SEQ ID NO: 25937 - DNA, 22 bp, Artificial Sequence
  chemically synthesized
tcactgtttgctgatgatatga

SEQ ID NO: 25938 - DNA, 22 bp, Artificial Sequence
  chemically synthesized
tttgctgatgatatgatcattt

SEQ ID NO: 25939 - DNA, 22 bp, Artificial Sequence
  chemically synthesized
gctgatgatatgatcatttacc

SEQ ID NO: 25940 - DNA, 22 bp, Artificial Sequence
  chemically synthesized
ctgatgatatgatcatttacct

SEQ ID NO: 25941 - DNA, 22 bp, Artificial Sequence
  chemically synthesized
atgatatgatcatttaccttta

SEQ ID NO: 25942 - DNA, 22 bp, Artificial Sequence
  chemically synthesized
acctttaaaaccctaaagactc

SEQ ID NO: 25943 - DNA, 22 bp, Artificial Sequence
  chemically synthesized
cctttaaaaccctaaagactcc

SEQ ID NO: 25944 - DNA, 22 bp, Artificial Sequence
  chemically synthesized
taaaaccctaaagactcctcca

SEQ ID NO: 25945 - DNA, 22 bp, Artificial Sequence
  chemically synthesized
aaaaccctaaagactcctccag

SEQ ID NO: 25946 - DNA, 22 bp, Artificial Sequence
  chemically synthesized
aaaccctaaagactcctccaga

SEQ ID NO: 25947 - DNA, 22 bp, Artificial Sequence
  chemically synthesized
aagactcctccagaaagctcct

SEQ ID NO: 25948 - DNA, 22 bp, Artificial Sequence
  chemically synthesized
ctccagaaagctcctagaactg

SEQ ID NO: 25949 - DNA, 22 bp, Artificial Sequence
  chemically synthesized
cagaaagctcctagaactgata

SEQ ID NO: 25950 - DNA, 22 bp, Artificial Sequence
  chemically synthesized
ctagaactgataaaataattca

SEQ ID NO: 25951 - DNA, 22 bp, Artificial Sequence
  chemically synthesized
gaactgataaaataattcagca

SEQ ID NO: 25952 - DNA, 22 bp, Artificial Sequence
  chemically synthesized
ataaaataattcagcaaagttt

SEQ ID NO: 25953 - DNA, 22 bp, Artificial Sequence
  chemically synthesized
agcaaagtttccagatacaaga

SEQ ID NO: 25954 - DNA, 22 bp, Artificial Sequence
  chemically synthesized
ccagatacaagatgaatgcaca

SEQ ID NO: 25955 - DNA, 22 bp, Artificial Sequence
  chemically synthesized
cagatacaagatgaatgcacac

SEQ ID NO: 25956 - DNA, 22 bp, Artificial Sequence
  chemically synthesized
ttctatacaccaacagcaacca

SEQ ID NO: 25957 - DNA, 22 bp, Artificial Sequence
  chemically synthesized
ctatacaccaacagcaaccaaa

SEQ ID NO: 25958 - DNA, 22 bp, Artificial Sequence
  chemically synthesized
tatacaccaacagcaaccaaat

SEQ ID NO: 25959 - DNA, 22 bp, Artificial Sequence
  chemically synthesized
tacaccaacagcaaccaaatgg

SEQ ID NO: 25960 - DNA, 22 bp, Artificial Sequence
  chemically synthesized
aaccccttgtacaatagatgca

SEQ ID NO: 25961 - DNA, 22 bp, Artificial Sequence
  chemically synthesized
gtacaatagatgcaaaaatggc

SEQ ID NO: 25962 - DNA, 22 bp, Artificial Sequence
  chemically synthesized
tacaatagatgcaaaaatggcc

SEQ ID NO: 25963 - DNA, 22 bp, Artificial Sequence
  chemically synthesized
atacaacccctatttattgcca

SEQ ID NO: 25964 - DNA, 22 bp, Artificial Sequence
  chemically synthesized
tttattgccatataaaacgtac

SEQ ID NO: 25965 - DNA, 22 bp, Artificial Sequence
  chemically synthesized
attgccatataaaacgtactct

SEQ ID NO: 25966 - DNA, 22 bp, Artificial Sequence
  chemically synthesized
ttgccatataaaacgtactctc

SEQ ID NO: 25967 - DNA, 22 bp, Artificial Sequence
  chemically synthesized
ccatataaaacgtactctcaag

SEQ ID NO: 25968 - DNA, 22 bp, Artificial Sequence
  chemically synthesized
tcaagatggattaaagacttaa

SEQ ID NO: 25969 - DNA, 22 bp, Artificial Sequence
  chemically synthesized
aagatggattaaagacttaaat

SEQ ID NO: 25970 - DNA, 22 bp, Artificial Sequence
  chemically synthesized
aagacttaaatataaaacttaa

SEQ ID NO: 25971 - DNA, 22 bp, Artificial Sequence
  chemically synthesized
aaatataaaacttaaaactata

SEQ ID NO: 25972 - DNA, 22 bp, Artificial Sequence
  chemically synthesized
aatataaaacttaaaactataa

SEQ ID NO: 25973 - DNA, 22 bp, Artificial Sequence
  chemically synthesized
aaaactataaaactactaaaag

SEQ ID NO: 25974 - DNA, 22 bp, Artificial Sequence
  chemically synthesized
aaactataaaactactaaaaga

SEQ ID NO: 25975 - DNA, 22 bp, Artificial Sequence
  chemically synthesized
taaaactactaaaagaaaacat

SEQ ID NO: 25976 - DNA, 22 bp, Artificial Sequence
  chemically synthesized
ctaaaagaaaacataagggaga

SEQ ID NO: 25977 - DNA, 22 bp, Artificial Sequence
  chemically synthesized
aaagaaaacataagggagacac

SEQ ID NO: 25978 - DNA, 22 bp, Artificial Sequence
  chemically synthesized
caagacatggctttgggcaaag

SEQ ID NO: 25979 - DNA, 22 bp, Artificial Sequence
  chemically synthesized
aagacatggctttgggcaaaga

SEQ ID NO: 25980 - DNA, 22 bp, Artificial Sequence
  chemically synthesized
tgggcaaagattttatggccaa

SEQ ID NO: 25981 - DNA, 22 bp, Artificial Sequence
  chemically synthesized
gggcaaagattttatggccaag

SEQ ID NO: 25982 - DNA, 22 bp, Artificial Sequence
  chemically synthesized
ggcaaagattttatggccaaga

SEQ ID NO: 25983 - DNA, 22 bp, Artificial Sequence
  chemically synthesized
tatggccaagacctcaaaagca

SEQ ID NO: 25984 - DNA, 22 bp, Artificial Sequence
  chemically synthesized
atggccaagacctcaaaagcac

SEQ ID NO: 25985 - DNA, 22 bp, Artificial Sequence
  chemically synthesized
tggccaagacctcaaaagcaca

SEQ ID NO: 25986 - DNA, 22 bp, Artificial Sequence
  chemically synthesized
aaaagcacaggcaacaaaagca

SEQ ID NO: 25987 - DNA, 22 bp, Artificial Sequence
  chemically synthesized
tattaagctaaaatacatctgc

SEQ ID NO: 25988 - DNA, 22 bp, Artificial Sequence
  chemically synthesized
agctaaaatacatctgcacagt

SEQ ID NO: 25989 - DNA, 22 bp, Artificial Sequence
  chemically synthesized
aaatacatctgcacagtaaagg

SEQ ID NO: 25990 - DNA, 22 bp, Artificial Sequence
  chemically synthesized
cacagtaaaggaaacaatcaac

SEQ ID NO: 25991 - DNA, 22 bp, Artificial Sequence
  chemically synthesized
ttgaatgcgagaaaatatttgc

SEQ ID NO: 25992 - DNA, 22 bp, Artificial Sequence
  chemically synthesized
aatgcgagaaaatatttgcata

SEQ ID NO: 25993 - DNA, 22 bp, Artificial Sequence
  chemically synthesized
gcatacatttgacaaggaatta

SEQ ID NO: 25994 - DNA, 22 bp, Artificial Sequence
  chemically synthesized
catacatttgacaaggaattaa

SEQ ID NO: 25995 - DNA, 22 bp, Artificial Sequence
  chemically synthesized
gacaaggaattaatctccagaa

SEQ ID NO: 25996 - DNA, 22 bp, Artificial Sequence
  chemically synthesized
acaaggaattaatctccagaat

SEQ ID NO: 25997 - DNA, 22 bp, Artificial Sequence
  chemically synthesized
atctccagaatatataagaaac

SEQ ID NO: 25998 - DNA, 22 bp, Artificial Sequence
  chemically synthesized
cagaatatataagaaactcaaa

SEQ ID NO: 25999 - DNA, 22 bp, Artificial Sequence
  chemically synthesized
aaacaactcaacagtggaaaaa

SEQ ID NO: 26000 - DNA, 22 bp, Artificial Sequence
  chemically synthesized
aacagtggaaaaacaaataatc

SEQ ID NO: 26001 - DNA, 22 bp, Artificial Sequence
  chemically synthesized
attaaaaaattggcaaaggata

SEQ ID NO: 26002 - DNA, 22 bp, Artificial Sequence
  chemically synthesized
aaaaattggcaaaggatatttt

SEQ ID NO: 26003 - DNA, 22 bp, Artificial Sequence
  chemically synthesized
gcaaaggatatttttcaaaaga

SEQ ID NO: 26004 - DNA, 22 bp, Artificial Sequence
  chemically synthesized
ttcaaaagaagacatacaaatg

SEQ ID NO: 26005 - DNA, 22 bp, Artificial Sequence
  chemically synthesized
tcaaaagaagacatacaaatgc

SEQ ID NO: 26006 - DNA, 22 bp, Artificial Sequence
  chemically synthesized
caaaagaagacatacaaatgca

SEQ ID NO: 26007 - DNA, 22 bp, Artificial Sequence
  chemically synthesized
aaaagaagacatacaaatgcac

SEQ ID NO: 26008 - DNA, 22 bp, Artificial Sequence
  chemically synthesized
ctcaacattactaatcatcaga

SEQ ID NO: 26009 - DNA, 22 bp, Artificial Sequence
  chemically synthesized
aacattactaatcatcagagaa

SEQ ID NO: 26010 - DNA, 22 bp, Artificial Sequence
  chemically synthesized
ctaatcatcagagaaatgcaaa

SEQ ID NO: 26011 - DNA, 22 bp, Artificial Sequence
  chemically synthesized
atcatcagagaaatgcaaatca

SEQ ID NO: 26012 - DNA, 22 bp, Artificial Sequence
  chemically synthesized
atgccagttagaatcatcatga

SEQ ID NO: 26013 - DNA, 22 bp, Artificial Sequence
  chemically synthesized
tgccagttagaatcatcatgat

SEQ ID NO: 26014 - DNA, 22 bp, Artificial Sequence
  chemically synthesized
gaatcatcatgatttaaataaa

SEQ ID NO: 26015 - DNA, 22 bp, Artificial Sequence
  chemically synthesized
aaataaattaataaataaataa

SEQ ID NO: 26016 - DNA, 22 bp, Artificial Sequence
  chemically synthesized
aataaattaataaataaataac

SEQ ID NO: 26017 - DNA, 22 bp, Artificial Sequence
  chemically synthesized
ataaataaataacacatgctgg

SEQ ID NO: 26018 - DNA, 22 bp, Artificial Sequence
  chemically synthesized
gcaaggatgtgaaggaaaaggc

SEQ ID NO: 26019 - DNA, 22 bp, Artificial Sequence
  chemically synthesized
gtaggcactattggtaagcatg

SEQ ID NO: 26020 - DNA, 22 bp, Artificial Sequence
  chemically synthesized
ttggtaagcatgcaaattagta

SEQ ID NO: 26021 - DNA, 22 bp, Artificial Sequence
  chemically synthesized
gtaagcatgcaaattagtatag

SEQ ID NO: 26022 - DNA, 22 bp, Artificial Sequence
  chemically synthesized
gtatagccactatggaaaacaa

SEQ ID NO: 26023 - DNA, 22 bp, Artificial Sequence
  chemically synthesized
tggaaaacaatatgtagattta

SEQ ID NO: 26024 - DNA, 22 bp, Artificial Sequence
  chemically synthesized
accaaaaagctaaaaattgaac

SEQ ID NO: 26025 - DNA, 22 bp, Artificial Sequence
  chemically synthesized
ccaaaaagctaaaaattgaact

SEQ ID NO: 26026 - DNA, 22 bp, Artificial Sequence
  chemically synthesized
aaaattgaactatcataagatc

SEQ ID NO: 26027 - DNA, 22 bp, Artificial Sequence
  chemically synthesized
aactatcataagatccagcaat

SEQ ID NO: 26028 - DNA, 22 bp, Artificial Sequence
  chemically synthesized
tcataagatccagcaatcttat

SEQ ID NO: 26029 - DNA, 22 bp, Artificial Sequence
  chemically synthesized
attactgggtatttatccaaag

SEQ ID NO: 26030 - DNA, 22 bp, Artificial Sequence
  chemically synthesized
ttactgggtatttatccaaagg

SEQ ID NO: 26031 - DNA, 22 bp, Artificial Sequence
  chemically synthesized
ctgggtatttatccaaaggaaa

SEQ ID NO: 26032 - DNA, 22 bp, Artificial Sequence
  chemically synthesized
ggtatttatccaaaggaaaaga

SEQ ID NO: 26033 - DNA, 22 bp, Artificial Sequence
  chemically synthesized
atccaaaggaaaagaattcaga

SEQ ID NO: 26034 - DNA, 22 bp, Artificial Sequence
  chemically synthesized
tccaaaggaaaagaattcagaa

SEQ ID NO: 26035 - DNA, 22 bp, Artificial Sequence
  chemically synthesized
agaataataaacagatactggt

SEQ ID NO: 26036 - DNA, 22 bp, Artificial Sequence
  chemically synthesized
gtaccacactgtttattgcagc

SEQ ID NO: 26037 - DNA, 22 bp, Artificial Sequence
  chemically synthesized
tttattgcagcacgattcacat

SEQ ID NO: 26038 - DNA, 22 bp, Artificial Sequence
  chemically synthesized
attgcagcacgattcacattag

SEQ ID NO: 26039 - DNA, 22 bp, Artificial Sequence
  chemically synthesized
ttgcagcacgattcacattagc

SEQ ID NO: 26040 - DNA, 22 bp, Artificial Sequence
  chemically synthesized
cagcacgattcacattagcaaa

SEQ ID NO: 26041 - DNA, 22 bp, Artificial Sequence
  chemically synthesized
acattagcaaagatatggaatc

SEQ ID NO: 26042 - DNA, 22 bp, Artificial Sequence
  chemically synthesized
gcaaagatatggaatcaaccta

SEQ ID NO: 26043 - DNA, 22 bp, Artificial Sequence
  chemically synthesized
agtgtccatcaatggatgaatg

SEQ ID NO: 26044 - DNA, 22 bp, Artificial Sequence
  chemically synthesized
aatattattcaaccatacaaat

SEQ ID NO: 26045 - DNA, 22 bp, Artificial Sequence
  chemically synthesized
ttcaaccatacaaatataaaat

SEQ ID NO: 26046 - DNA, 22 bp, Artificial Sequence
  chemically synthesized
aaccatacaaatataaaatcat

SEQ ID NO: 26047 - DNA, 22 bp, Artificial Sequence
  chemically synthesized
catttgcagcaacatggatgaa

SEQ ID NO: 26048 - DNA, 22 bp, Artificial Sequence
  chemically synthesized
atttgcagcaacatggatgaaa

SEQ ID NO: 26049 - DNA, 22 bp, Artificial Sequence
  chemically synthesized
gcagcaacatggatgaaactgg

SEQ ID NO: 26050 - DNA, 22 bp, Artificial Sequence
  chemically synthesized
cagcaacatggatgaaactgga

SEQ ID NO: 26051 - DNA, 22 bp, Artificial Sequence
  chemically synthesized
gaagtcattatgttaaacgaaa

SEQ ID NO: 26052 - DNA, 22 bp, Artificial Sequence
  chemically synthesized
tgttaaacgaaataagccaggc

SEQ ID NO: 26053 - DNA, 22 bp, Artificial Sequence
  chemically synthesized
aacgaaataagccaggcataga

SEQ ID NO: 26054 - DNA, 22 bp, Artificial Sequence
  chemically synthesized
tgcatgttctcactgatatgtg

SEQ ID NO: 26055 - DNA, 22 bp, Artificial Sequence
  chemically synthesized
gcatgttctcactgatatgtgg

SEQ ID NO: 26056 - DNA, 22 bp, Artificial Sequence
  chemically synthesized
catgttctcactgatatgtggg

SEQ ID NO: 26057 - DNA, 22 bp, Artificial Sequence
  chemically synthesized
tcactgatatgtgggagctaaa

SEQ ID NO: 26058 - DNA, 22 bp, Artificial Sequence
  chemically synthesized
actgatatgtgggagctaaaaa

SEQ ID NO: 26059 - DNA, 22 bp, Artificial Sequence
  chemically synthesized
atatgtgggagctaaaaaagtt

SEQ ID NO: 26060 - DNA, 22 bp, Artificial Sequence
  chemically synthesized
aaaaagttaatatcatgtaggt

SEQ ID NO: 26061 - DNA, 22 bp, Artificial Sequence
  chemically synthesized
atatcatgtaggtagagagtag

SEQ ID NO: 26062 - DNA, 22 bp, Artificial Sequence
  chemically synthesized
tgggaggaagggagacgaagag

SEQ ID NO: 26063 - DNA, 22 bp, Artificial Sequence
  chemically synthesized
gttaatggaaacaggcagttag

SEQ ID NO: 26064 - DNA, 22 bp, Artificial Sequence
  chemically synthesized
atggaaacaggcagttagatag

SEQ ID NO: 26065 - DNA, 22 bp, Artificial Sequence
  chemically synthesized
gatagaaggaatatgttctgat

SEQ ID NO: 26066 - DNA, 22 bp, Artificial Sequence
  chemically synthesized
tgatgttcaatagcaaagtagg

SEQ ID NO: 26067 - DNA, 22 bp, Artificial Sequence
  chemically synthesized
atgttcaatagcaaagtagggt

SEQ ID NO: 26068 - DNA, 22 bp, Artificial Sequence
  chemically synthesized
aatagcaaagtagggtgattat

SEQ ID NO: 26069 - DNA, 22 bp, Artificial Sequence
  chemically synthesized
tagttaaaaacaatatattgta

SEQ ID NO: 26070 - DNA, 22 bp, Artificial Sequence
  chemically synthesized
aaaacaatatattgtatatttc

SEQ ID NO: 26071 - DNA, 22 bp, Artificial Sequence
  chemically synthesized
tatatttcaaaatagtagaaga

SEQ ID NO: 26072 - DNA, 22 bp, Artificial Sequence
  chemically synthesized
caaaatagtagaagaaaggtct

SEQ ID NO: 26073 - DNA, 22 bp, Artificial Sequence
  chemically synthesized
aaaatagtagaagaaaggtctt

SEQ ID NO: 26074 - DNA, 22 bp, Artificial Sequence
  chemically synthesized
gaaatgttcctaacacatagaa

SEQ ID NO: 26075 - DNA, 22 bp, Artificial Sequence
  chemically synthesized
aaatgttcctaacacatagaaa

SEQ ID NO: 26076 - DNA, 22 bp, Artificial Sequence
  chemically synthesized
ctaacacatagaaacgataaat

SEQ ID NO: 26077 - DNA, 22 bp, Artificial Sequence
  chemically synthesized
acacatagaaacgataaatact

SEQ ID NO: 26078 - DNA, 22 bp, Artificial Sequence
  chemically synthesized
gaggtgatgaataccccaaata

SEQ ID NO: 26079 - DNA, 22 bp, Artificial Sequence
  chemically synthesized
aggtgatgaataccccaaatac

SEQ ID NO: 26080 - DNA, 22 bp, Artificial Sequence
  chemically synthesized
acttgatcattatacattatat

SEQ ID NO: 26081 - DNA, 22 bp, Artificial Sequence
  chemically synthesized
gatcattatacattatatgcat

SEQ ID NO: 26082 - DNA, 22 bp, Artificial Sequence
  chemically synthesized
atcattatacattatatgcatg

SEQ ID NO: 26083 - DNA, 22 bp, Artificial Sequence
  chemically synthesized
tacattatatgcatgtaacaaa

SEQ ID NO: 26084 - DNA, 22 bp, Artificial Sequence
  chemically synthesized
tatgcatgtaacaaaatgtcac

SEQ ID NO: 26085 - DNA, 22 bp, Artificial Sequence
  chemically synthesized
atacatataaacacgtcatata

SEQ ID NO: 26086 - DNA, 22 bp, Artificial Sequence
  chemically synthesized
atattggttgaggcctgattgt

SEQ ID NO: 26087 - DNA, 22 bp, Artificial Sequence
  chemically synthesized
gttgaggcctgattgtaagtaa

SEQ ID NO: 26088 - DNA, 22 bp, Artificial Sequence
  chemically synthesized
aggcctgattgtaagtaaatct

SEQ ID NO: 26089 - DNA, 22 bp, Artificial Sequence
  chemically synthesized
attgtaagtaaatctttgtccc

SEQ ID NO: 26090 - DNA, 22 bp, Artificial Sequence
  chemically synthesized
taagtaaatctttgtccctcca

SEQ ID NO: 26091 - DNA, 22 bp, Artificial Sequence
  chemically synthesized
tgtccctccagacatttccctg

SEQ ID NO: 26092 - DNA, 22 bp, Artificial Sequence
  chemically synthesized
gtccctccagacatttccctgt

SEQ ID NO: 26093 - DNA, 22 bp, Artificial Sequence
  chemically synthesized
tccctccagacatttccctgta

SEQ ID NO: 26094 - DNA, 22 bp, Artificial Sequence
  chemically synthesized
cagacatttccctgtactgtct

SEQ ID NO: 26095 - DNA, 22 bp, Artificial Sequence
  chemically synthesized
ccctgtactgtcttgctgtgag

SEQ ID NO: 26096 - DNA, 22 bp, Artificial Sequence
  chemically synthesized
cctgtactgtcttgctgtgagg

SEQ ID NO: 26097 - DNA, 22 bp, Artificial Sequence
  chemically synthesized
tactgtcttgctgtgaggagct

SEQ ID NO: 26098 - DNA, 22 bp, Artificial Sequence
  chemically synthesized
tcttgctgtgaggagcttcttt

SEQ ID NO: 26099 - DNA, 22 bp, Artificial Sequence
  chemically synthesized
gctgtgaggagcttcttttact

SEQ ID NO: 26100 - DNA, 22 bp, Artificial Sequence
  chemically synthesized
ctgtgaggagcttcttttactg

SEQ ID NO: 26101 - DNA, 22 bp, Artificial Sequence
  chemically synthesized
tgaggagcttcttttactgcta

SEQ ID NO: 26102 - DNA, 22 bp, Artificial Sequence
  chemically synthesized
cttttactgctatttcttatat

SEQ ID NO: 26103 - DNA, 22 bp, Artificial Sequence
  chemically synthesized
ttttactgctatttcttatatt

SEQ ID NO: 26104 - DNA, 22 bp, Artificial Sequence
  chemically synthesized
ttactgctatttcttatattcc

SEQ ID NO: 26105 - DNA, 22 bp, Artificial Sequence
  chemically synthesized
tactgctatttcttatattcca

SEQ ID NO: 26106 - DNA, 22 bp, Artificial Sequence
  chemically synthesized
actgctatttcttatattccaa

SEQ ID NO: 26107 - DNA, 22 bp, Artificial Sequence
  chemically synthesized
ctgctatttcttatattccaac

SEQ ID NO: 26108 - DNA, 22 bp, Artificial Sequence
  chemically synthesized
ctatttcttatattccaacacc

SEQ ID NO: 26109 - DNA, 22 bp, Artificial Sequence
  chemically synthesized
tttcttatattccaacaccatt

SEQ ID NO: 26110 - DNA, 22 bp, Artificial Sequence
  chemically synthesized
cttatattccaacaccatttta

SEQ ID NO: 26111 - DNA, 22 bp, Artificial Sequence
  chemically synthesized
ttatattccaacaccattttag

SEQ ID NO: 26112 - DNA, 22 bp, Artificial Sequence
  chemically synthesized
atattccaacaccattttagcc

SEQ ID NO: 26113 - DNA, 22 bp, Artificial Sequence
  chemically synthesized
tattccaacaccattttagccc

SEQ ID NO: 26114 - DNA, 22 bp, Artificial Sequence
  chemically synthesized
caacaccattttagcccttttt

SEQ ID NO: 26115 - DNA, 22 bp, Artificial Sequence
  chemically synthesized
tagcccttttttgtcctcccca

SEQ ID NO: 26116 - DNA, 22 bp, Artificial Sequence
  chemically synthesized
agcccttttttgtcctccccat

SEQ ID NO: 26117 - DNA, 22 bp, Artificial Sequence
  chemically synthesized
gcccttttttgtcctccccata

SEQ ID NO: 26118 - DNA, 22 bp, Artificial Sequence
  chemically synthesized
ttttgtcctccccatattttta

SEQ ID NO: 26119 - DNA, 22 bp, Artificial Sequence
  chemically synthesized
tttgtcctccccatatttttac

SEQ ID NO: 26120 - DNA, 22 bp, Artificial Sequence
  chemically synthesized
ttgtcctccccatatttttacc

SEQ ID NO: 26121 - DNA, 22 bp, Artificial Sequence
  chemically synthesized
tgtcctccccatatttttacct

SEQ ID NO: 26122 - DNA, 22 bp, Artificial Sequence
  chemically synthesized
gtcctccccatatttttacctc

SEQ ID NO: 26123 - DNA, 22 bp, Artificial Sequence
  chemically synthesized
tcctccccatatttttacctcg

SEQ ID NO: 26124 - DNA, 22 bp, Artificial Sequence
  chemically synthesized
cccatatttttacctcggtttt

SEQ ID NO: 26125 - DNA, 22 bp, Artificial Sequence
  chemically synthesized
ttacctcggtttttactgttta

SEQ ID NO: 26126 - DNA, 22 bp, Artificial Sequence
  chemically synthesized
tacctcggtttttactgtttat

SEQ ID NO: 26127 - DNA, 22 bp, Artificial Sequence
  chemically synthesized
acctcggtttttactgtttata

SEQ ID NO: 26128 - DNA, 22 bp, Artificial Sequence
  chemically synthesized
cctcggtttttactgtttatat

SEQ ID NO: 26129 - DNA, 22 bp, Artificial Sequence
  chemically synthesized
ggtttttactgtttatatagca

SEQ ID NO: 26130 - DNA, 22 bp, Artificial Sequence
  chemically synthesized
ttactgtttatatagcacactt

SEQ ID NO: 26131 - DNA, 22 bp, Artificial Sequence
  chemically synthesized
tactgtttatatagcacacttt

SEQ ID NO: 26132 - DNA, 22 bp, Artificial Sequence
  chemically synthesized
actgtttatatagcacactttg

SEQ ID NO: 26133 - DNA, 22 bp, Artificial Sequence
  chemically synthesized
ctgtttatatagcacactttgt

SEQ ID NO: 26134 - DNA, 22 bp, Artificial Sequence
  chemically synthesized
tttatatagcacactttgtgct

SEQ ID NO: 26135 - DNA, 22 bp, Artificial Sequence
  chemically synthesized
atatagcacactttgtgctata

SEQ ID NO: 26136 - DNA, 22 bp, Artificial Sequence
  chemically synthesized
tatagcacactttgtgctatag

SEQ ID NO: 26137 - DNA, 22 bp, Artificial Sequence
  chemically synthesized
tgtgctatagtttacctcagtt

SEQ ID NO: 26138 - DNA, 22 bp, Artificial Sequence
  chemically synthesized
gtgctatagtttacctcagttt

SEQ ID NO: 26139 - DNA, 22 bp, Artificial Sequence
  chemically synthesized
tgctatagtttacctcagtttt

SEQ ID NO: 26140 - DNA, 22 bp, Artificial Sequence
  chemically synthesized
tagtttacctcagtttttacta

SEQ ID NO: 26141 - DNA, 22 bp, Artificial Sequence
  chemically synthesized
acctcagtttttactatttata

SEQ ID NO: 26142 - DNA, 22 bp, Artificial Sequence
  chemically synthesized
cctcagtttttactatttataa

SEQ ID NO: 26143 - DNA, 22 bp, Artificial Sequence
  chemically synthesized
agtttttactatttataaagca

SEQ ID NO: 26144 - DNA, 22 bp, Artificial Sequence
  chemically synthesized
ttactatttataaagcacattt

SEQ ID NO: 26145 - DNA, 22 bp, Artificial Sequence
  chemically synthesized
tactatttataaagcacatttt

SEQ ID NO: 26146 - DNA, 22 bp, Artificial Sequence
  chemically synthesized
actatttataaagcacattttg

SEQ ID NO: 26147 - DNA, 22 bp, Artificial Sequence
  chemically synthesized
ctatttataaagcacattttgc

SEQ ID NO: 26148 - DNA, 22 bp, Artificial Sequence
  chemically synthesized
tttataaagcacattttgcccc

SEQ ID NO: 26149 - DNA, 22 bp, Artificial Sequence
  chemically synthesized
ataaagcacattttgccccaaa

SEQ ID NO: 26150 - DNA, 22 bp, Artificial Sequence
  chemically synthesized
taaagcacattttgccccaaac

SEQ ID NO: 26151 - DNA, 22 bp, Artificial Sequence
  chemically synthesized
tgccccaaacttctctcttaac

SEQ ID NO: 26152 - DNA, 22 bp, Artificial Sequence
  chemically synthesized
gccccaaacttctctcttaaca

SEQ ID NO: 26153 - DNA, 22 bp, Artificial Sequence
  chemically synthesized
ccccaaacttctctcttaacaa

SEQ ID NO: 26154 - DNA, 22 bp, Artificial Sequence
  chemically synthesized
ctctcttaacaagctagaatat

SEQ ID NO: 26155 - DNA, 22 bp, Artificial Sequence
  chemically synthesized
tctcttaacaagctagaatata

SEQ ID NO: 26156 - DNA, 22 bp, Artificial Sequence
  chemically synthesized
tcttaacaagctagaatataag

SEQ ID NO: 26157 - DNA, 22 bp, Artificial Sequence
  chemically synthesized
ttaacaagctagaatataagtg

SEQ ID NO: 26158 - DNA, 22 bp, Artificial Sequence
  chemically synthesized
aacaagctagaatataagtgaa

SEQ ID NO: 26159 - DNA, 22 bp, Artificial Sequence
  chemically synthesized
acaagctagaatataagtgaat

SEQ ID NO: 26160 - DNA, 22 bp, Artificial Sequence
  chemically synthesized
gaatataagtgaatgcaagagc

SEQ ID NO: 26161 - DNA, 22 bp, Artificial Sequence
  chemically synthesized
ctattttcatatttgaggtata

SEQ ID NO: 26162 - DNA, 22 bp, Artificial Sequence
  chemically synthesized
ttttcatatttgaggtataaac

SEQ ID NO: 26163 - DNA, 22 bp, Artificial Sequence
  chemically synthesized
tcatatttgaggtataaaccaa

SEQ ID NO: 26164 - DNA, 22 bp, Artificial Sequence
  chemically synthesized
catatttgaggtataaaccaag

SEQ ID NO: 26165 - DNA, 22 bp, Artificial Sequence
  chemically synthesized
atatttgaggtataaaccaagg

SEQ ID NO: 26166 - DNA, 22 bp, Artificial Sequence
  chemically synthesized
gaggtataaaccaaggagattt

SEQ ID NO: 26167 - DNA, 22 bp, Artificial Sequence
  chemically synthesized
aggtataaaccaaggagattta

SEQ ID NO: 26168 - DNA, 22 bp, Artificial Sequence
  chemically synthesized
acatacacatatatatttttaa

SEQ ID NO: 26169 - DNA, 22 bp, Artificial Sequence
  chemically synthesized
catacacatatatatttttaaa

SEQ ID NO: 26170 - DNA, 22 bp, Artificial Sequence
  chemically synthesized
ttaaatctgcaaataaatggtt

SEQ ID NO: 26171 - DNA, 22 bp, Artificial Sequence
  chemically synthesized
taaatctgcaaataaatggttt

SEQ ID NO: 26172 - DNA, 22 bp, Artificial Sequence
  chemically synthesized
aaatctgcaaataaatggtttt

SEQ ID NO: 26173 - DNA, 22 bp, Artificial Sequence
  chemically synthesized
aatctgcaaataaatggtttta

SEQ ID NO: 26174 - DNA, 22 bp, Artificial Sequence
  chemically synthesized
caaataaatggttttattctga

SEQ ID NO: 26175 - DNA, 22 bp, Artificial Sequence
  chemically synthesized
tattctgacattaaaaaagaaa

SEQ ID NO: 26176 - DNA, 22 bp, Artificial Sequence
  chemically synthesized
attctgacattaaaaaagaaaa

SEQ ID NO: 26177 - DNA, 22 bp, Artificial Sequence
  chemically synthesized
ttctgacattaaaaaagaaaat

SEQ ID NO: 26178 - DNA, 22 bp, Artificial Sequence
  chemically synthesized
tgacattaaaaaagaaaatact

SEQ ID NO: 26179 - DNA, 22 bp, Artificial Sequence
  chemically synthesized
acattaaaaaagaaaatactta

SEQ ID NO: 26180 - DNA, 22 bp, Artificial Sequence
  chemically synthesized
aaaaagaaaatacttaatatca

SEQ ID NO: 26181 - DNA, 22 bp, Artificial Sequence
  chemically synthesized
aatatcattaatgaatgatcgt

SEQ ID NO: 26182 - DNA, 22 bp, Artificial Sequence
  chemically synthesized
atatcattaatgaatgatcgtt

SEQ ID NO: 26183 - DNA, 22 bp, Artificial Sequence
  chemically synthesized
atgaatgatcgttttaccacag

SEQ ID NO: 26184 - DNA, 22 bp, Artificial Sequence
  chemically synthesized
taccacagcgtaggtcattgaa

SEQ ID NO: 26185 - DNA, 22 bp, Artificial Sequence
  chemically synthesized
accacagcgtaggtcattgaat

SEQ ID NO: 26186 - DNA, 22 bp, Artificial Sequence
  chemically synthesized
ccacagcgtaggtcattgaatt

SEQ ID NO: 26187 - DNA, 22 bp, Artificial Sequence
  chemically synthesized
aatttgaacttaaccttcactt

SEQ ID NO: 26188 - DNA, 22 bp, Artificial Sequence
  chemically synthesized
gaacttaaccttcactttcaaa

SEQ ID NO: 26189 - DNA, 22 bp, Artificial Sequence
  chemically synthesized
aacttaaccttcactttcaaac

SEQ ID NO: 26190 - DNA, 22 bp, Artificial Sequence
  chemically synthesized
aaccttcactttcaaacaagta

SEQ ID NO: 26191 - DNA, 22 bp, Artificial Sequence
  chemically synthesized
accttcactttcaaacaagtac

SEQ ID NO: 26192 - DNA, 22 bp, Artificial Sequence
  chemically synthesized
cactttcaaacaagtactttgt

SEQ ID NO: 26193 - DNA, 22 bp, Artificial Sequence
  chemically synthesized
actttcaaacaagtactttgta

SEQ ID NO: 26194 - DNA, 22 bp, Artificial Sequence
  chemically synthesized
tcaaacaagtactttgtatttt

SEQ ID NO: 26195 - DNA, 22 bp, Artificial Sequence
  chemically synthesized
caaacaagtactttgtatttta

SEQ ID NO: 26196 - DNA, 22 bp, Artificial Sequence
  chemically synthesized
aaacaagtactttgtattttat

SEQ ID NO: 26197 - DNA, 22 bp, Artificial Sequence
  chemically synthesized
tgtattttattgatctctattt

SEQ ID NO: 26198 - DNA, 22 bp, Artificial Sequence
  chemically synthesized
gtattttattgatctctatttt

SEQ ID NO: 26199 - DNA, 22 bp, Artificial Sequence
  chemically synthesized
tattttattgatctctattttc

SEQ ID NO: 26200 - DNA, 22 bp, Artificial Sequence
  chemically synthesized
tattgatctctattttcctgga

SEQ ID NO: 26201 - DNA, 22 bp, Artificial Sequence
  chemically synthesized
attgatctctattttcctggaa

SEQ ID NO: 26202 - DNA, 22 bp, Artificial Sequence
  chemically synthesized
ttgatctctattttcctggaac

SEQ ID NO: 26203 - DNA, 22 bp, Artificial Sequence
  chemically synthesized
atctctattttcctggaacaac

SEQ ID NO: 26204 - DNA, 22 bp, Artificial Sequence
  chemically synthesized
tattttcctggaacaacatggg

SEQ ID NO: 26205 - DNA, 22 bp, Artificial Sequence
  chemically synthesized
ttttcctggaacaacatggggg

SEQ ID NO: 26206 - DNA, 22 bp, Artificial Sequence
  chemically synthesized
tcctggaacaacatgggggcta

SEQ ID NO: 26207 - DNA, 22 bp, Artificial Sequence
  chemically synthesized
cctggaacaacatgggggctat

SEQ ID NO: 26208 - DNA, 22 bp, Artificial Sequence
  chemically synthesized
ctggaacaacatgggggctatg

SEQ ID NO: 26209 - DNA, 22 bp, Artificial Sequence
  chemically synthesized
gaacaacatgggggctatgttt

SEQ ID NO: 26210 - DNA, 22 bp, Artificial Sequence
  chemically synthesized
tgtttagcgtgaggacaaagta

SEQ ID NO: 26211 - DNA, 22 bp, Artificial Sequence
  chemically synthesized
agcgtgaggacaaagtatcaca

SEQ ID NO: 26212 - DNA, 22 bp, Artificial Sequence
  chemically synthesized
gcgtgaggacaaagtatcacaa

SEQ ID NO: 26213 - DNA, 22 bp, Artificial Sequence
  chemically synthesized
tcacctgaaagaaaagatgagc

SEQ ID NO: 26214 - DNA, 22 bp, Artificial Sequence
  chemically synthesized
cacctgaaagaaaagatgagct

SEQ ID NO: 26215 - DNA, 22 bp, Artificial Sequence
  chemically synthesized
acctgaaagaaaagatgagcta

SEQ ID NO: 26216 - DNA, 22 bp, Artificial Sequence
  chemically synthesized
aaagaaaagatgagctaccatg

SEQ ID NO: 26217 - DNA, 22 bp, Artificial Sequence
  chemically synthesized
ccatggtacatataacaatgag

SEQ ID NO: 26218 - DNA, 22 bp, Artificial Sequence
  chemically synthesized
aaactctaagtcgtcatctggc

SEQ ID NO: 26219 - DNA, 22 bp, Artificial Sequence
  chemically synthesized
taagtcgtcatctggcaacact

SEQ ID NO: 26220 - DNA, 22 bp, Artificial Sequence
  chemically synthesized
agtcgtcatctggcaacactgc

SEQ ID NO: 26221 - DNA, 22 bp, Artificial Sequence
  chemically synthesized
gcaacactgccaatttactaaa

SEQ ID NO: 26222 - DNA, 22 bp, Artificial Sequence
  chemically synthesized
ccaatttactaaaaatcactat

SEQ ID NO: 26223 - DNA, 22 bp, Artificial Sequence
  chemically synthesized
actaaaaatcactatttcaaag

SEQ ID NO: 26224 - DNA, 22 bp, Artificial Sequence
  chemically synthesized
ctaaaaatcactatttcaaaga

SEQ ID NO: 26225 - DNA, 22 bp, Artificial Sequence
  chemically synthesized
aaaatcactatttcaaagaagt

SEQ ID NO: 26226 - DNA, 22 bp, Artificial Sequence
  chemically synthesized
tttcaaagaagtatagaataga

SEQ ID NO: 26227 - DNA, 22 bp, Artificial Sequence
  chemically synthesized
caaagaagtatagaatagatat

SEQ ID NO: 26228 - DNA, 22 bp, Artificial Sequence
  chemically synthesized
aaagaagtatagaatagatatc

SEQ ID NO: 26229 - DNA, 22 bp, Artificial Sequence
  chemically synthesized
tttctctgcctctctctcgctc

SEQ ID NO: 26230 - DNA, 22 bp, Artificial Sequence
  chemically synthesized
tctctgcctctctctcgctctc

SEQ ID NO: 26231 - DNA, 22 bp, Artificial Sequence
  chemically synthesized
ctctgcctctctctcgctctct

SEQ ID NO: 26232 - DNA, 22 bp, Artificial Sequence
  chemically synthesized
tctgcctctctctcgctctctc

SEQ ID NO: 26233 - DNA, 22 bp, Artificial Sequence
  chemically synthesized
tgcctctctctcgctctctctc

SEQ ID NO: 26234 - DNA, 22 bp, Artificial Sequence
  chemically synthesized
cctctctctcgctctctctctc

SEQ ID NO: 26235 - DNA, 22 bp, Artificial Sequence
  chemically synthesized
tctctcgctctctctctctctc

SEQ ID NO: 26236 - DNA, 22 bp, Artificial Sequence
  chemically synthesized
tctcgctctctctctctctctc

SEQ ID NO: 26237 - DNA, 22 bp, Artificial Sequence
  chemically synthesized
tcgctctctctctctctctccc

SEQ ID NO: 26238 - DNA, 22 bp, Artificial Sequence
  chemically synthesized
gctctctctctctctctccccc

SEQ ID NO: 26239 - DNA, 22 bp, Artificial Sequence
  chemically synthesized
tctctctctctctcccccatct

SEQ ID NO: 26240 - DNA, 22 bp, Artificial Sequence
  chemically synthesized
tctctctctctcccccatctct

SEQ ID NO: 26241 - DNA, 22 bp, Artificial Sequence
  chemically synthesized
tctctctctcccccatctctct

SEQ ID NO: 26242 - DNA, 22 bp, Artificial Sequence
  chemically synthesized
tctctctcccccatctctctct

SEQ ID NO: 26243 - DNA, 22 bp, Artificial Sequence
  chemically synthesized
tctctcccccatctctctctgt

SEQ ID NO: 26244 - DNA, 22 bp, Artificial Sequence
  chemically synthesized
tctcccccatctctctctgtct

SEQ ID NO: 26245 - DNA, 22 bp, Artificial Sequence
  chemically synthesized
tcccccatctctctctgtctct

SEQ ID NO: 26246 - DNA, 22 bp, Artificial Sequence
  chemically synthesized
ccccatctctctctgtctctct

SEQ ID NO: 26247 - DNA, 22 bp, Artificial Sequence
  chemically synthesized
tctctgtctctctctctatata

SEQ ID NO: 26248 - DNA, 22 bp, Artificial Sequence
  chemically synthesized
tctgtctctctctctatatata

SEQ ID NO: 26249 - DNA, 22 bp, Artificial Sequence
  chemically synthesized
tgtctctctctctatatatatg

SEQ ID NO: 26250 - DNA, 22 bp, Artificial Sequence
  chemically synthesized
tctctctctctatatatatgta

SEQ ID NO: 26251 - DNA, 22 bp, Artificial Sequence
  chemically synthesized
tctctctatatatatgtataca

SEQ ID NO: 26252 - DNA, 22 bp, Artificial Sequence
  chemically synthesized
tctctatatatatgtatacaca

SEQ ID NO: 26253 - DNA, 22 bp, Artificial Sequence
  chemically synthesized
tctatatatatgtatacacaca

SEQ ID NO: 26254 - DNA, 22 bp, Artificial Sequence
  chemically synthesized
tatatatatgtatacacacata

SEQ ID NO: 26255 - DNA, 22 bp, Artificial Sequence
  chemically synthesized
tatatatgtatacacacatata

SEQ ID NO: 26256 - DNA, 22 bp, Artificial Sequence
  chemically synthesized
tacacatatggagaaatttcac

SEQ ID NO: 26257 - DNA, 22 bp, Artificial Sequence
  chemically synthesized
cactattttgtatatgcttaaa

SEQ ID NO: 26258 - DNA, 22 bp, Artificial Sequence
  chemically synthesized
actattttgtatatgcttaaaa

SEQ ID NO: 26259 - DNA, 22 bp, Artificial Sequence
  chemically synthesized
ttttgtatatgcttaaaaatta

SEQ ID NO: 26260 - DNA, 22 bp, Artificial Sequence
  chemically synthesized
tgtatatgcttaaaaattacag

SEQ ID NO: 26261 - DNA, 22 bp, Artificial Sequence
  chemically synthesized
gtatatgcttaaaaattacaga

SEQ ID NO: 26262 - DNA, 22 bp, Artificial Sequence
  chemically synthesized
tatatgcttaaaaattacagac

SEQ ID NO: 26263 - DNA, 22 bp, Artificial Sequence
  chemically synthesized
aaaaattacagactttggaagt

SEQ ID NO: 26264 - DNA, 22 bp, Artificial Sequence
  chemically synthesized
aaaattacagactttggaagtc

SEQ ID NO: 26265 - DNA, 22 bp, Artificial Sequence
  chemically synthesized
cagactttggaagtcatatgac

SEQ ID NO: 26266 - DNA, 22 bp, Artificial Sequence
  chemically synthesized
tggaagtcatatgactatttca

SEQ ID NO: 26267 - DNA, 22 bp, Artificial Sequence
  chemically synthesized
ggaagtcatatgactatttcag

SEQ ID NO: 26268 - DNA, 22 bp, Artificial Sequence
  chemically synthesized
gaagtcatatgactatttcagt

SEQ ID NO: 26269 - DNA, 22 bp, Artificial Sequence
  chemically synthesized
tttcagtgtgtgtggctactaa

SEQ ID NO: 26270 - DNA, 22 bp, Artificial Sequence
  chemically synthesized
cagtgtgtgtggctactaatct

SEQ ID NO: 26271 - DNA, 22 bp, Artificial Sequence
  chemically synthesized
agtgtgtgtggctactaatctc

SEQ ID NO: 26272 - DNA, 22 bp, Artificial Sequence
  chemically synthesized
ctaatctcaccctcctgttcca

SEQ ID NO: 26273 - DNA, 22 bp, Artificial Sequence
  chemically synthesized
atctcaccctcctgttccaaaa

SEQ ID NO: 26274 - DNA, 22 bp, Artificial Sequence
  chemically synthesized
accctcctgttccaaaacacag

SEQ ID NO: 26275 - DNA, 22 bp, Artificial Sequence
  chemically synthesized
ctgttccaaaacacagttgcag

SEQ ID NO: 26276 - DNA, 22 bp, Artificial Sequence
  chemically synthesized
ttccaaaacacagttgcagaag

SEQ ID NO: 26277 - DNA, 22 bp, Artificial Sequence
  chemically synthesized
caaaacacagttgcagaagcag

SEQ ID NO: 26278 - DNA, 22 bp, Artificial Sequence
  chemically synthesized
cagaagcagaggaagtcattat

SEQ ID NO: 26279 - DNA, 22 bp, Artificial Sequence
  chemically synthesized
tacacttagaacatcattttat

SEQ ID NO: 26280 - DNA, 22 bp, Artificial Sequence
  chemically synthesized
agaacatcattttataaggcag

SEQ ID NO: 26281 - DNA, 22 bp, Artificial Sequence
  chemically synthesized
gaacatcattttataaggcagc

SEQ ID NO: 26282 - DNA, 22 bp, Artificial Sequence
  chemically synthesized
tataaggcagcaggtctggtag

SEQ ID NO: 26283 - DNA, 22 bp, Artificial Sequence
  chemically synthesized
ataaggcagcaggtctggtagg

SEQ ID NO: 26284 - DNA, 22 bp, Artificial Sequence
  chemically synthesized
taaggcagcaggtctggtagga

SEQ ID NO: 26285 - DNA, 22 bp, Artificial Sequence
  chemically synthesized
gtaggaaggagattaggtgcta

SEQ ID NO: 26286 - DNA, 22 bp, Artificial Sequence
  chemically synthesized
ggtgctacttgtgacaaaggtc

SEQ ID NO: 26287 - DNA, 22 bp, Artificial Sequence
  chemically synthesized
cttgtgacaaaggtcagcaaat

SEQ ID NO: 26288 - DNA, 22 bp, Artificial Sequence
  chemically synthesized
gtgacaaaggtcagcaaatatt

SEQ ID NO: 26289 - DNA, 22 bp, Artificial Sequence
  chemically synthesized
tgacaaaggtcagcaaatattt

SEQ ID NO: 26290 - DNA, 22 bp, Artificial Sequence
  chemically synthesized
gtgttcccagcacttttctaga

SEQ ID NO: 26291 - DNA, 22 bp, Artificial Sequence
  chemically synthesized
tgttcccagcacttttctagat

SEQ ID NO: 26292 - DNA, 22 bp, Artificial Sequence
  chemically synthesized
ccagcacttttctagatcctca

SEQ ID NO: 26293 - DNA, 22 bp, Artificial Sequence
  chemically synthesized
ttctagatcctcagttaaaatc

SEQ ID NO: 26294 - DNA, 22 bp, Artificial Sequence
  chemically synthesized
tctagatcctcagttaaaatca

SEQ ID NO: 26295 - DNA, 22 bp, Artificial Sequence
  chemically synthesized
ctagatcctcagttaaaatcaa

SEQ ID NO: 26296 - DNA, 22 bp, Artificial Sequence
  chemically synthesized
tagatcctcagttaaaatcaaa

SEQ ID NO: 26297 - DNA, 22 bp, Artificial Sequence
  chemically synthesized
gatcctcagttaaaatcaaagc

SEQ ID NO: 26298 - DNA, 22 bp, Artificial Sequence
  chemically synthesized
agttaaaatcaaagcagctgca

SEQ ID NO: 26299 - DNA, 22 bp, Artificial Sequence
  chemically synthesized
aaatcaaagcagctgcagtctt

SEQ ID NO: 26300 - DNA, 22 bp, Artificial Sequence
  chemically synthesized
cagtcttggcagtgggaggtga

SEQ ID NO: 26301 - DNA, 22 bp, Artificial Sequence
  chemically synthesized
ggcagtgggaggtgatactcac

SEQ ID NO: 26302 - DNA, 22 bp, Artificial Sequence
  chemically synthesized
gcagtgggaggtgatactcaca

SEQ ID NO: 26303 - DNA, 22 bp, Artificial Sequence
  chemically synthesized
acactttgaacaagaccacctg

SEQ ID NO: 26304 - DNA, 22 bp, Artificial Sequence
  chemically synthesized
tgaacaagaccacctgcactac

SEQ ID NO: 26305 - DNA, 22 bp, Artificial Sequence
  chemically synthesized
gaacaagaccacctgcactacc

SEQ ID NO: 26306 - DNA, 22 bp, Artificial Sequence
  chemically synthesized
aacaagaccacctgcactacct

SEQ ID NO: 26307 - DNA, 22 bp, Artificial Sequence
  chemically synthesized
cactacctacaatggcagctcc

SEQ ID NO: 26308 - DNA, 22 bp, Artificial Sequence
  chemically synthesized
cctacaatggcagctccaaata

SEQ ID NO: 26309 - DNA, 22 bp, Artificial Sequence
  chemically synthesized
caatggcagctccaaatatttt

SEQ ID NO: 26310 - DNA, 22 bp, Artificial Sequence
  chemically synthesized
caaatattttatatgaaagggg

SEQ ID NO: 26311 - DNA, 22 bp, Artificial Sequence
  chemically synthesized
tatatgaaaggggcctagacat

SEQ ID NO: 26312 - DNA, 22 bp, Artificial Sequence
  chemically synthesized
atatgaaaggggcctagacata

SEQ ID NO: 26313 - DNA, 22 bp, Artificial Sequence
  chemically synthesized
tatgaaaggggcctagacatag

SEQ ID NO: 26314 - DNA, 22 bp, Artificial Sequence
  chemically synthesized
gacatagcatgctgaatgaaaa

SEQ ID NO: 26315 - DNA, 22 bp, Artificial Sequence
  chemically synthesized
aatgaaaaggaagtgagtagac

SEQ ID NO: 26316 - DNA, 22 bp, Artificial Sequence
  chemically synthesized
gtgctttccttgaagctgtgca

SEQ ID NO: 26317 - DNA, 22 bp, Artificial Sequence
  chemically synthesized
tccttgaagctgtgcaaccaag

SEQ ID NO: 26318 - DNA, 22 bp, Artificial Sequence
  chemically synthesized
ccttgaagctgtgcaaccaagc

SEQ ID NO: 26319 - DNA, 22 bp, Artificial Sequence
  chemically synthesized
cttgaagctgtgcaaccaagca

SEQ ID NO: 26320 - DNA, 22 bp, Artificial Sequence
  chemically synthesized
gaagctgtgcaaccaagcatag

SEQ ID NO: 26321 - DNA, 22 bp, Artificial Sequence
  chemically synthesized
aagctgtgcaaccaagcatagt

SEQ ID NO: 26322 - DNA, 22 bp, Artificial Sequence
  chemically synthesized
tgcaaccaagcatagtttttac

SEQ ID NO: 26323 - DNA, 22 bp, Artificial Sequence
  chemically synthesized
ttacatagatcgtgtgtttcac

SEQ ID NO: 26324 - DNA, 22 bp, Artificial Sequence
  chemically synthesized
tacatagatcgtgtgtttcaca

SEQ ID NO: 26325 - DNA, 22 bp, Artificial Sequence
  chemically synthesized
acatagatcgtgtgtttcacat

SEQ ID NO: 26326 - DNA, 22 bp, Artificial Sequence
  chemically synthesized
catagatcgtgtgtttcacatg

SEQ ID NO: 26327 - DNA, 22 bp, Artificial Sequence
  chemically synthesized
cacatggtgtgataacagcttg

SEQ ID NO: 26328 - DNA, 22 bp, Artificial Sequence
  chemically synthesized
acatggtgtgataacagcttga

SEQ ID NO: 26329 - DNA, 22 bp, Artificial Sequence
  chemically synthesized
gagatgccattgacatggccca

SEQ ID NO: 26330 - DNA, 22 bp, Artificial Sequence
  chemically synthesized
agatgccattgacatggcccac

SEQ ID NO: 26331 - DNA, 22 bp, Artificial Sequence
  chemically synthesized
acatggcccaccggcttatcca

SEQ ID NO: 26332 - DNA, 22 bp, Artificial Sequence
  chemically synthesized
atccacatcagtaattagggca

SEQ ID NO: 26333 - DNA, 22 bp, Artificial Sequence
  chemically synthesized
tccacatcagtaattagggcaa

SEQ ID NO: 26334 - DNA, 22 bp, Artificial Sequence
  chemically synthesized
gggcaaagaaatcctaattact

SEQ ID NO: 26335 - DNA, 22 bp, Artificial Sequence
  chemically synthesized
attactatgcatcccgtgattg

SEQ ID NO: 26336 - DNA, 22 bp, Artificial Sequence
  chemically synthesized
ctatgcatcccgtgattgaagt

SEQ ID NO: 26337 - DNA, 22 bp, Artificial Sequence
  chemically synthesized
tgcatcccgtgattgaagtaac

SEQ ID NO: 26338 - DNA, 22 bp, Artificial Sequence
  chemically synthesized
aagtaacattgatgtatacata

SEQ ID NO: 26339 - DNA, 22 bp, Artificial Sequence
  chemically synthesized
atgtatacatattttttcctat

SEQ ID NO: 26340 - DNA, 22 bp, Artificial Sequence
  chemically synthesized
tttcctattatttctctttttg

SEQ ID NO: 26341 - DNA, 22 bp, Artificial Sequence
  chemically synthesized
ttcctattatttctctttttgt

SEQ ID NO: 26342 - DNA, 22 bp, Artificial Sequence
  chemically synthesized
tcctattatttctctttttgtg

SEQ ID NO: 26343 - DNA, 22 bp, Artificial Sequence
  chemically synthesized
cctattatttctctttttgtgt

SEQ ID NO: 26344 - DNA, 22 bp, Artificial Sequence
  chemically synthesized
ctattatttctctttttgtgtt

SEQ ID NO: 26345 - DNA, 22 bp, Artificial Sequence
  chemically synthesized
ttatttctctttttgtgtttaa

SEQ ID NO: 26346 - DNA, 22 bp, Artificial Sequence
  chemically synthesized
tttctctttttgtgtttaaaaa

SEQ ID NO: 26347 - DNA, 22 bp, Artificial Sequence
  chemically synthesized
ctctttttgtgtttaaaaatgc

SEQ ID NO: 26348 - DNA, 22 bp, Artificial Sequence
  chemically synthesized
tctttttgtgtttaaaaatgca

SEQ ID NO: 26349 - DNA, 22 bp, Artificial Sequence
  chemically synthesized
tttttgtgtttaaaaatgcaat

SEQ ID NO: 26350 - DNA, 22 bp, Artificial Sequence
  chemically synthesized
tttgtgtttaaaaatgcaatta

SEQ ID NO: 26351 - DNA, 22 bp, Artificial Sequence
  chemically synthesized
ttgtgtttaaaaatgcaattat

SEQ ID NO: 26352 - DNA, 22 bp, Artificial Sequence
  chemically synthesized
tgtgtttaaaaatgcaattatg

SEQ ID NO: 26353 - DNA, 22 bp, Artificial Sequence
  chemically synthesized
gtgtttaaaaatgcaattatgg

SEQ ID NO: 26354 - DNA, 22 bp, Artificial Sequence
  chemically synthesized
tgtttaaaaatgcaattatgga

SEQ ID NO: 26355 - DNA, 22 bp, Artificial Sequence
  chemically synthesized
aaaaatgcaattatggactcat

SEQ ID NO: 26356 - DNA, 22 bp, Artificial Sequence
  chemically synthesized
aaaatgcaattatggactcatt

SEQ ID NO: 26357 - DNA, 22 bp, Artificial Sequence
  chemically synthesized
tggactcattcaaagtgaaagc

SEQ ID NO: 26358 - DNA, 22 bp, Artificial Sequence
  chemically synthesized
attcaaagtgaaagctggtatg

SEQ ID NO: 26359 - DNA, 22 bp, Artificial Sequence
  chemically synthesized
aaagtgaaagctggtatgacaa

SEQ ID NO: 26360 - DNA, 22 bp, Artificial Sequence
  chemically synthesized
gtatgacaatacatgagctaac

SEQ ID NO: 26361 - DNA, 22 bp, Artificial Sequence
  chemically synthesized
acttcctcattttatgaataaa

SEQ ID NO: 26362 - DNA, 22 bp, Artificial Sequence
  chemically synthesized
cctcattttatgaataaatttt

SEQ ID NO: 26363 - DNA, 22 bp, Artificial Sequence
  chemically synthesized
ctcattttatgaataaatttta

SEQ ID NO: 26364 - DNA, 22 bp, Artificial Sequence
  chemically synthesized
attttatgaataaattttataa

SEQ ID NO: 26365 - DNA, 22 bp, Artificial Sequence
  chemically synthesized
tatgaataaattttataaagaa

SEQ ID NO: 26366 - DNA, 22 bp, Artificial Sequence
  chemically synthesized
atgaataaattttataaagaaa

SEQ ID NO: 26367 - DNA, 22 bp, Artificial Sequence
  chemically synthesized
tgaataaattttataaagaaat

SEQ ID NO: 26368 - DNA, 22 bp, Artificial Sequence
  chemically synthesized
tataaagaaataagctaatacc

SEQ ID NO: 26369 - DNA, 22 bp, Artificial Sequence
  chemically synthesized
ataaagaaataagctaatacct

SEQ ID NO: 26370 - DNA, 22 bp, Artificial Sequence
  chemically synthesized
taaagaaataagctaataccta

SEQ ID NO: 26371 - DNA, 22 bp, Artificial Sequence
  chemically synthesized
atacctacagagtgtttattaa

SEQ ID NO: 26372 - DNA, 22 bp, Artificial Sequence
  chemically synthesized
cagagtgtttattaaatgctag

SEQ ID NO: 26373 - DNA, 22 bp, Artificial Sequence
  chemically synthesized
attaaatgctaggcacagttct

SEQ ID NO: 26374 - DNA, 22 bp, Artificial Sequence
  chemically synthesized
ttaaatgctaggcacagttctg

SEQ ID NO: 26375 - DNA, 22 bp, Artificial Sequence
  chemically synthesized
aatgctaggcacagttctgagt

SEQ ID NO: 26376 - DNA, 22 bp, Artificial Sequence
  chemically synthesized
ggcacagttctgagtgatttac

SEQ ID NO: 26377 - DNA, 22 bp, Artificial Sequence
  chemically synthesized
tgagtgatttacaactggtatt

SEQ ID NO: 26378 - DNA, 22 bp, Artificial Sequence
  chemically synthesized
agtgatttacaactggtatttc

SEQ ID NO: 26379 - DNA, 22 bp, Artificial Sequence
  chemically synthesized
acaactggtatttcttttaatt

SEQ ID NO: 26380 - DNA, 22 bp, Artificial Sequence
  chemically synthesized
caactggtatttcttttaattt

SEQ ID NO: 26381 - DNA, 22 bp, Artificial Sequence
  chemically synthesized
gtatttcttttaattttcacaa

SEQ ID NO: 26382 - DNA, 22 bp, Artificial Sequence
  chemically synthesized
cttttaattttcacaacattat

SEQ ID NO: 26383 - DNA, 22 bp, Artificial Sequence
  chemically synthesized
ttttaattttcacaacattatt

SEQ ID NO: 26384 - DNA, 22 bp, Artificial Sequence
  chemically synthesized
ttaattttcacaacattattac

SEQ ID NO: 26385 - DNA, 22 bp, Artificial Sequence
  chemically synthesized
taattttcacaacattattaca

SEQ ID NO: 26386 - DNA, 22 bp, Artificial Sequence
  chemically synthesized
aattttcacaacattattacag

SEQ ID NO: 26387 - DNA, 22 bp, Artificial Sequence
  chemically synthesized
attttcacaacattattacagg

SEQ ID NO: 26388 - DNA, 22 bp, Artificial Sequence
  chemically synthesized
tcacaacattattacaggtaga

SEQ ID NO: 26389 - DNA, 22 bp, Artificial Sequence
  chemically synthesized
cacaacattattacaggtagat

SEQ ID NO: 26390 - DNA, 22 bp, Artificial Sequence
  chemically synthesized
acaacattattacaggtagatt

SEQ ID NO: 26391 - DNA, 22 bp, Artificial Sequence
  chemically synthesized
ttacaggtagattttatatatg

SEQ ID NO: 26392 - DNA, 22 bp, Artificial Sequence
  chemically synthesized
caggtagattttatatatggag

SEQ ID NO: 26393 - DNA, 22 bp, Artificial Sequence
  chemically synthesized
tatatatggagaaactgaggca

SEQ ID NO: 26394 - DNA, 22 bp, Artificial Sequence
  chemically synthesized
atatatggagaaactgaggcac

SEQ ID NO: 26395 - DNA, 22 bp, Artificial Sequence
  chemically synthesized
tatatggagaaactgaggcaca

SEQ ID NO: 26396 - DNA, 22 bp, Artificial Sequence
  chemically synthesized
aggcacagagatgctatgtaat

SEQ ID NO: 26397 - DNA, 22 bp, Artificial Sequence
  chemically synthesized
tgtaataaatctcaacattacc

SEQ ID NO: 26398 - DNA, 22 bp, Artificial Sequence
  chemically synthesized
aacattacccaggtgatggtgg

SEQ ID NO: 26399 - DNA, 22 bp, Artificial Sequence
  chemically synthesized
cccaggtgatggtggagttgga

SEQ ID NO: 26400 - DNA, 22 bp, Artificial Sequence
  chemically synthesized
gaattccaaatcatgcagtctg

SEQ ID NO: 26401 - DNA, 22 bp, Artificial Sequence
  chemically synthesized
caaatcatgcagtctgacttta

SEQ ID NO: 26402 - DNA, 22 bp, Artificial Sequence
  chemically synthesized
actttagctgtagacagcaaga

SEQ ID NO: 26403 - DNA, 22 bp, Artificial Sequence
  chemically synthesized
tagctgtagacagcaagatagt

SEQ ID NO: 26404 - DNA, 22 bp, Artificial Sequence
  chemically synthesized
agctgtagacagcaagatagta

SEQ ID NO: 26405 - DNA, 22 bp, Artificial Sequence
  chemically synthesized
gctgtagacagcaagatagtaa

SEQ ID NO: 26406 - DNA, 22 bp, Artificial Sequence
  chemically synthesized
tagacagcaagatagtaagtaa

SEQ ID NO: 26407 - DNA, 22 bp, Artificial Sequence
  chemically synthesized
atggatctttttgcttttgctt

SEQ ID NO: 26408 - DNA, 22 bp, Artificial Sequence
  chemically synthesized
tttgcttttgcttgtttgtttg

SEQ ID NO: 26409 - DNA, 22 bp, Artificial Sequence
  chemically synthesized
ttgcttttgcttgtttgtttga

SEQ ID NO: 26410 - DNA, 22 bp, Artificial Sequence
  chemically synthesized
tgcttttgcttgtttgtttgaa

SEQ ID NO: 26411 - DNA, 22 bp, Artificial Sequence
  chemically synthesized
gcttttgcttgtttgtttgaaa

SEQ ID NO: 26412 - DNA, 22 bp, Artificial Sequence
  chemically synthesized
cttttgcttgtttgtttgaaac

SEQ ID NO: 26413 - DNA, 22 bp, Artificial Sequence
  chemically synthesized
ttgcttgtttgtttgaaacagg

SEQ ID NO: 26414 - DNA, 22 bp, Artificial Sequence
  chemically synthesized
tgcttgtttgtttgaaacaggg

SEQ ID NO: 26415 - DNA, 22 bp, Artificial Sequence
  chemically synthesized
gcttgtttgtttgaaacagggt

SEQ ID NO: 26416 - DNA, 22 bp, Artificial Sequence
  chemically synthesized
cttgtttgtttgaaacagggtc

SEQ ID NO: 26417 - DNA, 22 bp, Artificial Sequence
  chemically synthesized
gtttgtttgaaacagggtctca

SEQ ID NO: 26418 - DNA, 22 bp, Artificial Sequence
  chemically synthesized
tttgtttgaaacagggtctcac

SEQ ID NO: 26419 - DNA, 22 bp, Artificial Sequence
  chemically synthesized
gtttgaaacagggtctcactct

SEQ ID NO: 26420 - DNA, 22 bp, Artificial Sequence
  chemically synthesized
tttgaaacagggtctcactctg

SEQ ID NO: 26421 - DNA, 22 bp, Artificial Sequence
  chemically synthesized
gaaacagggtctcactctgtca

SEQ ID NO: 26422 - DNA, 22 bp, Artificial Sequence
  chemically synthesized
aaacagggtctcactctgtcac

SEQ ID NO: 26423 - DNA, 22 bp, Artificial Sequence
  chemically synthesized
actctgtcaccccggctggagt

SEQ ID NO: 26424 - DNA, 22 bp, Artificial Sequence
  chemically synthesized
tgtcaccccggctggagtgcaa

SEQ ID NO: 26425 - DNA, 22 bp, Artificial Sequence
  chemically synthesized
tcaccccggctggagtgcaatg

SEQ ID NO: 26426 - DNA, 22 bp, Artificial Sequence
  chemically synthesized
gagtgcaatggtgcaatcttgc

SEQ ID NO: 26427 - DNA, 22 bp, Artificial Sequence
  chemically synthesized
gctcactgaagcctcactagaa

SEQ ID NO: 26428 - DNA, 22 bp, Artificial Sequence
  chemically synthesized
ctcactgaagcctcactagaac

SEQ ID NO: 26429 - DNA, 22 bp, Artificial Sequence
  chemically synthesized
actgaagcctcactagaacgcc

SEQ ID NO: 26430 - DNA, 22 bp, Artificial Sequence
  chemically synthesized
aagcctcactagaacgcctgga

SEQ ID NO: 26431 - DNA, 22 bp, Artificial Sequence
  chemically synthesized
actagaacgcctggattcaatt

SEQ ID NO: 26432 - DNA, 22 bp, Artificial Sequence
  chemically synthesized
gaacgcctggattcaattgatc

SEQ ID NO: 26433 - DNA, 22 bp, Artificial Sequence
  chemically synthesized
gattcaattgatcctcctgctt

SEQ ID NO: 26434 - DNA, 22 bp, Artificial Sequence
  chemically synthesized
aattgatcctcctgctttagcc

SEQ ID NO: 26435 - DNA, 22 bp, Artificial Sequence
  chemically synthesized
atcctcctgctttagcctctca

SEQ ID NO: 26436 - DNA, 22 bp, Artificial Sequence
  chemically synthesized
ctgctttagcctctcaggtagc

SEQ ID NO: 26437 - DNA, 22 bp, Artificial Sequence
  chemically synthesized
ctttagcctctcaggtagctag

SEQ ID NO: 26438 - DNA, 22 bp, Artificial Sequence
  chemically synthesized
tagcctctcaggtagctaggac

SEQ ID NO: 26439 - DNA, 22 bp, Artificial Sequence
  chemically synthesized
agcctctcaggtagctaggact

SEQ ID NO: 26440 - DNA, 22 bp, Artificial Sequence
  chemically synthesized
gcctctcaggtagctaggacta

SEQ ID NO: 26441 - DNA, 22 bp, Artificial Sequence
  chemically synthesized
tcaggtagctaggactacaggt

SEQ ID NO: 26442 - DNA, 22 bp, Artificial Sequence
  chemically synthesized
aggtagctaggactacaggtgt

SEQ ID NO: 26443 - DNA, 22 bp, Artificial Sequence
  chemically synthesized
ggactacaggtgtgagcctcca

SEQ ID NO: 26444 - DNA, 22 bp, Artificial Sequence
  chemically synthesized
caggtgtgagcctccatggcca

SEQ ID NO: 26445 - DNA, 22 bp, Artificial Sequence
  chemically synthesized
catggccagctagagaaatttt

SEQ ID NO: 26446 - DNA, 22 bp, Artificial Sequence
  chemically synthesized
gagaaattttttaaatttctgt

SEQ ID NO: 26447 - DNA, 22 bp, Artificial Sequence
  chemically synthesized
tttaaatttctgtagaaacagg

SEQ ID NO: 26448 - DNA, 22 bp, Artificial Sequence
  chemically synthesized
ttaaatttctgtagaaacaggg

SEQ ID NO: 26449 - DNA, 22 bp, Artificial Sequence
  chemically synthesized
taaatttctgtagaaacagggt

SEQ ID NO: 26450 - DNA, 22 bp, Artificial Sequence
  chemically synthesized
aaatttctgtagaaacagggtc

SEQ ID NO: 26451 - DNA, 22 bp, Artificial Sequence
  chemically synthesized
aatttctgtagaaacagggtct

SEQ ID NO: 26452 - DNA, 22 bp, Artificial Sequence
  chemically synthesized
ctgtagaaacagggtctcccta

SEQ ID NO: 26453 - DNA, 22 bp, Artificial Sequence
  chemically synthesized
tgtagaaacagggtctccctat

SEQ ID NO: 26454 - DNA, 22 bp, Artificial Sequence
  chemically synthesized
tagaaacagggtctccctatgt

SEQ ID NO: 26455 - DNA, 22 bp, Artificial Sequence
  chemically synthesized
cctatgttccccaggctggtat

SEQ ID NO: 26456 - DNA, 22 bp, Artificial Sequence
  chemically synthesized
tgttccccaggctggtatccaa

SEQ ID NO: 26457 - DNA, 22 bp, Artificial Sequence
  chemically synthesized
cccaggctggtatccaactctt

SEQ ID NO: 26458 - DNA, 22 bp, Artificial Sequence
  chemically synthesized
gtatccaactcttggtctcaaa

SEQ ID NO: 26459 - DNA, 22 bp, Artificial Sequence
  chemically synthesized
ttggtctcaaacaattctccca

SEQ ID NO: 26460 - DNA, 22 bp, Artificial Sequence
  chemically synthesized
ggtctcaaacaattctcccacc

SEQ ID NO: 26461 - DNA, 22 bp, Artificial Sequence
  chemically synthesized
gtctcaaacaattctcccacct

SEQ ID NO: 26462 - DNA, 22 bp, Artificial Sequence
  chemically synthesized
aaacaattctcccacctcagcc

SEQ ID NO: 26463 - DNA, 22 bp, Artificial Sequence
  chemically synthesized
tcccacctcagccttgaaaagt

SEQ ID NO: 26464 - DNA, 22 bp, Artificial Sequence
  chemically synthesized
ccacctcagccttgaaaagtgt

SEQ ID NO: 26465 - DNA, 22 bp, Artificial Sequence
  chemically synthesized
agccttgaaaagtgttgagatt

SEQ ID NO: 26466 - DNA, 22 bp, Artificial Sequence
  chemically synthesized
gaaaagtgttgagattacaggt

SEQ ID NO: 26467 - DNA, 22 bp, Artificial Sequence
  chemically synthesized
aaaagtgttgagattacaggtg

SEQ ID NO: 26468 - DNA, 22 bp, Artificial Sequence
  chemically synthesized
agattacaggtgtgaatcacca

SEQ ID NO: 26469 - DNA, 22 bp, Artificial Sequence
  chemically synthesized
caggtgtgaatcaccatgctgg

SEQ ID NO: 26470 - DNA, 22 bp, Artificial Sequence
  chemically synthesized
ggccttgatggatctttaaaag

SEQ ID NO: 26471 - DNA, 22 bp, Artificial Sequence
  chemically synthesized
gatggatctttaaaagtggtgg

SEQ ID NO: 26472 - DNA, 22 bp, Artificial Sequence
  chemically synthesized
atggatctttaaaagtggtggg

SEQ ID NO: 26473 - DNA, 22 bp, Artificial Sequence
  chemically synthesized
taaaagtggtggggggtaggag

SEQ ID NO: 26474 - DNA, 22 bp, Artificial Sequence
  chemically synthesized
aaaagtggtggggggtaggaga

SEQ ID NO: 26475 - DNA, 22 bp, Artificial Sequence
  chemically synthesized
aaagtggtggggggtaggagaa

SEQ ID NO: 26476 - DNA, 22 bp, Artificial Sequence
  chemically synthesized
ggtctcgggaaggatgggatcc

SEQ ID NO: 26477 - DNA, 22 bp, Artificial Sequence
  chemically synthesized
gggaaggatgggatccttttca

SEQ ID NO: 26478 - DNA, 22 bp, Artificial Sequence
  chemically synthesized
ttcattttgctctagagaaaag

SEQ ID NO: 26479 - DNA, 22 bp, Artificial Sequence
  chemically synthesized
tcattttgctctagagaaaagc

SEQ ID NO: 26480 - DNA, 22 bp, Artificial Sequence
  chemically synthesized
cattttgctctagagaaaagcc

SEQ ID NO: 26481 - DNA, 22 bp, Artificial Sequence
  chemically synthesized
attttgctctagagaaaagcca

SEQ ID NO: 26482 - DNA, 22 bp, Artificial Sequence
  chemically synthesized
tgctctagagaaaagccatttg

SEQ ID NO: 26483 - DNA, 22 bp, Artificial Sequence
  chemically synthesized
gctctagagaaaagccatttgg

SEQ ID NO: 26484 - DNA, 22 bp, Artificial Sequence
  chemically synthesized
ctctagagaaaagccatttgga

SEQ ID NO: 26485 - DNA, 22 bp, Artificial Sequence
  chemically synthesized
tagagaaaagccatttggaaaa

SEQ ID NO: 26486 - DNA, 22 bp, Artificial Sequence
  chemically synthesized
gagaaaagccatttggaaaact

SEQ ID NO: 26487 - DNA, 22 bp, Artificial Sequence
  chemically synthesized
ggaaaacttctgtgttaacaaa

SEQ ID NO: 26488 - DNA, 22 bp, Artificial Sequence
  chemically synthesized
gaaaacttctgtgttaacaaaa

SEQ ID NO: 26489 - DNA, 22 bp, Artificial Sequence
  chemically synthesized
ctgtgttaacaaaaaacagccg

SEQ ID NO: 26490 - DNA, 22 bp, Artificial Sequence
  chemically synthesized
tgtgttaacaaaaaacagccga

SEQ ID NO: 26491 - DNA, 22 bp, Artificial Sequence
  chemically synthesized
tgttaacaaaaaacagccgagt

SEQ ID NO: 26492 - DNA, 22 bp, Artificial Sequence
  chemically synthesized
acaaaaaacagccgagtagcct

SEQ ID NO: 26493 - DNA, 22 bp, Artificial Sequence
  chemically synthesized
gtattaaactttagagcagttg

SEQ ID NO: 26494 - DNA, 22 bp, Artificial Sequence
  chemically synthesized
aactttagagcagttgttcttt

SEQ ID NO: 26495 - DNA, 22 bp, Artificial Sequence
  chemically synthesized
tagagcagttgttctttacggc

SEQ ID NO: 26496 - DNA, 22 bp, Artificial Sequence
  chemically synthesized
agagcagttgttctttacggca

SEQ ID NO: 26497 - DNA, 22 bp, Artificial Sequence
  chemically synthesized
gagcagttgttctttacggcaa

SEQ ID NO: 26498 - DNA, 22 bp, Artificial Sequence
  chemically synthesized
ttctttacggcaattacagggg

SEQ ID NO: 26499 - DNA, 22 bp, Artificial Sequence
  chemically synthesized
tttacggcaattacaggggcct

SEQ ID NO: 26500 - DNA, 22 bp, Artificial Sequence
  chemically synthesized
tacggcaattacaggggccttc

SEQ ID NO: 26501 - DNA, 22 bp, Artificial Sequence
  chemically synthesized
acggcaattacaggggccttca

SEQ ID NO: 26502 - DNA, 22 bp, Artificial Sequence
  chemically synthesized
cggcaattacaggggccttcag

SEQ ID NO: 26503 - DNA, 22 bp, Artificial Sequence
  chemically synthesized
caggggccttcaggaagctgat

SEQ ID NO: 26504 - DNA, 22 bp, Artificial Sequence
  chemically synthesized
caggaagctgatggaagtgtga

SEQ ID NO: 26505 - DNA, 22 bp, Artificial Sequence
  chemically synthesized
aggaagctgatggaagtgtgaa

SEQ ID NO: 26506 - DNA, 22 bp, Artificial Sequence
  chemically synthesized
atggaagtgtgaagtcctcttc

SEQ ID NO: 26507 - DNA, 22 bp, Artificial Sequence
  chemically synthesized
ttctcagagaaaagtacttcta

SEQ ID NO: 26508 - DNA, 22 bp, Artificial Sequence
  chemically synthesized
ctcagagaaaagtacttctata

SEQ ID NO: 26509 - DNA, 22 bp, Artificial Sequence
  chemically synthesized
tcagagaaaagtacttctatat

SEQ ID NO: 26510 - DNA, 22 bp, Artificial Sequence
  chemically synthesized
agagaaaagtacttctatatac

SEQ ID NO: 26511 - DNA, 22 bp, Artificial Sequence
  chemically synthesized
ctatatacgtgcacctaatttt

SEQ ID NO: 26512 - DNA, 22 bp, Artificial Sequence
  chemically synthesized
tatatacgtgcacctaattttt

SEQ ID NO: 26513 - DNA, 22 bp, Artificial Sequence
  chemically synthesized
tatacgtgcacctaatttttag

SEQ ID NO: 26514 - DNA, 22 bp, Artificial Sequence
  chemically synthesized
atttttagatataatttctgaa

SEQ ID NO: 26515 - DNA, 22 bp, Artificial Sequence
  chemically synthesized
ttagatataatttctgaaggtt

SEQ ID NO: 26516 - DNA, 22 bp, Artificial Sequence
  chemically synthesized
tagatataatttctgaaggttt

SEQ ID NO: 26517 - DNA, 22 bp, Artificial Sequence
  chemically synthesized
agatataatttctgaaggttta

SEQ ID NO: 26518 - DNA, 22 bp, Artificial Sequence
  chemically synthesized
gatataatttctgaaggtttag

SEQ ID NO: 26519 - DNA, 22 bp, Artificial Sequence
  chemically synthesized
ctgaaggtttagaaactccttg

SEQ ID NO: 26520 - DNA, 22 bp, Artificial Sequence
  chemically synthesized
tgaaggtttagaaactccttga

SEQ ID NO: 26521 - DNA, 22 bp, Artificial Sequence
  chemically synthesized
aaggtttagaaactccttgagt

SEQ ID NO: 26522 - DNA, 22 bp, Artificial Sequence
  chemically synthesized
agaaactccttgagttcactta

SEQ ID NO: 26523 - DNA, 22 bp, Artificial Sequence
  chemically synthesized
gaaactccttgagttcacttat

SEQ ID NO: 26524 - DNA, 22 bp, Artificial Sequence
  chemically synthesized
cttgagttcacttatatcaaag

SEQ ID NO: 26525 - DNA, 22 bp, Artificial Sequence
  chemically synthesized
gagttcacttatatcaaagtcc

SEQ ID NO: 26526 - DNA, 22 bp, Artificial Sequence
  chemically synthesized
agttcacttatatcaaagtcct

SEQ ID NO: 26527 - DNA, 22 bp, Artificial Sequence
  chemically synthesized
acttatatcaaagtcctcacct

SEQ ID NO: 26528 - DNA, 22 bp, Artificial Sequence
  chemically synthesized
atatcaaagtcctcacctttag

SEQ ID NO: 26529 - DNA, 22 bp, Artificial Sequence
  chemically synthesized
tatcaaagtcctcacctttaga

SEQ ID NO: 26530 - DNA, 22 bp, Artificial Sequence
  chemically synthesized
acctttagaactcctgtcctag

SEQ ID NO: 26531 - DNA, 22 bp, Artificial Sequence
  chemically synthesized
tagaactcctgtcctagaagag

SEQ ID NO: 26532 - DNA, 22 bp, Artificial Sequence
  chemically synthesized
agaactcctgtcctagaagagt

SEQ ID NO: 26533 - DNA, 22 bp, Artificial Sequence
  chemically synthesized
gaactcctgtcctagaagagtg

SEQ ID NO: 26534 - DNA, 22 bp, Artificial Sequence
  chemically synthesized
ctgtcctagaagagtggactca

SEQ ID NO: 26535 - DNA, 22 bp, Artificial Sequence
  chemically synthesized
tcctagaagagtggactcatta

SEQ ID NO: 26536 - DNA, 22 bp, Artificial Sequence
  chemically synthesized
gaagagtggactcattattata

SEQ ID NO: 26537 - DNA, 22 bp, Artificial Sequence
  chemically synthesized
attattataatttcttccataa

SEQ ID NO: 26538 - DNA, 22 bp, Artificial Sequence
  chemically synthesized
ttataatttcttccataaccac

SEQ ID NO: 26539 - DNA, 22 bp, Artificial Sequence
  chemically synthesized
taatttcttccataaccacttt

SEQ ID NO: 26540 - DNA, 22 bp, Artificial Sequence
  chemically synthesized
cttccataaccactttgactct

SEQ ID NO: 26541 - DNA, 22 bp, Artificial Sequence
  chemically synthesized
ttccataaccactttgactcta

SEQ ID NO: 26542 - DNA, 22 bp, Artificial Sequence
  chemically synthesized
ccataaccactttgactctagt

SEQ ID NO: 26543 - DNA, 22 bp, Artificial Sequence
  chemically synthesized
cataaccactttgactctagtt

SEQ ID NO: 26544 - DNA, 22 bp, Artificial Sequence
  chemically synthesized
tgactctagttttctgaattct

SEQ ID NO: 26545 - DNA, 22 bp, Artificial Sequence
  chemically synthesized
gactctagttttctgaattctt

SEQ ID NO: 26546 - DNA, 22 bp, Artificial Sequence
  chemically synthesized
actctagttttctgaattcttc

SEQ ID NO: 26547 - DNA, 22 bp, Artificial Sequence
  chemically synthesized
tagttttctgaattcttccctg

SEQ ID NO: 26548 - DNA, 22 bp, Artificial Sequence
  chemically synthesized
gttttctgaattcttccctgtg

SEQ ID NO: 26549 - DNA, 22 bp, Artificial Sequence
  chemically synthesized
tctgaattcttccctgtgccac

SEQ ID NO: 26550 - DNA, 22 bp, Artificial Sequence
  chemically synthesized
ctgaattcttccctgtgccact

SEQ ID NO: 26551 - DNA, 22 bp, Artificial Sequence
  chemically synthesized
tgaattcttccctgtgccactt

SEQ ID NO: 26552 - DNA, 22 bp, Artificial Sequence
  chemically synthesized
aattcttccctgtgccacttgt

SEQ ID NO: 26553 - DNA, 22 bp, Artificial Sequence
  chemically synthesized
ttccctgtgccacttgtaccat

SEQ ID NO: 26554 - DNA, 22 bp, Artificial Sequence
  chemically synthesized
ccctgtgccacttgtaccatgt

SEQ ID NO: 26555 - DNA, 22 bp, Artificial Sequence
  chemically synthesized
cctgtgccacttgtaccatgta

SEQ ID NO: 26556 - DNA, 22 bp, Artificial Sequence
  chemically synthesized
tgccacttgtaccatgtaattc

SEQ ID NO: 26557 - DNA, 22 bp, Artificial Sequence
  chemically synthesized
gtaccatgtaattcagaggtgt

SEQ ID NO: 26558 - DNA, 22 bp, Artificial Sequence
  chemically synthesized
taccatgtaattcagaggtgta

SEQ ID NO: 26559 - DNA, 22 bp, Artificial Sequence
  chemically synthesized
agaggtgtagtgtcaagactga

SEQ ID NO: 26560 - DNA, 22 bp, Artificial Sequence
  chemically synthesized
aggaggaagcaggtaaattatg

SEQ ID NO: 26561 - DNA, 22 bp, Artificial Sequence
  chemically synthesized
tgtccagcaatacgttggctta

SEQ ID NO: 26562 - DNA, 22 bp, Artificial Sequence
  chemically synthesized
gcttaggcaaaaacaaattgtt

SEQ ID NO: 26563 - DNA, 22 bp, Artificial Sequence
  chemically synthesized
aggcaaaaacaaattgtttcta

SEQ ID NO: 26564 - DNA, 22 bp, Artificial Sequence
  chemically synthesized
ggcaaaaacaaattgtttctag

SEQ ID NO: 26565 - DNA, 22 bp, Artificial Sequence
  chemically synthesized
tttctagtccattttaagaggg

SEQ ID NO: 26566 - DNA, 22 bp, Artificial Sequence
  chemically synthesized
ctagtccattttaagagggaag

SEQ ID NO: 26567 - DNA, 22 bp, Artificial Sequence
  chemically synthesized
tagtccattttaagagggaagc

SEQ ID NO: 26568 - DNA, 22 bp, Artificial Sequence
  chemically synthesized
gtccattttaagagggaagcat

SEQ ID NO: 26569 - DNA, 22 bp, Artificial Sequence
  chemically synthesized
taagagggaagcatttatttag

SEQ ID NO: 26570 - DNA, 22 bp, Artificial Sequence
  chemically synthesized
aagagggaagcatttatttagg

SEQ ID NO: 26571 - DNA, 22 bp, Artificial Sequence
  chemically synthesized
agagggaagcatttatttaggg

SEQ ID NO: 26572 - DNA, 22 bp, Artificial Sequence
  chemically synthesized
atttagggactacatcgctcaa

SEQ ID NO: 26573 - DNA, 22 bp, Artificial Sequence
  chemically synthesized
tttagggactacatcgctcaag

SEQ ID NO: 26574 - DNA, 22 bp, Artificial Sequence
  chemically synthesized
agggactacatcgctcaagtct

SEQ ID NO: 26575 - DNA, 22 bp, Artificial Sequence
  chemically synthesized
gggactacatcgctcaagtctt

SEQ ID NO: 26576 - DNA, 22 bp, Artificial Sequence
  chemically synthesized
catcgctcaagtctttacaatt

SEQ ID NO: 26577 - DNA, 22 bp, Artificial Sequence
  chemically synthesized
aagtctttacaattcttaaatt

SEQ ID NO: 26578 - DNA, 22 bp, Artificial Sequence
  chemically synthesized
tacaattcttaaattaactttc

SEQ ID NO: 26579 - DNA, 22 bp, Artificial Sequence
  chemically synthesized
acaattcttaaattaactttca

SEQ ID NO: 26580 - DNA, 22 bp, Artificial Sequence
  chemically synthesized
caattcttaaattaactttcat

SEQ ID NO: 26581 - DNA, 22 bp, Artificial Sequence
  chemically synthesized
ttaaattaactttcattatgtg

SEQ ID NO: 26582 - DNA, 22 bp, Artificial Sequence
  chemically synthesized
aaattaactttcattatgtgtg

SEQ ID NO: 26583 - DNA, 22 bp, Artificial Sequence
  chemically synthesized
aattaactttcattatgtgtga

SEQ ID NO: 26584 - DNA, 22 bp, Artificial Sequence
  chemically synthesized
actttcattatgtgtgacaaca

SEQ ID NO: 26585 - DNA, 22 bp, Artificial Sequence
  chemically synthesized
tcattatgtgtgacaacattta

SEQ ID NO: 26586 - DNA, 22 bp, Artificial Sequence
  chemically synthesized
cattatgtgtgacaacatttat

SEQ ID NO: 26587 - DNA, 22 bp, Artificial Sequence
  chemically synthesized
attatgtgtgacaacatttatt

SEQ ID NO: 26588 - DNA, 22 bp, Artificial Sequence
  chemically synthesized
tgtgtgacaacatttattaaac

SEQ ID NO: 26589 - DNA, 22 bp, Artificial Sequence
  chemically synthesized
attaaacttttttaatgatcct

SEQ ID NO: 26590 - DNA, 22 bp, Artificial Sequence
  chemically synthesized
ttaaacttttttaatgatccta

SEQ ID NO: 26591 - DNA, 22 bp, Artificial Sequence
  chemically synthesized
aacttttttaatgatcctaaat

SEQ ID NO: 26592 - DNA, 22 bp, Artificial Sequence
  chemically synthesized
ttttaatgatcctaaatatcct

SEQ ID NO: 26593 - DNA, 22 bp, Artificial Sequence
  chemically synthesized
tttaatgatcctaaatatcctt

SEQ ID NO: 26594 - DNA, 22 bp, Artificial Sequence
  chemically synthesized
ttaatgatcctaaatatcctta

SEQ ID NO: 26595 - DNA, 22 bp, Artificial Sequence
  chemically synthesized
taatgatcctaaatatccttaa

SEQ ID NO: 26596 - DNA, 22 bp, Artificial Sequence
  chemically synthesized
aatgatcctaaatatccttaac

SEQ ID NO: 26597 - DNA, 22 bp, Artificial Sequence
  chemically synthesized
atgatcctaaatatccttaaca

SEQ ID NO: 26598 - DNA, 22 bp, Artificial Sequence
  chemically synthesized
aatatccttaacatgttaattt

SEQ ID NO: 26599 - DNA, 22 bp, Artificial Sequence
  chemically synthesized
aacatgttaatttctccagagt

SEQ ID NO: 26600 - DNA, 22 bp, Artificial Sequence
  chemically synthesized
acatgttaatttctccagagtt

SEQ ID NO: 26601 - DNA, 22 bp, Artificial Sequence
  chemically synthesized
atttctccagagtttgtaatgt

SEQ ID NO: 26602 - DNA, 22 bp, Artificial Sequence
  chemically synthesized
ctccagagtttgtaatgttctg

SEQ ID NO: 26603 - DNA, 22 bp, Artificial Sequence
  chemically synthesized
tccagagtttgtaatgttctga

SEQ ID NO: 26604 - DNA, 22 bp, Artificial Sequence
  chemically synthesized
cagagtttgtaatgttctgagc

SEQ ID NO: 26605 - DNA, 22 bp, Artificial Sequence
  chemically synthesized
gtaatgttctgagcaagtgtgt

SEQ ID NO: 26606 - DNA, 22 bp, Artificial Sequence
  chemically synthesized
taatgttctgagcaagtgtgtg

SEQ ID NO: 26607 - DNA, 22 bp, Artificial Sequence
  chemically synthesized
tgagcaagtgtgtgcagaagaa

SEQ ID NO: 26608 - DNA, 22 bp, Artificial Sequence
  chemically synthesized
agcaagtgtgtgcagaagaaat

SEQ ID NO: 26609 - DNA, 22 bp, Artificial Sequence
  chemically synthesized
tagtaagacctgggcaaaggag

SEQ ID NO: 26610 - DNA, 22 bp, Artificial Sequence
  chemically synthesized
ggcaaaggagagagtaaacatt

SEQ ID NO: 26611 - DNA, 22 bp, Artificial Sequence
  chemically synthesized
ttcccccacatttgggcaaaac

SEQ ID NO: 26612 - DNA, 22 bp, Artificial Sequence
  chemically synthesized
tcccccacatttgggcaaaact

SEQ ID NO: 26613 - DNA, 22 bp, Artificial Sequence
  chemically synthesized
cccccacatttgggcaaaactt

SEQ ID NO: 26614 - DNA, 22 bp, Artificial Sequence
  chemically synthesized
ccccacatttgggcaaaacttt

SEQ ID NO: 26615 - DNA, 22 bp, Artificial Sequence
  chemically synthesized
gggcaaaactttccatcctggg

SEQ ID NO: 26616 - DNA, 22 bp, Artificial Sequence
  chemically synthesized
ggcaaaactttccatcctgggt

SEQ ID NO: 26617 - DNA, 22 bp, Artificial Sequence
  chemically synthesized
tccatcctgggtcacaccacag

SEQ ID NO: 26618 - DNA, 22 bp, Artificial Sequence
  chemically synthesized
ccatcctgggtcacaccacagt

SEQ ID NO: 26619 - DNA, 22 bp, Artificial Sequence
  chemically synthesized
catcctgggtcacaccacagtc

SEQ ID NO: 26620 - DNA, 22 bp, Artificial Sequence
  chemically synthesized
ggtcacaccacagtctaatttc

SEQ ID NO: 26621 - DNA, 22 bp, Artificial Sequence
  chemically synthesized
atttccctcctctcctctccct

SEQ ID NO: 26622 - DNA, 22 bp, Artificial Sequence
  chemically synthesized
ccctcctctcctctccctcaac

SEQ ID NO: 26623 - DNA, 22 bp, Artificial Sequence
  chemically synthesized
cctcctctcctctccctcaact

SEQ ID NO: 26624 - DNA, 22 bp, Artificial Sequence
  chemically synthesized
ctctcctctccctcaactggta

SEQ ID NO: 26625 - DNA, 22 bp, Artificial Sequence
  chemically synthesized
tcctctccctcaactggtaaca

SEQ ID NO: 26626 - DNA, 22 bp, Artificial Sequence
  chemically synthesized
ctctccctcaactggtaacagt

SEQ ID NO: 26627 - DNA, 22 bp, Artificial Sequence
  chemically synthesized
tccctcaactggtaacagtgct

SEQ ID NO: 26628 - DNA, 22 bp, Artificial Sequence
  chemically synthesized
cctcaactggtaacagtgcttc

SEQ ID NO: 26629 - DNA, 22 bp, Artificial Sequence
  chemically synthesized
aactggtaacagtgcttcttcc

SEQ ID NO: 26630 - DNA, 22 bp, Artificial Sequence
  chemically synthesized
gtaacagtgcttcttccaaaac

SEQ ID NO: 26631 - DNA, 22 bp, Artificial Sequence
  chemically synthesized
cttccaaaacatacctgactac

SEQ ID NO: 26632 - DNA, 22 bp, Artificial Sequence
  chemically synthesized
ttccaaaacatacctgactact

SEQ ID NO: 26633 - DNA, 22 bp, Artificial Sequence
  chemically synthesized
ccaaaacatacctgactactta

SEQ ID NO: 26634 - DNA, 22 bp, Artificial Sequence
  chemically synthesized
caaaacatacctgactacttag

SEQ ID NO: 26635 - DNA, 22 bp, Artificial Sequence
  chemically synthesized
actacttagtacttcccactac

SEQ ID NO: 26636 - DNA, 22 bp, Artificial Sequence
  chemically synthesized
cttagtacttcccactactgtg

SEQ ID NO: 26637 - DNA, 22 bp, Artificial Sequence
  chemically synthesized
agtacttcccactactgtggat

SEQ ID NO: 26638 - DNA, 22 bp, Artificial Sequence
  chemically synthesized
gtacttcccactactgtggata

SEQ ID NO: 26639 - DNA, 22 bp, Artificial Sequence
  chemically synthesized
cccactactgtggatagaattt

SEQ ID NO: 26640 - DNA, 22 bp, Artificial Sequence
  chemically synthesized
ccactactgtggatagaatttc

SEQ ID NO: 26641 - DNA, 22 bp, Artificial Sequence
  chemically synthesized
ctgtggatagaatttcagtgac

SEQ ID NO: 26642 - DNA, 22 bp, Artificial Sequence
  chemically synthesized
tggatagaatttcagtgactcc

SEQ ID NO: 26643 - DNA, 22 bp, Artificial Sequence
  chemically synthesized
cagtgactcctcattcattgtt

SEQ ID NO: 26644 - DNA, 22 bp, Artificial Sequence
  chemically synthesized
agtgactcctcattcattgttc

SEQ ID NO: 26645 - DNA, 22 bp, Artificial Sequence
  chemically synthesized
ctcattcattgttcataccctg

SEQ ID NO: 26646 - DNA, 22 bp, Artificial Sequence
  chemically synthesized
attcattgttcataccctggag

SEQ ID NO: 26647 - DNA, 22 bp, Artificial Sequence
  chemically synthesized
attgttcataccctggagacaa

SEQ ID NO: 26648 - DNA, 22 bp, Artificial Sequence
  chemically synthesized
ttcataccctggagacaaaact

SEQ ID NO: 26649 - DNA, 22 bp, Artificial Sequence
  chemically synthesized
ataccctggagacaaaactcct

SEQ ID NO: 26650 - DNA, 22 bp, Artificial Sequence
  chemically synthesized
gagacaaaactccttaaggcta

SEQ ID NO: 26651 - DNA, 22 bp, Artificial Sequence
  chemically synthesized
cttaaggctattaactccccct

SEQ ID NO: 26652 - DNA, 22 bp, Artificial Sequence
  chemically synthesized
aaggctattaactccccctgag

SEQ ID NO: 26653 - DNA, 22 bp, Artificial Sequence
  chemically synthesized
aggctattaactccccctgagc

SEQ ID NO: 26654 - DNA, 22 bp, Artificial Sequence
  chemically synthesized
ttaactccccctgagcttcaca

SEQ ID NO: 26655 - DNA, 22 bp, Artificial Sequence
  chemically synthesized
actccccctgagcttcacaatc

SEQ ID NO: 26656 - DNA, 22 bp, Artificial Sequence
  chemically synthesized
cccctgagcttcacaatctagt

SEQ ID NO: 26657 - DNA, 22 bp, Artificial Sequence
  chemically synthesized
agcttcacaatctagtccctgc

SEQ ID NO: 26658 - DNA, 22 bp, Artificial Sequence
  chemically synthesized
cacaatctagtccctgcaggtc

SEQ ID NO: 26659 - DNA, 22 bp, Artificial Sequence
  chemically synthesized
acaatctagtccctgcaggtct

SEQ ID NO: 26660 - DNA, 22 bp, Artificial Sequence
  chemically synthesized
gtccctgcaggtctctcccatc

SEQ ID NO: 26661 - DNA, 22 bp, Artificial Sequence
  chemically synthesized
caggtctctcccatcttctctc

SEQ ID NO: 26662 - DNA, 22 bp, Artificial Sequence
  chemically synthesized
tcccatcttctctcatactcct

SEQ ID NO: 26663 - DNA, 22 bp, Artificial Sequence
  chemically synthesized
ccatcttctctcatactcctct

SEQ ID NO: 26664 - DNA, 22 bp, Artificial Sequence
  chemically synthesized
ctctcatactcctctccttttc

SEQ ID NO: 26665 - DNA, 22 bp, Artificial Sequence
  chemically synthesized
tctcatactcctctccttttcc

SEQ ID NO: 26666 - DNA, 22 bp, Artificial Sequence
  chemically synthesized
tcatactcctctccttttccct

SEQ ID NO: 26667 - DNA, 22 bp, Artificial Sequence
  chemically synthesized
atactcctctccttttccctct

SEQ ID NO: 26668 - DNA, 22 bp, Artificial Sequence
  chemically synthesized
ctctccttttccctctctgagc

SEQ ID NO: 26669 - DNA, 22 bp, Artificial Sequence
  chemically synthesized
tccttttccctctctgagcccc

SEQ ID NO: 26670 - DNA, 22 bp, Artificial Sequence
  chemically synthesized
cttttccctctctgagccccgc

SEQ ID NO: 26671 - DNA, 22 bp, Artificial Sequence
  chemically synthesized
ttccctctctgagccccgctca

SEQ ID NO: 26672 - DNA, 22 bp, Artificial Sequence
  chemically synthesized
tccctctctgagccccgctcag

SEQ ID NO: 26673 - DNA, 22 bp, Artificial Sequence
  chemically synthesized
ccctctctgagccccgctcaga

SEQ ID NO: 26674 - DNA, 22 bp, Artificial Sequence
  chemically synthesized
cctctctgagccccgctcagat

SEQ ID NO: 26675 - DNA, 22 bp, Artificial Sequence
  chemically synthesized
tctgagccccgctcagatcttc

SEQ ID NO: 26676 - DNA, 22 bp, Artificial Sequence
  chemically synthesized
tgagccccgctcagatcttcga

SEQ ID NO: 26677 - DNA, 22 bp, Artificial Sequence
  chemically synthesized
agccccgctcagatcttcgaac

SEQ ID NO: 26678 - DNA, 22 bp, Artificial Sequence
  chemically synthesized
agatcttcgaacagagaacact

SEQ ID NO: 26679 - DNA, 22 bp, Artificial Sequence
  chemically synthesized
cgaacagagaacacttctgcat

SEQ ID NO: 26680 - DNA, 22 bp, Artificial Sequence
  chemically synthesized
gaacagagaacacttctgcatc

SEQ ID NO: 26681 - DNA, 22 bp, Artificial Sequence
  chemically synthesized
ctgcatcttggcatatatagtt

SEQ ID NO: 26682 - DNA, 22 bp, Artificial Sequence
  chemically synthesized
tgcatcttggcatatatagttc

SEQ ID NO: 26683 - DNA, 22 bp, Artificial Sequence
  chemically synthesized
catcttggcatatatagttctc

SEQ ID NO: 26684 - DNA, 22 bp, Artificial Sequence
  chemically synthesized
ggcatatatagttctctcacat

SEQ ID NO: 26685 - DNA, 22 bp, Artificial Sequence
  chemically synthesized
gcatatatagttctctcacata

SEQ ID NO: 26686 - DNA, 22 bp, Artificial Sequence
  chemically synthesized
tctcacatagaacgctttctcc

SEQ ID NO: 26687 - DNA, 22 bp, Artificial Sequence
  chemically synthesized
tcacatagaacgctttctcccc

SEQ ID NO: 26688 - DNA, 22 bp, Artificial Sequence
  chemically synthesized
acatagaacgctttctcccctt

SEQ ID NO: 26689 - DNA, 22 bp, Artificial Sequence
  chemically synthesized
tctcccctttagctatttatcc

SEQ ID NO: 26690 - DNA, 22 bp, Artificial Sequence
  chemically synthesized
ctcccctttagctatttatcct

SEQ ID NO: 26691 - DNA, 22 bp, Artificial Sequence
  chemically synthesized
tcccctttagctatttatcctt

SEQ ID NO: 26692 - DNA, 22 bp, Artificial Sequence
  chemically synthesized
ccctttagctatttatccttca

SEQ ID NO: 26693 - DNA, 22 bp, Artificial Sequence
  chemically synthesized
tagctatttatccttcaagtgt

SEQ ID NO: 26694 - DNA, 22 bp, Artificial Sequence
  chemically synthesized
agctatttatccttcaagtgtc

SEQ ID NO: 26695 - DNA, 22 bp, Artificial Sequence
  chemically synthesized
gctatttatccttcaagtgtca

SEQ ID NO: 26696 - DNA, 22 bp, Artificial Sequence
  chemically synthesized
tttatccttcaagtgtcagctc

SEQ ID NO: 26697 - DNA, 22 bp, Artificial Sequence
  chemically synthesized
atccttcaagtgtcagctcaaa

SEQ ID NO: 26698 - DNA, 22 bp, Artificial Sequence
  chemically synthesized
tccttcaagtgtcagctcaaac

SEQ ID NO: 26699 - DNA, 22 bp, Artificial Sequence
  chemically synthesized
caagtgtcagctcaaacatctc

SEQ ID NO: 26700 - DNA, 22 bp, Artificial Sequence
  chemically synthesized
aagtgtcagctcaaacatctca

SEQ ID NO: 26701 - DNA, 22 bp, Artificial Sequence
  chemically synthesized
aaacatctcatcattagagagg

SEQ ID NO: 26702 - DNA, 22 bp, Artificial Sequence
  chemically synthesized
atcattagagaggtttttccca

SEQ ID NO: 26703 - DNA, 22 bp, Artificial Sequence
  chemically synthesized
gagaggtttttcccaaacctct

SEQ ID NO: 26704 - DNA, 22 bp, Artificial Sequence
  chemically synthesized
ttcccaaacctctaggtaacta

SEQ ID NO: 26705 - DNA, 22 bp, Artificial Sequence
  chemically synthesized
tcccaaacctctaggtaactag

SEQ ID NO: 26706 - DNA, 22 bp, Artificial Sequence
  chemically synthesized
cccaaacctctaggtaactagg

SEQ ID NO: 26707 - DNA, 22 bp, Artificial Sequence
  chemically synthesized
ccaaacctctaggtaactaggt

SEQ ID NO: 26708 - DNA, 22 bp, Artificial Sequence
  chemically synthesized
taggtaactaggttagaaacca

SEQ ID NO: 26709 - DNA, 22 bp, Artificial Sequence
  chemically synthesized
ggtaactaggttagaaaccact

SEQ ID NO: 26710 - DNA, 22 bp, Artificial Sequence
  chemically synthesized
ggttagaaaccactccccattc

SEQ ID NO: 26711 - DNA, 22 bp, Artificial Sequence
  chemically synthesized
gaaaccactccccattccacgg

SEQ ID NO: 26712 - DNA, 22 bp, Artificial Sequence
  chemically synthesized
cccattccacggtacactgtat

SEQ ID NO: 26713 - DNA, 22 bp, Artificial Sequence
  chemically synthesized
cacggtacactgtatagtctta

SEQ ID NO: 26714 - DNA, 22 bp, Artificial Sequence
  chemically synthesized
tatagtcttaggacacctggtt

SEQ ID NO: 26715 - DNA, 22 bp, Artificial Sequence
  chemically synthesized
aggacacctggttcccttagtc

SEQ ID NO: 26716 - DNA, 22 bp, Artificial Sequence
  chemically synthesized
ggacacctggttcccttagtct

SEQ ID NO: 26717 - DNA, 22 bp, Artificial Sequence
  chemically synthesized
gttcccttagtctcacactcat

SEQ ID NO: 26718 - DNA, 22 bp, Artificial Sequence
  chemically synthesized
ccttagtctcacactcatcaca

SEQ ID NO: 26719 - DNA, 22 bp, Artificial Sequence
  chemically synthesized
agtctcacactcatcacatttg

SEQ ID NO: 26720 - DNA, 22 bp, Artificial Sequence
  chemically synthesized
gtctcacactcatcacatttga

SEQ ID NO: 26721 - DNA, 22 bp, Artificial Sequence
  chemically synthesized
acactcatcacatttgactgta

SEQ ID NO: 26722 - DNA, 22 bp, Artificial Sequence
  chemically synthesized
atcacatttgactgtattgtat

SEQ ID NO: 26723 - DNA, 22 bp, Artificial Sequence
  chemically synthesized
gactgtattgtatgttcaatgt

SEQ ID NO: 26724 - DNA, 22 bp, Artificial Sequence
  chemically synthesized
actgtattgtatgttcaatgtc

SEQ ID NO: 26725 - DNA, 22 bp, Artificial Sequence
  chemically synthesized
tattgtatgttcaatgtctacc

SEQ ID NO: 26726 - DNA, 22 bp, Artificial Sequence
  chemically synthesized
tatgttcaatgtctaccttcta

SEQ ID NO: 26727 - DNA, 22 bp, Artificial Sequence
  chemically synthesized
aatgtctaccttctacaaattt

SEQ ID NO: 26728 - DNA, 22 bp, Artificial Sequence
  chemically synthesized
ccttctacaaatttgtcaattc

SEQ ID NO: 26729 - DNA, 22 bp, Artificial Sequence
  chemically synthesized
ctacaaatttgtcaattcttga

SEQ ID NO: 26730 - DNA, 22 bp, Artificial Sequence
  chemically synthesized
tacaaatttgtcaattcttgaa

SEQ ID NO: 26731 - DNA, 22 bp, Artificial Sequence
  chemically synthesized
caaatttgtcaattcttgaaga

SEQ ID NO: 26732 - DNA, 22 bp, Artificial Sequence
  chemically synthesized
gtcaattcttgaagattaagaa

SEQ ID NO: 26733 - DNA, 22 bp, Artificial Sequence
  chemically synthesized
tcaattcttgaagattaagaat

SEQ ID NO: 26734 - DNA, 22 bp, Artificial Sequence
  chemically synthesized
ttgaagattaagaatcagttct

SEQ ID NO: 26735 - DNA, 22 bp, Artificial Sequence
  chemically synthesized
gaagattaagaatcagttctgt

SEQ ID NO: 26736 - DNA, 22 bp, Artificial Sequence
  chemically synthesized
aagattaagaatcagttctgta

SEQ ID NO: 26737 - DNA, 22 bp, Artificial Sequence
  chemically synthesized
agaatcagttctgtattcttaa

SEQ ID NO: 26738 - DNA, 22 bp, Artificial Sequence
  chemically synthesized
tgtattcttaactctatctccc

SEQ ID NO: 26739 - DNA, 22 bp, Artificial Sequence
  chemically synthesized
tattcttaactctatctccctc

SEQ ID NO: 26740 - DNA, 22 bp, Artificial Sequence
  chemically synthesized
ttaactctatctccctcgcctc

SEQ ID NO: 26741 - DNA, 22 bp, Artificial Sequence
  chemically synthesized
aactctatctccctcgcctctc

SEQ ID NO: 26742 - DNA, 22 bp, Artificial Sequence
  chemically synthesized
actctatctccctcgcctctca

SEQ ID NO: 26743 - DNA, 22 bp, Artificial Sequence
  chemically synthesized
tatctccctcgcctctcagtgc

SEQ ID NO: 26744 - DNA, 22 bp, Artificial Sequence
  chemically synthesized
tctccctcgcctctcagtgcct

SEQ ID NO: 26745 - DNA, 22 bp, Artificial Sequence
  chemically synthesized
cctcgcctctcagtgcctgata

SEQ ID NO: 26746 - DNA, 22 bp, Artificial Sequence
  chemically synthesized
gcctctcagtgcctgataccta

SEQ ID NO: 26747 - DNA, 22 bp, Artificial Sequence
  chemically synthesized
tcagtgcctgatacctaataga

SEQ ID NO: 26748 - DNA, 22 bp, Artificial Sequence
  chemically synthesized
agtgcctgatacctaatagaca

SEQ ID NO: 26749 - DNA, 22 bp, Artificial Sequence
  chemically synthesized
atacctaatagacacttgatga

SEQ ID NO: 26750 - DNA, 22 bp, Artificial Sequence
  chemically synthesized
atagacacttgatgaatcctta

SEQ ID NO: 26751 - DNA, 22 bp, Artificial Sequence
  chemically synthesized
gatgaatccttactgaataata

SEQ ID NO: 26752 - DNA, 22 bp, Artificial Sequence
  chemically synthesized
atgaatccttactgaataataa

SEQ ID NO: 26753 - DNA, 22 bp, Artificial Sequence
  chemically synthesized
actgaataataaaatggattaa

SEQ ID NO: 26754 - DNA, 22 bp, Artificial Sequence
  chemically synthesized
ctgaataataaaatggattaat

SEQ ID NO: 26755 - DNA, 22 bp, Artificial Sequence
  chemically synthesized
aataataaaatggattaatgaa

SEQ ID NO: 26756 - DNA, 22 bp, Artificial Sequence
  chemically synthesized
atgaataaaagcaataaatttc

SEQ ID NO: 26757 - DNA, 22 bp, Artificial Sequence
  chemically synthesized
caaggttaatattaataaatta

SEQ ID NO: 26758 - DNA, 22 bp, Artificial Sequence
  chemically synthesized
aaggttaatattaataaattaa

SEQ ID NO: 26759 - DNA, 22 bp, Artificial Sequence
  chemically synthesized
atattaataaattaaaaaggtt

SEQ ID NO: 26760 - DNA, 22 bp, Artificial Sequence
  chemically synthesized
ataaattaaaaaggttattttg

SEQ ID NO: 26761 - DNA, 22 bp, Artificial Sequence
  chemically synthesized
aaaaggttattttgaagtctga

SEQ ID NO: 26762 - DNA, 22 bp, Artificial Sequence
  chemically synthesized
ttttgaagtctgagaattagta

SEQ ID NO: 26763 - DNA, 22 bp, Artificial Sequence
  chemically synthesized
tgaagtctgagaattagtaccc

SEQ ID NO: 26764 - DNA, 22 bp, Artificial Sequence
  chemically synthesized
gaagtctgagaattagtaccca

SEQ ID NO: 26765 - DNA, 22 bp, Artificial Sequence
  chemically synthesized
aagtctgagaattagtacccaa

SEQ ID NO: 26766 - DNA, 22 bp, Artificial Sequence
  chemically synthesized
agaattagtacccaaaactaac

SEQ ID NO: 26767 - DNA, 22 bp, Artificial Sequence
  chemically synthesized
gtacccaaaactaactgtgact

SEQ ID NO: 26768 - DNA, 22 bp, Artificial Sequence
  chemically synthesized
actgtgactctctcatctgtta

SEQ ID NO: 26769 - DNA, 22 bp, Artificial Sequence
  chemically synthesized
tgactctctcatctgttatgtt

SEQ ID NO: 26770 - DNA, 22 bp, Artificial Sequence
  chemically synthesized
tctcatctgttatgtttttcac

SEQ ID NO: 26771 - DNA, 22 bp, Artificial Sequence
  chemically synthesized
tcatctgttatgtttttcacgt

SEQ ID NO: 26772 - DNA, 22 bp, Artificial Sequence
  chemically synthesized
atctgttatgtttttcacgttt

SEQ ID NO: 26773 - DNA, 22 bp, Artificial Sequence
  chemically synthesized
ttatgtttttcacgtttccatt

SEQ ID NO: 26774 - DNA, 22 bp, Artificial Sequence
  chemically synthesized
tgtttttcacgtttccattgtt

SEQ ID NO: 26775 - DNA, 22 bp, Artificial Sequence
  chemically synthesized
ttcacgtttccattgttcatgg

SEQ ID NO: 26776 - DNA, 22 bp, Artificial Sequence
  chemically synthesized
tcacgtttccattgttcatggg

SEQ ID NO: 26777 - DNA, 22 bp, Artificial Sequence
  chemically synthesized
cacgtttccattgttcatgggc

SEQ ID NO: 26778 - DNA, 22 bp, Artificial Sequence
  chemically synthesized
acgtttccattgttcatgggca

SEQ ID NO: 26779 - DNA, 22 bp, Artificial Sequence
  chemically synthesized
ccattgttcatgggcaaaattc

SEQ ID NO: 26780 - DNA, 22 bp, Artificial Sequence
  chemically synthesized
cattgttcatgggcaaaattct

SEQ ID NO: 26781 - DNA, 22 bp, Artificial Sequence
  chemically synthesized
ttcatgggcaaaattctggcag

SEQ ID NO: 26782 - DNA, 22 bp, Artificial Sequence
  chemically synthesized
atgggcaaaattctggcagcaa

SEQ ID NO: 26783 - DNA, 22 bp, Artificial Sequence
  chemically synthesized
tggcagcaagggattcttctcc

SEQ ID NO: 26784 - DNA, 22 bp, Artificial Sequence
  chemically synthesized
gcagcaagggattcttctccta

SEQ ID NO: 26785 - DNA, 22 bp, Artificial Sequence
  chemically synthesized
ttctcctaagaaaccttttgtt

SEQ ID NO: 26786 - DNA, 22 bp, Artificial Sequence
  chemically synthesized
ctcctaagaaaccttttgtttt

SEQ ID NO: 26787 - DNA, 22 bp, Artificial Sequence
  chemically synthesized
tcctaagaaaccttttgttttc

SEQ ID NO: 26788 - DNA, 22 bp, Artificial Sequence
  chemically synthesized
ctaagaaaccttttgttttctt

SEQ ID NO: 26789 - DNA, 22 bp, Artificial Sequence
  chemically synthesized
agaaaccttttgttttcttgga

SEQ ID NO: 26790 - DNA, 22 bp, Artificial Sequence
  chemically synthesized
ttgttttcttggatgtgaatac

SEQ ID NO: 26791 - DNA, 22 bp, Artificial Sequence
  chemically synthesized
tgttttcttggatgtgaataca

SEQ ID NO: 26792 - DNA, 22 bp, Artificial Sequence
  chemically synthesized
gttttcttggatgtgaatacat

SEQ ID NO: 26793 - DNA, 22 bp, Artificial Sequence
  chemically synthesized
ttttcttggatgtgaatacatt

SEQ ID NO: 26794 - DNA, 22 bp, Artificial Sequence
  chemically synthesized
tcttggatgtgaatacatttcc

SEQ ID NO: 26795 - DNA, 22 bp, Artificial Sequence
  chemically synthesized
cttggatgtgaatacatttcct

SEQ ID NO: 26796 - DNA, 22 bp, Artificial Sequence
  chemically synthesized
ttggatgtgaatacatttcctt

SEQ ID NO: 26797 - DNA, 22 bp, Artificial Sequence
  chemically synthesized
ggatgtgaatacatttccttgt

SEQ ID NO: 26798 - DNA, 22 bp, Artificial Sequence
  chemically synthesized
gatgtgaatacatttccttgtt

SEQ ID NO: 26799 - DNA, 22 bp, Artificial Sequence
  chemically synthesized
ccttgtttgccagaaaacatgg

SEQ ID NO: 26800 - DNA, 22 bp, Artificial Sequence
  chemically synthesized
cttgtttgccagaaaacatggt

SEQ ID NO: 26801 - DNA, 22 bp, Artificial Sequence
  chemically synthesized
gtttgccagaaaacatggtaag

SEQ ID NO: 26802 - DNA, 22 bp, Artificial Sequence
  chemically synthesized
tttgccagaaaacatggtaaga

SEQ ID NO: 26803 - DNA, 22 bp, Artificial Sequence
  chemically synthesized
gccagaaaacatggtaagataa

SEQ ID NO: 26804 - DNA, 22 bp, Artificial Sequence
  chemically synthesized
ccagaaaacatggtaagataac

SEQ ID NO: 26805 - DNA, 22 bp, Artificial Sequence
  chemically synthesized
gagagtataacattcattttat

SEQ ID NO: 26806 - DNA, 22 bp, Artificial Sequence
  chemically synthesized
attttattcatgaagaaactgt

SEQ ID NO: 26807 - DNA, 22 bp, Artificial Sequence
  chemically synthesized
tattcatgaagaaactgttatt

SEQ ID NO: 26808 - DNA, 22 bp, Artificial Sequence
  chemically synthesized
attcatgaagaaactgttattc

SEQ ID NO: 26809 - DNA, 22 bp, Artificial Sequence
  chemically synthesized
ttcatgaagaaactgttattca

SEQ ID NO: 26810 - DNA, 22 bp, Artificial Sequence
  chemically synthesized
atgaagaaactgttattcagtt

SEQ ID NO: 26811 - DNA, 22 bp, Artificial Sequence
  chemically synthesized
ttattcagtttaaggggttctt

SEQ ID NO: 26812 - DNA, 22 bp, Artificial Sequence
  chemically synthesized
ttcagtttaaggggttcttttt

SEQ ID NO: 26813 - DNA, 22 bp, Artificial Sequence
  chemically synthesized
agtttaaggggttctttttcag

SEQ ID NO: 26814 - DNA, 22 bp, Artificial Sequence
  chemically synthesized
aaggggttctttttcagaaagt

SEQ ID NO: 26815 - DNA, 22 bp, Artificial Sequence
  chemically synthesized
aggggttctttttcagaaagtt

SEQ ID NO: 26816 - DNA, 22 bp, Artificial Sequence
  chemically synthesized
tttttcagaaagtttcagaaat

SEQ ID NO: 26817 - DNA, 22 bp, Artificial Sequence
  chemically synthesized
tttcagaaagtttcagaaatcc

SEQ ID NO: 26818 - DNA, 22 bp, Artificial Sequence
  chemically synthesized
ttcagaaagtttcagaaatcca

SEQ ID NO: 26819 - DNA, 22 bp, Artificial Sequence
  chemically synthesized
tcagaaagtttcagaaatccaa

SEQ ID NO: 26820 - DNA, 22 bp, Artificial Sequence
  chemically synthesized
cagaaagtttcagaaatccaag

SEQ ID NO: 26821 - DNA, 22 bp, Artificial Sequence
  chemically synthesized
agaaagtttcagaaatccaaga

SEQ ID NO: 26822 - DNA, 22 bp, Artificial Sequence
  chemically synthesized
cagaaatccaagacctttgact

SEQ ID NO: 26823 - DNA, 22 bp, Artificial Sequence
  chemically synthesized
agaaatccaagacctttgactg

SEQ ID NO: 26824 - DNA, 22 bp, Artificial Sequence
  chemically synthesized
tgactgcaagtactgtgttctt

SEQ ID NO: 26825 - DNA, 22 bp, Artificial Sequence
  chemically synthesized
gactgcaagtactgtgttcttt

SEQ ID NO: 26826 - DNA, 22 bp, Artificial Sequence
  chemically synthesized
actgcaagtactgtgttctttc

SEQ ID NO: 26827 - DNA, 22 bp, Artificial Sequence
  chemically synthesized
caagtactgtgttctttcatct

SEQ ID NO: 26828 - DNA, 22 bp, Artificial Sequence
  chemically synthesized
tgttctttcatctataggacat

SEQ ID NO: 26829 - DNA, 22 bp, Artificial Sequence
  chemically synthesized
tttcatctataggacatttcct

SEQ ID NO: 26830 - DNA, 22 bp, Artificial Sequence
  chemically synthesized
tcatctataggacatttccttt

SEQ ID NO: 26831 - DNA, 22 bp, Artificial Sequence
  chemically synthesized
catctataggacatttcctttg

SEQ ID NO: 26832 - DNA, 22 bp, Artificial Sequence
  chemically synthesized
atctataggacatttcctttga

SEQ ID NO: 26833 - DNA, 22 bp, Artificial Sequence
  chemically synthesized
taggacatttcctttgaaaact

SEQ ID NO: 26834 - DNA, 22 bp, Artificial Sequence
  chemically synthesized
cctttgaaaactgaggttttaa

SEQ ID NO: 26835 - DNA, 22 bp, Artificial Sequence
  chemically synthesized
ctttgaaaactgaggttttaat

SEQ ID NO: 26836 - DNA, 22 bp, Artificial Sequence
  chemically synthesized
tgaaaactgaggttttaatatt

SEQ ID NO: 26837 - DNA, 22 bp, Artificial Sequence
  chemically synthesized
gaaaactgaggttttaatattt

SEQ ID NO: 26838 - DNA, 22 bp, Artificial Sequence
  chemically synthesized
aaaactgaggttttaatattta

SEQ ID NO: 26839 - DNA, 22 bp, Artificial Sequence
  chemically synthesized
aggttttaatatttaattctta

SEQ ID NO: 26840 - DNA, 22 bp, Artificial Sequence
  chemically synthesized
taatatttaattcttacataat

SEQ ID NO: 26841 - DNA, 22 bp, Artificial Sequence
  chemically synthesized
aatatttaattcttacataata

SEQ ID NO: 26842 - DNA, 22 bp, Artificial Sequence
  chemically synthesized
atatttaattcttacataatag

SEQ ID NO: 26843 - DNA, 22 bp, Artificial Sequence
  chemically synthesized
aattcttacataatagtaaaaa

SEQ ID NO: 26844 - DNA, 22 bp, Artificial Sequence
  chemically synthesized
attcttacataatagtaaaaaa

SEQ ID NO: 26845 - DNA, 22 bp, Artificial Sequence
  chemically synthesized
ttacataatagtaaaaaagtga

SEQ ID NO: 26846 - DNA, 22 bp, Artificial Sequence
  chemically synthesized
acataatagtaaaaaagtgaat

SEQ ID NO: 26847 - DNA, 22 bp, Artificial Sequence
  chemically synthesized
cataatagtaaaaaagtgaatt

SEQ ID NO: 26848 - DNA, 22 bp, Artificial Sequence
  chemically synthesized
gccttggaaaagacctaaatcc

SEQ ID NO: 26849 - DNA, 22 bp, Artificial Sequence
  chemically synthesized
ggaaaagacctaaatcctggtc

SEQ ID NO: 26850 - DNA, 22 bp, Artificial Sequence
  chemically synthesized
gaaaagacctaaatcctggtcc

SEQ ID NO: 26851 - DNA, 22 bp, Artificial Sequence
  chemically synthesized
aatcctggtcctaactctgcca

SEQ ID NO: 26852 - DNA, 22 bp, Artificial Sequence
  chemically synthesized
gtcctaactctgccatttgctt

SEQ ID NO: 26853 - DNA, 22 bp, Artificial Sequence
  chemically synthesized
actctgccatttgcttgatcat

SEQ ID NO: 26854 - DNA, 22 bp, Artificial Sequence
  chemically synthesized
tgccatttgcttgatcattaaa

SEQ ID NO: 26855 - DNA, 22 bp, Artificial Sequence
  chemically synthesized
ccatttgcttgatcattaaata

SEQ ID NO: 26856 - DNA, 22 bp, Artificial Sequence
  chemically synthesized
gcttgatcattaaatacctcta

SEQ ID NO: 26857 - DNA, 22 bp, Artificial Sequence
  chemically synthesized
cttgatcattaaatacctctac

SEQ ID NO: 26858 - DNA, 22 bp, Artificial Sequence
  chemically synthesized
gatcattaaatacctctacgaa

SEQ ID NO: 26859 - DNA, 22 bp, Artificial Sequence
  chemically synthesized
atcattaaatacctctacgaat

SEQ ID NO: 26860 - DNA, 22 bp, Artificial Sequence
  chemically synthesized
aatacctctacgaatcaatttg

SEQ ID NO: 26861 - DNA, 22 bp, Artificial Sequence
  chemically synthesized
tacgaatcaatttgctctatga

SEQ ID NO: 26862 - DNA, 22 bp, Artificial Sequence
  chemically synthesized
cgaatcaatttgctctatgaac

SEQ ID NO: 26863 - DNA, 22 bp, Artificial Sequence
  chemically synthesized
gctctatgaactggaggagtgg

SEQ ID NO: 26864 - DNA, 22 bp, Artificial Sequence
  chemically synthesized
ctctatgaactggaggagtggg

SEQ ID NO: 26865 - DNA, 22 bp, Artificial Sequence
  chemically synthesized
tatgaactggaggagtgggatt

SEQ ID NO: 26866 - DNA, 22 bp, Artificial Sequence
  chemically synthesized
tgaactggaggagtgggattca

SEQ ID NO: 26867 - DNA, 22 bp, Artificial Sequence
  chemically synthesized
gaggagtgggattcatgatctc

SEQ ID NO: 26868 - DNA, 22 bp, Artificial Sequence
  chemically synthesized
atgatctctaagatacctcata

SEQ ID NO: 26869 - DNA, 22 bp, Artificial Sequence
  chemically synthesized
taagatacctcatatcactact

SEQ ID NO: 26870 - DNA, 22 bp, Artificial Sequence
  chemically synthesized
agatacctcatatcactactat

SEQ ID NO: 26871 - DNA, 22 bp, Artificial Sequence
  chemically synthesized
atatcactactatgaaatgcag

SEQ ID NO: 26872 - DNA, 22 bp, Artificial Sequence
  chemically synthesized
ctatgaaatgcagggaagtaaa

SEQ ID NO: 26873 - DNA, 22 bp, Artificial Sequence
  chemically synthesized
tgaaatgcagggaagtaaaaat

SEQ ID NO: 26874 - DNA, 22 bp, Artificial Sequence
  chemically synthesized
aaatcattaaatttaaagaaac

SEQ ID NO: 26875 - DNA, 22 bp, Artificial Sequence
  chemically synthesized
aatttaaagaaactatagtggc

SEQ ID NO: 26876 - DNA, 22 bp, Artificial Sequence
  chemically synthesized
aaagaaactatagtggcaatgt

SEQ ID NO: 26877 - DNA, 22 bp, Artificial Sequence
  chemically synthesized
aagaaactatagtggcaatgta

SEQ ID NO: 26878 - DNA, 22 bp, Artificial Sequence
  chemically synthesized
tagtggcaatgtattattagga

SEQ ID NO: 26879 - DNA, 22 bp, Artificial Sequence
  chemically synthesized
ttaggaataaacacaataatta

SEQ ID NO: 26880 - DNA, 22 bp, Artificial Sequence
  chemically synthesized
ggaataaacacaataattatcc

SEQ ID NO: 26881 - DNA, 22 bp, Artificial Sequence
  chemically synthesized
tccatctatatgaaaatctcaa

SEQ ID NO: 26882 - DNA, 22 bp, Artificial Sequence
  chemically synthesized
tatgaaaatctcaaaccatacc

SEQ ID NO: 26883 - DNA, 22 bp, Artificial Sequence
  chemically synthesized
aaaccataccaggctatgataa

SEQ ID NO: 26884 - DNA, 22 bp, Artificial Sequence
  chemically synthesized
tgataatattaaaataaagata

SEQ ID NO: 26885 - DNA, 22 bp, Artificial Sequence
  chemically synthesized
aaataaagatacattgaagatg

SEQ ID NO: 26886 - DNA, 22 bp, Artificial Sequence
  chemically synthesized
aagatgatatcaacttgtgtaa

SEQ ID NO: 26887 - DNA, 22 bp, Artificial Sequence
  chemically synthesized
gtgtaaatcacattgtggggac

SEQ ID NO: 26888 - DNA, 22 bp, Artificial Sequence
  chemically synthesized
tgtaaatcacattgtggggacc

SEQ ID NO: 26889 - DNA, 22 bp, Artificial Sequence
  chemically synthesized
tggggacctctccacaaaaaca

SEQ ID NO: 26890 - DNA, 22 bp, Artificial Sequence
  chemically synthesized
tccacaaaaacacttcccttcc

SEQ ID NO: 26891 - DNA, 22 bp, Artificial Sequence
  chemically synthesized
cacaaaaacacttcccttcccc

SEQ ID NO: 26892 - DNA, 22 bp, Artificial Sequence
  chemically synthesized
cccttccccttgaaagggaaat

SEQ ID NO: 26893 - DNA, 22 bp, Artificial Sequence
  chemically synthesized
ccttccccttgaaagggaaatg

SEQ ID NO: 26894 - DNA, 22 bp, Artificial Sequence
  chemically synthesized
ccccttgaaagggaaatgatag

SEQ ID NO: 26895 - DNA, 22 bp, Artificial Sequence
  chemically synthesized
cccttgaaagggaaatgataga

SEQ ID NO: 26896 - DNA, 22 bp, Artificial Sequence
  chemically synthesized
gaaagggaaatgatagaaaata

SEQ ID NO: 26897 - DNA, 22 bp, Artificial Sequence
  chemically synthesized
aaagggaaatgatagaaaataa

SEQ ID NO: 26898 - DNA, 22 bp, Artificial Sequence
  chemically synthesized
aaggcagcttaggggttgaaaa

SEQ ID NO: 26899 - DNA, 22 bp, Artificial Sequence
  chemically synthesized
aggggttgaaaaacaaattttt

SEQ ID NO: 26900 - DNA, 22 bp, Artificial Sequence
  chemically synthesized
ggggttgaaaaacaaatttttt

SEQ ID NO: 26901 - DNA, 22 bp, Artificial Sequence
  chemically synthesized
aaaaacaaattttttcaaaaaa

SEQ ID NO: 26902 - DNA, 22 bp, Artificial Sequence
  chemically synthesized
tttcaaaaaaaaatccattgag

SEQ ID NO: 26903 - DNA, 22 bp, Artificial Sequence
  chemically synthesized
ttcaaaaaaaaatccattgagc

SEQ ID NO: 26904 - DNA, 22 bp, Artificial Sequence
  chemically synthesized
tcaaaaaaaaatccattgagca

SEQ ID NO: 26905 - DNA, 22 bp, Artificial Sequence
  chemically synthesized
caaaaaaaaatccattgagcat

SEQ ID NO: 26906 - DNA, 22 bp, Artificial Sequence
  chemically synthesized
aaaaaaaaatccattgagcatt

SEQ ID NO: 26907 - DNA, 22 bp, Artificial Sequence
  chemically synthesized
agcattttctatgtaccaggca

SEQ ID NO: 26908 - DNA, 22 bp, Artificial Sequence
  chemically synthesized
tctatgtaccaggcactgttct

SEQ ID NO: 26909 - DNA, 22 bp, Artificial Sequence
  chemically synthesized
ctatgtaccaggcactgttcta

SEQ ID NO: 26910 - DNA, 22 bp, Artificial Sequence
  chemically synthesized
tatgtaccaggcactgttctag

SEQ ID NO: 26911 - DNA, 22 bp, Artificial Sequence
  chemically synthesized
tgtaccaggcactgttctagac

SEQ ID NO: 26912 - DNA, 22 bp, Artificial Sequence
  chemically synthesized
ttctagaccctgagatcaacac

SEQ ID NO: 26913 - DNA, 22 bp, Artificial Sequence
  chemically synthesized
tagaccctgagatcaacacaca

SEQ ID NO: 26914 - DNA, 22 bp, Artificial Sequence
  chemically synthesized
gaccctgagatcaacacacatg

SEQ ID NO: 26915 - DNA, 22 bp, Artificial Sequence
  chemically synthesized
agatcaacacacatgctactga

SEQ ID NO: 26916 - DNA, 22 bp, Artificial Sequence
  chemically synthesized
ctgattataagatccataaaat

SEQ ID NO: 26917 - DNA, 22 bp, Artificial Sequence
  chemically synthesized
attataagatccataaaataac

SEQ ID NO: 26918 - DNA, 22 bp, Artificial Sequence
  chemically synthesized
taagatccataaaataacttag

SEQ ID NO: 26919 - DNA, 22 bp, Artificial Sequence
  chemically synthesized
agtttcactggcgtgttcccag

SEQ ID NO: 26920 - DNA, 22 bp, Artificial Sequence
  chemically synthesized
gtttcactggcgtgttcccagt

SEQ ID NO: 26921 - DNA, 22 bp, Artificial Sequence
  chemically synthesized
cactggcgtgttcccagtgccc

SEQ ID NO: 26922 - DNA, 22 bp, Artificial Sequence
  chemically synthesized
actggcgtgttcccagtgccca

SEQ ID NO: 26923 - DNA, 22 bp, Artificial Sequence
  chemically synthesized
gcgtgttcccagtgcccaggta

SEQ ID NO: 26924 - DNA, 22 bp, Artificial Sequence
  chemically synthesized
ccagtgcccaggtaacagtgct

SEQ ID NO: 26925 - DNA, 22 bp, Artificial Sequence
  chemically synthesized
cattaatgtttgttaaatgatg

SEQ ID NO: 26926 - DNA, 22 bp, Artificial Sequence
  chemically synthesized
atgtttgttaaatgatgagaaa

SEQ ID NO: 26927 - DNA, 22 bp, Artificial Sequence
  chemically synthesized
gttaaatgatgagaaaagagga

SEQ ID NO: 26928 - DNA, 22 bp, Artificial Sequence
  chemically synthesized
ttaaatgatgagaaaagaggaa

SEQ ID NO: 26929 - DNA, 22 bp, Artificial Sequence
  chemically synthesized
aatgatgagaaaagaggaaagc

SEQ ID NO: 26930 - DNA, 22 bp, Artificial Sequence
  chemically synthesized
tgctcaggtgcaggaacttgtg

SEQ ID NO: 26931 - DNA, 22 bp, Artificial Sequence
  chemically synthesized
ctcaggtgcaggaacttgtgca

SEQ ID NO: 26932 - DNA, 22 bp, Artificial Sequence
  chemically synthesized
aggtgcaggaacttgtgcagag

SEQ ID NO: 26933 - DNA, 22 bp, Artificial Sequence
  chemically synthesized
gtgcagagatcttctggactga

SEQ ID NO: 26934 - DNA, 22 bp, Artificial Sequence
  chemically synthesized
tgcagagatcttctggactgat

SEQ ID NO: 26935 - DNA, 22 bp, Artificial Sequence
  chemically synthesized
ctggactgattcccagtgctaa

SEQ ID NO: 26936 - DNA, 22 bp, Artificial Sequence
  chemically synthesized
tggactgattcccagtgctaac

SEQ ID NO: 26937 - DNA, 22 bp, Artificial Sequence
  chemically synthesized
gactgattcccagtgctaacaa

SEQ ID NO: 26938 - DNA, 22 bp, Artificial Sequence
  chemically synthesized
attcccagtgctaacaagtccc

SEQ ID NO: 26939 - DNA, 22 bp, Artificial Sequence
  chemically synthesized
ccagtgctaacaagtcccttcc

SEQ ID NO: 26940 - DNA, 22 bp, Artificial Sequence
  chemically synthesized
acaagtcccttccagttttatc

SEQ ID NO: 26941 - DNA, 22 bp, Artificial Sequence
  chemically synthesized
ccagttttatccaccaataagc

SEQ ID NO: 26942 - DNA, 22 bp, Artificial Sequence
  chemically synthesized
cagttttatccaccaataagct

SEQ ID NO: 26943 - DNA, 22 bp, Artificial Sequence
  chemically synthesized
tatccaccaataagctatgtcc

SEQ ID NO: 26944 - DNA, 22 bp, Artificial Sequence
  chemically synthesized
atccaccaataagctatgtcct

SEQ ID NO: 26945 - DNA, 22 bp, Artificial Sequence
  chemically synthesized
tccaccaataagctatgtcctt

SEQ ID NO: 26946 - DNA, 22 bp, Artificial Sequence
  chemically synthesized
tgtccttgagctcctgcccact

SEQ ID NO: 26947 - DNA, 22 bp, Artificial Sequence
  chemically synthesized
gagctcctgcccactctctaga

SEQ ID NO: 26948 - DNA, 22 bp, Artificial Sequence
  chemically synthesized
agctcctgcccactctctagag

SEQ ID NO: 26949 - DNA, 22 bp, Artificial Sequence
  chemically synthesized
ctgcccactctctagagaaaac

SEQ ID NO: 26950 - DNA, 22 bp, Artificial Sequence
  chemically synthesized
cccactctctagagaaaacttt

SEQ ID NO: 26951 - DNA, 22 bp, Artificial Sequence
  chemically synthesized
tctagagaaaacttttatttca

SEQ ID NO: 26952 - DNA, 22 bp, Artificial Sequence
  chemically synthesized
tagagaaaacttttatttcaag

SEQ ID NO: 26953 - DNA, 22 bp, Artificial Sequence
  chemically synthesized
gagaaaacttttatttcaaggc

SEQ ID NO: 26954 - DNA, 22 bp, Artificial Sequence
  chemically synthesized
ttatttcaaggcatactccggg

SEQ ID NO: 26955 - DNA, 22 bp, Artificial Sequence
  chemically synthesized
tatttcaaggcatactccggga

SEQ ID NO: 26956 - DNA, 22 bp, Artificial Sequence
  chemically synthesized
atttcaaggcatactccgggat

SEQ ID NO: 26957 - DNA, 22 bp, Artificial Sequence
  chemically synthesized
tttcaaggcatactccgggatt

SEQ ID NO: 26958 - DNA, 22 bp, Artificial Sequence
  chemically synthesized
caaggcatactccgggattcac

SEQ ID NO: 26959 - DNA, 22 bp, Artificial Sequence
  chemically synthesized
aaggcatactccgggattcaca

SEQ ID NO: 26960 - DNA, 22 bp, Artificial Sequence
  chemically synthesized
cgggattcacatgtgatagaga

SEQ ID NO: 26961 - DNA, 22 bp, Artificial Sequence
  chemically synthesized
acatgtgatagagatggttctg

SEQ ID NO: 26962 - DNA, 22 bp, Artificial Sequence
  chemically synthesized
tgttcccaggaactttgggcat

SEQ ID NO: 26963 - DNA, 22 bp, Artificial Sequence
  chemically synthesized
ttcccaggaactttgggcatat

SEQ ID NO: 26964 - DNA, 22 bp, Artificial Sequence
  chemically synthesized
ccaggaactttgggcatattta

SEQ ID NO: 26965 - DNA, 22 bp, Artificial Sequence
  chemically synthesized
tgggcatatttaaaaactggac

SEQ ID NO: 26966 - DNA, 22 bp, Artificial Sequence
  chemically synthesized
gggcatatttaaaaactggact

SEQ ID NO: 26967 - DNA, 22 bp, Artificial Sequence
  chemically synthesized
ggcatatttaaaaactggactg

SEQ ID NO: 26968 - DNA, 22 bp, Artificial Sequence
  chemically synthesized
aaaaactggactggaaaaattt

SEQ ID NO: 26969 - DNA, 22 bp, Artificial Sequence
  chemically synthesized
aaaactggactggaaaaatttg

SEQ ID NO: 26970 - DNA, 22 bp, Artificial Sequence
  chemically synthesized
gactggaaaaatttgtgactag

SEQ ID NO: 26971 - DNA, 22 bp, Artificial Sequence
  chemically synthesized
gaaaaatttgtgactagaaaaa

SEQ ID NO: 26972 - DNA, 22 bp, Artificial Sequence
  chemically synthesized
gtgactagaaaaaggacattaa

SEQ ID NO: 26973 - DNA, 22 bp, Artificial Sequence
  chemically synthesized
tgactagaaaaaggacattaaa

SEQ ID NO: 26974 - DNA, 22 bp, Artificial Sequence
  chemically synthesized
gaaaaaggacattaaaaacaca

SEQ ID NO: 26975 - DNA, 22 bp, Artificial Sequence
  chemically synthesized
aaaacacatgctcatttcagga

SEQ ID NO: 26976 - DNA, 22 bp, Artificial Sequence
  chemically synthesized
atttcaggataaagatctctga

SEQ ID NO: 26977 - DNA, 22 bp, Artificial Sequence
  chemically synthesized
caggataaagatctctgaggaa

SEQ ID NO: 26978 - DNA, 22 bp, Artificial Sequence
  chemically synthesized
aggataaagatctctgaggaaa

SEQ ID NO: 26979 - DNA, 22 bp, Artificial Sequence
  chemically synthesized
tgaggaaaagaatacaaaataa

SEQ ID NO: 26980 - DNA, 22 bp, Artificial Sequence
  chemically synthesized
aggaaaagaatacaaaataatt

SEQ ID NO: 26981 - DNA, 22 bp, Artificial Sequence
  chemically synthesized
aaaaagaaacaacagaaacagg

SEQ ID NO: 26982 - DNA, 22 bp, Artificial Sequence
  chemically synthesized
aaaagaaacaacagaaacaggt

SEQ ID NO: 26983 - DNA, 22 bp, Artificial Sequence
  chemically synthesized
cacttctctgtaataaggtttc

SEQ ID NO: 26984 - DNA, 22 bp, Artificial Sequence
  chemically synthesized
acttctctgtaataaggtttct

SEQ ID NO: 26985 - DNA, 22 bp, Artificial Sequence
  chemically synthesized
ctctgtaataaggtttctgtcc

SEQ ID NO: 26986 - DNA, 22 bp, Artificial Sequence
  chemically synthesized
tctgtaataaggtttctgtcct

SEQ ID NO: 26987 - DNA, 22 bp, Artificial Sequence
  chemically synthesized
tgtaataaggtttctgtcctcc

SEQ ID NO: 26988 - DNA, 22 bp, Artificial Sequence
  chemically synthesized
taataaggtttctgtcctccta

SEQ ID NO: 26989 - DNA, 22 bp, Artificial Sequence
  chemically synthesized
ctgtcctcctagattctttctc

SEQ ID NO: 26990 - DNA, 22 bp, Artificial Sequence
  chemically synthesized
tgtcctcctagattctttctca

SEQ ID NO: 26991 - DNA, 22 bp, Artificial Sequence
  chemically synthesized
tcctcctagattctttctcact

SEQ ID NO: 26992 - DNA, 22 bp, Artificial Sequence
  chemically synthesized
ctagattctttctcactaaact

SEQ ID NO: 26993 - DNA, 22 bp, Artificial Sequence
  chemically synthesized
gattctttctcactaaactaca

SEQ ID NO: 26994 - DNA, 22 bp, Artificial Sequence
  chemically synthesized
tttctcactaaactacagagaa

SEQ ID NO: 26995 - DNA, 22 bp, Artificial Sequence
  chemically synthesized
tctcactaaactacagagaata

SEQ ID NO: 26996 - DNA, 22 bp, Artificial Sequence
  chemically synthesized
ctcactaaactacagagaataa

SEQ ID NO: 26997 - DNA, 22 bp, Artificial Sequence
  chemically synthesized
tcactaaactacagagaataag

SEQ ID NO: 26998 - DNA, 22 bp, Artificial Sequence
  chemically synthesized
actaaactacagagaataagac

SEQ ID NO: 26999 - DNA, 22 bp, Artificial Sequence
  chemically synthesized
aactacagagaataagaccgtg

SEQ ID NO: 27000 - DNA, 22 bp, Artificial Sequence
  chemically synthesized
cagagaataagaccgtgctttg

SEQ ID NO: 27001 - DNA, 22 bp, Artificial Sequence
  chemically synthesized
tgttctcttatatgcattctgt

SEQ ID NO: 27002 - DNA, 22 bp, Artificial Sequence
  chemically synthesized
gttctcttatatgcattctgtc

SEQ ID NO: 27003 - DNA, 22 bp, Artificial Sequence
  chemically synthesized
ttctcttatatgcattctgtcc

SEQ ID NO: 27004 - DNA, 22 bp, Artificial Sequence
  chemically synthesized
tcttatatgcattctgtccact

SEQ ID NO: 27005 - DNA, 22 bp, Artificial Sequence
  chemically synthesized
ttatatgcattctgtccacttc

SEQ ID NO: 27006 - DNA, 22 bp, Artificial Sequence
  chemically synthesized
atatgcattctgtccacttcta

SEQ ID NO: 27007 - DNA, 22 bp, Artificial Sequence
  chemically synthesized
tatgcattctgtccacttctac

SEQ ID NO: 27008 - DNA, 22 bp, Artificial Sequence
  chemically synthesized
tgtccacttctacataggcaaa

SEQ ID NO: 27009 - DNA, 22 bp, Artificial Sequence
  chemically synthesized
tccacttctacataggcaaaat

SEQ ID NO: 27010 - DNA, 22 bp, Artificial Sequence
  chemically synthesized
ctacataggcaaaattgacttt

SEQ ID NO: 27011 - DNA, 22 bp, Artificial Sequence
  chemically synthesized
tacataggcaaaattgactttt

SEQ ID NO: 27012 - DNA, 22 bp, Artificial Sequence
  chemically synthesized
cataggcaaaattgacttttaa

SEQ ID NO: 27013 - DNA, 22 bp, Artificial Sequence
  chemically synthesized
acttttaattttgattttatga

SEQ ID NO: 27014 - DNA, 22 bp, Artificial Sequence
  chemically synthesized
ttaattttgattttatgaatgc

SEQ ID NO: 27015 - DNA, 22 bp, Artificial Sequence
  chemically synthesized
taattttgattttatgaatgca

SEQ ID NO: 27016 - DNA, 22 bp, Artificial Sequence
  chemically synthesized
aattttgattttatgaatgcat

SEQ ID NO: 27017 - DNA, 22 bp, Artificial Sequence
  chemically synthesized
attttgattttatgaatgcata

SEQ ID NO: 27018 - DNA, 22 bp, Artificial Sequence
  chemically synthesized
tgattttatgaatgcatacaca

SEQ ID NO: 27019 - DNA, 22 bp, Artificial Sequence
  chemically synthesized
gattttatgaatgcatacacac

SEQ ID NO: 27020 - DNA, 22 bp, Artificial Sequence
  chemically synthesized
attttatgaatgcatacacacg

SEQ ID NO: 27021 - DNA, 22 bp, Artificial Sequence
  chemically synthesized
tatgaatgcatacacacgagaa

SEQ ID NO: 27022 - DNA, 22 bp, Artificial Sequence
  chemically synthesized
atgaatgcatacacacgagaac

SEQ ID NO: 27023 - DNA, 22 bp, Artificial Sequence
  chemically synthesized
tgaatgcatacacacgagaact

SEQ ID NO: 27024 - DNA, 22 bp, Artificial Sequence
  chemically synthesized
tgaacagttagtataaggtgaa

SEQ ID NO: 27025 - DNA, 22 bp, Artificial Sequence
  chemically synthesized
gaacagttagtataaggtgaat

SEQ ID NO: 27026 - DNA, 22 bp, Artificial Sequence
  chemically synthesized
aacagttagtataaggtgaatt

SEQ ID NO: 27027 - DNA, 22 bp, Artificial Sequence
  chemically synthesized
gtataaggtgaattctgatttt

SEQ ID NO: 27028 - DNA, 22 bp, Artificial Sequence
  chemically synthesized
tgatttttcagaatgcatgcca

SEQ ID NO: 27029 - DNA, 22 bp, Artificial Sequence
  chemically synthesized
atttttcagaatgcatgccata

SEQ ID NO: 27030 - DNA, 22 bp, Artificial Sequence
  chemically synthesized
ttcagaatgcatgccatatata

SEQ ID NO: 27031 - DNA, 22 bp, Artificial Sequence
  chemically synthesized
tcagaatgcatgccatatataa

SEQ ID NO: 27032 - DNA, 22 bp, Artificial Sequence
  chemically synthesized
cagaatgcatgccatatataat

SEQ ID NO: 27033 - DNA, 22 bp, Artificial Sequence
  chemically synthesized
agaatgcatgccatatataatg

SEQ ID NO: 27034 - DNA, 22 bp, Artificial Sequence
  chemically synthesized
aattttgagattatgctggctc

SEQ ID NO: 27035 - DNA, 22 bp, Artificial Sequence
  chemically synthesized
attttgagattatgctggctct

SEQ ID NO: 27036 - DNA, 22 bp, Artificial Sequence
  chemically synthesized
tgagattatgctggctctgatt

SEQ ID NO: 27037 - DNA, 22 bp, Artificial Sequence
  chemically synthesized
gagattatgctggctctgatta

SEQ ID NO: 27038 - DNA, 22 bp, Artificial Sequence
  chemically synthesized
agattatgctggctctgattag

SEQ ID NO: 27039 - DNA, 22 bp, Artificial Sequence
  chemically synthesized
tgctggctctgattagccaaaa

SEQ ID NO: 27040 - DNA, 22 bp, Artificial Sequence
  chemically synthesized
gctctgattagccaaaagaagg

SEQ ID NO: 27041 - DNA, 22 bp, Artificial Sequence
  chemically synthesized
tgattagccaaaagaaggaagt

SEQ ID NO: 27042 - DNA, 22 bp, Artificial Sequence
  chemically synthesized
attagccaaaagaaggaagtaa

SEQ ID NO: 27043 - DNA, 22 bp, Artificial Sequence
  chemically synthesized
gccaaaagaaggaagtaatata

SEQ ID NO: 27044 - DNA, 22 bp, Artificial Sequence
  chemically synthesized
tggttattatttcagatccttt

SEQ ID NO: 27045 - DNA, 22 bp, Artificial Sequence
  chemically synthesized
gttattatttcagatcctttag

SEQ ID NO: 27046 - DNA, 22 bp, Artificial Sequence
  chemically synthesized
ttatttcagatcctttagatta

SEQ ID NO: 27047 - DNA, 22 bp, Artificial Sequence
  chemically synthesized
tttcagatcctttagattactg

SEQ ID NO: 27048 - DNA, 22 bp, Artificial Sequence
  chemically synthesized
cagatcctttagattactgtaa

SEQ ID NO: 27049 - DNA, 22 bp, Artificial Sequence
  chemically synthesized
agatcctttagattactgtaat

SEQ ID NO: 27050 - DNA, 22 bp, Artificial Sequence
  chemically synthesized
tagattactgtaatagacatga

SEQ ID NO: 27051 - DNA, 22 bp, Artificial Sequence
  chemically synthesized
agattactgtaatagacatgaa

SEQ ID NO: 27052 - DNA, 22 bp, Artificial Sequence
  chemically synthesized
gattactgtaatagacatgaaa

SEQ ID NO: 27053 - DNA, 22 bp, Artificial Sequence
  chemically synthesized
ctgtaatagacatgaaatagta

SEQ ID NO: 27054 - DNA, 22 bp, Artificial Sequence
  chemically synthesized
taatagacatgaaatagtaaac

SEQ ID NO: 27055 - DNA, 22 bp, Artificial Sequence
  chemically synthesized
tatatcacaacacatgacataa

SEQ ID NO: 27056 - DNA, 22 bp, Artificial Sequence
  chemically synthesized
cagatcgtttaaatcacacaag

SEQ ID NO: 27057 - DNA, 22 bp, Artificial Sequence
  chemically synthesized
agatcgtttaaatcacacaagt

SEQ ID NO: 27058 - DNA, 22 bp, Artificial Sequence
  chemically synthesized
aaatcacacaagtcatcactgc

SEQ ID NO: 27059 - DNA, 22 bp, Artificial Sequence
  chemically synthesized
aatcacacaagtcatcactgcc

SEQ ID NO: 27060 - DNA, 22 bp, Artificial Sequence
  chemically synthesized
ccatttacccagcaatcagttg

SEQ ID NO: 27061 - DNA, 22 bp, Artificial Sequence
  chemically synthesized
acccagcaatcagttggcttga

SEQ ID NO: 27062 - DNA, 22 bp, Artificial Sequence
  chemically synthesized
cccagcaatcagttggcttgat

SEQ ID NO: 27063 - DNA, 22 bp, Artificial Sequence
  chemically synthesized
gcttgattcttcaagatcttga

SEQ ID NO: 27064 - DNA, 22 bp, Artificial Sequence
  chemically synthesized
gattcttcaagatcttgaggaa

SEQ ID NO: 27065 - DNA, 22 bp, Artificial Sequence
  chemically synthesized
attcttcaagatcttgaggaac

SEQ ID NO: 27066 - DNA, 22 bp, Artificial Sequence
  chemically synthesized
ttcaagatcttgaggaactcag

SEQ ID NO: 27067 - DNA, 22 bp, Artificial Sequence
  chemically synthesized
caagatcttgaggaactcagcc

SEQ ID NO: 27068 - DNA, 22 bp, Artificial Sequence
  chemically synthesized
aagatcttgaggaactcagcct

SEQ ID NO: 27069 - DNA, 22 bp, Artificial Sequence
  chemically synthesized
gaggaactcagccttcaaaacc

SEQ ID NO: 27070 - DNA, 22 bp, Artificial Sequence
  chemically synthesized
aggaactcagccttcaaaacca

SEQ ID NO: 27071 - DNA, 22 bp, Artificial Sequence
  chemically synthesized
agccttcaaaaccatgactttt

SEQ ID NO: 27072 - DNA, 22 bp, Artificial Sequence
  chemically synthesized
caaaaccatgactttttctttg

SEQ ID NO: 27073 - DNA, 22 bp, Artificial Sequence
  chemically synthesized
aaaaccatgactttttctttgc

SEQ ID NO: 27074 - DNA, 22 bp, Artificial Sequence
  chemically synthesized
tttctttgctaatgttccttca

SEQ ID NO: 27075 - DNA, 22 bp, Artificial Sequence
  chemically synthesized
ttctttgctaatgttccttcaa

SEQ ID NO: 27076 - DNA, 22 bp, Artificial Sequence
  chemically synthesized
tctttgctaatgttccttcaat

SEQ ID NO: 27077 - DNA, 22 bp, Artificial Sequence
  chemically synthesized
ctttgctaatgttccttcaata

SEQ ID NO: 27078 - DNA, 22 bp, Artificial Sequence
  chemically synthesized
tttgctaatgttccttcaatag

SEQ ID NO: 27079 - DNA, 22 bp, Artificial Sequence
  chemically synthesized
tgctaatgttccttcaatagtc

SEQ ID NO: 27080 - DNA, 22 bp, Artificial Sequence
  chemically synthesized
gctaatgttccttcaatagtct

SEQ ID NO: 27081 - DNA, 22 bp, Artificial Sequence
  chemically synthesized
ctaatgttccttcaatagtctt

SEQ ID NO: 27082 - DNA, 22 bp, Artificial Sequence
  chemically synthesized
atgttccttcaatagtcttgac

SEQ ID NO: 27083 - DNA, 22 bp, Artificial Sequence
  chemically synthesized
cttcaatagtcttgacactttt

SEQ ID NO: 27084 - DNA, 22 bp, Artificial Sequence
  chemically synthesized
caatagtcttgacacttttaaa

SEQ ID NO: 27085 - DNA, 22 bp, Artificial Sequence
  chemically synthesized
aatagtcttgacacttttaaac

SEQ ID NO: 27086 - DNA, 22 bp, Artificial Sequence
  chemically synthesized
gacacttttaaactagagagta

SEQ ID NO: 27087 - DNA, 22 bp, Artificial Sequence
  chemically synthesized
acacttttaaactagagagtat

SEQ ID NO: 27088 - DNA, 22 bp, Artificial Sequence
  chemically synthesized
ttaaactagagagtataaaccc

SEQ ID NO: 27089 - DNA, 22 bp, Artificial Sequence
  chemically synthesized
taaactagagagtataaaccca

SEQ ID NO: 27090 - DNA, 22 bp, Artificial Sequence
  chemically synthesized
aaactagagagtataaacccac

SEQ ID NO: 27091 - DNA, 22 bp, Artificial Sequence
  chemically synthesized
aactagagagtataaacccaca

SEQ ID NO: 27092 - DNA, 22 bp, Artificial Sequence
  chemically synthesized
gagagtataaacccacaaggaa

SEQ ID NO: 27093 - DNA, 22 bp, Artificial Sequence
  chemically synthesized
ttttataattttacagatgtct

SEQ ID NO: 27094 - DNA, 22 bp, Artificial Sequence
  chemically synthesized
tataattttacagatgtcttta

SEQ ID NO: 27095 - DNA, 22 bp, Artificial Sequence
  chemically synthesized
ataattttacagatgtctttat

SEQ ID NO: 27096 - DNA, 22 bp, Artificial Sequence
  chemically synthesized
taattttacagatgtctttatt

SEQ ID NO: 27097 - DNA, 22 bp, Artificial Sequence
  chemically synthesized
tacagatgtctttattttcaaa

SEQ ID NO: 27098 - DNA, 22 bp, Artificial Sequence
  chemically synthesized
acagatgtctttattttcaaaa

SEQ ID NO: 27099 - DNA, 22 bp, Artificial Sequence
  chemically synthesized
cagatgtctttattttcaaaat

SEQ ID NO: 27100 - DNA, 22 bp, Artificial Sequence
  chemically synthesized
tattttcaaaatcatttacatt

SEQ ID NO: 27101 - DNA, 22 bp, Artificial Sequence
  chemically synthesized
attttcaaaatcatttacattg

SEQ ID NO: 27102 - DNA, 22 bp, Artificial Sequence
  chemically synthesized
ttttcaaaatcatttacattgt

SEQ ID NO: 27103 - DNA, 22 bp, Artificial Sequence
  chemically synthesized
tcaaaatcatttacattgtggt

SEQ ID NO: 27104 - DNA, 22 bp, Artificial Sequence
  chemically synthesized
caaaatcatttacattgtggtt

SEQ ID NO: 27105 - DNA, 22 bp, Artificial Sequence
  chemically synthesized
aaaatcatttacattgtggttc

SEQ ID NO: 27106 - DNA, 22 bp, Artificial Sequence
  chemically synthesized
acattgtggttctctaccttgc

SEQ ID NO: 27107 - DNA, 22 bp, Artificial Sequence
  chemically synthesized
cattgtggttctctaccttgcc

SEQ ID NO: 27108 - DNA, 22 bp, Artificial Sequence
  chemically synthesized
tggttctctaccttgccttctc

SEQ ID NO: 27109 - DNA, 22 bp, Artificial Sequence
  chemically synthesized
tctaccttgccttctcttaccc

SEQ ID NO: 27110 - DNA, 22 bp, Artificial Sequence
  chemically synthesized
taccttgccttctcttacccag

SEQ ID NO: 27111 - DNA, 22 bp, Artificial Sequence
  chemically synthesized
ccttgccttctcttacccagca

SEQ ID NO: 27112 - DNA, 22 bp, Artificial Sequence
  chemically synthesized
gccttctcttacccagcacaga

SEQ ID NO: 27113 - DNA, 22 bp, Artificial Sequence
  chemically synthesized
ccttctcttacccagcacagat

SEQ ID NO: 27114 - DNA, 22 bp, Artificial Sequence
  chemically synthesized
ctcttacccagcacagatgagg

SEQ ID NO: 27115 - DNA, 22 bp, Artificial Sequence
  chemically synthesized
tcttacccagcacagatgaggt

SEQ ID NO: 27116 - DNA, 22 bp, Artificial Sequence
  chemically synthesized
ttacccagcacagatgaggtta

SEQ ID NO: 27117 - DNA, 22 bp, Artificial Sequence
  chemically synthesized
acccagcacagatgaggttata

SEQ ID NO: 27118 - DNA, 22 bp, Artificial Sequence
  chemically synthesized
cccagcacagatgaggttatac

SEQ ID NO: 27119 - DNA, 22 bp, Artificial Sequence
  chemically synthesized
tacctcactcgcaaattgtttt

SEQ ID NO: 27120 - DNA, 22 bp, Artificial Sequence
  chemically synthesized
actcgcaaattgttttatcaat

SEQ ID NO: 27121 - DNA, 22 bp, Artificial Sequence
  chemically synthesized
gcaaattgttttatcaatttga

SEQ ID NO: 27122 - DNA, 22 bp, Artificial Sequence
  chemically synthesized
ttttatcaatttgattttcttt

SEQ ID NO: 27123 - DNA, 22 bp, Artificial Sequence
  chemically synthesized
tatcaatttgattttctttatt

SEQ ID NO: 27124 - DNA, 22 bp, Artificial Sequence
  chemically synthesized
atcaatttgattttctttattt

SEQ ID NO: 27125 - DNA, 22 bp, Artificial Sequence
  chemically synthesized
tcaatttgattttctttatttt

SEQ ID NO: 27126 - DNA, 22 bp, Artificial Sequence
  chemically synthesized
gattttctttattttataattc

SEQ ID NO: 27127 - DNA, 22 bp, Artificial Sequence
  chemically synthesized
attttctttattttataattcc

SEQ ID NO: 27128 - DNA, 22 bp, Artificial Sequence
  chemically synthesized
tctttattttataattcctaca

SEQ ID NO: 27129 - DNA, 22 bp, Artificial Sequence
  chemically synthesized
ctttattttataattcctacat

SEQ ID NO: 27130 - DNA, 22 bp, Artificial Sequence
  chemically synthesized
tttattttataattcctacata

SEQ ID NO: 27131 - DNA, 22 bp, Artificial Sequence
  chemically synthesized
tattttataattcctacataag

SEQ ID NO: 27132 - DNA, 22 bp, Artificial Sequence
  chemically synthesized
attttataattcctacataagc

SEQ ID NO: 27133 - DNA, 22 bp, Artificial Sequence
  chemically synthesized
ttttataattcctacataagca

SEQ ID NO: 27134 - DNA, 22 bp, Artificial Sequence
  chemically synthesized
tataattcctacataagcatag

SEQ ID NO: 27135 - DNA, 22 bp, Artificial Sequence
  chemically synthesized
ataattcctacataagcatagc

SEQ ID NO: 27136 - DNA, 22 bp, Artificial Sequence
  chemically synthesized
taattcctacataagcatagca

SEQ ID NO: 27137 - DNA, 22 bp, Artificial Sequence
  chemically synthesized
ctacataagcatagcattgaag

SEQ ID NO: 27138 - DNA, 22 bp, Artificial Sequence
  chemically synthesized
cataagcatagcattgaagaaa

SEQ ID NO: 27139 - DNA, 22 bp, Artificial Sequence
  chemically synthesized
aagaaaaaaattactttcattc

SEQ ID NO: 27140 - DNA, 22 bp, Artificial Sequence
  chemically synthesized
ctttcattctgaaaggagcaca

SEQ ID NO: 27141 - DNA, 22 bp, Artificial Sequence
  chemically synthesized
tcattctgaaaggagcacagta

SEQ ID NO: 27142 - DNA, 22 bp, Artificial Sequence
  chemically synthesized
cattctgaaaggagcacagtat

SEQ ID NO: 27143 - DNA, 22 bp, Artificial Sequence
  chemically synthesized
attctgaaaggagcacagtatt

SEQ ID NO: 27144 - DNA, 22 bp, Artificial Sequence
  chemically synthesized
tgaaaggagcacagtattttgc

SEQ ID NO: 27145 - DNA, 22 bp, Artificial Sequence
  chemically synthesized
aaaggagcacagtattttgcct

SEQ ID NO: 27146 - DNA, 22 bp, Artificial Sequence
  chemically synthesized
tgccttttgagaagctcctgaa

SEQ ID NO: 27147 - DNA, 22 bp, Artificial Sequence
  chemically synthesized
gccttttgagaagctcctgaat

SEQ ID NO: 27148 - DNA, 22 bp, Artificial Sequence
  chemically synthesized
ccttttgagaagctcctgaatt

SEQ ID NO: 27149 - DNA, 22 bp, Artificial Sequence
  chemically synthesized
ttgagaagctcctgaattaaaa

SEQ ID NO: 27150 - DNA, 22 bp, Artificial Sequence
  chemically synthesized
tgagaagctcctgaattaaaac

SEQ ID NO: 27151 - DNA, 22 bp, Artificial Sequence
  chemically synthesized
gagaagctcctgaattaaaaca

SEQ ID NO: 27152 - DNA, 22 bp, Artificial Sequence
  chemically synthesized
agaagctcctgaattaaaacat

SEQ ID NO: 27153 - DNA, 22 bp, Artificial Sequence
  chemically synthesized
ctgaattaaaacattaattcca

SEQ ID NO: 27154 - DNA, 22 bp, Artificial Sequence
  chemically synthesized
aattaaaacattaattccaagc

SEQ ID NO: 27155 - DNA, 22 bp, Artificial Sequence
  chemically synthesized
aaacattaattccaagctaatt

SEQ ID NO: 27156 - DNA, 22 bp, Artificial Sequence
  chemically synthesized
attccaagctaattgtgaatat

SEQ ID NO: 27157 - DNA, 22 bp, Artificial Sequence
  chemically synthesized
caagctaattgtgaatatgaaa

SEQ ID NO: 27158 - DNA, 22 bp, Artificial Sequence
  chemically synthesized
attgtgaatatgaaacattctt

SEQ ID NO: 27159 - DNA, 22 bp, Artificial Sequence
  chemically synthesized
tgaatatgaaacattcttaagc

SEQ ID NO: 27160 - DNA, 22 bp, Artificial Sequence
  chemically synthesized
ttaagcatttcatataattact

SEQ ID NO: 27161 - DNA, 22 bp, Artificial Sequence
  chemically synthesized
aagcatttcatataattactaa

SEQ ID NO: 27162 - DNA, 22 bp, Artificial Sequence
  chemically synthesized
agcatttcatataattactaac

SEQ ID NO: 27163 - DNA, 22 bp, Artificial Sequence
  chemically synthesized
catataattactaacagaatgt

SEQ ID NO: 27164 - DNA, 22 bp, Artificial Sequence
  chemically synthesized
atataattactaacagaatgta

SEQ ID NO: 27165 - DNA, 22 bp, Artificial Sequence
  chemically synthesized
ctaacagaatgtagagttgagg

SEQ ID NO: 27166 - DNA, 22 bp, Artificial Sequence
  chemically synthesized
acagaatgtagagttgaggttt

SEQ ID NO: 27167 - DNA, 22 bp, Artificial Sequence
  chemically synthesized
aggtttccaactggttctaatc

SEQ ID NO: 27168 - DNA, 22 bp, Artificial Sequence
  chemically synthesized
ccaactggttctaatcacatat

SEQ ID NO: 27169 - DNA, 22 bp, Artificial Sequence
  chemically synthesized
caactggttctaatcacatata

SEQ ID NO: 27170 - DNA, 22 bp, Artificial Sequence
  chemically synthesized
gttctaatcacatatacatctt

SEQ ID NO: 27171 - DNA, 22 bp, Artificial Sequence
  chemically synthesized
taatcacatatacatcttccta

SEQ ID NO: 27172 - DNA, 22 bp, Artificial Sequence
  chemically synthesized
atcacatatacatcttcctaaa

SEQ ID NO: 27173 - DNA, 22 bp, Artificial Sequence
  chemically synthesized
cctaaaataaaatgtttaatta

SEQ ID NO: 27174 - DNA, 22 bp, Artificial Sequence
  chemically synthesized
ctaaaataaaatgtttaattat

SEQ ID NO: 27175 - DNA, 22 bp, Artificial Sequence
  chemically synthesized
aaataaaatgtttaattatact

SEQ ID NO: 27176 - DNA, 22 bp, Artificial Sequence
  chemically synthesized
aattatactattttgctgagaa

SEQ ID NO: 27177 - DNA, 22 bp, Artificial Sequence
  chemically synthesized
attatactattttgctgagaaa

SEQ ID NO: 27178 - DNA, 22 bp, Artificial Sequence
  chemically synthesized
tactattttgctgagaaaaatt

SEQ ID NO: 27179 - DNA, 22 bp, Artificial Sequence
  chemically synthesized
ttttgctgagaaaaattttaaa

SEQ ID NO: 27180 - DNA, 22 bp, Artificial Sequence
  chemically synthesized
tgctgagaaaaattttaaaaca

SEQ ID NO: 27181 - DNA, 22 bp, Artificial Sequence
  chemically synthesized
gctgagaaaaattttaaaacaa

SEQ ID NO: 27182 - DNA, 22 bp, Artificial Sequence
  chemically synthesized
ctgagaaaaattttaaaacaaa

SEQ ID NO: 27183 - DNA, 22 bp, Artificial Sequence
  chemically synthesized
agaaaaattttaaaacaaaaaa

SEQ ID NO: 27184 - DNA, 22 bp, Artificial Sequence
  chemically synthesized
taaaacaaaaaatgtaaatatt

SEQ ID NO: 27185 - DNA, 22 bp, Artificial Sequence
  chemically synthesized
aaaacaaaaaatgtaaatatta

SEQ ID NO: 27186 - DNA, 22 bp, Artificial Sequence
  chemically synthesized
aaacaaaaaatgtaaatattaa

SEQ ID NO: 27187 - DNA, 22 bp, Artificial Sequence
  chemically synthesized
actttttatttctatgttgtca

SEQ ID NO: 27188 - DNA, 22 bp, Artificial Sequence
  chemically synthesized
tttatttctatgttgtcataat

SEQ ID NO: 27189 - DNA, 22 bp, Artificial Sequence
  chemically synthesized
ttatttctatgttgtcataata

SEQ ID NO: 27190 - DNA, 22 bp, Artificial Sequence
  chemically synthesized
tatttctatgttgtcataatat

SEQ ID NO: 27191 - DNA, 22 bp, Artificial Sequence
  chemically synthesized
atttctatgttgtcataatatg

SEQ ID NO: 27192 - DNA, 22 bp, Artificial Sequence
  chemically synthesized
tttctatgttgtcataatatgg

SEQ ID NO: 27193 - DNA, 22 bp, Artificial Sequence
  chemically synthesized
ctatgttgtcataatatggatt

SEQ ID NO: 27194 - DNA, 22 bp, Artificial Sequence
  chemically synthesized
tatgttgtcataatatggattt

SEQ ID NO: 27195 - DNA, 22 bp, Artificial Sequence
  chemically synthesized
tgttgtcataatatggatttta

SEQ ID NO: 27196 - DNA, 22 bp, Artificial Sequence
  chemically synthesized
tcataatatggattttaaattt

SEQ ID NO: 27197 - DNA, 22 bp, Artificial Sequence
  chemically synthesized
taaattttaatttaaatgcaca

SEQ ID NO: 27198 - DNA, 22 bp, Artificial Sequence
  chemically synthesized
aaattttaatttaaatgcacat

SEQ ID NO: 27199 - DNA, 22 bp, Artificial Sequence
  chemically synthesized
aattttaatttaaatgcacatt

SEQ ID NO: 27200 - DNA, 22 bp, Artificial Sequence
  chemically synthesized
taatttaaatgcacattccatg

SEQ ID NO: 27201 - DNA, 22 bp, Artificial Sequence
  chemically synthesized
aatttaaatgcacattccatgg

SEQ ID NO: 27202 - DNA, 22 bp, Artificial Sequence
  chemically synthesized
atttaaatgcacattccatggc

SEQ ID NO: 27203 - DNA, 22 bp, Artificial Sequence
  chemically synthesized
aaatgcacattccatggcaatg

SEQ ID NO: 27204 - DNA, 22 bp, Artificial Sequence
  chemically synthesized
aatgcacattccatggcaatgg

SEQ ID NO: 27205 - DNA, 22 bp, Artificial Sequence
  chemically synthesized
catggcaatggctaatattttc

SEQ ID NO: 27206 - DNA, 22 bp, Artificial Sequence
  chemically synthesized
atattttcaactttctccctct

SEQ ID NO: 27207 - DNA, 22 bp, Artificial Sequence
  chemically synthesized
tcaactttctccctcttcaaca

SEQ ID NO: 27208 - DNA, 22 bp, Artificial Sequence
  chemically synthesized
caactttctccctcttcaacac

SEQ ID NO: 27209 - DNA, 22 bp, Artificial Sequence
  chemically synthesized
aactttctccctcttcaacaca

SEQ ID NO: 27210 - DNA, 22 bp, Artificial Sequence
  chemically synthesized
tctccctcttcaacacatacac

SEQ ID NO: 27211 - DNA, 22 bp, Artificial Sequence
  chemically synthesized
ctccctcttcaacacatacaca

SEQ ID NO: 27212 - DNA, 22 bp, Artificial Sequence
  chemically synthesized
tccctcttcaacacatacacaa

SEQ ID NO: 27213 - DNA, 22 bp, Artificial Sequence
  chemically synthesized
cctcttcaacacatacacaagt

SEQ ID NO: 27214 - DNA, 22 bp, Artificial Sequence
  chemically synthesized
ttcaacacatacacaagtctgt

SEQ ID NO: 27215 - DNA, 22 bp, Artificial Sequence
  chemically synthesized
caacacatacacaagtctgtat

SEQ ID NO: 27216 - DNA, 22 bp, Artificial Sequence
  chemically synthesized
aacacatacacaagtctgtatt

SEQ ID NO: 27217 - DNA, 22 bp, Artificial Sequence
  chemically synthesized
tattcatagcctgttgtaatag

SEQ ID NO: 27218 - DNA, 22 bp, Artificial Sequence
  chemically synthesized
atagcctgttgtaatagacaag

SEQ ID NO: 27219 - DNA, 22 bp, Artificial Sequence
  chemically synthesized
ttgtaatagacaaggttaaatg

SEQ ID NO: 27220 - DNA, 22 bp, Artificial Sequence
  chemically synthesized
taatagacaaggttaaatgtag

SEQ ID NO: 27221 - DNA, 22 bp, Artificial Sequence
  chemically synthesized
aatgtagcctaaatatatattc

SEQ ID NO: 27222 - DNA, 22 bp, Artificial Sequence
  chemically synthesized
aatatatattccgtttaaatgc

SEQ ID NO: 27223 - DNA, 22 bp, Artificial Sequence
  chemically synthesized
cgtttaaatgctttcctcactc

SEQ ID NO: 27224 - DNA, 22 bp, Artificial Sequence
  chemically synthesized
aaatgctttcctcactcactag

SEQ ID NO: 27225 - DNA, 22 bp, Artificial Sequence
  chemically synthesized
aatgctttcctcactcactagc

SEQ ID NO: 27226 - DNA, 22 bp, Artificial Sequence
  chemically synthesized
tcctcactcactagcaattggt

SEQ ID NO: 27227 - DNA, 22 bp, Artificial Sequence
  chemically synthesized
cctcactcactagcaattggtt

SEQ ID NO: 27228 - DNA, 22 bp, Artificial Sequence
  chemically synthesized
ctcactcactagcaattggtta

SEQ ID NO: 27229 - DNA, 22 bp, Artificial Sequence
  chemically synthesized
actcactagcaattggttatca

SEQ ID NO: 27230 - DNA, 22 bp, Artificial Sequence
  chemically synthesized
actagcaattggttatcactag

SEQ ID NO: 27231 - DNA, 22 bp, Artificial Sequence
  chemically synthesized
gcaattggttatcactagagag

SEQ ID NO: 27232 - DNA, 22 bp, Artificial Sequence
  chemically synthesized
gttatcactagagagttatctg

SEQ ID NO: 27233 - DNA, 22 bp, Artificial Sequence
  chemically synthesized
tcactagagagttatctgtgaa

SEQ ID NO: 27234 - DNA, 22 bp, Artificial Sequence
  chemically synthesized
gagagttatctgtgaaatctta

SEQ ID NO: 27235 - DNA, 22 bp, Artificial Sequence
  chemically synthesized
tctgtgaaatcttactctacat

SEQ ID NO: 27236 - DNA, 22 bp, Artificial Sequence
  chemically synthesized
tgaaatcttactctacattcct

SEQ ID NO: 27237 - DNA, 22 bp, Artificial Sequence
  chemically synthesized
actctacattcctcagtcacct

SEQ ID NO: 27238 - DNA, 22 bp, Artificial Sequence
  chemically synthesized
ctctacattcctcagtcaccta

SEQ ID NO: 27239 - DNA, 22 bp, Artificial Sequence
  chemically synthesized
tacattcctcagtcacctagtg

SEQ ID NO: 27240 - DNA, 22 bp, Artificial Sequence
  chemically synthesized
cattcctcagtcacctagtgaa

SEQ ID NO: 27241 - DNA, 22 bp, Artificial Sequence
  chemically synthesized
ctcagtcacctagtgaaggtgt

SEQ ID NO: 27242 - DNA, 22 bp, Artificial Sequence
  chemically synthesized
agtcacctagtgaaggtgtact

SEQ ID NO: 27243 - DNA, 22 bp, Artificial Sequence
  chemically synthesized
gtgaaggtgtactgatccacct

SEQ ID NO: 27244 - DNA, 22 bp, Artificial Sequence
  chemically synthesized
atccaccttcaggagcagtaca

SEQ ID NO: 27245 - DNA, 22 bp, Artificial Sequence
  chemically synthesized
caggagcagtacaaacctttat

SEQ ID NO: 27246 - DNA, 22 bp, Artificial Sequence
  chemically synthesized
aggagcagtacaaacctttatt

SEQ ID NO: 27247 - DNA, 22 bp, Artificial Sequence
  chemically synthesized
tattggtcacttcccaagcaac

SEQ ID NO: 27248 - DNA, 22 bp, Artificial Sequence
  chemically synthesized
attggtcacttcccaagcaact

SEQ ID NO: 27249 - DNA, 22 bp, Artificial Sequence
  chemically synthesized
ttggtcacttcccaagcaactt

SEQ ID NO: 27250 - DNA, 22 bp, Artificial Sequence
  chemically synthesized
gtcacttcccaagcaacttcaa

SEQ ID NO: 27251 - DNA, 22 bp, Artificial Sequence
  chemically synthesized
cccaagcaacttcaaagagcag

SEQ ID NO: 27252 - DNA, 22 bp, Artificial Sequence
  chemically synthesized
ccaagcaacttcaaagagcagt

SEQ ID NO: 27253 - DNA, 22 bp, Artificial Sequence
  chemically synthesized
caaagagcagtaactcctccac

SEQ ID NO: 27254 - DNA, 22 bp, Artificial Sequence
  chemically synthesized
aaagagcagtaactcctccaca

SEQ ID NO: 27255 - DNA, 22 bp, Artificial Sequence
  chemically synthesized
ctccacaggaagttcttcgact

SEQ ID NO: 27256 - DNA, 22 bp, Artificial Sequence
  chemically synthesized
cacaggaagttcttcgacttcc

SEQ ID NO: 27257 - DNA, 22 bp, Artificial Sequence
  chemically synthesized
ttcgacttcccactggggaagc

SEQ ID NO: 27258 - DNA, 22 bp, Artificial Sequence
  chemically synthesized
cgacttcccactggggaagccc

SEQ ID NO: 27259 - DNA, 22 bp, Artificial Sequence
  chemically synthesized
gacttcccactggggaagccca

SEQ ID NO: 27260 - DNA, 22 bp, Artificial Sequence
  chemically synthesized
cccactggggaagcccacccag

SEQ ID NO: 27261 - DNA, 22 bp, Artificial Sequence
  chemically synthesized
ccactggggaagcccacccagg

SEQ ID NO: 27262 - DNA, 22 bp, Artificial Sequence
  chemically synthesized
gggaagcccacccagggatgtt

SEQ ID NO: 27263 - DNA, 22 bp, Artificial Sequence
  chemically synthesized
cagagagggatcggcctcgaag

SEQ ID NO: 27264 - DNA, 22 bp, Artificial Sequence
  chemically synthesized
gaagcattcttcttacagtcct

SEQ ID NO: 27265 - DNA, 22 bp, Artificial Sequence
  chemically synthesized
ttcttacagtcctccgagactc

SEQ ID NO: 27266 - DNA, 22 bp, Artificial Sequence
  chemically synthesized
cttacagtcctccgagactcct

SEQ ID NO: 27267 - DNA, 22 bp, Artificial Sequence
  chemically synthesized
ttacagtcctccgagactcctt

SEQ ID NO: 27268 - DNA, 22 bp, Artificial Sequence
  chemically synthesized
acagtcctccgagactcctttg

SEQ ID NO: 27269 - DNA, 22 bp, Artificial Sequence
  chemically synthesized
cagtcctccgagactcctttga

SEQ ID NO: 27270 - DNA, 22 bp, Artificial Sequence
  chemically synthesized
cgagactcctttgaattcctgt

SEQ ID NO: 27271 - DNA, 22 bp, Artificial Sequence
  chemically synthesized
ctttgaattcctgtttcaatta

SEQ ID NO: 27272 - DNA, 22 bp, Artificial Sequence
  chemically synthesized
tgaattcctgtttcaattagtt

SEQ ID NO: 27273 - DNA, 22 bp, Artificial Sequence
  chemically synthesized
gaattcctgtttcaattagttg

SEQ ID NO: 27274 - DNA, 22 bp, Artificial Sequence
  chemically synthesized
aattcctgtttcaattagttgt

SEQ ID NO: 27275 - DNA, 22 bp, Artificial Sequence
  chemically synthesized
ctgtttcaattagttgtaatcc

SEQ ID NO: 27276 - DNA, 22 bp, Artificial Sequence
  chemically synthesized
tttcaattagttgtaatcccag

SEQ ID NO: 27277 - DNA, 22 bp, Artificial Sequence
  chemically synthesized
caattagttgtaatcccaggag

SEQ ID NO: 27278 - DNA, 22 bp, Artificial Sequence
  chemically synthesized
aattagttgtaatcccaggaga

SEQ ID NO: 27279 - DNA, 22 bp, Artificial Sequence
  chemically synthesized
gttgtaatcccaggagaagaga

SEQ ID NO: 27280 - DNA, 22 bp, Artificial Sequence
  chemically synthesized
taatcccaggagaagagaactt

SEQ ID NO: 27281 - DNA, 22 bp, Artificial Sequence
  chemically synthesized
acaggcacaaaagttagagttg

SEQ ID NO: 27282 - DNA, 22 bp, Artificial Sequence
  chemically synthesized
caggcacaaaagttagagttgg

SEQ ID NO: 27283 - DNA, 22 bp, Artificial Sequence
  chemically synthesized
gagttggtagagttaccaggct

SEQ ID NO: 27284 - DNA, 22 bp, Artificial Sequence
  chemically synthesized
gtagagttaccaggctttggta

SEQ ID NO: 27285 - DNA, 22 bp, Artificial Sequence
  chemically synthesized
ccaggctttggtagcttctctt

SEQ ID NO: 27286 - DNA, 22 bp, Artificial Sequence
  chemically synthesized
tggtagcttctcttgggaataa

SEQ ID NO: 27287 - DNA, 22 bp, Artificial Sequence
  chemically synthesized
ggtagcttctcttgggaataaa

SEQ ID NO: 27288 - DNA, 22 bp, Artificial Sequence
  chemically synthesized
gtagcttctcttgggaataaac

SEQ ID NO: 27289 - DNA, 22 bp, Artificial Sequence
  chemically synthesized
ctcttgggaataaactagtagc

SEQ ID NO: 27290 - DNA, 22 bp, Artificial Sequence
  chemically synthesized
tcttgggaataaactagtagca

SEQ ID NO: 27291 - DNA, 22 bp, Artificial Sequence
  chemically synthesized
ttgggaataaactagtagcatg

SEQ ID NO: 27292 - DNA, 22 bp, Artificial Sequence
  chemically synthesized
gggaataaactagtagcatgaa

SEQ ID NO: 27293 - DNA, 22 bp, Artificial Sequence
  chemically synthesized
ggaataaactagtagcatgaaa

SEQ ID NO: 27294 - DNA, 22 bp, Artificial Sequence
  chemically synthesized
gtagcatgaaatcttatgtgct

SEQ ID NO: 27295 - DNA, 22 bp, Artificial Sequence
  chemically synthesized
atgtgcttcccacagaattcct

SEQ ID NO: 27296 - DNA, 22 bp, Artificial Sequence
  chemically synthesized
tgtgcttcccacagaattcctg

SEQ ID NO: 27297 - DNA, 22 bp, Artificial Sequence
  chemically synthesized
cccacagaattcctggtggaag

SEQ ID NO: 27298 - DNA, 22 bp, Artificial Sequence
  chemically synthesized
ccacagaattcctggtggaagg

SEQ ID NO: 27299 - DNA, 22 bp, Artificial Sequence
  chemically synthesized
ctggtggaaggaggaattcttc

SEQ ID NO: 27300 - DNA, 22 bp, Artificial Sequence
  chemically synthesized
gtggaaggaggaattcttcctc

SEQ ID NO: 27301 - DNA, 22 bp, Artificial Sequence
  chemically synthesized
ttcctcctctttctcgtctttc

SEQ ID NO: 27302 - DNA, 22 bp, Artificial Sequence
  chemically synthesized
cctcctctttctcgtctttctg

SEQ ID NO: 27303 - DNA, 22 bp, Artificial Sequence
  chemically synthesized
ctcctctttctcgtctttctgg

SEQ ID NO: 27304 - DNA, 22 bp, Artificial Sequence
  chemically synthesized
ctctttctcgtctttctgggca

SEQ ID NO: 27305 - DNA, 22 bp, Artificial Sequence
  chemically synthesized
tttctcgtctttctgggcaggt

SEQ ID NO: 27306 - DNA, 22 bp, Artificial Sequence
  chemically synthesized
tctcgtctttctgggcaggtat

SEQ ID NO: 27307 - DNA, 22 bp, Artificial Sequence
  chemically synthesized
ctcgtctttctgggcaggtatt

SEQ ID NO: 27308 - DNA, 22 bp, Artificial Sequence
  chemically synthesized
tcgtctttctgggcaggtattg

SEQ ID NO: 27309 - DNA, 22 bp, Artificial Sequence
  chemically synthesized
gtctttctgggcaggtattgtg

SEQ ID NO: 27310 - DNA, 22 bp, Artificial Sequence
  chemically synthesized
tctgggcaggtattgtgaggac

SEQ ID NO: 27311 - DNA, 22 bp, Artificial Sequence
  chemically synthesized
ctgggcaggtattgtgaggacg

SEQ ID NO: 27312 - DNA, 22 bp, Artificial Sequence
  chemically synthesized
tgggcaggtattgtgaggacgg

SEQ ID NO: 27313 - DNA, 22 bp, Artificial Sequence
  chemically synthesized
ggcaggtattgtgaggacggta

SEQ ID NO: 27314 - DNA, 22 bp, Artificial Sequence
  chemically synthesized
tgaggacggtatctgccctgtc

SEQ ID NO: 27315 - DNA, 22 bp, Artificial Sequence
  chemically synthesized
acagggcagataccgtcctcac

SEQ ID NO: 27316 - DNA, 22 bp, Artificial Sequence
  chemically synthesized
acaatacctgcccagaaagacg

SEQ ID NO: 27317 - DNA, 22 bp, Artificial Sequence
  chemically synthesized
cccagaaagacgagaaagagga

SEQ ID NO: 27318 - DNA, 22 bp, Artificial Sequence
  chemically synthesized
ctccttccaccaggaattctgt

SEQ ID NO: 27319 - DNA, 22 bp, Artificial Sequence
  chemically synthesized
cttccaccaggaattctgtggg

SEQ ID NO: 27320 - DNA, 22 bp, Artificial Sequence
  chemically synthesized
ccaccaggaattctgtgggaag

SEQ ID NO: 27321 - DNA, 22 bp, Artificial Sequence
  chemically synthesized
caccaggaattctgtgggaagc

SEQ ID NO: 27322 - DNA, 22 bp, Artificial Sequence
  chemically synthesized
tgtgggaagcacataagatttc

SEQ ID NO: 27323 - DNA, 22 bp, Artificial Sequence
  chemically synthesized
tgggaagcacataagatttcat

SEQ ID NO: 27324 - DNA, 22 bp, Artificial Sequence
  chemically synthesized
catgctactagtttattcccaa

SEQ ID NO: 27325 - DNA, 22 bp, Artificial Sequence
  chemically synthesized
atgctactagtttattcccaag

SEQ ID NO: 27326 - DNA, 22 bp, Artificial Sequence
  chemically synthesized
ctagtttattcccaagagaagc

SEQ ID NO: 27327 - DNA, 22 bp, Artificial Sequence
  chemically synthesized
gtttattcccaagagaagctac

SEQ ID NO: 27328 - DNA, 22 bp, Artificial Sequence
  chemically synthesized
attcccaagagaagctaccaaa

SEQ ID NO: 27329 - DNA, 22 bp, Artificial Sequence
  chemically synthesized
ttcccaagagaagctaccaaag

SEQ ID NO: 27330 - DNA, 22 bp, Artificial Sequence
  chemically synthesized
ccaagagaagctaccaaagcct

SEQ ID NO: 27331 - DNA, 22 bp, Artificial Sequence
  chemically synthesized
ccaaagcctggtaactctacca

SEQ ID NO: 27332 - DNA, 22 bp, Artificial Sequence
  chemically synthesized
gtaactctaccaactctaactt

SEQ ID NO: 27333 - DNA, 22 bp, Artificial Sequence
  chemically synthesized
taccaactctaacttttgtgcc

SEQ ID NO: 27334 - DNA, 22 bp, Artificial Sequence
  chemically synthesized
ccaactctaacttttgtgcctg

SEQ ID NO: 27335 - DNA, 22 bp, Artificial Sequence
  chemically synthesized
taacttttgtgcctgtaagttc

SEQ ID NO: 27336 - DNA, 22 bp, Artificial Sequence
  chemically synthesized
acttttgtgcctgtaagttctc

SEQ ID NO: 27337 - DNA, 22 bp, Artificial Sequence
  chemically synthesized
ttgtgcctgtaagttctcttct

SEQ ID NO: 27338 - DNA, 22 bp, Artificial Sequence
  chemically synthesized
tgtgcctgtaagttctcttctc

SEQ ID NO: 27339 - DNA, 22 bp, Artificial Sequence
  chemically synthesized
gtgcctgtaagttctcttctcc

SEQ ID NO: 27340 - DNA, 22 bp, Artificial Sequence
  chemically synthesized
tgcctgtaagttctcttctcct

SEQ ID NO: 27341 - DNA, 22 bp, Artificial Sequence
  chemically synthesized
taagttctcttctcctgggatt

SEQ ID NO: 27342 - DNA, 22 bp, Artificial Sequence
  chemically synthesized
tcttctcctgggattacaacta

SEQ ID NO: 27343 - DNA, 22 bp, Artificial Sequence
  chemically synthesized
ttctcctgggattacaactaat

SEQ ID NO: 27344 - DNA, 22 bp, Artificial Sequence
  chemically synthesized
ctcctgggattacaactaattg

SEQ ID NO: 27345 - DNA, 22 bp, Artificial Sequence
  chemically synthesized
tcctgggattacaactaattga

SEQ ID NO: 27346 - DNA, 22 bp, Artificial Sequence
  chemically synthesized
ctgggattacaactaattgaaa

SEQ ID NO: 27347 - DNA, 22 bp, Artificial Sequence
  chemically synthesized
ggattacaactaattgaaacag

SEQ ID NO: 27348 - DNA, 22 bp, Artificial Sequence
  chemically synthesized
caactaattgaaacaggaattc

SEQ ID NO: 27349 - DNA, 22 bp, Artificial Sequence
  chemically synthesized
attgaaacaggaattcaaagga

SEQ ID NO: 27350 - DNA, 22 bp, Artificial Sequence
  chemically synthesized
aaacaggaattcaaaggagtct

SEQ ID NO: 27351 - DNA, 22 bp, Artificial Sequence
  chemically synthesized
aaaggagtctcggaggactgta

SEQ ID NO: 27352 - DNA, 22 bp, Artificial Sequence
  chemically synthesized
ggaggactgtaagaagaatgct

SEQ ID NO: 27353 - DNA, 22 bp, Artificial Sequence
  chemically synthesized
taagaagaatgcttcgaggccg

SEQ ID NO: 27354 - DNA, 22 bp, Artificial Sequence
  chemically synthesized
cgaggccgatccctctctgtaa

SEQ ID NO: 27355 - DNA, 22 bp, Artificial Sequence
  chemically synthesized
gaggccgatccctctctgtaac

SEQ ID NO: 27356 - DNA, 22 bp, Artificial Sequence
  chemically synthesized
tctgtaacatccctgggtgggc

SEQ ID NO: 27357 - DNA, 22 bp, Artificial Sequence
  chemically synthesized
tgtaacatccctgggtgggctt

SEQ ID NO: 27358 - DNA, 22 bp, Artificial Sequence
  chemically synthesized
taacatccctgggtgggcttcc

SEQ ID NO: 27359 - DNA, 22 bp, Artificial Sequence
  chemically synthesized
ggtgggcttccccagtgggaag

SEQ ID NO: 27360 - DNA, 22 bp, Artificial Sequence
  chemically synthesized
ccccagtgggaagtcgaagaac

SEQ ID NO: 27361 - DNA, 22 bp, Artificial Sequence
  chemically synthesized
cccagtgggaagtcgaagaact

SEQ ID NO: 27362 - DNA, 22 bp, Artificial Sequence
  chemically synthesized
cctgtggaggagttactgctct

SEQ ID NO: 27363 - DNA, 22 bp, Artificial Sequence
  chemically synthesized
ctgtggaggagttactgctctt

SEQ ID NO: 27364 - DNA, 22 bp, Artificial Sequence
  chemically synthesized
tggaggagttactgctctttga

SEQ ID NO: 27365 - DNA, 22 bp, Artificial Sequence
  chemically synthesized
ctgctctttgaagttgcttggg

SEQ ID NO: 27366 - DNA, 22 bp, Artificial Sequence
  chemically synthesized
ctctttgaagttgcttgggaag

SEQ ID NO: 27367 - DNA, 22 bp, Artificial Sequence
  chemically synthesized
tttgaagttgcttgggaagtga

SEQ ID NO: 27368 - DNA, 22 bp, Artificial Sequence
  chemically synthesized
tgaagttgcttgggaagtgacc

SEQ ID NO: 27369 - DNA, 22 bp, Artificial Sequence
  chemically synthesized
gaagttgcttgggaagtgacca

SEQ ID NO: 27370 - DNA, 22 bp, Artificial Sequence
  chemically synthesized
aagttgcttgggaagtgaccaa

SEQ ID NO: 27371 - DNA, 22 bp, Artificial Sequence
  chemically synthesized
cttgggaagtgaccaataaagg

SEQ ID NO: 27372 - DNA, 22 bp, Artificial Sequence
  chemically synthesized
gggaagtgaccaataaaggttt

SEQ ID NO: 27373 - DNA, 22 bp, Artificial Sequence
  chemically synthesized
ggaagtgaccaataaaggtttg

SEQ ID NO: 27374 - DNA, 22 bp, Artificial Sequence
  chemically synthesized
gtactgctcctgaaggtggatc

SEQ ID NO: 27375 - DNA, 22 bp, Artificial Sequence
  chemically synthesized
tactgctcctgaaggtggatca

SEQ ID NO: 27376 - DNA, 22 bp, Artificial Sequence
  chemically synthesized
ctcctgaaggtggatcagtaca

SEQ ID NO: 27377 - DNA, 22 bp, Artificial Sequence
  chemically synthesized
ctgaaggtggatcagtacacct

SEQ ID NO: 27378 - DNA, 22 bp, Artificial Sequence
  chemically synthesized
aaggtggatcagtacaccttca

SEQ ID NO: 27379 - DNA, 22 bp, Artificial Sequence
  chemically synthesized
cactaggtgactgaggaatgta

SEQ ID NO: 27380 - DNA, 22 bp, Artificial Sequence
  chemically synthesized
actaggtgactgaggaatgtag

SEQ ID NO: 27381 - DNA, 22 bp, Artificial Sequence
  chemically synthesized
ggtgactgaggaatgtagagta

SEQ ID NO: 27382 - DNA, 22 bp, Artificial Sequence
  chemically synthesized
aggaatgtagagtaagatttca

SEQ ID NO: 27383 - DNA, 22 bp, Artificial Sequence
  chemically synthesized
cacagataactctctagtgata

SEQ ID NO: 27384 - DNA, 22 bp, Artificial Sequence
  chemically synthesized
acagataactctctagtgataa

SEQ ID NO: 27385 - DNA, 22 bp, Artificial Sequence
  chemically synthesized
tctagtgataaccaattgctag

SEQ ID NO: 27386 - DNA, 22 bp, Artificial Sequence
  chemically synthesized
tagtgataaccaattgctagtg

SEQ ID NO: 27387 - DNA, 22 bp, Artificial Sequence
  chemically synthesized
gtgataaccaattgctagtgag

SEQ ID NO: 27388 - DNA, 22 bp, Artificial Sequence
  chemically synthesized
ctagtgagtgaggaaagcattt

SEQ ID NO: 27389 - DNA, 22 bp, Artificial Sequence
  chemically synthesized
gtgagtgaggaaagcatttaaa

SEQ ID NO: 27390 - DNA, 22 bp, Artificial Sequence
  chemically synthesized
aaacggaatatatatttaggct

SEQ ID NO: 27391 - DNA, 22 bp, Artificial Sequence
  chemically synthesized
aacggaatatatatttaggcta

SEQ ID NO: 27392 - DNA, 22 bp, Artificial Sequence
  chemically synthesized
aggctacatttaaccttgtcta

SEQ ID NO: 27393 - DNA, 22 bp, Artificial Sequence
  chemically synthesized
ggctacatttaaccttgtctat

SEQ ID NO: 27394 - DNA, 22 bp, Artificial Sequence
  chemically synthesized
catttaaccttgtctattacaa

SEQ ID NO: 27395 - DNA, 22 bp, Artificial Sequence
  chemically synthesized
aaccttgtctattacaacaggc

SEQ ID NO: 27396 - DNA, 22 bp, Artificial Sequence
  chemically synthesized
accttgtctattacaacaggct

SEQ ID NO: 27397 - DNA, 22 bp, Artificial Sequence
  chemically synthesized
gtctattacaacaggctatgaa

SEQ ID NO: 27398 - DNA, 22 bp, Artificial Sequence
  chemically synthesized
tctattacaacaggctatgaat

SEQ ID NO: 27399 - DNA, 22 bp, Artificial Sequence
  chemically synthesized
ttacaacaggctatgaatacag

SEQ ID NO: 27400 - DNA, 22 bp, Artificial Sequence
  chemically synthesized
caacaggctatgaatacagact

SEQ ID NO: 27401 - DNA, 22 bp, Artificial Sequence
  chemically synthesized
tgaatacagacttgtgtatgtg

SEQ ID NO: 27402 - DNA, 22 bp, Artificial Sequence
  chemically synthesized
gtgtatgtgttgaagagggaga

SEQ ID NO: 27403 - DNA, 22 bp, Artificial Sequence
  chemically synthesized
tgtatgtgttgaagagggagaa

SEQ ID NO: 27404 - DNA, 22 bp, Artificial Sequence
  chemically synthesized
aagagggagaaagttgaaaata

SEQ ID NO: 27405 - DNA, 22 bp, Artificial Sequence
  chemically synthesized
aaaatattagccattgccatgg

SEQ ID NO: 27406 - DNA, 22 bp, Artificial Sequence
  chemically synthesized
gccattgccatggaatgtgcat

SEQ ID NO: 27407 - DNA, 22 bp, Artificial Sequence
  chemically synthesized
ccatggaatgtgcatttaaatt

SEQ ID NO: 27408 - DNA, 22 bp, Artificial Sequence
  chemically synthesized
aaattaaaatttaaaatccata

SEQ ID NO: 27409 - DNA, 22 bp, Artificial Sequence
  chemically synthesized
aattaaaatttaaaatccatat

SEQ ID NO: 27410 - DNA, 22 bp, Artificial Sequence
  chemically synthesized
aaatttaaaatccatattatga

SEQ ID NO: 27411 - DNA, 22 bp, Artificial Sequence
  chemically synthesized
aaaatccatattatgacaacat

SEQ ID NO: 27412 - DNA, 22 bp, Artificial Sequence
  chemically synthesized
aaatccatattatgacaacata

SEQ ID NO: 27413 - DNA, 22 bp, Artificial Sequence
  chemically synthesized
tgacaacatagaaataaaaagt

SEQ ID NO: 27414 - DNA, 22 bp, Artificial Sequence
  chemically synthesized
atatttacattttttgttttaa

SEQ ID NO: 27415 - DNA, 22 bp, Artificial Sequence
  chemically synthesized
acattttttgttttaaaatttt

SEQ ID NO: 27416 - DNA, 22 bp, Artificial Sequence
  chemically synthesized
cattttttgttttaaaattttt

SEQ ID NO: 27417 - DNA, 22 bp, Artificial Sequence
  chemically synthesized
tttgttttaaaatttttctcag

SEQ ID NO: 27418 - DNA, 22 bp, Artificial Sequence
  chemically synthesized
ttgttttaaaatttttctcagc

SEQ ID NO: 27419 - DNA, 22 bp, Artificial Sequence
  chemically synthesized
tgttttaaaatttttctcagca

SEQ ID NO: 27420 - DNA, 22 bp, Artificial Sequence
  chemically synthesized
gttttaaaatttttctcagcaa

SEQ ID NO: 27421 - DNA, 22 bp, Artificial Sequence
  chemically synthesized
ttttaaaatttttctcagcaaa

SEQ ID NO: 27422 - DNA, 22 bp, Artificial Sequence
  chemically synthesized
taaaatttttctcagcaaaata

SEQ ID NO: 27423 - DNA, 22 bp, Artificial Sequence
  chemically synthesized
aaaatttttctcagcaaaatag

SEQ ID NO: 27424 - DNA, 22 bp, Artificial Sequence
  chemically synthesized
aaatttttctcagcaaaatagt

SEQ ID NO: 27425 - DNA, 22 bp, Artificial Sequence
  chemically synthesized
ttctcagcaaaatagtataatt

SEQ ID NO: 27426 - DNA, 22 bp, Artificial Sequence
  chemically synthesized
tctcagcaaaatagtataatta

SEQ ID NO: 27427 - DNA, 22 bp, Artificial Sequence
  chemically synthesized
ctcagcaaaatagtataattaa

SEQ ID NO: 27428 - DNA, 22 bp, Artificial Sequence
  chemically synthesized
tcagcaaaatagtataattaaa

SEQ ID NO: 27429 - DNA, 22 bp, Artificial Sequence
  chemically synthesized
agcaaaatagtataattaaaca

SEQ ID NO: 27430 - DNA, 22 bp, Artificial Sequence
  chemically synthesized
aacattttattttaggaagatg

SEQ ID NO: 27431 - DNA, 22 bp, Artificial Sequence
  chemically synthesized
tattttaggaagatgtatatgt

SEQ ID NO: 27432 - DNA, 22 bp, Artificial Sequence
  chemically synthesized
attttaggaagatgtatatgtg

SEQ ID NO: 27433 - DNA, 22 bp, Artificial Sequence
  chemically synthesized
ttttaggaagatgtatatgtga

SEQ ID NO: 27434 - DNA, 22 bp, Artificial Sequence
  chemically synthesized
taggaagatgtatatgtgatta

SEQ ID NO: 27435 - DNA, 22 bp, Artificial Sequence
  chemically synthesized
aggaagatgtatatgtgattag

SEQ ID NO: 27436 - DNA, 22 bp, Artificial Sequence
  chemically synthesized
ggaagatgtatatgtgattaga

SEQ ID NO: 27437 - DNA, 22 bp, Artificial Sequence
  chemically synthesized
gaaccagttggaaacctcaact

SEQ ID NO: 27438 - DNA, 22 bp, Artificial Sequence
  chemically synthesized
gaaacctcaactctacattctg

SEQ ID NO: 27439 - DNA, 22 bp, Artificial Sequence
  chemically synthesized
aactctacattctgttagtaat

SEQ ID NO: 27440 - DNA, 22 bp, Artificial Sequence
  chemically synthesized
tacattctgttagtaattatat

SEQ ID NO: 27441 - DNA, 22 bp, Artificial Sequence
  chemically synthesized
cattctgttagtaattatatga

SEQ ID NO: 27442 - DNA, 22 bp, Artificial Sequence
  chemically synthesized
tgttagtaattatatgaaatgc

SEQ ID NO: 27443 - DNA, 22 bp, Artificial Sequence
  chemically synthesized
ttagtaattatatgaaatgctt

SEQ ID NO: 27444 - DNA, 22 bp, Artificial Sequence
  chemically synthesized
gtaattatatgaaatgcttaag

SEQ ID NO: 27445 - DNA, 22 bp, Artificial Sequence
  chemically synthesized
tatgaaatgcttaagaatgttt

SEQ ID NO: 27446 - DNA, 22 bp, Artificial Sequence
  chemically synthesized
aagaatgtttcatattcacaat

SEQ ID NO: 27447 - DNA, 22 bp, Artificial Sequence
  chemically synthesized
agaatgtttcatattcacaatt

SEQ ID NO: 27448 - DNA, 22 bp, Artificial Sequence
  chemically synthesized
catattcacaattagcttggaa

SEQ ID NO: 27449 - DNA, 22 bp, Artificial Sequence
  chemically synthesized
atattcacaattagcttggaat

SEQ ID NO: 27450 - DNA, 22 bp, Artificial Sequence
  chemically synthesized
acaattagcttggaattaatgt

SEQ ID NO: 27451 - DNA, 22 bp, Artificial Sequence
  chemically synthesized
gcttggaattaatgttttaatt

SEQ ID NO: 27452 - DNA, 22 bp, Artificial Sequence
  chemically synthesized
ggaattaatgttttaattcagg

SEQ ID NO: 27453 - DNA, 22 bp, Artificial Sequence
  chemically synthesized
gaattaatgttttaattcagga

SEQ ID NO: 27454 - DNA, 22 bp, Artificial Sequence
  chemically synthesized
atgttttaattcaggagcttct

SEQ ID NO: 27455 - DNA, 22 bp, Artificial Sequence
  chemically synthesized
taattcaggagcttctcaaaag

SEQ ID NO: 27456 - DNA, 22 bp, Artificial Sequence
  chemically synthesized
aattcaggagcttctcaaaagg

SEQ ID NO: 27457 - DNA, 22 bp, Artificial Sequence
  chemically synthesized
attcaggagcttctcaaaaggc

SEQ ID NO: 27458 - DNA, 22 bp, Artificial Sequence
  chemically synthesized
aggagcttctcaaaaggcaaaa

SEQ ID NO: 27459 - DNA, 22 bp, Artificial Sequence
  chemically synthesized
ctcaaaaggcaaaatactgtgc

SEQ ID NO: 27460 - DNA, 22 bp, Artificial Sequence
  chemically synthesized
tcaaaaggcaaaatactgtgct

SEQ ID NO: 27461 - DNA, 22 bp, Artificial Sequence
  chemically synthesized
aaaaggcaaaatactgtgctcc

SEQ ID NO: 27462 - DNA, 22 bp, Artificial Sequence
  chemically synthesized
tgctcctttcagaatgaaagta

SEQ ID NO: 27463 - DNA, 22 bp, Artificial Sequence
  chemically synthesized
ctttcagaatgaaagtaatttt

SEQ ID NO: 27464 - DNA, 22 bp, Artificial Sequence
  chemically synthesized
tcagaatgaaagtaattttttt

SEQ ID NO: 27465 - DNA, 22 bp, Artificial Sequence
  chemically synthesized
cagaatgaaagtaatttttttc

SEQ ID NO: 27466 - DNA, 22 bp, Artificial Sequence
  chemically synthesized
agaatgaaagtaatttttttct

SEQ ID NO: 27467 - DNA, 22 bp, Artificial Sequence
  chemically synthesized
ttttcttcaatgctatgcttat

SEQ ID NO: 27468 - DNA, 22 bp, Artificial Sequence
  chemically synthesized
tttcttcaatgctatgcttatg

SEQ ID NO: 27469 - DNA, 22 bp, Artificial Sequence
  chemically synthesized
ttcttcaatgctatgcttatgt

SEQ ID NO: 27470 - DNA, 22 bp, Artificial Sequence
  chemically synthesized
tcttcaatgctatgcttatgta

SEQ ID NO: 27471 - DNA, 22 bp, Artificial Sequence
  chemically synthesized
cttcaatgctatgcttatgtag

SEQ ID NO: 27472 - DNA, 22 bp, Artificial Sequence
  chemically synthesized
ttcaatgctatgcttatgtagg

SEQ ID NO: 27473 - DNA, 22 bp, Artificial Sequence
  chemically synthesized
caatgctatgcttatgtaggaa

SEQ ID NO: 27474 - DNA, 22 bp, Artificial Sequence
  chemically synthesized
aatgctatgcttatgtaggaat

SEQ ID NO: 27475 - DNA, 22 bp, Artificial Sequence
  chemically synthesized
tgcttatgtaggaattataaaa

SEQ ID NO: 27476 - DNA, 22 bp, Artificial Sequence
  chemically synthesized
atgtaggaattataaaataaag

SEQ ID NO: 27477 - DNA, 22 bp, Artificial Sequence
  chemically synthesized
tgtaggaattataaaataaaga

SEQ ID NO: 27478 - DNA, 22 bp, Artificial Sequence
  chemically synthesized
taaaataaagaaaatcaaattg

SEQ ID NO: 27479 - DNA, 22 bp, Artificial Sequence
  chemically synthesized
ataaaacaatttgcgagtgagg

SEQ ID NO: 27480 - DNA, 22 bp, Artificial Sequence
  chemically synthesized
gcgagtgaggtataacctcatc

SEQ ID NO: 27481 - DNA, 22 bp, Artificial Sequence
  chemically synthesized
cgagtgaggtataacctcatct

SEQ ID NO: 27482 - DNA, 22 bp, Artificial Sequence
  chemically synthesized
atctgtgctgggtaagagaagg

SEQ ID NO: 27483 - DNA, 22 bp, Artificial Sequence
  chemically synthesized
tgctgggtaagagaaggcaagg

SEQ ID NO: 27484 - DNA, 22 bp, Artificial Sequence
  chemically synthesized
ggtaagagaaggcaaggtagag

SEQ ID NO: 27485 - DNA, 22 bp, Artificial Sequence
  chemically synthesized
tgaaaataaagacatctgtaaa

SEQ ID NO: 27486 - DNA, 22 bp, Artificial Sequence
  chemically synthesized
gaaaataaagacatctgtaaaa

SEQ ID NO: 27487 - DNA, 22 bp, Artificial Sequence
  chemically synthesized
aaaataaagacatctgtaaaat

SEQ ID NO: 27488 - DNA, 22 bp, Artificial Sequence
  chemically synthesized
taaaattataaaacaattcctt

SEQ ID NO: 27489 - DNA, 22 bp, Artificial Sequence
  chemically synthesized
taaaacaattccttgtgggttt

SEQ ID NO: 27490 - DNA, 22 bp, Artificial Sequence
  chemically synthesized
cttgtgggtttatactctctag

SEQ ID NO: 27491 - DNA, 22 bp, Artificial Sequence
  chemically synthesized
gtgggtttatactctctagttt

SEQ ID NO: 27492 - DNA, 22 bp, Artificial Sequence
  chemically synthesized
tgggtttatactctctagttta

SEQ ID NO: 27493 - DNA, 22 bp, Artificial Sequence
  chemically synthesized
atactctctagtttaaaagtgt

SEQ ID NO: 27494 - DNA, 22 bp, Artificial Sequence
  chemically synthesized
tactctctagtttaaaagtgtc

SEQ ID NO: 27495 - DNA, 22 bp, Artificial Sequence
  chemically synthesized
tctagtttaaaagtgtcaagac

SEQ ID NO: 27496 - DNA, 22 bp, Artificial Sequence
  chemically synthesized
tagtttaaaagtgtcaagacta

SEQ ID NO: 27497 - DNA, 22 bp, Artificial Sequence
  chemically synthesized
gtttaaaagtgtcaagactatt

SEQ ID NO: 27498 - DNA, 22 bp, Artificial Sequence
  chemically synthesized
aaaagtgtcaagactattgaag

SEQ ID NO: 27499 - DNA, 22 bp, Artificial Sequence
  chemically synthesized
aaagtgtcaagactattgaagg

SEQ ID NO: 27500 - DNA, 22 bp, Artificial Sequence
  chemically synthesized
ttgaaggaacattagcaaagaa

SEQ ID NO: 27501 - DNA, 22 bp, Artificial Sequence
  chemically synthesized
aaggaacattagcaaagaaaaa

SEQ ID NO: 27502 - DNA, 22 bp, Artificial Sequence
  chemically synthesized
gcaaagaaaaagtcatggtttt

SEQ ID NO: 27503 - DNA, 22 bp, Artificial Sequence
  chemically synthesized
tgaaggctgagttcctcaagat

SEQ ID NO: 27504 - DNA, 22 bp, Artificial Sequence
  chemically synthesized
gaaggctgagttcctcaagatc

SEQ ID NO: 27505 - DNA, 22 bp, Artificial Sequence
  chemically synthesized
aaggctgagttcctcaagatct

SEQ ID NO: 27506 - DNA, 22 bp, Artificial Sequence
  chemically synthesized
agttcctcaagatcttgaagaa

SEQ ID NO: 27507 - DNA, 22 bp, Artificial Sequence
  chemically synthesized
ctcaagatcttgaagaatcaag

SEQ ID NO: 27508 - DNA, 22 bp, Artificial Sequence
  chemically synthesized
aagatcttgaagaatcaagcca

SEQ ID NO: 27509 - DNA, 22 bp, Artificial Sequence
  chemically synthesized
gaagaatcaagccaactgattg

SEQ ID NO: 27510 - DNA, 22 bp, Artificial Sequence
  chemically synthesized
aagaatcaagccaactgattgc

SEQ ID NO: 27511 - DNA, 22 bp, Artificial Sequence
  chemically synthesized
attgctgggtaaatggcagtga

SEQ ID NO: 27512 - DNA, 22 bp, Artificial Sequence
  chemically synthesized
ctgggtaaatggcagtgatgac

SEQ ID NO: 27513 - DNA, 22 bp, Artificial Sequence
  chemically synthesized
ggtaaatggcagtgatgacttg

SEQ ID NO: 27514 - DNA, 22 bp, Artificial Sequence
  chemically synthesized
gtgtgatttaaacgatctgaaa

SEQ ID NO: 27515 - DNA, 22 bp, Artificial Sequence
  chemically synthesized
tgtgatttaaacgatctgaaat

SEQ ID NO: 27516 - DNA, 22 bp, Artificial Sequence
  chemically synthesized
aaacgatctgaaattatgtcat

SEQ ID NO: 27517 - DNA, 22 bp, Artificial Sequence
  chemically synthesized
aacgatctgaaattatgtcatg

SEQ ID NO: 27518 - DNA, 22 bp, Artificial Sequence
  chemically synthesized
aaattatgtcatgtgttgtgat

SEQ ID NO: 27519 - DNA, 22 bp, Artificial Sequence
  chemically synthesized
tgtcatgtgttgtgatatataa

SEQ ID NO: 27520 - DNA, 22 bp, Artificial Sequence
  chemically synthesized
tgatatataacacatttatttt

SEQ ID NO: 27521 - DNA, 22 bp, Artificial Sequence
  chemically synthesized
atttttcattttgtgtttacta

SEQ ID NO: 27522 - DNA, 22 bp, Artificial Sequence
  chemically synthesized
tttttcattttgtgtttactat

SEQ ID NO: 27523 - DNA, 22 bp, Artificial Sequence
  chemically synthesized
ttcattttgtgtttactatttc

SEQ ID NO: 27524 - DNA, 22 bp, Artificial Sequence
  chemically synthesized
tcattttgtgtttactatttca

SEQ ID NO: 27525 - DNA, 22 bp, Artificial Sequence
  chemically synthesized
cattttgtgtttactatttcat

SEQ ID NO: 27526 - DNA, 22 bp, Artificial Sequence
  chemically synthesized
attttgtgtttactatttcatg

SEQ ID NO: 27527 - DNA, 22 bp, Artificial Sequence
  chemically synthesized
tgtgtttactatttcatgtcta

SEQ ID NO: 27528 - DNA, 22 bp, Artificial Sequence
  chemically synthesized
gtgtttactatttcatgtctat

SEQ ID NO: 27529 - DNA, 22 bp, Artificial Sequence
  chemically synthesized
tgtttactatttcatgtctatt

SEQ ID NO: 27530 - DNA, 22 bp, Artificial Sequence
  chemically synthesized
actatttcatgtctattacagt

SEQ ID NO: 27531 - DNA, 22 bp, Artificial Sequence
  chemically synthesized
ctatttcatgtctattacagta

SEQ ID NO: 27532 - DNA, 22 bp, Artificial Sequence
  chemically synthesized
tttcatgtctattacagtaatc

SEQ ID NO: 27533 - DNA, 22 bp, Artificial Sequence
  chemically synthesized
catgtctattacagtaatctaa

SEQ ID NO: 27534 - DNA, 22 bp, Artificial Sequence
  chemically synthesized
atgtctattacagtaatctaaa

SEQ ID NO: 27535 - DNA, 22 bp, Artificial Sequence
  chemically synthesized
ttacagtaatctaaaggatctg

SEQ ID NO: 27536 - DNA, 22 bp, Artificial Sequence
  chemically synthesized
cagtaatctaaaggatctgaaa

SEQ ID NO: 27537 - DNA, 22 bp, Artificial Sequence
  chemically synthesized
aaggatctgaaataataaccag

SEQ ID NO: 27538 - DNA, 22 bp, Artificial Sequence
  chemically synthesized
aaataataaccagaatgtgata

SEQ ID NO: 27539 - DNA, 22 bp, Artificial Sequence
  chemically synthesized
cttccttcttttggctaatcag

SEQ ID NO: 27540 - DNA, 22 bp, Artificial Sequence
  chemically synthesized
ccttcttttggctaatcagagc

SEQ ID NO: 27541 - DNA, 22 bp, Artificial Sequence
  chemically synthesized
cttcttttggctaatcagagcc

SEQ ID NO: 27542 - DNA, 22 bp, Artificial Sequence
  chemically synthesized
cttttggctaatcagagccagc

SEQ ID NO: 27543 - DNA, 22 bp, Artificial Sequence
  chemically synthesized
ttttggctaatcagagccagca

SEQ ID NO: 27544 - DNA, 22 bp, Artificial Sequence
  chemically synthesized
ttggctaatcagagccagcata

SEQ ID NO: 27545 - DNA, 22 bp, Artificial Sequence
  chemically synthesized
tggctaatcagagccagcataa

SEQ ID NO: 27546 - DNA, 22 bp, Artificial Sequence
  chemically synthesized
ggctaatcagagccagcataat

SEQ ID NO: 27547 - DNA, 22 bp, Artificial Sequence
  chemically synthesized
gctaatcagagccagcataatc

SEQ ID NO: 27548 - DNA, 22 bp, Artificial Sequence
  chemically synthesized
atcagagccagcataatctcaa

SEQ ID NO: 27549 - DNA, 22 bp, Artificial Sequence
  chemically synthesized
aaaattaaatgcattatatatg

SEQ ID NO: 27550 - DNA, 22 bp, Artificial Sequence
  chemically synthesized
aatgcattatatatggcatgca

SEQ ID NO: 27551 - DNA, 22 bp, Artificial Sequence
  chemically synthesized
tatatggcatgcattctgaaaa

SEQ ID NO: 27552 - DNA, 22 bp, Artificial Sequence
  chemically synthesized
tgaaaaatcagaattcacctta

SEQ ID NO: 27553 - DNA, 22 bp, Artificial Sequence
  chemically synthesized
aaaaatcagaattcaccttata

SEQ ID NO: 27554 - DNA, 22 bp, Artificial Sequence
  chemically synthesized
accttatactaactgttcaaag

SEQ ID NO: 27555 - DNA, 22 bp, Artificial Sequence
  chemically synthesized
atactaactgttcaaagttctc

SEQ ID NO: 27556 - DNA, 22 bp, Artificial Sequence
  chemically synthesized
tactaactgttcaaagttctcg

SEQ ID NO: 27557 - DNA, 22 bp, Artificial Sequence
  chemically synthesized
actgttcaaagttctcgtgtgt

SEQ ID NO: 27558 - DNA, 22 bp, Artificial Sequence
  chemically synthesized
ttcaaagttctcgtgtgtatgc

SEQ ID NO: 27559 - DNA, 22 bp, Artificial Sequence
  chemically synthesized
aaagttctcgtgtgtatgcatt

SEQ ID NO: 27560 - DNA, 22 bp, Artificial Sequence
  chemically synthesized
tcgtgtgtatgcattcataaaa

SEQ ID NO: 27561 - DNA, 22 bp, Artificial Sequence
  chemically synthesized
gtgtgtatgcattcataaaatc

SEQ ID NO: 27562 - DNA, 22 bp, Artificial Sequence
  chemically synthesized
ataaaatcaaaattaaaagtca

SEQ ID NO: 27563 - DNA, 22 bp, Artificial Sequence
  chemically synthesized
aaagtcaattttgcctatgtag

SEQ ID NO: 27564 - DNA, 22 bp, Artificial Sequence
  chemically synthesized
tgcctatgtagaagtggacaga

SEQ ID NO: 27565 - DNA, 22 bp, Artificial Sequence
  chemically synthesized
gcctatgtagaagtggacagaa

SEQ ID NO: 27566 - DNA, 22 bp, Artificial Sequence
  chemically synthesized
cctatgtagaagtggacagaat

SEQ ID NO: 27567 - DNA, 22 bp, Artificial Sequence
  chemically synthesized
tgtagaagtggacagaatgcat

SEQ ID NO: 27568 - DNA, 22 bp, Artificial Sequence
  chemically synthesized
attctctgtagtttagtgagaa

SEQ ID NO: 27569 - DNA, 22 bp, Artificial Sequence
  chemically synthesized
ttctctgtagtttagtgagaaa

SEQ ID NO: 27570 - DNA, 22 bp, Artificial Sequence
  chemically synthesized
tctgtagtttagtgagaaagaa

SEQ ID NO: 27571 - DNA, 22 bp, Artificial Sequence
  chemically synthesized
tgtagtttagtgagaaagaatc

SEQ ID NO: 27572 - DNA, 22 bp, Artificial Sequence
  chemically synthesized
tagtttagtgagaaagaatcta

SEQ ID NO: 27573 - DNA, 22 bp, Artificial Sequence
  chemically synthesized
agtgagaaagaatctaggagga

SEQ ID NO: 27574 - DNA, 22 bp, Artificial Sequence
  chemically synthesized
gtgagaaagaatctaggaggac

SEQ ID NO: 27575 - DNA, 22 bp, Artificial Sequence
  chemically synthesized
ggaggacagaaaccttattaca

SEQ ID NO: 27576 - DNA, 22 bp, Artificial Sequence
  chemically synthesized
attacagagaagtgaagtattt

SEQ ID NO: 27577 - DNA, 22 bp, Artificial Sequence
  chemically synthesized
ttacagagaagtgaagtatttt

SEQ ID NO: 27578 - DNA, 22 bp, Artificial Sequence
  chemically synthesized
cagagaagtgaagtattttatg

SEQ ID NO: 27579 - DNA, 22 bp, Artificial Sequence
  chemically synthesized
tatgtgtacctgtttctgttgt

SEQ ID NO: 27580 - DNA, 22 bp, Artificial Sequence
  chemically synthesized
atgtgtacctgtttctgttgtt

SEQ ID NO: 27581 - DNA, 22 bp, Artificial Sequence
  chemically synthesized
tgtgtacctgtttctgttgttt

SEQ ID NO: 27582 - DNA, 22 bp, Artificial Sequence
  chemically synthesized
tttctgttgtttctttttaaat

SEQ ID NO: 27583 - DNA, 22 bp, Artificial Sequence
  chemically synthesized
ctgttgtttctttttaaattat

SEQ ID NO: 27584 - DNA, 22 bp, Artificial Sequence
  chemically synthesized
tgttgtttctttttaaattatt

SEQ ID NO: 27585 - DNA, 22 bp, Artificial Sequence
  chemically synthesized
ttgtttctttttaaattatttt

SEQ ID NO: 27586 - DNA, 22 bp, Artificial Sequence
  chemically synthesized
tttctttttaaattattttgta

SEQ ID NO: 27587 - DNA, 22 bp, Artificial Sequence
  chemically synthesized
ctttttaaattattttgtattc

SEQ ID NO: 27588 - DNA, 22 bp, Artificial Sequence
  chemically synthesized
tttttaaattattttgtattct

SEQ ID NO: 27589 - DNA, 22 bp, Artificial Sequence
  chemically synthesized
tttaaattattttgtattcttt

SEQ ID NO: 27590 - DNA, 22 bp, Artificial Sequence
  chemically synthesized
ttaaattattttgtattctttt

SEQ ID NO: 27591 - DNA, 22 bp, Artificial Sequence
  chemically synthesized
taaattattttgtattcttttc

SEQ ID NO: 27592 - DNA, 22 bp, Artificial Sequence
  chemically synthesized
aaattattttgtattcttttcc

SEQ ID NO: 27593 - DNA, 22 bp, Artificial Sequence
  chemically synthesized
aattattttgtattcttttcct

SEQ ID NO: 27594 - DNA, 22 bp, Artificial Sequence
  chemically synthesized
ttttgtattcttttcctcagag

SEQ ID NO: 27595 - DNA, 22 bp, Artificial Sequence
  chemically synthesized
tgtattcttttcctcagagatc

SEQ ID NO: 27596 - DNA, 22 bp, Artificial Sequence
  chemically synthesized
gtattcttttcctcagagatct

SEQ ID NO: 27597 - DNA, 22 bp, Artificial Sequence
  chemically synthesized
tattcttttcctcagagatctt

SEQ ID NO: 27598 - DNA, 22 bp, Artificial Sequence
  chemically synthesized
ttttcctcagagatctttatcc

SEQ ID NO: 27599 - DNA, 22 bp, Artificial Sequence
  chemically synthesized
ttcctcagagatctttatcctg

SEQ ID NO: 27600 - DNA, 22 bp, Artificial Sequence
  chemically synthesized
tcctcagagatctttatcctga

SEQ ID NO: 27601 - DNA, 22 bp, Artificial Sequence
  chemically synthesized
cctcagagatctttatcctgaa

SEQ ID NO: 27602 - DNA, 22 bp, Artificial Sequence
  chemically synthesized
ctcagagatctttatcctgaaa

SEQ ID NO: 27603 - DNA, 22 bp, Artificial Sequence
  chemically synthesized
agagatctttatcctgaaatga

SEQ ID NO: 27604 - DNA, 22 bp, Artificial Sequence
  chemically synthesized
tatcctgaaatgagcatgtgtt

SEQ ID NO: 27605 - DNA, 22 bp, Artificial Sequence
  chemically synthesized
atcctgaaatgagcatgtgttt

SEQ ID NO: 27606 - DNA, 22 bp, Artificial Sequence
  chemically synthesized
tcctgaaatgagcatgtgtttt

SEQ ID NO: 27607 - DNA, 22 bp, Artificial Sequence
  chemically synthesized
aaatgagcatgtgtttttaatg

SEQ ID NO: 27608 - DNA, 22 bp, Artificial Sequence
  chemically synthesized
ttaatgtcctttttctagtcac

SEQ ID NO: 27609 - DNA, 22 bp, Artificial Sequence
  chemically synthesized
taatgtcctttttctagtcaca

SEQ ID NO: 27610 - DNA, 22 bp, Artificial Sequence
  chemically synthesized
aatgtcctttttctagtcacaa

SEQ ID NO: 27611 - DNA, 22 bp, Artificial Sequence
  chemically synthesized
atgtcctttttctagtcacaaa

SEQ ID NO: 27612 - DNA, 22 bp, Artificial Sequence
  chemically synthesized
tttctagtcacaaatttttcca

SEQ ID NO: 27613 - DNA, 22 bp, Artificial Sequence
  chemically synthesized
ttctagtcacaaatttttccag

SEQ ID NO: 27614 - DNA, 22 bp, Artificial Sequence
  chemically synthesized
tctagtcacaaatttttccagt

SEQ ID NO: 27615 - DNA, 22 bp, Artificial Sequence
  chemically synthesized
ctagtcacaaatttttccagtc

SEQ ID NO: 27616 - DNA, 22 bp, Artificial Sequence
  chemically synthesized
tagtcacaaatttttccagtcc

SEQ ID NO: 27617 - DNA, 22 bp, Artificial Sequence
  chemically synthesized
gtcacaaatttttccagtccag

SEQ ID NO: 27618 - DNA, 22 bp, Artificial Sequence
  chemically synthesized
ttccagtccagtttttaaatat

SEQ ID NO: 27619 - DNA, 22 bp, Artificial Sequence
  chemically synthesized
tccagtccagtttttaaatatg

SEQ ID NO: 27620 - DNA, 22 bp, Artificial Sequence
  chemically synthesized
ccagtccagtttttaaatatgc

SEQ ID NO: 27621 - DNA, 22 bp, Artificial Sequence
  chemically synthesized
cagtccagtttttaaatatgcc

SEQ ID NO: 27622 - DNA, 22 bp, Artificial Sequence
  chemically synthesized
ttaaatatgcccaaagttcctg

SEQ ID NO: 27623 - DNA, 22 bp, Artificial Sequence
  chemically synthesized
taaatatgcccaaagttcctgg

SEQ ID NO: 27624 - DNA, 22 bp, Artificial Sequence
  chemically synthesized
aaatatgcccaaagttcctggg

SEQ ID NO: 27625 - DNA, 22 bp, Artificial Sequence
  chemically synthesized
aatatgcccaaagttcctggga

SEQ ID NO: 27626 - DNA, 22 bp, Artificial Sequence
  chemically synthesized
ctgggaacagaaccatctctat

SEQ ID NO: 27627 - DNA, 22 bp, Artificial Sequence
  chemically synthesized
ggaacagaaccatctctatcac

SEQ ID NO: 27628 - DNA, 22 bp, Artificial Sequence
  chemically synthesized
tatcacatgtgaatcccggagt

SEQ ID NO: 27629 - DNA, 22 bp, Artificial Sequence
  chemically synthesized
tcacatgtgaatcccggagtat

SEQ ID NO: 27630 - DNA, 22 bp, Artificial Sequence
  chemically synthesized
gaaataaaagttttctctagag

SEQ ID NO: 27631 - DNA, 22 bp, Artificial Sequence
  chemically synthesized
aaataaaagttttctctagaga

SEQ ID NO: 27632 - DNA, 22 bp, Artificial Sequence
  chemically synthesized
tctctagagagtgggcaggagc

SEQ ID NO: 27633 - DNA, 22 bp, Artificial Sequence
  chemically synthesized
ctctagagagtgggcaggagct

SEQ ID NO: 27634 - DNA, 22 bp, Artificial Sequence
  chemically synthesized
tctagagagtgggcaggagctc

SEQ ID NO: 27635 - DNA, 22 bp, Artificial Sequence
  chemically synthesized
tagagagtgggcaggagctcaa

SEQ ID NO: 27636 - DNA, 22 bp, Artificial Sequence
  chemically synthesized
gagagtgggcaggagctcaagg

SEQ ID NO: 27637 - DNA, 22 bp, Artificial Sequence
  chemically synthesized
aaggacatagcttattggtgga

SEQ ID NO: 27638 - DNA, 22 bp, Artificial Sequence
  chemically synthesized
attggtggataaaactggaagg

SEQ ID NO: 27639 - DNA, 22 bp, Artificial Sequence
  chemically synthesized
ttggtggataaaactggaaggg

SEQ ID NO: 27640 - DNA, 22 bp, Artificial Sequence
  chemically synthesized
gtggataaaactggaagggact

SEQ ID NO: 27641 - DNA, 22 bp, Artificial Sequence
  chemically synthesized
gaagggacttgttagcactggg

SEQ ID NO: 27642 - DNA, 22 bp, Artificial Sequence
  chemically synthesized
gttagcactgggaatcagtcca

SEQ ID NO: 27643 - DNA, 22 bp, Artificial Sequence
  chemically synthesized
ttagcactgggaatcagtccag

SEQ ID NO: 27644 - DNA, 22 bp, Artificial Sequence
  chemically synthesized
gcactgggaatcagtccagaag

SEQ ID NO: 27645 - DNA, 22 bp, Artificial Sequence
  chemically synthesized
ggaatcagtccagaagatctct

SEQ ID NO: 27646 - DNA, 22 bp, Artificial Sequence
  chemically synthesized
tgcacaagttcctgcacctgag

SEQ ID NO: 27647 - DNA, 22 bp, Artificial Sequence
  chemically synthesized
cacaagttcctgcacctgagca

SEQ ID NO: 27648 - DNA, 22 bp, Artificial Sequence
  chemically synthesized
ctgcacctgagcagagcccctt

SEQ ID NO: 27649 - DNA, 22 bp, Artificial Sequence
  chemically synthesized
cacctgagcagagccccttctg

SEQ ID NO: 27650 - DNA, 22 bp, Artificial Sequence
  chemically synthesized
agcagagccccttctgctttcc

SEQ ID NO: 27651 - DNA, 22 bp, Artificial Sequence
  chemically synthesized
ctgctttcctcttttctcatca

SEQ ID NO: 27652 - DNA, 22 bp, Artificial Sequence
  chemically synthesized
tgctttcctcttttctcatcat

SEQ ID NO: 27653 - DNA, 22 bp, Artificial Sequence
  chemically synthesized
ctttcctcttttctcatcattt

SEQ ID NO: 27654 - DNA, 22 bp, Artificial Sequence
  chemically synthesized
tcctcttttctcatcatttaac

SEQ ID NO: 27655 - DNA, 22 bp, Artificial Sequence
  chemically synthesized
cctcttttctcatcatttaaca

SEQ ID NO: 27656 - DNA, 22 bp, Artificial Sequence
  chemically synthesized
ctcttttctcatcatttaacaa

SEQ ID NO: 27657 - DNA, 22 bp, Artificial Sequence
  chemically synthesized
ttttctcatcatttaacaaaca

SEQ ID NO: 27658 - DNA, 22 bp, Artificial Sequence
  chemically synthesized
ttctcatcatttaacaaacatt

SEQ ID NO: 27659 - DNA, 22 bp, Artificial Sequence
  chemically synthesized
tctcatcatttaacaaacatta

SEQ ID NO: 27660 - DNA, 22 bp, Artificial Sequence
  chemically synthesized
ctcatcatttaacaaacattaa

SEQ ID NO: 27661 - DNA, 22 bp, Artificial Sequence
  chemically synthesized
tcatcatttaacaaacattaat

SEQ ID NO: 27662 - DNA, 22 bp, Artificial Sequence
  chemically synthesized
atcatttaacaaacattaatgg

SEQ ID NO: 27663 - DNA, 22 bp, Artificial Sequence
  chemically synthesized
aacaaacattaatggagcactg

SEQ ID NO: 27664 - DNA, 22 bp, Artificial Sequence
  chemically synthesized
acaaacattaatggagcactgt

SEQ ID NO: 27665 - DNA, 22 bp, Artificial Sequence
  chemically synthesized
atggagcactgttacctgggca

SEQ ID NO: 27666 - DNA, 22 bp, Artificial Sequence
  chemically synthesized
ttacctgggcactgggaacacg

SEQ ID NO: 27667 - DNA, 22 bp, Artificial Sequence
  chemically synthesized
cctgggcactgggaacacgcca

SEQ ID NO: 27668 - DNA, 22 bp, Artificial Sequence
  chemically synthesized
ggcactgggaacacgccagtga

SEQ ID NO: 27669 - DNA, 22 bp, Artificial Sequence
  chemically synthesized
ggaacacgccagtgaaactaag

SEQ ID NO: 27670 - DNA, 22 bp, Artificial Sequence
  chemically synthesized
agttattttatggatcttataa

SEQ ID NO: 27671 - DNA, 22 bp, Artificial Sequence
  chemically synthesized
ttttatggatcttataatcagt

SEQ ID NO: 27672 - DNA, 22 bp, Artificial Sequence
  chemically synthesized
tatggatcttataatcagtagc

SEQ ID NO: 27673 - DNA, 22 bp, Artificial Sequence
  chemically synthesized
atggatcttataatcagtagca

SEQ ID NO: 27674 - DNA, 22 bp, Artificial Sequence
  chemically synthesized
tggatcttataatcagtagcat

SEQ ID NO: 27675 - DNA, 22 bp, Artificial Sequence
  chemically synthesized
ataatcagtagcatgtgtgttg

SEQ ID NO: 27676 - DNA, 22 bp, Artificial Sequence
  chemically synthesized
taatcagtagcatgtgtgttga

SEQ ID NO: 27677 - DNA, 22 bp, Artificial Sequence
  chemically synthesized
atctcagggtctagaacagtgc

SEQ ID NO: 27678 - DNA, 22 bp, Artificial Sequence
  chemically synthesized
agggtctagaacagtgcctggt

SEQ ID NO: 27679 - DNA, 22 bp, Artificial Sequence
  chemically synthesized
gaacagtgcctggtacatagaa

SEQ ID NO: 27680 - DNA, 22 bp, Artificial Sequence
  chemically synthesized
gtacatagaaaatgctcaatgg

SEQ ID NO: 27681 - DNA, 22 bp, Artificial Sequence
  chemically synthesized
aatggatttttttttgaaaaaa

SEQ ID NO: 27682 - DNA, 22 bp, Artificial Sequence
  chemically synthesized
ttttttgaaaaaatttgttttt

SEQ ID NO: 27683 - DNA, 22 bp, Artificial Sequence
  chemically synthesized
tttttgaaaaaatttgtttttc

SEQ ID NO: 27684 - DNA, 22 bp, Artificial Sequence
  chemically synthesized
ttttgaaaaaatttgtttttca

SEQ ID NO: 27685 - DNA, 22 bp, Artificial Sequence
  chemically synthesized
tttgaaaaaatttgtttttcaa

SEQ ID NO: 27686 - DNA, 22 bp, Artificial Sequence
  chemically synthesized
ttgaaaaaatttgtttttcaac

SEQ ID NO: 27687 - DNA, 22 bp, Artificial Sequence
  chemically synthesized
tgaaaaaatttgtttttcaacc

SEQ ID NO: 27688 - DNA, 22 bp, Artificial Sequence
  chemically synthesized
gaaaaaatttgtttttcaaccc

SEQ ID NO: 27689 - DNA, 22 bp, Artificial Sequence
  chemically synthesized
aaaaaatttgtttttcaacccc

SEQ ID NO: 27690 - DNA, 22 bp, Artificial Sequence
  chemically synthesized
gtttttcaacccctaagctgcc

SEQ ID NO: 27691 - DNA, 22 bp, Artificial Sequence
  chemically synthesized
tttttcaacccctaagctgcct

SEQ ID NO: 27692 - DNA, 22 bp, Artificial Sequence
  chemically synthesized
ttcaacccctaagctgccttta

SEQ ID NO: 27693 - DNA, 22 bp, Artificial Sequence
  chemically synthesized
tcaacccctaagctgcctttaa

SEQ ID NO: 27694 - DNA, 22 bp, Artificial Sequence
  chemically synthesized
caacccctaagctgcctttaat

SEQ ID NO: 27695 - DNA, 22 bp, Artificial Sequence
  chemically synthesized
aacccctaagctgcctttaata

SEQ ID NO: 27696 - DNA, 22 bp, Artificial Sequence
  chemically synthesized
agctgcctttaatacttatttt

SEQ ID NO: 27697 - DNA, 22 bp, Artificial Sequence
  chemically synthesized
cctttaatacttattttctatc

SEQ ID NO: 27698 - DNA, 22 bp, Artificial Sequence
  chemically synthesized
taatacttattttctatcattt

SEQ ID NO: 27699 - DNA, 22 bp, Artificial Sequence
  chemically synthesized
aatacttattttctatcatttc

SEQ ID NO: 27700 - DNA, 22 bp, Artificial Sequence
  chemically synthesized
atacttattttctatcatttcc

SEQ ID NO: 27701 - DNA, 22 bp, Artificial Sequence
  chemically synthesized
attttctatcatttccctttca

SEQ ID NO: 27702 - DNA, 22 bp, Artificial Sequence
  chemically synthesized
ttttctatcatttccctttcaa

SEQ ID NO: 27703 - DNA, 22 bp, Artificial Sequence
  chemically synthesized
tctatcatttccctttcaaggg

SEQ ID NO: 27704 - DNA, 22 bp, Artificial Sequence
  chemically synthesized
ctatcatttccctttcaagggg

SEQ ID NO: 27705 - DNA, 22 bp, Artificial Sequence
  chemically synthesized
tatcatttccctttcaagggga

SEQ ID NO: 27706 - DNA, 22 bp, Artificial Sequence
  chemically synthesized
tcatttccctttcaaggggaag

SEQ ID NO: 27707 - DNA, 22 bp, Artificial Sequence
  chemically synthesized
ccctttcaaggggaagggaagt

SEQ ID NO: 27708 - DNA, 22 bp, Artificial Sequence
  chemically synthesized
cctttcaaggggaagggaagtg

SEQ ID NO: 27709 - DNA, 22 bp, Artificial Sequence
  chemically synthesized
tcaaggggaagggaagtgtttt

SEQ ID NO: 27710 - DNA, 22 bp, Artificial Sequence
  chemically synthesized
caaggggaagggaagtgttttt

SEQ ID NO: 27711 - DNA, 22 bp, Artificial Sequence
  chemically synthesized
aaggggaagggaagtgtttttg

SEQ ID NO: 27712 - DNA, 22 bp, Artificial Sequence
  chemically synthesized
ttgtggagaggtccccacaatg

SEQ ID NO: 27713 - DNA, 22 bp, Artificial Sequence
  chemically synthesized
tgtggagaggtccccacaatgt

SEQ ID NO: 27714 - DNA, 22 bp, Artificial Sequence
  chemically synthesized
gtggagaggtccccacaatgtg

SEQ ID NO: 27715 - DNA, 22 bp, Artificial Sequence
  chemically synthesized
tggagaggtccccacaatgtga

SEQ ID NO: 27716 - DNA, 22 bp, Artificial Sequence
  chemically synthesized
acacaagttgatatcatcttca

SEQ ID NO: 27717 - DNA, 22 bp, Artificial Sequence
  chemically synthesized
cacaagttgatatcatcttcaa

SEQ ID NO: 27718 - DNA, 22 bp, Artificial Sequence
  chemically synthesized
atatcatcttcaatgtatcttt

SEQ ID NO: 27719 - DNA, 22 bp, Artificial Sequence
  chemically synthesized
caatgtatctttattttaatat

SEQ ID NO: 27720 - DNA, 22 bp, Artificial Sequence
  chemically synthesized
aatgtatctttattttaatatt

SEQ ID NO: 27721 - DNA, 22 bp, Artificial Sequence
  chemically synthesized
tattttaatattatcatagcct

SEQ ID NO: 27722 - DNA, 22 bp, Artificial Sequence
  chemically synthesized
attttaatattatcatagcctg

SEQ ID NO: 27723 - DNA, 22 bp, Artificial Sequence
  chemically synthesized
ttttaatattatcatagcctgg

SEQ ID NO: 27724 - DNA, 22 bp, Artificial Sequence
  chemically synthesized
taatattatcatagcctggtat

SEQ ID NO: 27725 - DNA, 22 bp, Artificial Sequence
  chemically synthesized
aatattatcatagcctggtatg

SEQ ID NO: 27726 - DNA, 22 bp, Artificial Sequence
  chemically synthesized
atattatcatagcctggtatgg

SEQ ID NO: 27727 - DNA, 22 bp, Artificial Sequence
  chemically synthesized
tcatagcctggtatggtttgag

SEQ ID NO: 27728 - DNA, 22 bp, Artificial Sequence
  chemically synthesized
gtatggtttgagattttcatat

SEQ ID NO: 27729 - DNA, 22 bp, Artificial Sequence
  chemically synthesized
gagattttcatatagatggata

SEQ ID NO: 27730 - DNA, 22 bp, Artificial Sequence
  chemically synthesized
agattttcatatagatggataa

SEQ ID NO: 27731 - DNA, 22 bp, Artificial Sequence
  chemically synthesized
tcatatagatggataattattg

SEQ ID NO: 27732 - DNA, 22 bp, Artificial Sequence
  chemically synthesized
catatagatggataattattgt

SEQ ID NO: 27733 - DNA, 22 bp, Artificial Sequence
  chemically synthesized
atatagatggataattattgtg

SEQ ID NO: 27734 - DNA, 22 bp, Artificial Sequence
  chemically synthesized
ttgtgtttattcctaataatac

SEQ ID NO: 27735 - DNA, 22 bp, Artificial Sequence
  chemically synthesized
tgtttattcctaataatacatt

SEQ ID NO: 27736 - DNA, 22 bp, Artificial Sequence
  chemically synthesized
attcctaataatacattgccac

SEQ ID NO: 27737 - DNA, 22 bp, Artificial Sequence
  chemically synthesized
ttcctaataatacattgccact

SEQ ID NO: 27738 - DNA, 22 bp, Artificial Sequence
  chemically synthesized
ctaataatacattgccactata

SEQ ID NO: 27739 - DNA, 22 bp, Artificial Sequence
  chemically synthesized
ataatacattgccactatagtt

SEQ ID NO: 27740 - DNA, 22 bp, Artificial Sequence
  chemically synthesized
ccactatagtttctttaaattt

SEQ ID NO: 27741 - DNA, 22 bp, Artificial Sequence
  chemically synthesized
tagtttctttaaatttaatgat

SEQ ID NO: 27742 - DNA, 22 bp, Artificial Sequence
  chemically synthesized
ctttaaatttaatgatttgaat

SEQ ID NO: 27743 - DNA, 22 bp, Artificial Sequence
  chemically synthesized
tttaaatttaatgatttgaatt

SEQ ID NO: 27744 - DNA, 22 bp, Artificial Sequence
  chemically synthesized
taaatttaatgatttgaatttt

SEQ ID NO: 27745 - DNA, 22 bp, Artificial Sequence
  chemically synthesized
aaatttaatgatttgaattttt

SEQ ID NO: 27746 - DNA, 22 bp, Artificial Sequence
  chemically synthesized
aatttaatgatttgaattttta

SEQ ID NO: 27747 - DNA, 22 bp, Artificial Sequence
  chemically synthesized
aatgatttgaatttttacttcc

SEQ ID NO: 27748 - DNA, 22 bp, Artificial Sequence
  chemically synthesized
atgatttgaatttttacttccc

SEQ ID NO: 27749 - DNA, 22 bp, Artificial Sequence
  chemically synthesized
gaatttttacttccctgcattt

SEQ ID NO: 27750 - DNA, 22 bp, Artificial Sequence
  chemically synthesized
aatttttacttccctgcatttc

SEQ ID NO: 27751 - DNA, 22 bp, Artificial Sequence
  chemically synthesized
ttacttccctgcatttcatagt

SEQ ID NO: 27752 - DNA, 22 bp, Artificial Sequence
  chemically synthesized
tacttccctgcatttcatagta

SEQ ID NO: 27753 - DNA, 22 bp, Artificial Sequence
  chemically synthesized
acttccctgcatttcatagtag

SEQ ID NO: 27754 - DNA, 22 bp, Artificial Sequence
  chemically synthesized
cttccctgcatttcatagtagt

SEQ ID NO: 27755 - DNA, 22 bp, Artificial Sequence
  chemically synthesized
ccctgcatttcatagtagtgat

SEQ ID NO: 27756 - DNA, 22 bp, Artificial Sequence
  chemically synthesized
cctgcatttcatagtagtgata

SEQ ID NO: 27757 - DNA, 22 bp, Artificial Sequence
  chemically synthesized
catttcatagtagtgatatgag

SEQ ID NO: 27758 - DNA, 22 bp, Artificial Sequence
  chemically synthesized
catagtagtgatatgaggtatc

SEQ ID NO: 27759 - DNA, 22 bp, Artificial Sequence
  chemically synthesized
atagtagtgatatgaggtatct

SEQ ID NO: 27760 - DNA, 22 bp, Artificial Sequence
  chemically synthesized
agagatcatgaatcccactcct

SEQ ID NO: 27761 - DNA, 22 bp, Artificial Sequence
  chemically synthesized
gagatcatgaatcccactcctc

SEQ ID NO: 27762 - DNA, 22 bp, Artificial Sequence
  chemically synthesized
ctccagttcatagagcaaattg

SEQ ID NO: 27763 - DNA, 22 bp, Artificial Sequence
  chemically synthesized
cagttcatagagcaaattgatt

SEQ ID NO: 27764 - DNA, 22 bp, Artificial Sequence
  chemically synthesized
atagagcaaattgattcgtaga

SEQ ID NO: 27765 - DNA, 22 bp, Artificial Sequence
  chemically synthesized
attcgtagaggtatttaatgat

SEQ ID NO: 27766 - DNA, 22 bp, Artificial Sequence
  chemically synthesized
gtagaggtatttaatgatcaag

SEQ ID NO: 27767 - DNA, 22 bp, Artificial Sequence
  chemically synthesized
aatgatcaagcaaatggcagag

SEQ ID NO: 27768 - DNA, 22 bp, Artificial Sequence
  chemically synthesized
atgatcaagcaaatggcagagt

SEQ ID NO: 27769 - DNA, 22 bp, Artificial Sequence
  chemically synthesized
ggaccaggatttaggtcttttc

SEQ ID NO: 27770 - DNA, 22 bp, Artificial Sequence
  chemically synthesized
aggtcttttccaaggccaattc

SEQ ID NO: 27771 - DNA, 22 bp, Artificial Sequence
  chemically synthesized
ggtcttttccaaggccaattca

SEQ ID NO: 27772 - DNA, 22 bp, Artificial Sequence
  chemically synthesized
ttccaaggccaattcacttttt

SEQ ID NO: 27773 - DNA, 22 bp, Artificial Sequence
  chemically synthesized
tccaaggccaattcactttttt

SEQ ID NO: 27774 - DNA, 22 bp, Artificial Sequence
  chemically synthesized
ccaaggccaattcactttttta

SEQ ID NO: 27775 - DNA, 22 bp, Artificial Sequence
  chemically synthesized
caaggccaattcacttttttac

SEQ ID NO: 27776 - DNA, 22 bp, Artificial Sequence
  chemically synthesized
acttttttactattatgtaaga

SEQ ID NO: 27777 - DNA, 22 bp, Artificial Sequence
  chemically synthesized
ttttactattatgtaagaatta

SEQ ID NO: 27778 - DNA, 22 bp, Artificial Sequence
  chemically synthesized
tttactattatgtaagaattaa

SEQ ID NO: 27779 - DNA, 22 bp, Artificial Sequence
  chemically synthesized
ttactattatgtaagaattaaa

SEQ ID NO: 27780 - DNA, 22 bp, Artificial Sequence
  chemically synthesized
tactattatgtaagaattaaat

SEQ ID NO: 27781 - DNA, 22 bp, Artificial Sequence
  chemically synthesized
actattatgtaagaattaaata

SEQ ID NO: 27782 - DNA, 22 bp, Artificial Sequence
  chemically synthesized
ctattatgtaagaattaaatat

SEQ ID NO: 27783 - DNA, 22 bp, Artificial Sequence
  chemically synthesized
ttatgtaagaattaaatattaa

SEQ ID NO: 27784 - DNA, 22 bp, Artificial Sequence
  chemically synthesized
tgtaagaattaaatattaaaac

SEQ ID NO: 27785 - DNA, 22 bp, Artificial Sequence
  chemically synthesized
aatattaaaacctcagttttca

SEQ ID NO: 27786 - DNA, 22 bp, Artificial Sequence
  chemically synthesized
aaacctcagttttcaaaggaaa

SEQ ID NO: 27787 - DNA, 22 bp, Artificial Sequence
  chemically synthesized
agttttcaaaggaaatgtccta

SEQ ID NO: 27788 - DNA, 22 bp, Artificial Sequence
  chemically synthesized
tcaaaggaaatgtcctatagat

SEQ ID NO: 27789 - DNA, 22 bp, Artificial Sequence
  chemically synthesized
caaaggaaatgtcctatagatg

SEQ ID NO: 27790 - DNA, 22 bp, Artificial Sequence
  chemically synthesized
aaaggaaatgtcctatagatga

SEQ ID NO: 27791 - DNA, 22 bp, Artificial Sequence
  chemically synthesized
tagatgaaagaacacagtactt

SEQ ID NO: 27792 - DNA, 22 bp, Artificial Sequence
  chemically synthesized
gcagtcaaaggtcttggatttc

SEQ ID NO: 27793 - DNA, 22 bp, Artificial Sequence
  chemically synthesized
cagtcaaaggtcttggatttct

SEQ ID NO: 27794 - DNA, 22 bp, Artificial Sequence
  chemically synthesized
ggatttctgaaactttctgaaa

SEQ ID NO: 27795 - DNA, 22 bp, Artificial Sequence
  chemically synthesized
gatttctgaaactttctgaaaa

SEQ ID NO: 27796 - DNA, 22 bp, Artificial Sequence
  chemically synthesized
ctgaaactttctgaaaaagaac

SEQ ID NO: 27797 - DNA, 22 bp, Artificial Sequence
  chemically synthesized
tgaaactttctgaaaaagaacc

SEQ ID NO: 27798 - DNA, 22 bp, Artificial Sequence
  chemically synthesized
aaactttctgaaaaagaacccc

SEQ ID NO: 27799 - DNA, 22 bp, Artificial Sequence
  chemically synthesized
tctgaaaaagaaccccttaaac

SEQ ID NO: 27800 - DNA, 22 bp, Artificial Sequence
  chemically synthesized
ctgaaaaagaaccccttaaact

SEQ ID NO: 27801 - DNA, 22 bp, Artificial Sequence
  chemically synthesized
tgaaaaagaaccccttaaactg

SEQ ID NO: 27802 - DNA, 22 bp, Artificial Sequence
  chemically synthesized
aaaaagaaccccttaaactgaa

SEQ ID NO: 27803 - DNA, 22 bp, Artificial Sequence
  chemically synthesized
aaactgaataacagtttcttca

SEQ ID NO: 27804 - DNA, 22 bp, Artificial Sequence
  chemically synthesized
aactgaataacagtttcttcat

SEQ ID NO: 27805 - DNA, 22 bp, Artificial Sequence
  chemically synthesized
aataacagtttcttcatgaata

SEQ ID NO: 27806 - DNA, 22 bp, Artificial Sequence
  chemically synthesized
cttcatgaataaaatgaatgtt

SEQ ID NO: 27807 - DNA, 22 bp, Artificial Sequence
  chemically synthesized
ttcatgaataaaatgaatgtta

SEQ ID NO: 27808 - DNA, 22 bp, Artificial Sequence
  chemically synthesized
catgaataaaatgaatgttata

SEQ ID NO: 27809 - DNA, 22 bp, Artificial Sequence
  chemically synthesized
atgaataaaatgaatgttatac

SEQ ID NO: 27810 - DNA, 22 bp, Artificial Sequence
  chemically synthesized
tactctccagttatcttaccat

SEQ ID NO: 27811 - DNA, 22 bp, Artificial Sequence
  chemically synthesized
tccagttatcttaccatgtttt

SEQ ID NO: 27812 - DNA, 22 bp, Artificial Sequence
  chemically synthesized
cagttatcttaccatgttttct

SEQ ID NO: 27813 - DNA, 22 bp, Artificial Sequence
  chemically synthesized
tcttaccatgttttctggcaaa

SEQ ID NO: 27814 - DNA, 22 bp, Artificial Sequence
  chemically synthesized
accatgttttctggcaaacaag

SEQ ID NO: 27815 - DNA, 22 bp, Artificial Sequence
  chemically synthesized
ccatgttttctggcaaacaagg

SEQ ID NO: 27816 - DNA, 22 bp, Artificial Sequence
  chemically synthesized
tctggcaaacaaggaaatgtat

SEQ ID NO: 27817 - DNA, 22 bp, Artificial Sequence
  chemically synthesized
ctggcaaacaaggaaatgtatt

SEQ ID NO: 27818 - DNA, 22 bp, Artificial Sequence
  chemically synthesized
tggcaaacaaggaaatgtattc

SEQ ID NO: 27819 - DNA, 22 bp, Artificial Sequence
  chemically synthesized
gcaaacaaggaaatgtattcac

SEQ ID NO: 27820 - DNA, 22 bp, Artificial Sequence
  chemically synthesized
acatccaagaaaacaaaaggtt

SEQ ID NO: 27821 - DNA, 22 bp, Artificial Sequence
  chemically synthesized
cttaggagaagaatcccttgct

SEQ ID NO: 27822 - DNA, 22 bp, Artificial Sequence
  chemically synthesized
ttaggagaagaatcccttgctg

SEQ ID NO: 27823 - DNA, 22 bp, Artificial Sequence
  chemically synthesized
aggagaagaatcccttgctgcc

SEQ ID NO: 27824 - DNA, 22 bp, Artificial Sequence
  chemically synthesized
ggagaagaatcccttgctgcca

SEQ ID NO: 27825 - DNA, 22 bp, Artificial Sequence
  chemically synthesized
gctgccagaattttgcccatga

SEQ ID NO: 27826 - DNA, 22 bp, Artificial Sequence
  chemically synthesized
ctgccagaattttgcccatgaa

SEQ ID NO: 27827 - DNA, 22 bp, Artificial Sequence
  chemically synthesized
ccagaattttgcccatgaacaa

SEQ ID NO: 27828 - DNA, 22 bp, Artificial Sequence
  chemically synthesized
tgcccatgaacaatggaaacgt

SEQ ID NO: 27829 - DNA, 22 bp, Artificial Sequence
  chemically synthesized
gcccatgaacaatggaaacgtg

SEQ ID NO: 27830 - DNA, 22 bp, Artificial Sequence
  chemically synthesized
cccatgaacaatggaaacgtga

SEQ ID NO: 27831 - DNA, 22 bp, Artificial Sequence
  chemically synthesized
gttttgggtactaattctcaga

SEQ ID NO: 27832 - DNA, 22 bp, Artificial Sequence
  chemically synthesized
tgggtactaattctcagacttc

SEQ ID NO: 27833 - DNA, 22 bp, Artificial Sequence
  chemically synthesized
gggtactaattctcagacttca

SEQ ID NO: 27834 - DNA, 22 bp, Artificial Sequence
  chemically synthesized
ggtactaattctcagacttcaa

SEQ ID NO: 27835 - DNA, 22 bp, Artificial Sequence
  chemically synthesized
attctcagacttcaaaataacc

SEQ ID NO: 27836 - DNA, 22 bp, Artificial Sequence
  chemically synthesized
tcagacttcaaaataacctttt

SEQ ID NO: 27837 - DNA, 22 bp, Artificial Sequence
  chemically synthesized
agacttcaaaataaccttttta

SEQ ID NO: 27838 - DNA, 22 bp, Artificial Sequence
  chemically synthesized
caaaataacctttttaatttat

SEQ ID NO: 27839 - DNA, 22 bp, Artificial Sequence
  chemically synthesized
aaaataacctttttaatttatt

SEQ ID NO: 27840 - DNA, 22 bp, Artificial Sequence
  chemically synthesized
tttaatttattaatattaacct

SEQ ID NO: 27841 - DNA, 22 bp, Artificial Sequence
  chemically synthesized
ttaatttattaatattaacctt

SEQ ID NO: 27842 - DNA, 22 bp, Artificial Sequence
  chemically synthesized
taatttattaatattaaccttg

SEQ ID NO: 27843 - DNA, 22 bp, Artificial Sequence
  chemically synthesized
aatttattaatattaaccttga

SEQ ID NO: 27844 - DNA, 22 bp, Artificial Sequence
  chemically synthesized
atttattaatattaaccttgaa

SEQ ID NO: 27845 - DNA, 22 bp, Artificial Sequence
  chemically synthesized
attaatattaaccttgaaattt

SEQ ID NO: 27846 - DNA, 22 bp, Artificial Sequence
  chemically synthesized
ttaatattaaccttgaaattta

SEQ ID NO: 27847 - DNA, 22 bp, Artificial Sequence
  chemically synthesized
atattaaccttgaaatttattg

SEQ ID NO: 27848 - DNA, 22 bp, Artificial Sequence
  chemically synthesized
accttgaaatttattgctttta

SEQ ID NO: 27849 - DNA, 22 bp, Artificial Sequence
  chemically synthesized
gaaatttattgcttttattcat

SEQ ID NO: 27850 - DNA, 22 bp, Artificial Sequence
  chemically synthesized
aaatttattgcttttattcatt

SEQ ID NO: 27851 - DNA, 22 bp, Artificial Sequence
  chemically synthesized
attgcttttattcattaatcca

SEQ ID NO: 27852 - DNA, 22 bp, Artificial Sequence
  chemically synthesized
ttgcttttattcattaatccat

SEQ ID NO: 27853 - DNA, 22 bp, Artificial Sequence
  chemically synthesized
cttttattcattaatccatttt

SEQ ID NO: 27854 - DNA, 22 bp, Artificial Sequence
  chemically synthesized
ttattcattaatccattttatt

SEQ ID NO: 27855 - DNA, 22 bp, Artificial Sequence
  chemically synthesized
tattcattaatccattttatta

SEQ ID NO: 27856 - DNA, 22 bp, Artificial Sequence
  chemically synthesized
attcattaatccattttattat

SEQ ID NO: 27857 - DNA, 22 bp, Artificial Sequence
  chemically synthesized
ttcattaatccattttattatt

SEQ ID NO: 27858 - DNA, 22 bp, Artificial Sequence
  chemically synthesized
attaatccattttattattcag

SEQ ID NO: 27859 - DNA, 22 bp, Artificial Sequence
  chemically synthesized
atccattttattattcagtaag

SEQ ID NO: 27860 - DNA, 22 bp, Artificial Sequence
  chemically synthesized
tattattcagtaaggattcatc

SEQ ID NO: 27861 - DNA, 22 bp, Artificial Sequence
  chemically synthesized
attattcagtaaggattcatca

SEQ ID NO: 27862 - DNA, 22 bp, Artificial Sequence
  chemically synthesized
ttattcagtaaggattcatcaa

SEQ ID NO: 27863 - DNA, 22 bp, Artificial Sequence
  chemically synthesized
ttcagtaaggattcatcaagtg

SEQ ID NO: 27864 - DNA, 22 bp, Artificial Sequence
  chemically synthesized
agtaaggattcatcaagtgtct

SEQ ID NO: 27865 - DNA, 22 bp, Artificial Sequence
  chemically synthesized
atcaagtgtctattaggtatca

SEQ ID NO: 27866 - DNA, 22 bp, Artificial Sequence
  chemically synthesized
ttaggtatcaggcactgagagg

SEQ ID NO: 27867 - DNA, 22 bp, Artificial Sequence
  chemically synthesized
ggtatcaggcactgagaggcga

SEQ ID NO: 27868 - DNA, 22 bp, Artificial Sequence
  chemically synthesized
agaggcgagggagatagagtta

SEQ ID NO: 27869 - DNA, 22 bp, Artificial Sequence
  chemically synthesized
agaatacagaactgattcttaa

SEQ ID NO: 27870 - DNA, 22 bp, Artificial Sequence
  chemically synthesized
attcttaatcttcaagaattga

SEQ ID NO: 27871 - DNA, 22 bp, Artificial Sequence
  chemically synthesized
ttaatcttcaagaattgacaaa

SEQ ID NO: 27872 - DNA, 22 bp, Artificial Sequence
  chemically synthesized
aatcttcaagaattgacaaatt

SEQ ID NO: 27873 - DNA, 22 bp, Artificial Sequence
  chemically synthesized
atcttcaagaattgacaaattt

SEQ ID NO: 27874 - DNA, 22 bp, Artificial Sequence
  chemically synthesized
caagaattgacaaatttgtaga

SEQ ID NO: 27875 - DNA, 22 bp, Artificial Sequence
  chemically synthesized
aagaattgacaaatttgtagaa

SEQ ID NO: 27876 - DNA, 22 bp, Artificial Sequence
  chemically synthesized
acaaatttgtagaaggtagaca

SEQ ID NO: 27877 - DNA, 22 bp, Artificial Sequence
  chemically synthesized
gtagaaggtagacattgaacat

SEQ ID NO: 27878 - DNA, 22 bp, Artificial Sequence
  chemically synthesized
tagaaggtagacattgaacata

SEQ ID NO: 27879 - DNA, 22 bp, Artificial Sequence
  chemically synthesized
aacatacaatacagtcaaatgt

SEQ ID NO: 27880 - DNA, 22 bp, Artificial Sequence
  chemically synthesized
agggaaccaggtgtcctaagac

SEQ ID NO: 27881 - DNA, 22 bp, Artificial Sequence
  chemically synthesized
agactatacagtgtaccgtgga

SEQ ID NO: 27882 - DNA, 22 bp, Artificial Sequence
  chemically synthesized
tacagtgtaccgtggaatgggg

SEQ ID NO: 27883 - DNA, 22 bp, Artificial Sequence
  chemically synthesized
ctaacctagttacctagaggtt

SEQ ID NO: 27884 - DNA, 22 bp, Artificial Sequence
  chemically synthesized
taacctagttacctagaggttt

SEQ ID NO: 27885 - DNA, 22 bp, Artificial Sequence
  chemically synthesized
acctagttacctagaggtttgg

SEQ ID NO: 27886 - DNA, 22 bp, Artificial Sequence
  chemically synthesized
gttacctagaggtttgggaaaa

SEQ ID NO: 27887 - DNA, 22 bp, Artificial Sequence
  chemically synthesized
cctagaggtttgggaaaaacct

SEQ ID NO: 27888 - DNA, 22 bp, Artificial Sequence
  chemically synthesized
gaggtttgggaaaaacctctct

SEQ ID NO: 27889 - DNA, 22 bp, Artificial Sequence
  chemically synthesized
gggaaaaacctctctaatgatg

SEQ ID NO: 27890 - DNA, 22 bp, Artificial Sequence
  chemically synthesized
ggaaaaacctctctaatgatga

SEQ ID NO: 27891 - DNA, 22 bp, Artificial Sequence
  chemically synthesized
tctaatgatgagatgtttgagc

SEQ ID NO: 27892 - DNA, 22 bp, Artificial Sequence
  chemically synthesized
taatgatgagatgtttgagctg

SEQ ID NO: 27893 - DNA, 22 bp, Artificial Sequence
  chemically synthesized
atgatgagatgtttgagctgac

SEQ ID NO: 27894 - DNA, 22 bp, Artificial Sequence
  chemically synthesized
gagctgacacttgaaggataaa

SEQ ID NO: 27895 - DNA, 22 bp, Artificial Sequence
  chemically synthesized
agctgacacttgaaggataaat

SEQ ID NO: 27896 - DNA, 22 bp, Artificial Sequence
  chemically synthesized
acacttgaaggataaatagcta

SEQ ID NO: 27897 - DNA, 22 bp, Artificial Sequence
  chemically synthesized
gaaggataaatagctaaagggg

SEQ ID NO: 27898 - DNA, 22 bp, Artificial Sequence
  chemically synthesized
aaggataaatagctaaagggga

SEQ ID NO: 27899 - DNA, 22 bp, Artificial Sequence
  chemically synthesized
aaggggagaaagcgttctatgt

SEQ ID NO: 27900 - DNA, 22 bp, Artificial Sequence
  chemically synthesized
tatgtgagagaactatatatgc

SEQ ID NO: 27901 - DNA, 22 bp, Artificial Sequence
  chemically synthesized
tgtgagagaactatatatgcca

SEQ ID NO: 27902 - DNA, 22 bp, Artificial Sequence
  chemically synthesized
tatatgccaagatgcagaagtg

SEQ ID NO: 27903 - DNA, 22 bp, Artificial Sequence
  chemically synthesized
tctgttcgaagatctgagcggg

SEQ ID NO: 27904 - DNA, 22 bp, Artificial Sequence
  chemically synthesized
tgttcgaagatctgagcggggc

SEQ ID NO: 27905 - DNA, 22 bp, Artificial Sequence
  chemically synthesized
ttcgaagatctgagcggggctc

SEQ ID NO: 27906 - DNA, 22 bp, Artificial Sequence
  chemically synthesized
gaagatctgagcggggctcaga

SEQ ID NO: 27907 - DNA, 22 bp, Artificial Sequence
  chemically synthesized
agcggggctcagagagggaaaa

SEQ ID NO: 27908 - DNA, 22 bp, Artificial Sequence
  chemically synthesized
agagagggaaaaggagaggagt

SEQ ID NO: 27909 - DNA, 22 bp, Artificial Sequence
  chemically synthesized
cagggactagattgtgaagctc

SEQ ID NO: 27910 - DNA, 22 bp, Artificial Sequence
  chemically synthesized
gattgtgaagctcagggggagt

SEQ ID NO: 27911 - DNA, 22 bp, Artificial Sequence
  chemically synthesized
tgaagctcagggggagttaata

SEQ ID NO: 27912 - DNA, 22 bp, Artificial Sequence
  chemically synthesized
agggggagttaatagccttaag

SEQ ID NO: 27913 - DNA, 22 bp, Artificial Sequence
  chemically synthesized
atagccttaaggagttttgtct

SEQ ID NO: 27914 - DNA, 22 bp, Artificial Sequence
  chemically synthesized
aaggagttttgtctccagggta

SEQ ID NO: 27915 - DNA, 22 bp, Artificial Sequence
  chemically synthesized
aggagttttgtctccagggtat

SEQ ID NO: 27916 - DNA, 22 bp, Artificial Sequence
  chemically synthesized
tgtctccagggtatgaacaatg

SEQ ID NO: 27917 - DNA, 22 bp, Artificial Sequence
  chemically synthesized
gtctccagggtatgaacaatga

SEQ ID NO: 27918 - DNA, 22 bp, Artificial Sequence
  chemically synthesized
tctccagggtatgaacaatgaa

SEQ ID NO: 27919 - DNA, 22 bp, Artificial Sequence
  chemically synthesized
cagggtatgaacaatgaatgag

SEQ ID NO: 27920 - DNA, 22 bp, Artificial Sequence
  chemically synthesized
aaattctatccacagtagtggg

SEQ ID NO: 27921 - DNA, 22 bp, Artificial Sequence
  chemically synthesized
tatccacagtagtgggaagtac

SEQ ID NO: 27922 - DNA, 22 bp, Artificial Sequence
  chemically synthesized
tccacagtagtgggaagtacta

SEQ ID NO: 27923 - DNA, 22 bp, Artificial Sequence
  chemically synthesized
agtagtcaggtatgttttggaa

SEQ ID NO: 27924 - DNA, 22 bp, Artificial Sequence
  chemically synthesized
tggaagaagcactgttaccagt

SEQ ID NO: 27925 - DNA, 22 bp, Artificial Sequence
  chemically synthesized
ggaagaagcactgttaccagtt

SEQ ID NO: 27926 - DNA, 22 bp, Artificial Sequence
  chemically synthesized
gaagaagcactgttaccagttg

SEQ ID NO: 27927 - DNA, 22 bp, Artificial Sequence
  chemically synthesized
ttaccagttgagggagaggaga

SEQ ID NO: 27928 - DNA, 22 bp, Artificial Sequence
  chemically synthesized
ccagttgagggagaggagagga

SEQ ID NO: 27929 - DNA, 22 bp, Artificial Sequence
  chemically synthesized
agggagaggagaggagggaaat

SEQ ID NO: 27930 - DNA, 22 bp, Artificial Sequence
  chemically synthesized
gactgtggtgtgacccaggatg

SEQ ID NO: 27931 - DNA, 22 bp, Artificial Sequence
  chemically synthesized
tggtgtgacccaggatggaaag

SEQ ID NO: 27932 - DNA, 22 bp, Artificial Sequence
  chemically synthesized
tgcccaaatgtgggggaaaaat

SEQ ID NO: 27933 - DNA, 22 bp, Artificial Sequence
  chemically synthesized
gcccaaatgtgggggaaaaatg

SEQ ID NO: 27934 - DNA, 22 bp, Artificial Sequence
  chemically synthesized
cccaaatgtgggggaaaaatgt

SEQ ID NO: 27935 - DNA, 22 bp, Artificial Sequence
  chemically synthesized
actctctcctttgcccaggtct

SEQ ID NO: 27936 - DNA, 22 bp, Artificial Sequence
  chemically synthesized
ctctctcctttgcccaggtctt

SEQ ID NO: 27937 - DNA, 22 bp, Artificial Sequence
  chemically synthesized
tctcctttgcccaggtcttact

SEQ ID NO: 27938 - DNA, 22 bp, Artificial Sequence
  chemically synthesized
tcctttgcccaggtcttactac

SEQ ID NO: 27939 - DNA, 22 bp, Artificial Sequence
  chemically synthesized
ctttgcccaggtcttactacaa

SEQ ID NO: 27940 - DNA, 22 bp, Artificial Sequence
  chemically synthesized
tgcccaggtcttactacaatca

SEQ ID NO: 27941 - DNA, 22 bp, Artificial Sequence
  chemically synthesized
gcccaggtcttactacaatcat

SEQ ID NO: 27942 - DNA, 22 bp, Artificial Sequence
  chemically synthesized
cccaggtcttactacaatcatt

SEQ ID NO: 27943 - DNA, 22 bp, Artificial Sequence
  chemically synthesized
actacaatcatttcttctgcac

SEQ ID NO: 27944 - DNA, 22 bp, Artificial Sequence
  chemically synthesized
ctacaatcatttcttctgcaca

SEQ ID NO: 27945 - DNA, 22 bp, Artificial Sequence
  chemically synthesized
caatcatttcttctgcacacac

SEQ ID NO: 27946 - DNA, 22 bp, Artificial Sequence
  chemically synthesized
cttctgcacacacttgctcaga

SEQ ID NO: 27947 - DNA, 22 bp, Artificial Sequence
  chemically synthesized
ttctgcacacacttgctcagaa

SEQ ID NO: 27948 - DNA, 22 bp, Artificial Sequence
  chemically synthesized
ctgcacacacttgctcagaaca

SEQ ID NO: 27949 - DNA, 22 bp, Artificial Sequence
  chemically synthesized
tgcacacacttgctcagaacat

SEQ ID NO: 27950 - DNA, 22 bp, Artificial Sequence
  chemically synthesized
cacacacttgctcagaacatta

SEQ ID NO: 27951 - DNA, 22 bp, Artificial Sequence
  chemically synthesized
gctcagaacattacaaactctg

SEQ ID NO: 27952 - DNA, 22 bp, Artificial Sequence
  chemically synthesized
ctcagaacattacaaactctgg

SEQ ID NO: 27953 - DNA, 22 bp, Artificial Sequence
  chemically synthesized
agaacattacaaactctggaga

SEQ ID NO: 27954 - DNA, 22 bp, Artificial Sequence
  chemically synthesized
caaactctggagaaattaacat

SEQ ID NO: 27955 - DNA, 22 bp, Artificial Sequence
  chemically synthesized
tggagaaattaacatgttaagg

SEQ ID NO: 27956 - DNA, 22 bp, Artificial Sequence
  chemically synthesized
gagaaattaacatgttaaggat

SEQ ID NO: 27957 - DNA, 22 bp, Artificial Sequence
  chemically synthesized
acatgttaaggatatttaggat

SEQ ID NO: 27958 - DNA, 22 bp, Artificial Sequence
  chemically synthesized
aggatatttaggatcattaaaa

SEQ ID NO: 27959 - DNA, 22 bp, Artificial Sequence
  chemically synthesized
aggatcattaaaaaagtttaat

SEQ ID NO: 27960 - DNA, 22 bp, Artificial Sequence
  chemically synthesized
ggatcattaaaaaagtttaata

SEQ ID NO: 27961 - DNA, 22 bp, Artificial Sequence
  chemically synthesized
aaaaagtttaataaatgttgtc

SEQ ID NO: 27962 - DNA, 22 bp, Artificial Sequence
  chemically synthesized
aataaatgttgtcacacataat

SEQ ID NO: 27963 - DNA, 22 bp, Artificial Sequence
  chemically synthesized
ataaatgttgtcacacataatg

SEQ ID NO: 27964 - DNA, 22 bp, Artificial Sequence
  chemically synthesized
tcacacataatgaaagttaatt

SEQ ID NO: 27965 - DNA, 22 bp, Artificial Sequence
  chemically synthesized
atttaagaattgtaaagacttg

SEQ ID NO: 27966 - DNA, 22 bp, Artificial Sequence
  chemically synthesized
aagaattgtaaagacttgagcg

SEQ ID NO: 27967 - DNA, 22 bp, Artificial Sequence
  chemically synthesized
agaattgtaaagacttgagcga

SEQ ID NO: 27968 - DNA, 22 bp, Artificial Sequence
  chemically synthesized
taaagacttgagcgatgtagtc

SEQ ID NO: 27969 - DNA, 22 bp, Artificial Sequence
  chemically synthesized
gagcgatgtagtccctaaataa

SEQ ID NO: 27970 - DNA, 22 bp, Artificial Sequence
  chemically synthesized
agcgatgtagtccctaaataaa

SEQ ID NO: 27971 - DNA, 22 bp, Artificial Sequence
  chemically synthesized
aataaatgcttccctcttaaaa

SEQ ID NO: 27972 - DNA, 22 bp, Artificial Sequence
  chemically synthesized
ccctcttaaaatggactagaaa

SEQ ID NO: 27973 - DNA, 22 bp, Artificial Sequence
  chemically synthesized
cctcttaaaatggactagaaac

SEQ ID NO: 27974 - DNA, 22 bp, Artificial Sequence
  chemically synthesized
ttaaaatggactagaaacaatt

SEQ ID NO: 27975 - DNA, 22 bp, Artificial Sequence
  chemically synthesized
aaaatggactagaaacaatttg

SEQ ID NO: 27976 - DNA, 22 bp, Artificial Sequence
  chemically synthesized
aaatggactagaaacaatttgt

SEQ ID NO: 27977 - DNA, 22 bp, Artificial Sequence
  chemically synthesized
gaaacaatttgtttttgcctaa

SEQ ID NO: 27978 - DNA, 22 bp, Artificial Sequence
  chemically synthesized
gtttttgcctaagccaacgtat

SEQ ID NO: 27979 - DNA, 22 bp, Artificial Sequence
  chemically synthesized
tttttgcctaagccaacgtatt

SEQ ID NO: 27980 - DNA, 22 bp, Artificial Sequence
  chemically synthesized
ttgcctaagccaacgtattgct

SEQ ID NO: 27981 - DNA, 22 bp, Artificial Sequence
  chemically synthesized
tgcctaagccaacgtattgctg

SEQ ID NO: 27982 - DNA, 22 bp, Artificial Sequence
  chemically synthesized
gcctaagccaacgtattgctgg

SEQ ID NO: 27983 - DNA, 22 bp, Artificial Sequence
  chemically synthesized
cctaagccaacgtattgctgga

SEQ ID NO: 27984 - DNA, 22 bp, Artificial Sequence
  chemically synthesized
agccaacgtattgctggacata

SEQ ID NO: 27985 - DNA, 22 bp, Artificial Sequence
  chemically synthesized
ctggacataatttacctgcttc

SEQ ID NO: 27986 - DNA, 22 bp, Artificial Sequence
  chemically synthesized
gacataatttacctgcttcctc

SEQ ID NO: 27987 - DNA, 22 bp, Artificial Sequence
  chemically synthesized
acctgcttcctcctcagtcttg

SEQ ID NO: 27988 - DNA, 22 bp, Artificial Sequence
  chemically synthesized
cctgcttcctcctcagtcttga

SEQ ID NO: 27989 - DNA, 22 bp, Artificial Sequence
  chemically synthesized
cttcctcctcagtcttgacact

SEQ ID NO: 27990 - DNA, 22 bp, Artificial Sequence
  chemically synthesized
cctcctcagtcttgacactaca

SEQ ID NO: 27991 - DNA, 22 bp, Artificial Sequence
  chemically synthesized
ctcctcagtcttgacactacac

SEQ ID NO: 27992 - DNA, 22 bp, Artificial Sequence
  chemically synthesized
ctcagtcttgacactacacctc

SEQ ID NO: 27993 - DNA, 22 bp, Artificial Sequence
  chemically synthesized
agtcttgacactacacctctga

SEQ ID NO: 27994 - DNA, 22 bp, Artificial Sequence
  chemically synthesized
gacactacacctctgaattaca

SEQ ID NO: 27995 - DNA, 22 bp, Artificial Sequence
  chemically synthesized
acactacacctctgaattacat

SEQ ID NO: 27996 - DNA, 22 bp, Artificial Sequence
  chemically synthesized
cacctctgaattacatggtaca

SEQ ID NO: 27997 - DNA, 22 bp, Artificial Sequence
  chemically synthesized
tgaattacatggtacaagtggc

SEQ ID NO: 27998 - DNA, 22 bp, Artificial Sequence
  chemically synthesized
aattacatggtacaagtggcac

SEQ ID NO: 27999 - DNA, 22 bp, Artificial Sequence
  chemically synthesized
catggtacaagtggcacaggga

SEQ ID NO: 28000 - DNA, 22 bp, Artificial Sequence
  chemically synthesized
agaaaactagagtcaaagtggt

SEQ ID NO: 28001 - DNA, 22 bp, Artificial Sequence
  chemically synthesized
gagtcaaagtggttatggaaga

SEQ ID NO: 28002 - DNA, 22 bp, Artificial Sequence
  chemically synthesized
tggaagaaattataataatgag

SEQ ID NO: 28003 - DNA, 22 bp, Artificial Sequence
  chemically synthesized
taataatgagtccactcttcta

SEQ ID NO: 28004 - DNA, 22 bp, Artificial Sequence
  chemically synthesized
ttctaggacaggagttctaaag

SEQ ID NO: 28005 - DNA, 22 bp, Artificial Sequence
  chemically synthesized
ctaggacaggagttctaaaggt

SEQ ID NO: 28006 - DNA, 22 bp, Artificial Sequence
  chemically synthesized
taggacaggagttctaaaggtg

SEQ ID NO: 28007 - DNA, 22 bp, Artificial Sequence
  chemically synthesized
ggacaggagttctaaaggtgag

SEQ ID NO: 28008 - DNA, 22 bp, Artificial Sequence
  chemically synthesized
taaaggtgaggactttgatata

SEQ ID NO: 28009 - DNA, 22 bp, Artificial Sequence
  chemically synthesized
aaggtgaggactttgatataag

SEQ ID NO: 28010 - DNA, 22 bp, Artificial Sequence
  chemically synthesized
tgatataagtgaactcaaggag

SEQ ID NO: 28011 - DNA, 22 bp, Artificial Sequence
  chemically synthesized
gatataagtgaactcaaggagt

SEQ ID NO: 28012 - DNA, 22 bp, Artificial Sequence
  chemically synthesized
atataagtgaactcaaggagtt

SEQ ID NO: 28013 - DNA, 22 bp, Artificial Sequence
  chemically synthesized
aaggagtttctaaaccttcaga

SEQ ID NO: 28014 - DNA, 22 bp, Artificial Sequence
  chemically synthesized
ctaaaccttcagaaattatatc

SEQ ID NO: 28015 - DNA, 22 bp, Artificial Sequence
  chemically synthesized
taaaccttcagaaattatatct

SEQ ID NO: 28016 - DNA, 22 bp, Artificial Sequence
  chemically synthesized
aaccttcagaaattatatctaa

SEQ ID NO: 28017 - DNA, 22 bp, Artificial Sequence
  chemically synthesized
cagaaattatatctaaaaatta

SEQ ID NO: 28018 - DNA, 22 bp, Artificial Sequence
  chemically synthesized
agaaattatatctaaaaattag

SEQ ID NO: 28019 - DNA, 22 bp, Artificial Sequence
  chemically synthesized
tatctaaaaattaggtgcacgt

SEQ ID NO: 28020 - DNA, 22 bp, Artificial Sequence
  chemically synthesized
aaaattaggtgcacgtatatag

SEQ ID NO: 28021 - DNA, 22 bp, Artificial Sequence
  chemically synthesized
ggtgcacgtatatagaagtact

SEQ ID NO: 28022 - DNA, 22 bp, Artificial Sequence
  chemically synthesized
ttctctgagaagaggacttcac

SEQ ID NO: 28023 - DNA, 22 bp, Artificial Sequence
  chemically synthesized
tctctgagaagaggacttcaca

SEQ ID NO: 28024 - DNA, 22 bp, Artificial Sequence
  chemically synthesized
ctctgagaagaggacttcacac

SEQ ID NO: 28025 - DNA, 22 bp, Artificial Sequence
  chemically synthesized
tctgagaagaggacttcacact

SEQ ID NO: 28026 - DNA, 22 bp, Artificial Sequence
  chemically synthesized
tgagaagaggacttcacacttc

SEQ ID NO: 28027 - DNA, 22 bp, Artificial Sequence
  chemically synthesized
agaagaggacttcacacttcca

SEQ ID NO: 28028 - DNA, 22 bp, Artificial Sequence
  chemically synthesized
cacacttccatcagcttcctga

SEQ ID NO: 28029 - DNA, 22 bp, Artificial Sequence
  chemically synthesized
acacttccatcagcttcctgaa

SEQ ID NO: 28030 - DNA, 22 bp, Artificial Sequence
  chemically synthesized
ccatcagcttcctgaaggcccc

SEQ ID NO: 28031 - DNA, 22 bp, Artificial Sequence
  chemically synthesized
catcagcttcctgaaggcccct

SEQ ID NO: 28032 - DNA, 22 bp, Artificial Sequence
  chemically synthesized
cctgaaggcccctgtaattgcc

SEQ ID NO: 28033 - DNA, 22 bp, Artificial Sequence
  chemically synthesized
ctgaaggcccctgtaattgccg

SEQ ID NO: 28034 - DNA, 22 bp, Artificial Sequence
  chemically synthesized
aaggcccctgtaattgccgtaa

SEQ ID NO: 28035 - DNA, 22 bp, Artificial Sequence
  chemically synthesized
taattgccgtaaagaacaactg

SEQ ID NO: 28036 - DNA, 22 bp, Artificial Sequence
  chemically synthesized
ccgtaaagaacaactgctctaa

SEQ ID NO: 28037 - DNA, 22 bp, Artificial Sequence
  chemically synthesized
ctctaaagtttaatactaggct

SEQ ID NO: 28038 - DNA, 22 bp, Artificial Sequence
  chemically synthesized
taaagtttaatactaggctact

SEQ ID NO: 28039 - DNA, 22 bp, Artificial Sequence
  chemically synthesized
aagtttaatactaggctactcg

SEQ ID NO: 28040 - DNA, 22 bp, Artificial Sequence
  chemically synthesized
aatactaggctactcggctgtt

SEQ ID NO: 28041 - DNA, 22 bp, Artificial Sequence
  chemically synthesized
atactaggctactcggctgttt

SEQ ID NO: 28042 - DNA, 22 bp, Artificial Sequence
  chemically synthesized
ggctactcggctgttttttgtt

SEQ ID NO: 28043 - DNA, 22 bp, Artificial Sequence
  chemically synthesized
ctcggctgttttttgttaacac

SEQ ID NO: 28044 - DNA, 22 bp, Artificial Sequence
  chemically synthesized
ggctgttttttgttaacacaga

SEQ ID NO: 28045 - DNA, 22 bp, Artificial Sequence
  chemically synthesized
ttttttgttaacacagaagttt

SEQ ID NO: 28046 - DNA, 22 bp, Artificial Sequence
  chemically synthesized
tttgttaacacagaagttttcc

SEQ ID NO: 28047 - DNA, 22 bp, Artificial Sequence
  chemically synthesized
ttgttaacacagaagttttcca

SEQ ID NO: 28048 - DNA, 22 bp, Artificial Sequence
  chemically synthesized
tgttaacacagaagttttccaa

SEQ ID NO: 28049 - DNA, 22 bp, Artificial Sequence
  chemically synthesized
gttaacacagaagttttccaaa

SEQ ID NO: 28050 - DNA, 22 bp, Artificial Sequence
  chemically synthesized
ttaacacagaagttttccaaat

SEQ ID NO: 28051 - DNA, 22 bp, Artificial Sequence
  chemically synthesized
acacagaagttttccaaatggc

SEQ ID NO: 28052 - DNA, 22 bp, Artificial Sequence
  chemically synthesized
tccaaatggcttttctctagag

SEQ ID NO: 28053 - DNA, 22 bp, Artificial Sequence
  chemically synthesized
ccaaatggcttttctctagagc

SEQ ID NO: 28054 - DNA, 22 bp, Artificial Sequence
  chemically synthesized
caaatggcttttctctagagca

SEQ ID NO: 28055 - DNA, 22 bp, Artificial Sequence
  chemically synthesized
ttctctagagcaaaatgaaaag

SEQ ID NO: 28056 - DNA, 22 bp, Artificial Sequence
  chemically synthesized
tctctagagcaaaatgaaaagg

SEQ ID NO: 28057 - DNA, 22 bp, Artificial Sequence
  chemically synthesized
ctctagagcaaaatgaaaagga

SEQ ID NO: 28058 - DNA, 22 bp, Artificial Sequence
  chemically synthesized
tctagagcaaaatgaaaaggat

SEQ ID NO: 28059 - DNA, 22 bp, Artificial Sequence
  chemically synthesized
tagagcaaaatgaaaaggatcc

SEQ ID NO: 28060 - DNA, 22 bp, Artificial Sequence
  chemically synthesized
gagcaaaatgaaaaggatccca

SEQ ID NO: 28061 - DNA, 22 bp, Artificial Sequence
  chemically synthesized
cccgagacctaacgatgtttat

SEQ ID NO: 28062 - DNA, 22 bp, Artificial Sequence
  chemically synthesized
ccgagacctaacgatgtttatc

SEQ ID NO: 28063 - DNA, 22 bp, Artificial Sequence
  chemically synthesized
acgatgtttatctttcgtgata

SEQ ID NO: 28064 - DNA, 22 bp, Artificial Sequence
  chemically synthesized
atctttcgtgatactgtttttg

SEQ ID NO: 28065 - DNA, 22 bp, Artificial Sequence
  chemically synthesized
tctttcgtgatactgtttttgt

SEQ ID NO: 28066 - DNA, 22 bp, Artificial Sequence
  chemically synthesized
tcgtgatactgtttttgttctt

SEQ ID NO: 28067 - DNA, 22 bp, Artificial Sequence
  chemically synthesized
cgtgatactgtttttgttcttc

SEQ ID NO: 28068 - DNA, 22 bp, Artificial Sequence
  chemically synthesized
gtgatactgtttttgttcttcc

SEQ ID NO: 28069 - DNA, 22 bp, Artificial Sequence
  chemically synthesized
tttttgttcttcctctttttct

SEQ ID NO: 28070 - DNA, 22 bp, Artificial Sequence
  chemically synthesized
ttgttcttcctctttttctcct

SEQ ID NO: 28071 - DNA, 22 bp, Artificial Sequence
  chemically synthesized
tgttcttcctctttttctccta

SEQ ID NO: 28072 - DNA, 22 bp, Artificial Sequence
  chemically synthesized
gttcttcctctttttctcctac

SEQ ID NO: 28073 - DNA, 22 bp, Artificial Sequence
  chemically synthesized
ttcttcctctttttctcctacc

SEQ ID NO: 28074 - DNA, 22 bp, Artificial Sequence
  chemically synthesized
ttcctctttttctcctaccccc

SEQ ID NO: 28075 - DNA, 22 bp, Artificial Sequence
  chemically synthesized
cctctttttctcctacccccca

SEQ ID NO: 28076 - DNA, 22 bp, Artificial Sequence
  chemically synthesized
ctctttttctcctaccccccac

SEQ ID NO: 28077 - DNA, 22 bp, Artificial Sequence
  chemically synthesized
tttttctcctaccccccaccac

SEQ ID NO: 28078 - DNA, 22 bp, Artificial Sequence
  chemically synthesized
tttctcctaccccccaccactt

SEQ ID NO: 28079 - DNA, 22 bp, Artificial Sequence
  chemically synthesized
ttctcctaccccccaccacttt

SEQ ID NO: 28080 - DNA, 22 bp, Artificial Sequence
  chemically synthesized
tctcctaccccccaccactttt

SEQ ID NO: 28081 - DNA, 22 bp, Artificial Sequence
  chemically synthesized
ctcctaccccccaccactttta

SEQ ID NO: 28082 - DNA, 22 bp, Artificial Sequence
  chemically synthesized
tcctaccccccaccacttttaa

SEQ ID NO: 28083 - DNA, 22 bp, Artificial Sequence
  chemically synthesized
ctaccccccaccacttttaaag

SEQ ID NO: 28084 - DNA, 22 bp, Artificial Sequence
  chemically synthesized
ccccccaccacttttaaagatc

SEQ ID NO: 28085 - DNA, 22 bp, Artificial Sequence
  chemically synthesized
ttaaagatccatcaaggcccag

SEQ ID NO: 28086 - DNA, 22 bp, Artificial Sequence
  chemically synthesized
taaagatccatcaaggcccagc

SEQ ID NO: 28087 - DNA, 22 bp, Artificial Sequence
  chemically synthesized
aaagatccatcaaggcccagca

SEQ ID NO: 28088 - DNA, 22 bp, Artificial Sequence
  chemically synthesized
aagatccatcaaggcccagcat

SEQ ID NO: 28089 - DNA, 22 bp, Artificial Sequence
  chemically synthesized
acacctgtaatctcaacacttt

SEQ ID NO: 28090 - DNA, 22 bp, Artificial Sequence
  chemically synthesized
taatctcaacacttttcaaggc

SEQ ID NO: 28091 - DNA, 22 bp, Artificial Sequence
  chemically synthesized
aacacttttcaaggctgaggtg

SEQ ID NO: 28092 - DNA, 22 bp, Artificial Sequence
  chemically synthesized
ttcaaggctgaggtgggagaat

SEQ ID NO: 28093 - DNA, 22 bp, Artificial Sequence
  chemically synthesized
tcaaggctgaggtgggagaatt

SEQ ID NO: 28094 - DNA, 22 bp, Artificial Sequence
  chemically synthesized
caaggctgaggtgggagaattg

SEQ ID NO: 28095 - DNA, 22 bp, Artificial Sequence
  chemically synthesized
aaggctgaggtgggagaattgt

SEQ ID NO: 28096 - DNA, 22 bp, Artificial Sequence
  chemically synthesized
aggtgggagaattgtttgagac

SEQ ID NO: 28097 - DNA, 22 bp, Artificial Sequence
  chemically synthesized
tttgagaccaagagttggatac

SEQ ID NO: 28098 - DNA, 22 bp, Artificial Sequence
  chemically synthesized
gagaccaagagttggataccag

SEQ ID NO: 28099 - DNA, 22 bp, Artificial Sequence
  chemically synthesized
agaccaagagttggataccagc

SEQ ID NO: 28100 - DNA, 22 bp, Artificial Sequence
  chemically synthesized
gataccagcctggggaacatag

SEQ ID NO: 28101 - DNA, 22 bp, Artificial Sequence
  chemically synthesized
gggaacatagggagaccctgtt

SEQ ID NO: 28102 - DNA, 22 bp, Artificial Sequence
  chemically synthesized
tttctacagaaatttaaaaaat

SEQ ID NO: 28103 - DNA, 22 bp, Artificial Sequence
  chemically synthesized
ctacagaaatttaaaaaatttc

SEQ ID NO: 28104 - DNA, 22 bp, Artificial Sequence
  chemically synthesized
tacagaaatttaaaaaatttct

SEQ ID NO: 28105 - DNA, 22 bp, Artificial Sequence
  chemically synthesized
cagaaatttaaaaaatttctct

SEQ ID NO: 28106 - DNA, 22 bp, Artificial Sequence
  chemically synthesized
aaaaaatttctctagctggcca

SEQ ID NO: 28107 - DNA, 22 bp, Artificial Sequence
  chemically synthesized
aaaaatttctctagctggccat

SEQ ID NO: 28108 - DNA, 22 bp, Artificial Sequence
  chemically synthesized
ctctagctggccatggaggctc

SEQ ID NO: 28109 - DNA, 22 bp, Artificial Sequence
  chemically synthesized
tctagctggccatggaggctca

SEQ ID NO: 28110 - DNA, 22 bp, Artificial Sequence
  chemically synthesized
tagctggccatggaggctcaca

SEQ ID NO: 28111 - DNA, 22 bp, Artificial Sequence
  chemically synthesized
gctggccatggaggctcacacc

SEQ ID NO: 28112 - DNA, 22 bp, Artificial Sequence
  chemically synthesized
gccatggaggctcacacctgta

SEQ ID NO: 28113 - DNA, 22 bp, Artificial Sequence
  chemically synthesized
acacctgtagtcctagctacct

SEQ ID NO: 28114 - DNA, 22 bp, Artificial Sequence
  chemically synthesized
tagtcctagctacctgagaggc

SEQ ID NO: 28115 - DNA, 22 bp, Artificial Sequence
  chemically synthesized
gctacctgagaggctaaagcag

SEQ ID NO: 28116 - DNA, 22 bp, Artificial Sequence
  chemically synthesized
cctgagaggctaaagcaggagg

SEQ ID NO: 28117 - DNA, 22 bp, Artificial Sequence
  chemically synthesized
agaggctaaagcaggaggatca

SEQ ID NO: 28118 - DNA, 22 bp, Artificial Sequence
  chemically synthesized
aagcaggaggatcaattgaatc

SEQ ID NO: 28119 - DNA, 22 bp, Artificial Sequence
  chemically synthesized
aatccaggcgttctagtgaggc

SEQ ID NO: 28120 - DNA, 22 bp, Artificial Sequence
  chemically synthesized
tagtgaggcttcagtgagcaag

SEQ ID NO: 28121 - DNA, 22 bp, Artificial Sequence
  chemically synthesized
gtgaggcttcagtgagcaagat

SEQ ID NO: 28122 - DNA, 22 bp, Artificial Sequence
  chemically synthesized
cagtgagcaagattgcaccatt

SEQ ID NO: 28123 - DNA, 22 bp, Artificial Sequence
  chemically synthesized
agtgagcaagattgcaccattg

SEQ ID NO: 28124 - DNA, 22 bp, Artificial Sequence
  chemically synthesized
caccattgcactccagccgggg

SEQ ID NO: 28125 - DNA, 22 bp, Artificial Sequence
  chemically synthesized
cactccagccggggtgacagag

SEQ ID NO: 28126 - DNA, 22 bp, Artificial Sequence
  chemically synthesized
cagccggggtgacagagtgaga

SEQ ID NO: 28127 - DNA, 22 bp, Artificial Sequence
  chemically synthesized
tttcaaacaaacaagcaaaagc

SEQ ID NO: 28128 - DNA, 22 bp, Artificial Sequence
  chemically synthesized
caaacaaacaagcaaaagcaaa

SEQ ID NO: 28129 - DNA, 22 bp, Artificial Sequence
  chemically synthesized
aaacaaacaagcaaaagcaaaa

SEQ ID NO: 28130 - DNA, 22 bp, Artificial Sequence
  chemically synthesized
gttgctccattcctttacttac

SEQ ID NO: 28131 - DNA, 22 bp, Artificial Sequence
  chemically synthesized
ttgctccattcctttacttact

SEQ ID NO: 28132 - DNA, 22 bp, Artificial Sequence
  chemically synthesized
ctccattcctttacttactatc

SEQ ID NO: 28133 - DNA, 22 bp, Artificial Sequence
  chemically synthesized
cattcctttacttactatcttg

SEQ ID NO: 28134 - DNA, 22 bp, Artificial Sequence
  chemically synthesized
ctttacttactatcttgctgtc

SEQ ID NO: 28135 - DNA, 22 bp, Artificial Sequence
  chemically synthesized
tacttactatcttgctgtctac

SEQ ID NO: 28136 - DNA, 22 bp, Artificial Sequence
  chemically synthesized
acttactatcttgctgtctaca

SEQ ID NO: 28137 - DNA, 22 bp, Artificial Sequence
  chemically synthesized
cttactatcttgctgtctacag

SEQ ID NO: 28138 - DNA, 22 bp, Artificial Sequence
  chemically synthesized
actatcttgctgtctacagcta

SEQ ID NO: 28139 - DNA, 22 bp, Artificial Sequence
  chemically synthesized
ctatcttgctgtctacagctaa

SEQ ID NO: 28140 - DNA, 22 bp, Artificial Sequence
  chemically synthesized
tcttgctgtctacagctaaagt

SEQ ID NO: 28141 - DNA, 22 bp, Artificial Sequence
  chemically synthesized
gctgtctacagctaaagtcaga

SEQ ID NO: 28142 - DNA, 22 bp, Artificial Sequence
  chemically synthesized
ctgtctacagctaaagtcagac

SEQ ID NO: 28143 - DNA, 22 bp, Artificial Sequence
  chemically synthesized
tctacagctaaagtcagactgc

SEQ ID NO: 28144 - DNA, 22 bp, Artificial Sequence
  chemically synthesized
cagctaaagtcagactgcatga

SEQ ID NO: 28145 - DNA, 22 bp, Artificial Sequence
  chemically synthesized
aagtcagactgcatgatttgga

SEQ ID NO: 28146 - DNA, 22 bp, Artificial Sequence
  chemically synthesized
catgatttggaattccaactcc

SEQ ID NO: 28147 - DNA, 22 bp, Artificial Sequence
  chemically synthesized
ggaattccaactccaccatcac

SEQ ID NO: 28148 - DNA, 22 bp, Artificial Sequence
  chemically synthesized
gaattccaactccaccatcacc

SEQ ID NO: 28149 - DNA, 22 bp, Artificial Sequence
  chemically synthesized
caactccaccatcacctgggta

SEQ ID NO: 28150 - DNA, 22 bp, Artificial Sequence
  chemically synthesized
caccatcacctgggtaatgttg

SEQ ID NO: 28151 - DNA, 22 bp, Artificial Sequence
  chemically synthesized
ggtaatgttgagatttattaca

SEQ ID NO: 28152 - DNA, 22 bp, Artificial Sequence
  chemically synthesized
agatttattacatagcatctct

SEQ ID NO: 28153 - DNA, 22 bp, Artificial Sequence
  chemically synthesized
attacatagcatctctgtgcct

SEQ ID NO: 28154 - DNA, 22 bp, Artificial Sequence
  chemically synthesized
ttacatagcatctctgtgcctc

SEQ ID NO: 28155 - DNA, 22 bp, Artificial Sequence
  chemically synthesized
catagcatctctgtgcctcagt

SEQ ID NO: 28156 - DNA, 22 bp, Artificial Sequence
  chemically synthesized
tgtgcctcagtttctccatata

SEQ ID NO: 28157 - DNA, 22 bp, Artificial Sequence
  chemically synthesized
tgcctcagtttctccatatata

SEQ ID NO: 28158 - DNA, 22 bp, Artificial Sequence
  chemically synthesized
agtttctccatatataaaatct

SEQ ID NO: 28159 - DNA, 22 bp, Artificial Sequence
  chemically synthesized
ctccatatataaaatctacctg

SEQ ID NO: 28160 - DNA, 22 bp, Artificial Sequence
  chemically synthesized
tccatatataaaatctacctgt

SEQ ID NO: 28161 - DNA, 22 bp, Artificial Sequence
  chemically synthesized
catatataaaatctacctgtaa

SEQ ID NO: 28162 - DNA, 22 bp, Artificial Sequence
  chemically synthesized
cctgtaataatgttgtgaaaat

SEQ ID NO: 28163 - DNA, 22 bp, Artificial Sequence
  chemically synthesized
taataatgttgtgaaaattaaa

SEQ ID NO: 28164 - DNA, 22 bp, Artificial Sequence
  chemically synthesized
tgaaaattaaaagaaataccag

SEQ ID NO: 28165 - DNA, 22 bp, Artificial Sequence
  chemically synthesized
aaagaaataccagttgtaaatc

SEQ ID NO: 28166 - DNA, 22 bp, Artificial Sequence
  chemically synthesized
taaatcactcagaactgtgcct

SEQ ID NO: 28167 - DNA, 22 bp, Artificial Sequence
  chemically synthesized
agaactgtgcctagcatttaat

SEQ ID NO: 28168 - DNA, 22 bp, Artificial Sequence
  chemically synthesized
tgcctagcatttaataaacact

SEQ ID NO: 28169 - DNA, 22 bp, Artificial Sequence
  chemically synthesized
gcatttaataaacactctgtag

SEQ ID NO: 28170 - DNA, 22 bp, Artificial Sequence
  chemically synthesized
aataaacactctgtaggtatta

SEQ ID NO: 28171 - DNA, 22 bp, Artificial Sequence
  chemically synthesized
ataaacactctgtaggtattag

SEQ ID NO: 28172 - DNA, 22 bp, Artificial Sequence
  chemically synthesized
tgtaggtattagcttatttctt

SEQ ID NO: 28173 - DNA, 22 bp, Artificial Sequence
  chemically synthesized
taggtattagcttatttcttta

SEQ ID NO: 28174 - DNA, 22 bp, Artificial Sequence
  chemically synthesized
gcttatttctttataaaattta

SEQ ID NO: 28175 - DNA, 22 bp, Artificial Sequence
  chemically synthesized
atttctttataaaatttattca

SEQ ID NO: 28176 - DNA, 22 bp, Artificial Sequence
  chemically synthesized
tttctttataaaatttattcat

SEQ ID NO: 28177 - DNA, 22 bp, Artificial Sequence
  chemically synthesized
ctttataaaatttattcataaa

SEQ ID NO: 28178 - DNA, 22 bp, Artificial Sequence
  chemically synthesized
tttataaaatttattcataaaa

SEQ ID NO: 28179 - DNA, 22 bp, Artificial Sequence
  chemically synthesized
tataaaatttattcataaaatg

SEQ ID NO: 28180 - DNA, 22 bp, Artificial Sequence
  chemically synthesized
ataaaatttattcataaaatga

SEQ ID NO: 28181 - DNA, 22 bp, Artificial Sequence
  chemically synthesized
taaaatttattcataaaatgag

SEQ ID NO: 28182 - DNA, 22 bp, Artificial Sequence
  chemically synthesized
attcataaaatgaggaagttag

SEQ ID NO: 28183 - DNA, 22 bp, Artificial Sequence
  chemically synthesized
ttcataaaatgaggaagttagc

SEQ ID NO: 28184 - DNA, 22 bp, Artificial Sequence
  chemically synthesized
ataaaatgaggaagttagctca

SEQ ID NO: 28185 - DNA, 22 bp, Artificial Sequence
  chemically synthesized
gctcatgtattgtcataccagc

SEQ ID NO: 28186 - DNA, 22 bp, Artificial Sequence
  chemically synthesized
atgtattgtcataccagctttc

SEQ ID NO: 28187 - DNA, 22 bp, Artificial Sequence
  chemically synthesized
tcataccagctttcactttgaa

SEQ ID NO: 28188 - DNA, 22 bp, Artificial Sequence
  chemically synthesized
tcactttgaatgagtccataat

SEQ ID NO: 28189 - DNA, 22 bp, Artificial Sequence
  chemically synthesized
cactttgaatgagtccataatt

SEQ ID NO: 28190 - DNA, 22 bp, Artificial Sequence
  chemically synthesized
actttgaatgagtccataattg

SEQ ID NO: 28191 - DNA, 22 bp, Artificial Sequence
  chemically synthesized
tgaatgagtccataattgcatt

SEQ ID NO: 28192 - DNA, 22 bp, Artificial Sequence
  chemically synthesized
gaatgagtccataattgcattt

SEQ ID NO: 28193 - DNA, 22 bp, Artificial Sequence
  chemically synthesized
aatgagtccataattgcatttt

SEQ ID NO: 28194 - DNA, 22 bp, Artificial Sequence
  chemically synthesized
catttttaaacacaaaaagaga

SEQ ID NO: 28195 - DNA, 22 bp, Artificial Sequence
  chemically synthesized
ttaaacacaaaaagagaaataa

SEQ ID NO: 28196 - DNA, 22 bp, Artificial Sequence
  chemically synthesized
taaacacaaaaagagaaataat

SEQ ID NO: 28197 - DNA, 22 bp, Artificial Sequence
  chemically synthesized
aaacacaaaaagagaaataata

SEQ ID NO: 28198 - DNA, 22 bp, Artificial Sequence
  chemically synthesized
aacacaaaaagagaaataatag

SEQ ID NO: 28199 - DNA, 22 bp, Artificial Sequence
  chemically synthesized
cttcaatcacgggatgcatagt

SEQ ID NO: 28200 - DNA, 22 bp, Artificial Sequence
  chemically synthesized
caatcacgggatgcatagtaat

SEQ ID NO: 28201 - DNA, 22 bp, Artificial Sequence
  chemically synthesized
aatcacgggatgcatagtaatt

SEQ ID NO: 28202 - DNA, 22 bp, Artificial Sequence
  chemically synthesized
ggatttctttgccctaattact

SEQ ID NO: 28203 - DNA, 22 bp, Artificial Sequence
  chemically synthesized
ctttgccctaattactgatgtg

SEQ ID NO: 28204 - DNA, 22 bp, Artificial Sequence
  chemically synthesized
tttgccctaattactgatgtgg

SEQ ID NO: 28205 - DNA, 22 bp, Artificial Sequence
  chemically synthesized
tgccctaattactgatgtggat

SEQ ID NO: 28206 - DNA, 22 bp, Artificial Sequence
  chemically synthesized
gccctaattactgatgtggata

SEQ ID NO: 28207 - DNA, 22 bp, Artificial Sequence
  chemically synthesized
ccctaattactgatgtggataa

SEQ ID NO: 28208 - DNA, 22 bp, Artificial Sequence
  chemically synthesized
attactgatgtggataagccgg

SEQ ID NO: 28209 - DNA, 22 bp, Artificial Sequence
  chemically synthesized
ctgatgtggataagccggtggg

SEQ ID NO: 28210 - DNA, 22 bp, Artificial Sequence
  chemically synthesized
atgtggataagccggtgggcca

SEQ ID NO: 28211 - DNA, 22 bp, Artificial Sequence
  chemically synthesized
aagctgttatcacaccatgtga

SEQ ID NO: 28212 - DNA, 22 bp, Artificial Sequence
  chemically synthesized
ttatcacaccatgtgaaacaca

SEQ ID NO: 28213 - DNA, 22 bp, Artificial Sequence
  chemically synthesized
tcacaccatgtgaaacacacga

SEQ ID NO: 28214 - DNA, 22 bp, Artificial Sequence
  chemically synthesized
tgtaaaaactatgcttggttgc

SEQ ID NO: 28215 - DNA, 22 bp, Artificial Sequence
  chemically synthesized
tgcttggttgcacagcttcaag

SEQ ID NO: 28216 - DNA, 22 bp, Artificial Sequence
  chemically synthesized
ggttgcacagcttcaaggaaag

SEQ ID NO: 28217 - DNA, 22 bp, Artificial Sequence
  chemically synthesized
gttgcacagcttcaaggaaagc

SEQ ID NO: 28218 - DNA, 22 bp, Artificial Sequence
  chemically synthesized
cacagcttcaaggaaagcacta

SEQ ID NO: 28219 - DNA, 22 bp, Artificial Sequence
  chemically synthesized
caaggaaagcactagtctactc

SEQ ID NO: 28220 - DNA, 22 bp, Artificial Sequence
  chemically synthesized
aaggaaagcactagtctactca

SEQ ID NO: 28221 - DNA, 22 bp, Artificial Sequence
  chemically synthesized
gtctactcacttccttttcatt

SEQ ID NO: 28222 - DNA, 22 bp, Artificial Sequence
  chemically synthesized
ctcacttccttttcattcagca

SEQ ID NO: 28223 - DNA, 22 bp, Artificial Sequence
  chemically synthesized
acttccttttcattcagcatgc

SEQ ID NO: 28224 - DNA, 22 bp, Artificial Sequence
  chemically synthesized
ccttttcattcagcatgctatg

SEQ ID NO: 28225 - DNA, 22 bp, Artificial Sequence
  chemically synthesized
cttttcattcagcatgctatgt

SEQ ID NO: 28226 - DNA, 22 bp, Artificial Sequence
  chemically synthesized
ttcattcagcatgctatgtcta

SEQ ID NO: 28227 - DNA, 22 bp, Artificial Sequence
  chemically synthesized
tcattcagcatgctatgtctag

SEQ ID NO: 28228 - DNA, 22 bp, Artificial Sequence
  chemically synthesized
cattcagcatgctatgtctagg

SEQ ID NO: 28229 - DNA, 22 bp, Artificial Sequence
  chemically synthesized
attcagcatgctatgtctaggc

SEQ ID NO: 28230 - DNA, 22 bp, Artificial Sequence
  chemically synthesized
agcatgctatgtctaggcccct

SEQ ID NO: 28231 - DNA, 22 bp, Artificial Sequence
  chemically synthesized
tgtctaggcccctttcatataa

SEQ ID NO: 28232 - DNA, 22 bp, Artificial Sequence
  chemically synthesized
ggcccctttcatataaaatatt

SEQ ID NO: 28233 - DNA, 22 bp, Artificial Sequence
  chemically synthesized
tcatataaaatatttggagctg

SEQ ID NO: 28234 - DNA, 22 bp, Artificial Sequence
  chemically synthesized
catataaaatatttggagctgc

SEQ ID NO: 28235 - DNA, 22 bp, Artificial Sequence
  chemically synthesized
atataaaatatttggagctgcc

SEQ ID NO: 28236 - DNA, 22 bp, Artificial Sequence
  chemically synthesized
ggagctgccattgtaggtagtg

SEQ ID NO: 28237 - DNA, 22 bp, Artificial Sequence
  chemically synthesized
gagctgccattgtaggtagtgc

SEQ ID NO: 28238 - DNA, 22 bp, Artificial Sequence
  chemically synthesized
ccattgtaggtagtgcaggtgg

SEQ ID NO: 28239 - DNA, 22 bp, Artificial Sequence
  chemically synthesized
taggtagtgcaggtggtcttgt

SEQ ID NO: 28240 - DNA, 22 bp, Artificial Sequence
  chemically synthesized
gttcaaagtgtgagtatcacct

SEQ ID NO: 28241 - DNA, 22 bp, Artificial Sequence
  chemically synthesized
ttcaaagtgtgagtatcacctc

SEQ ID NO: 28242 - DNA, 22 bp, Artificial Sequence
  chemically synthesized
aaagtgtgagtatcacctccca

SEQ ID NO: 28243 - DNA, 22 bp, Artificial Sequence
  chemically synthesized
ccactgccaagactgcagctgc

SEQ ID NO: 28244 - DNA, 22 bp, Artificial Sequence
  chemically synthesized
ccaagactgcagctgctttgat

SEQ ID NO: 28245 - DNA, 22 bp, Artificial Sequence
  chemically synthesized
cagctgctttgattttaactga

SEQ ID NO: 28246 - DNA, 22 bp, Artificial Sequence
  chemically synthesized
ctttgattttaactgaggatct

SEQ ID NO: 28247 - DNA, 22 bp, Artificial Sequence
  chemically synthesized
tgattttaactgaggatctaga

SEQ ID NO: 28248 - DNA, 22 bp, Artificial Sequence
  chemically synthesized
gattttaactgaggatctagaa

SEQ ID NO: 28249 - DNA, 22 bp, Artificial Sequence
  chemically synthesized
attttaactgaggatctagaaa

SEQ ID NO: 28250 - DNA, 22 bp, Artificial Sequence
  chemically synthesized
taactgaggatctagaaaagtg

SEQ ID NO: 28251 - DNA, 22 bp, Artificial Sequence
  chemically synthesized
aactgaggatctagaaaagtgc

SEQ ID NO: 28252 - DNA, 22 bp, Artificial Sequence
  chemically synthesized
actgaggatctagaaaagtgct

SEQ ID NO: 28253 - DNA, 22 bp, Artificial Sequence
  chemically synthesized
aggatctagaaaagtgctggga

SEQ ID NO: 28254 - DNA, 22 bp, Artificial Sequence
  chemically synthesized
gaaaagtgctgggaacacaaat

SEQ ID NO: 28255 - DNA, 22 bp, Artificial Sequence
  chemically synthesized
ggaacacaaatatttgctgacc

SEQ ID NO: 28256 - DNA, 22 bp, Artificial Sequence
  chemically synthesized
gctgacctttgtcacaagtagc

SEQ ID NO: 28257 - DNA, 22 bp, Artificial Sequence
  chemically synthesized
ctgacctttgtcacaagtagca

SEQ ID NO: 28258 - DNA, 22 bp, Artificial Sequence
  chemically synthesized
acctttgtcacaagtagcacct

SEQ ID NO: 28259 - DNA, 22 bp, Artificial Sequence
  chemically synthesized
tgtcacaagtagcacctaatct

SEQ ID NO: 28260 - DNA, 22 bp, Artificial Sequence
  chemically synthesized
gtcacaagtagcacctaatctc

SEQ ID NO: 28261 - DNA, 22 bp, Artificial Sequence
  chemically synthesized
tcacaagtagcacctaatctcc

SEQ ID NO: 28262 - DNA, 22 bp, Artificial Sequence
  chemically synthesized
atctccttcctaccagacctgc

SEQ ID NO: 28263 - DNA, 22 bp, Artificial Sequence
  chemically synthesized
cttcctaccagacctgctgcct

SEQ ID NO: 28264 - DNA, 22 bp, Artificial Sequence
  chemically synthesized
cctaccagacctgctgccttat

SEQ ID NO: 28265 - DNA, 22 bp, Artificial Sequence
  chemically synthesized
ctaccagacctgctgccttata

SEQ ID NO: 28266 - DNA, 22 bp, Artificial Sequence
  chemically synthesized
ccagacctgctgccttataaaa

SEQ ID NO: 28267 - DNA, 22 bp, Artificial Sequence
  chemically synthesized
ctgccttataaaatgatgttct

SEQ ID NO: 28268 - DNA, 22 bp, Artificial Sequence
  chemically synthesized
ccttataaaatgatgttctaag

SEQ ID NO: 28269 - DNA, 22 bp, Artificial Sequence
  chemically synthesized
ataaaatgatgttctaagtgta

SEQ ID NO: 28270 - DNA, 22 bp, Artificial Sequence
  chemically synthesized
taaaatgatgttctaagtgtat

SEQ ID NO: 28271 - DNA, 22 bp, Artificial Sequence
  chemically synthesized
taagtgtataatgacttcctct

SEQ ID NO: 28272 - DNA, 22 bp, Artificial Sequence
  chemically synthesized
agtgtataatgacttcctctgc

SEQ ID NO: 28273 - DNA, 22 bp, Artificial Sequence
  chemically synthesized
cctctgcttctgcaactgtgtt

SEQ ID NO: 28274 - DNA, 22 bp, Artificial Sequence
  chemically synthesized
ctctgcttctgcaactgtgttt

SEQ ID NO: 28275 - DNA, 22 bp, Artificial Sequence
  chemically synthesized
tgcttctgcaactgtgttttgg

SEQ ID NO: 28276 - DNA, 22 bp, Artificial Sequence
  chemically synthesized
cttctgcaactgtgttttggaa

SEQ ID NO: 28277 - DNA, 22 bp, Artificial Sequence
  chemically synthesized
ctgcaactgtgttttggaacag

SEQ ID NO: 28278 - DNA, 22 bp, Artificial Sequence
  chemically synthesized
tgcaactgtgttttggaacagg

SEQ ID NO: 28279 - DNA, 22 bp, Artificial Sequence
  chemically synthesized
caactgtgttttggaacaggag

SEQ ID NO: 28280 - DNA, 22 bp, Artificial Sequence
  chemically synthesized
tgttttggaacaggagggtgag

SEQ ID NO: 28281 - DNA, 22 bp, Artificial Sequence
  chemically synthesized
tggaacaggagggtgagattag

SEQ ID NO: 28282 - DNA, 22 bp, Artificial Sequence
  chemically synthesized
ggaacaggagggtgagattagt

SEQ ID NO: 28283 - DNA, 22 bp, Artificial Sequence
  chemically synthesized
gaacaggagggtgagattagta

SEQ ID NO: 28284 - DNA, 22 bp, Artificial Sequence
  chemically synthesized
gtagccacacacactgaaatag

SEQ ID NO: 28285 - DNA, 22 bp, Artificial Sequence
  chemically synthesized
aaatagtcatatgacttccaaa

SEQ ID NO: 28286 - DNA, 22 bp, Artificial Sequence
  chemically synthesized
ccaaagtctgtaatttttaagc

SEQ ID NO: 28287 - DNA, 22 bp, Artificial Sequence
  chemically synthesized
caaagtctgtaatttttaagca

SEQ ID NO: 28288 - DNA, 22 bp, Artificial Sequence
  chemically synthesized
taatttttaagcatatacaaaa

SEQ ID NO: 28289 - DNA, 22 bp, Artificial Sequence
  chemically synthesized
ttaagcatatacaaaatagtga

SEQ ID NO: 28290 - DNA, 22 bp, Artificial Sequence
  chemically synthesized
taagcatatacaaaatagtgaa

SEQ ID NO: 28291 - DNA, 22 bp, Artificial Sequence
  chemically synthesized
aagcatatacaaaatagtgaaa

SEQ ID NO: 28292 - DNA, 22 bp, Artificial Sequence
  chemically synthesized
agcatatacaaaatagtgaaat

SEQ ID NO: 28293 - DNA, 22 bp, Artificial Sequence
  chemically synthesized
ctccatatgtgtataatatgta

SEQ ID NO: 28294 - DNA, 22 bp, Artificial Sequence
  chemically synthesized
tccatatgtgtataatatgtat

SEQ ID NO: 28295 - DNA, 22 bp, Artificial Sequence
  chemically synthesized
catatgtgtataatatgtatat

SEQ ID NO: 28296 - DNA, 22 bp, Artificial Sequence
  chemically synthesized
attttggctgatatctattcta

SEQ ID NO: 28297 - DNA, 22 bp, Artificial Sequence
  chemically synthesized
ttttggctgatatctattctat

SEQ ID NO: 28298 - DNA, 22 bp, Artificial Sequence
  chemically synthesized
tggctgatatctattctatact

SEQ ID NO: 28299 - DNA, 22 bp, Artificial Sequence
  chemically synthesized
ggctgatatctattctatactt

SEQ ID NO: 28300 - DNA, 22 bp, Artificial Sequence
  chemically synthesized
gctgatatctattctatacttc

SEQ ID NO: 28301 - DNA, 22 bp, Artificial Sequence
  chemically synthesized
atatctattctatacttctttg

SEQ ID NO: 28302 - DNA, 22 bp, Artificial Sequence
  chemically synthesized
ttctatacttctttgaaatagt

SEQ ID NO: 28303 - DNA, 22 bp, Artificial Sequence
  chemically synthesized
tatacttctttgaaatagtgat

SEQ ID NO: 28304 - DNA, 22 bp, Artificial Sequence
  chemically synthesized
tacttctttgaaatagtgattt

SEQ ID NO: 28305 - DNA, 22 bp, Artificial Sequence
  chemically synthesized
ctttgaaatagtgatttttagt

SEQ ID NO: 28306 - DNA, 22 bp, Artificial Sequence
  chemically synthesized
tttgaaatagtgatttttagta

SEQ ID NO: 28307 - DNA, 22 bp, Artificial Sequence
  chemically synthesized
tgaaatagtgatttttagtaaa

SEQ ID NO: 28308 - DNA, 22 bp, Artificial Sequence
  chemically synthesized
gaaatagtgatttttagtaaat

SEQ ID NO: 28309 - DNA, 22 bp, Artificial Sequence
  chemically synthesized
aaatagtgatttttagtaaatt

SEQ ID NO: 28310 - DNA, 22 bp, Artificial Sequence
  chemically synthesized
ttagtaaattggcagtgttgcc

SEQ ID NO: 28311 - DNA, 22 bp, Artificial Sequence
  chemically synthesized
tagtaaattggcagtgttgcca

SEQ ID NO: 28312 - DNA, 22 bp, Artificial Sequence
  chemically synthesized
agtaaattggcagtgttgccag

SEQ ID NO: 28313 - DNA, 22 bp, Artificial Sequence
  chemically synthesized
gtaaattggcagtgttgccaga

SEQ ID NO: 28314 - DNA, 22 bp, Artificial Sequence
  chemically synthesized
gcagtgttgccagatgacgact

SEQ ID NO: 28315 - DNA, 22 bp, Artificial Sequence
  chemically synthesized
ccagatgacgacttagagtttt

SEQ ID NO: 28316 - DNA, 22 bp, Artificial Sequence
  chemically synthesized
agagttttaaccacctcattgt

SEQ ID NO: 28317 - DNA, 22 bp, Artificial Sequence
  chemically synthesized
gagttttaaccacctcattgtt

SEQ ID NO: 28318 - DNA, 22 bp, Artificial Sequence
  chemically synthesized
taaccacctcattgttatatgt

SEQ ID NO: 28319 - DNA, 22 bp, Artificial Sequence
  chemically synthesized
aaccacctcattgttatatgta

SEQ ID NO: 28320 - DNA, 22 bp, Artificial Sequence
  chemically synthesized
accacctcattgttatatgtac

SEQ ID NO: 28321 - DNA, 22 bp, Artificial Sequence
  chemically synthesized
attgttatatgtaccatggtag

SEQ ID NO: 28322 - DNA, 22 bp, Artificial Sequence
  chemically synthesized
ttatatgtaccatggtagctca

SEQ ID NO: 28323 - DNA, 22 bp, Artificial Sequence
  chemically synthesized
tatgtaccatggtagctcatct

SEQ ID NO: 28324 - DNA, 22 bp, Artificial Sequence
  chemically synthesized
atcttttctttcaggtgaaagt

SEQ ID NO: 28325 - DNA, 22 bp, Artificial Sequence
  chemically synthesized
ttctttcaggtgaaagttgtga

SEQ ID NO: 28326 - DNA, 22 bp, Artificial Sequence
  chemically synthesized
tctttcaggtgaaagttgtgat

SEQ ID NO: 28327 - DNA, 22 bp, Artificial Sequence
  chemically synthesized
ctttcaggtgaaagttgtgata

SEQ ID NO: 28328 - DNA, 22 bp, Artificial Sequence
  chemically synthesized
tttcaggtgaaagttgtgatac

SEQ ID NO: 28329 - DNA, 22 bp, Artificial Sequence
  chemically synthesized
tcaggtgaaagttgtgatactt

SEQ ID NO: 28330 - DNA, 22 bp, Artificial Sequence
  chemically synthesized
caggtgaaagttgtgatacttt

SEQ ID NO: 28331 - DNA, 22 bp, Artificial Sequence
  chemically synthesized
aggtgaaagttgtgatactttg

SEQ ID NO: 28332 - DNA, 22 bp, Artificial Sequence
  chemically synthesized
tgatactttgtcctcacgctaa

SEQ ID NO: 28333 - DNA, 22 bp, Artificial Sequence
  chemically synthesized
tgtcctcacgctaaacatagcc

SEQ ID NO: 28334 - DNA, 22 bp, Artificial Sequence
  chemically synthesized
gtcctcacgctaaacatagccc

SEQ ID NO: 28335 - DNA, 22 bp, Artificial Sequence
  chemically synthesized
tcctcacgctaaacatagcccc

SEQ ID NO: 28336 - DNA, 22 bp, Artificial Sequence
  chemically synthesized
acgctaaacatagcccccatgt

SEQ ID NO: 28337 - DNA, 22 bp, Artificial Sequence
  chemically synthesized
aacatagcccccatgttgttcc

SEQ ID NO: 28338 - DNA, 22 bp, Artificial Sequence
  chemically synthesized
ttccaggaaaatagagatcaat

SEQ ID NO: 28339 - DNA, 22 bp, Artificial Sequence
  chemically synthesized
caggaaaatagagatcaataaa

SEQ ID NO: 28340 - DNA, 22 bp, Artificial Sequence
  chemically synthesized
gtttgaaagtgaaggttaagtt

SEQ ID NO: 28341 - DNA, 22 bp, Artificial Sequence
  chemically synthesized
tttgaaagtgaaggttaagttc

SEQ ID NO: 28342 - DNA, 22 bp, Artificial Sequence
  chemically synthesized
gaaagtgaaggttaagttcaaa

SEQ ID NO: 28343 - DNA, 22 bp, Artificial Sequence
  chemically synthesized
aaagtgaaggttaagttcaaat

SEQ ID NO: 28344 - DNA, 22 bp, Artificial Sequence
  chemically synthesized
agttcaaattcaatgacctacg

SEQ ID NO: 28345 - DNA, 22 bp, Artificial Sequence
  chemically synthesized
aaattcaatgacctacgctgtg

SEQ ID NO: 28346 - DNA, 22 bp, Artificial Sequence
  chemically synthesized
aatgacctacgctgtggtaaaa

SEQ ID NO: 28347 - DNA, 22 bp, Artificial Sequence
  chemically synthesized
cgctgtggtaaaacgatcattc

SEQ ID NO: 28348 - DNA, 22 bp, Artificial Sequence
  chemically synthesized
tggtaaaacgatcattcattaa

SEQ ID NO: 28349 - DNA, 22 bp, Artificial Sequence
  chemically synthesized
attaatgatattaagtattttc

SEQ ID NO: 28350 - DNA, 22 bp, Artificial Sequence
  chemically synthesized
atgatattaagtattttctttt

SEQ ID NO: 28351 - DNA, 22 bp, Artificial Sequence
  chemically synthesized
agtattttcttttttaatgtca

SEQ ID NO: 28352 - DNA, 22 bp, Artificial Sequence
  chemically synthesized
tcttttttaatgtcagaataaa

SEQ ID NO: 28353 - DNA, 22 bp, Artificial Sequence
  chemically synthesized
cttttttaatgtcagaataaaa

SEQ ID NO: 28354 - DNA, 22 bp, Artificial Sequence
  chemically synthesized
ttttttaatgtcagaataaaac

SEQ ID NO: 28355 - DNA, 22 bp, Artificial Sequence
  chemically synthesized
ttttaatgtcagaataaaacca

SEQ ID NO: 28356 - DNA, 22 bp, Artificial Sequence
  chemically synthesized
tttaatgtcagaataaaaccat

SEQ ID NO: 28357 - DNA, 22 bp, Artificial Sequence
  chemically synthesized
ttaatgtcagaataaaaccatt

SEQ ID NO: 28358 - DNA, 22 bp, Artificial Sequence
  chemically synthesized
taatgtcagaataaaaccattt

SEQ ID NO: 28359 - DNA, 22 bp, Artificial Sequence
  chemically synthesized
aatgtcagaataaaaccattta

SEQ ID NO: 28360 - DNA, 22 bp, Artificial Sequence
  chemically synthesized
atgtcagaataaaaccatttat

SEQ ID NO: 28361 - DNA, 22 bp, Artificial Sequence
  chemically synthesized
atttgcagatttaaaaatatat

SEQ ID NO: 28362 - DNA, 22 bp, Artificial Sequence
  chemically synthesized
tttgcagatttaaaaatatata

SEQ ID NO: 28363 - DNA, 22 bp, Artificial Sequence
  chemically synthesized
gcagatttaaaaatatatatgt

SEQ ID NO: 28364 - DNA, 22 bp, Artificial Sequence
  chemically synthesized
cagatttaaaaatatatatgtg

SEQ ID NO: 28365 - DNA, 22 bp, Artificial Sequence
  chemically synthesized
aaaaatatatatgtgtatgtaa

SEQ ID NO: 28366 - DNA, 22 bp, Artificial Sequence
  chemically synthesized
aaaatatatatgtgtatgtaaa

SEQ ID NO: 28367 - DNA, 22 bp, Artificial Sequence
  chemically synthesized
cttggtttatacctcaaatatg

SEQ ID NO: 28368 - DNA, 22 bp, Artificial Sequence
  chemically synthesized
ggtttatacctcaaatatgaaa

SEQ ID NO: 28369 - DNA, 22 bp, Artificial Sequence
  chemically synthesized
gtttatacctcaaatatgaaaa

SEQ ID NO: 28370 - DNA, 22 bp, Artificial Sequence
  chemically synthesized
atacctcaaatatgaaaatagg

SEQ ID NO: 28371 - DNA, 22 bp, Artificial Sequence
  chemically synthesized
tacctcaaatatgaaaatagga

SEQ ID NO: 28372 - DNA, 22 bp, Artificial Sequence
  chemically synthesized
aaatatgaaaataggaatgacc

SEQ ID NO: 28373 - DNA, 22 bp, Artificial Sequence
  chemically synthesized
tctctatgctcttgcattcact

SEQ ID NO: 28374 - DNA, 22 bp, Artificial Sequence
  chemically synthesized
tatgctcttgcattcacttata

SEQ ID NO: 28375 - DNA, 22 bp, Artificial Sequence
  chemically synthesized
tgctcttgcattcacttatatt

SEQ ID NO: 28376 - DNA, 22 bp, Artificial Sequence
  chemically synthesized
ttgcattcacttatattctagc

SEQ ID NO: 28377 - DNA, 22 bp, Artificial Sequence
  chemically synthesized
gcattcacttatattctagctt

SEQ ID NO: 28378 - DNA, 22 bp, Artificial Sequence
  chemically synthesized
cattcacttatattctagcttg

SEQ ID NO: 28379 - DNA, 22 bp, Artificial Sequence
  chemically synthesized
acttatattctagcttgttaag

SEQ ID NO: 28380 - DNA, 22 bp, Artificial Sequence
  chemically synthesized
atattctagcttgttaagagag

SEQ ID NO: 28381 - DNA, 22 bp, Artificial Sequence
  chemically synthesized
tattctagcttgttaagagaga

SEQ ID NO: 28382 - DNA, 22 bp, Artificial Sequence
  chemically synthesized
tagcttgttaagagagaagttt

SEQ ID NO: 28383 - DNA, 22 bp, Artificial Sequence
  chemically synthesized
gcttgttaagagagaagtttgg

SEQ ID NO: 28384 - DNA, 22 bp, Artificial Sequence
  chemically synthesized
gttaagagagaagtttggggca

SEQ ID NO: 28385 - DNA, 22 bp, Artificial Sequence
  chemically synthesized
ttaagagagaagtttggggcaa

SEQ ID NO: 28386 - DNA, 22 bp, Artificial Sequence
  chemically synthesized
agagagaagtttggggcaaaat

SEQ ID NO: 28387 - DNA, 22 bp, Artificial Sequence
  chemically synthesized
ggggcaaaatgtgctttataaa

SEQ ID NO: 28388 - DNA, 22 bp, Artificial Sequence
  chemically synthesized
gggcaaaatgtgctttataaat

SEQ ID NO: 28389 - DNA, 22 bp, Artificial Sequence
  chemically synthesized
tataaatagtaaaaactgaggt

SEQ ID NO: 28390 - DNA, 22 bp, Artificial Sequence
  chemically synthesized
ataaatagtaaaaactgaggta

SEQ ID NO: 28391 - DNA, 22 bp, Artificial Sequence
  chemically synthesized
taaatagtaaaaactgaggtaa

SEQ ID NO: 28392 - DNA, 22 bp, Artificial Sequence
  chemically synthesized
aggtaaactatagcacaaagtg

SEQ ID NO: 28393 - DNA, 22 bp, Artificial Sequence
  chemically synthesized
tagcacaaagtgtgctatataa

SEQ ID NO: 28394 - DNA, 22 bp, Artificial Sequence
  chemically synthesized
tataaacagtaaaaaccgaggt

SEQ ID NO: 28395 - DNA, 22 bp, Artificial Sequence
  chemically synthesized
aaatggtgttggaatataagaa

SEQ ID NO: 28396 - DNA, 22 bp, Artificial Sequence
  chemically synthesized
gaatataagaaatagcagtaaa

SEQ ID NO: 28397 - DNA, 22 bp, Artificial Sequence
  chemically synthesized
ctcacagcaagacagtacaggg

SEQ ID NO: 28398 - DNA, 22 bp, Artificial Sequence
  chemically synthesized
acagcaagacagtacagggaaa

SEQ ID NO: 28399 - DNA, 22 bp, Artificial Sequence
  chemically synthesized
gagggacaaagatttacttaca

SEQ ID NO: 28400 - DNA, 22 bp, Artificial Sequence
  chemically synthesized
acttacaatcaggcctcaacca

SEQ ID NO: 28401 - DNA, 22 bp, Artificial Sequence
  chemically synthesized
cttacaatcaggcctcaaccaa

SEQ ID NO: 28402 - DNA, 22 bp, Artificial Sequence
  chemically synthesized
acaatcaggcctcaaccaatat

SEQ ID NO: 28403 - DNA, 22 bp, Artificial Sequence
  chemically synthesized
caatcaggcctcaaccaatatg

SEQ ID NO: 28404 - DNA, 22 bp, Artificial Sequence
  chemically synthesized
aaccaatatgagatcgactttc

SEQ ID NO: 28405 - DNA, 22 bp, Artificial Sequence
  chemically synthesized
tcttttattgatatatgacgtg

SEQ ID NO: 28406 - DNA, 22 bp, Artificial Sequence
  chemically synthesized
cttttattgatatatgacgtgt

SEQ ID NO: 28407 - DNA, 22 bp, Artificial Sequence
  chemically synthesized
ttttattgatatatgacgtgtt

SEQ ID NO: 28408 - DNA, 22 bp, Artificial Sequence
  chemically synthesized
ttattgatatatgacgtgttta

SEQ ID NO: 28409 - DNA, 22 bp, Artificial Sequence
  chemically synthesized
tattgatatatgacgtgtttat

SEQ ID NO: 28410 - DNA, 22 bp, Artificial Sequence
  chemically synthesized
attgatatatgacgtgtttata

SEQ ID NO: 28411 - DNA, 22 bp, Artificial Sequence
  chemically synthesized
ttgatatatgacgtgtttatat

SEQ ID NO: 28412 - DNA, 22 bp, Artificial Sequence
  chemically synthesized
atatatgacgtgtttatatgta

SEQ ID NO: 28413 - DNA, 22 bp, Artificial Sequence
  chemically synthesized
atatgtatcaggtacatgtgac

SEQ ID NO: 28414 - DNA, 22 bp, Artificial Sequence
  chemically synthesized
tatgtatcaggtacatgtgaca

SEQ ID NO: 28415 - DNA, 22 bp, Artificial Sequence
  chemically synthesized
tgttacatgcatataatgtata

SEQ ID NO: 28416 - DNA, 22 bp, Artificial Sequence
  chemically synthesized
gttacatgcatataatgtataa

SEQ ID NO: 28417 - DNA, 22 bp, Artificial Sequence
  chemically synthesized
ttacatgcatataatgtataat

SEQ ID NO: 28418 - DNA, 22 bp, Artificial Sequence
  chemically synthesized
catgcatataatgtataatgat

SEQ ID NO: 28419 - DNA, 22 bp, Artificial Sequence
  chemically synthesized
ggggtattcatcacctcaagta

SEQ ID NO: 28420 - DNA, 22 bp, Artificial Sequence
  chemically synthesized
gggtattcatcacctcaagtat

SEQ ID NO: 28421 - DNA, 22 bp, Artificial Sequence
  chemically synthesized
atcacctcaagtatttatcgtt

SEQ ID NO: 28422 - DNA, 22 bp, Artificial Sequence
  chemically synthesized
aagtatttatcgtttctatgtg

SEQ ID NO: 28423 - DNA, 22 bp, Artificial Sequence
  chemically synthesized
atcgtttctatgtgttaggaac

SEQ ID NO: 28424 - DNA, 22 bp, Artificial Sequence
  chemically synthesized
tcgtttctatgtgttaggaaca

SEQ ID NO: 28425 - DNA, 22 bp, Artificial Sequence
  chemically synthesized
ctatgtgttaggaacatttcaa

SEQ ID NO: 28426 - DNA, 22 bp, Artificial Sequence
  chemically synthesized
tatgtgttaggaacatttcaag

SEQ ID NO: 28427 - DNA, 22 bp, Artificial Sequence
  chemically synthesized
tgtgttaggaacatttcaagac

SEQ ID NO: 28428 - DNA, 22 bp, Artificial Sequence
  chemically synthesized
ggaacatttcaagacctttctt

SEQ ID NO: 28429 - DNA, 22 bp, Artificial Sequence
  chemically synthesized
caagacctttcttctactattt

SEQ ID NO: 28430 - DNA, 22 bp, Artificial Sequence
  chemically synthesized
aagacctttcttctactatttt

SEQ ID NO: 28431 - DNA, 22 bp, Artificial Sequence
  chemically synthesized
tcttctactattttgaaatata

SEQ ID NO: 28432 - DNA, 22 bp, Artificial Sequence
  chemically synthesized
cttctactattttgaaatatac

SEQ ID NO: 28433 - DNA, 22 bp, Artificial Sequence
  chemically synthesized
ttctactattttgaaatataca

SEQ ID NO: 28434 - DNA, 22 bp, Artificial Sequence
  chemically synthesized
ctactattttgaaatatacaat

SEQ ID NO: 28435 - DNA, 22 bp, Artificial Sequence
  chemically synthesized
tactattttgaaatatacaata

SEQ ID NO: 28436 - DNA, 22 bp, Artificial Sequence
  chemically synthesized
ctattttgaaatatacaatata

SEQ ID NO: 28437 - DNA, 22 bp, Artificial Sequence
  chemically synthesized
ttttgaaatatacaatatattg

SEQ ID NO: 28438 - DNA, 22 bp, Artificial Sequence
  chemically synthesized
tgaaatatacaatatattgttt

SEQ ID NO: 28439 - DNA, 22 bp, Artificial Sequence
  chemically synthesized
gaaatatacaatatattgtttt

SEQ ID NO: 28440 - DNA, 22 bp, Artificial Sequence
  chemically synthesized
aaatatacaatatattgttttt

SEQ ID NO: 28441 - DNA, 22 bp, Artificial Sequence
  chemically synthesized
tttttaactataatcaccctac

SEQ ID NO: 28442 - DNA, 22 bp, Artificial Sequence
  chemically synthesized
ttaactataatcaccctacttt

SEQ ID NO: 28443 - DNA, 22 bp, Artificial Sequence
  chemically synthesized
taactataatcaccctactttg

SEQ ID NO: 28444 - DNA, 22 bp, Artificial Sequence
  chemically synthesized
aactataatcaccctactttgc

SEQ ID NO: 28445 - DNA, 22 bp, Artificial Sequence
  chemically synthesized
actataatcaccctactttgct

SEQ ID NO: 28446 - DNA, 22 bp, Artificial Sequence
  chemically synthesized
taatcaccctactttgctattg

SEQ ID NO: 28447 - DNA, 22 bp, Artificial Sequence
  chemically synthesized
ctttgctattgaacatcagaac

SEQ ID NO: 28448 - DNA, 22 bp, Artificial Sequence
  chemically synthesized
tgctattgaacatcagaacata

SEQ ID NO: 28449 - DNA, 22 bp, Artificial Sequence
  chemically synthesized
gctattgaacatcagaacatat

SEQ ID NO: 28450 - DNA, 22 bp, Artificial Sequence
  chemically synthesized
ctattgaacatcagaacatatt

SEQ ID NO: 28451 - DNA, 22 bp, Artificial Sequence
  chemically synthesized
ttgaacatcagaacatattcct

SEQ ID NO: 28452 - DNA, 22 bp, Artificial Sequence
  chemically synthesized
aacatcagaacatattccttct

SEQ ID NO: 28453 - DNA, 22 bp, Artificial Sequence
  chemically synthesized
cttctatctaactgcctgtttc

SEQ ID NO: 28454 - DNA, 22 bp, Artificial Sequence
  chemically synthesized
ctatctaactgcctgtttccat

SEQ ID NO: 28455 - DNA, 22 bp, Artificial Sequence
  chemically synthesized
tatctaactgcctgtttccatt

SEQ ID NO: 28456 - DNA, 22 bp, Artificial Sequence
  chemically synthesized
tctaactgcctgtttccattaa

SEQ ID NO: 28457 - DNA, 22 bp, Artificial Sequence
  chemically synthesized
actgcctgtttccattaaccaa

SEQ ID NO: 28458 - DNA, 22 bp, Artificial Sequence
  chemically synthesized
cctgtttccattaaccaacttc

SEQ ID NO: 28459 - DNA, 22 bp, Artificial Sequence
  chemically synthesized
tttccattaaccaacttctctt

SEQ ID NO: 28460 - DNA, 22 bp, Artificial Sequence
  chemically synthesized
ccattaaccaacttctcttcgt

SEQ ID NO: 28461 - DNA, 22 bp, Artificial Sequence
  chemically synthesized
cattaaccaacttctcttcgtc

SEQ ID NO: 28462 - DNA, 22 bp, Artificial Sequence
  chemically synthesized
accaacttctcttcgtctccct

SEQ ID NO: 28463 - DNA, 22 bp, Artificial Sequence
  chemically synthesized
ctcttcgtctcccttcctccca

SEQ ID NO: 28464 - DNA, 22 bp, Artificial Sequence
  chemically synthesized
tcttcgtctcccttcctcccat

SEQ ID NO: 28465 - DNA, 22 bp, Artificial Sequence
  chemically synthesized
ttcgtctcccttcctcccataa

SEQ ID NO: 28466 - DNA, 22 bp, Artificial Sequence
  chemically synthesized
cgtctcccttcctcccataacg

SEQ ID NO: 28467 - DNA, 22 bp, Artificial Sequence
  chemically synthesized
gtctcccttcctcccataacgt

SEQ ID NO: 28468 - DNA, 22 bp, Artificial Sequence
  chemically synthesized
ccttcctcccataacgtacaca

SEQ ID NO: 28469 - DNA, 22 bp, Artificial Sequence
  chemically synthesized
cctcccataacgtacacacctt

SEQ ID NO: 28470 - DNA, 22 bp, Artificial Sequence
  chemically synthesized
ctcccataacgtacacaccttt

SEQ ID NO: 28471 - DNA, 22 bp, Artificial Sequence
  chemically synthesized
ccataacgtacacacctttctc

SEQ ID NO: 28472 - DNA, 22 bp, Artificial Sequence
  chemically synthesized
tctctacctctggtttctgtca

SEQ ID NO: 28473 - DNA, 22 bp, Artificial Sequence
  chemically synthesized
ctctacctctggtttctgtcat

SEQ ID NO: 28474 - DNA, 22 bp, Artificial Sequence
  chemically synthesized
tctacctctggtttctgtcatt

SEQ ID NO: 28475 - DNA, 22 bp, Artificial Sequence
  chemically synthesized
tacctctggtttctgtcattct

SEQ ID NO: 28476 - DNA, 22 bp, Artificial Sequence
  chemically synthesized
cctctggtttctgtcattctac

SEQ ID NO: 28477 - DNA, 22 bp, Artificial Sequence
  chemically synthesized
tggtttctgtcattctactctc

SEQ ID NO: 28478 - DNA, 22 bp, Artificial Sequence
  chemically synthesized
gtttctgtcattctactctcta

SEQ ID NO: 28479 - DNA, 22 bp, Artificial Sequence
  chemically synthesized
ctgtcattctactctctaccta

SEQ ID NO: 28480 - DNA, 22 bp, Artificial Sequence
  chemically synthesized
tgtcattctactctctacctac

SEQ ID NO: 28481 - DNA, 22 bp, Artificial Sequence
  chemically synthesized
tcattctactctctacctacat

SEQ ID NO: 28482 - DNA, 22 bp, Artificial Sequence
  chemically synthesized
tactctctacctacatgatatt

SEQ ID NO: 28483 - DNA, 22 bp, Artificial Sequence
  chemically synthesized
ctctctacctacatgatattaa

SEQ ID NO: 28484 - DNA, 22 bp, Artificial Sequence
  chemically synthesized
tctacctacatgatattaactt

SEQ ID NO: 28485 - DNA, 22 bp, Artificial Sequence
  chemically synthesized
tacctacatgatattaactttt

SEQ ID NO: 28486 - DNA, 22 bp, Artificial Sequence
  chemically synthesized
cctacatgatattaactttttt

SEQ ID NO: 28487 - DNA, 22 bp, Artificial Sequence
  chemically synthesized
catgatattaacttttttagct

SEQ ID NO: 28488 - DNA, 22 bp, Artificial Sequence
  chemically synthesized
acttttttagctcccacatatc

SEQ ID NO: 28489 - DNA, 22 bp, Artificial Sequence
  chemically synthesized
ttttagctcccacatatcagtg

SEQ ID NO: 28490 - DNA, 22 bp, Artificial Sequence
  chemically synthesized
tttagctcccacatatcagtga

SEQ ID NO: 28491 - DNA, 22 bp, Artificial Sequence
  chemically synthesized
ttagctcccacatatcagtgag

SEQ ID NO: 28492 - DNA, 22 bp, Artificial Sequence
  chemically synthesized
tagctcccacatatcagtgaga

SEQ ID NO: 28493 - DNA, 22 bp, Artificial Sequence
  chemically synthesized
agctcccacatatcagtgagaa

SEQ ID NO: 28494 - DNA, 22 bp, Artificial Sequence
  chemically synthesized
gctcccacatatcagtgagaac

SEQ ID NO: 28495 - DNA, 22 bp, Artificial Sequence
  chemically synthesized
ccacatatcagtgagaacatgc

SEQ ID NO: 28496 - DNA, 22 bp, Artificial Sequence
  chemically synthesized
gtctttctatgcctggcttatt

SEQ ID NO: 28497 - DNA, 22 bp, Artificial Sequence
  chemically synthesized
tctttctatgcctggcttattt

SEQ ID NO: 28498 - DNA, 22 bp, Artificial Sequence
  chemically synthesized
tctatgcctggcttatttcgtt

SEQ ID NO: 28499 - DNA, 22 bp, Artificial Sequence
  chemically synthesized
ctatgcctggcttatttcgttt

SEQ ID NO: 28500 - DNA, 22 bp, Artificial Sequence
  chemically synthesized
tatgcctggcttatttcgttta

SEQ ID NO: 28501 - DNA, 22 bp, Artificial Sequence
  chemically synthesized
tgcctggcttatttcgtttaac

SEQ ID NO: 28502 - DNA, 22 bp, Artificial Sequence
  chemically synthesized
gcttatttcgtttaacataatg

SEQ ID NO: 28503 - DNA, 22 bp, Artificial Sequence
  chemically synthesized
atttcgtttaacataatgactt

SEQ ID NO: 28504 - DNA, 22 bp, Artificial Sequence
  chemically synthesized
tttcgtttaacataatgacttc

SEQ ID NO: 28505 - DNA, 22 bp, Artificial Sequence
  chemically synthesized
cgtttaacataatgacttccag

SEQ ID NO: 28506 - DNA, 22 bp, Artificial Sequence
  chemically synthesized
gtttaacataatgacttccagt

SEQ ID NO: 28507 - DNA, 22 bp, Artificial Sequence
  chemically synthesized
aacataatgacttccagtttca

SEQ ID NO: 28508 - DNA, 22 bp, Artificial Sequence
  chemically synthesized
acataatgacttccagtttcat

SEQ ID NO: 28509 - DNA, 22 bp, Artificial Sequence
  chemically synthesized
ccagtttcatccatgttgctgc

SEQ ID NO: 28510 - DNA, 22 bp, Artificial Sequence
  chemically synthesized
cagtttcatccatgttgctgca

SEQ ID NO: 28511 - DNA, 22 bp, Artificial Sequence
  chemically synthesized
catccatgttgctgcaaatgaa

SEQ ID NO: 28512 - DNA, 22 bp, Artificial Sequence
  chemically synthesized
atccatgttgctgcaaatgaaa

SEQ ID NO: 28513 - DNA, 22 bp, Artificial Sequence
  chemically synthesized
ctgcaaatgaaatgattttata

SEQ ID NO: 28514 - DNA, 22 bp, Artificial Sequence
  chemically synthesized
caaatgaaatgattttatattt

SEQ ID NO: 28515 - DNA, 22 bp, Artificial Sequence
  chemically synthesized
tatatttgtatggttgaataat

SEQ ID NO: 28516 - DNA, 22 bp, Artificial Sequence
  chemically synthesized
atatttgtatggttgaataata

SEQ ID NO: 28517 - DNA, 22 bp, Artificial Sequence
  chemically synthesized
tatttgtatggttgaataatat

SEQ ID NO: 28518 - DNA, 22 bp, Artificial Sequence
  chemically synthesized
gtatggttgaataatattcaat

SEQ ID NO: 28519 - DNA, 22 bp, Artificial Sequence
  chemically synthesized
tatggttgaataatattcaatt

SEQ ID NO: 28520 - DNA, 22 bp, Artificial Sequence
  chemically synthesized
aataatattcaattgtgtgtat

SEQ ID NO: 28521 - DNA, 22 bp, Artificial Sequence
  chemically synthesized
aattgtgtgtatacaccacatt

SEQ ID NO: 28522 - DNA, 22 bp, Artificial Sequence
  chemically synthesized
tgtgtatacaccacattttctt

SEQ ID NO: 28523 - DNA, 22 bp, Artificial Sequence
  chemically synthesized
tcttcattcatccattgatgga

SEQ ID NO: 28524 - DNA, 22 bp, Artificial Sequence
  chemically synthesized
cttcattcatccattgatggac

SEQ ID NO: 28525 - DNA, 22 bp, Artificial Sequence
  chemically synthesized
ttcattcatccattgatggaca

SEQ ID NO: 28526 - DNA, 22 bp, Artificial Sequence
  chemically synthesized
cattcatccattgatggacact

SEQ ID NO: 28527 - DNA, 22 bp, Artificial Sequence
  chemically synthesized
attcatccattgatggacactt

SEQ ID NO: 28528 - DNA, 22 bp, Artificial Sequence
  chemically synthesized
atccattgatggacacttaggt

SEQ ID NO: 28529 - DNA, 22 bp, Artificial Sequence
  chemically synthesized
atggacacttaggttgattcca

SEQ ID NO: 28530 - DNA, 22 bp, Artificial Sequence
  chemically synthesized
aggttgattccatatctttgct

SEQ ID NO: 28531 - DNA, 22 bp, Artificial Sequence
  chemically synthesized
ggttgattccatatctttgcta

SEQ ID NO: 28532 - DNA, 22 bp, Artificial Sequence
  chemically synthesized
attccatatctttgctaatgtg

SEQ ID NO: 28533 - DNA, 22 bp, Artificial Sequence
  chemically synthesized
catatctttgctaatgtgaatc

SEQ ID NO: 28534 - DNA, 22 bp, Artificial Sequence
  chemically synthesized
tgctaatgtgaatcgtgctgca

SEQ ID NO: 28535 - DNA, 22 bp, Artificial Sequence
  chemically synthesized
gctaatgtgaatcgtgctgcaa

SEQ ID NO: 28536 - DNA, 22 bp, Artificial Sequence
  chemically synthesized
ctaatgtgaatcgtgctgcaat

SEQ ID NO: 28537 - DNA, 22 bp, Artificial Sequence
  chemically synthesized
atgtgaatcgtgctgcaataaa

SEQ ID NO: 28538 - DNA, 22 bp, Artificial Sequence
  chemically synthesized
caataaacagtgtggtaccagt

SEQ ID NO: 28539 - DNA, 22 bp, Artificial Sequence
  chemically synthesized
tttattattctgaattcttttc

SEQ ID NO: 28540 - DNA, 22 bp, Artificial Sequence
  chemically synthesized
attattctgaattcttttcctt

SEQ ID NO: 28541 - DNA, 22 bp, Artificial Sequence
  chemically synthesized
ttattctgaattcttttccttt

SEQ ID NO: 28542 - DNA, 22 bp, Artificial Sequence
  chemically synthesized
ttctgaattcttttcctttgga

SEQ ID NO: 28543 - DNA, 22 bp, Artificial Sequence
  chemically synthesized
tgaattcttttcctttggataa

SEQ ID NO: 28544 - DNA, 22 bp, Artificial Sequence
  chemically synthesized
aattcttttcctttggataaat

SEQ ID NO: 28545 - DNA, 22 bp, Artificial Sequence
  chemically synthesized
ttttcctttggataaataccca

SEQ ID NO: 28546 - DNA, 22 bp, Artificial Sequence
  chemically synthesized
ttcctttggataaatacccagt

SEQ ID NO: 28547 - DNA, 22 bp, Artificial Sequence
  chemically synthesized
tcctttggataaatacccagta

SEQ ID NO: 28548 - DNA, 22 bp, Artificial Sequence
  chemically synthesized
cctttggataaatacccagtaa

SEQ ID NO: 28549 - DNA, 22 bp, Artificial Sequence
  chemically synthesized
ctttggataaatacccagtaat

SEQ ID NO: 28550 - DNA, 22 bp, Artificial Sequence
  chemically synthesized
tggataaatacccagtaataag

SEQ ID NO: 28551 - DNA, 22 bp, Artificial Sequence
  chemically synthesized
ggataaatacccagtaataaga

SEQ ID NO: 28552 - DNA, 22 bp, Artificial Sequence
  chemically synthesized
gataaatacccagtaataagat

SEQ ID NO: 28553 - DNA, 22 bp, Artificial Sequence
  chemically synthesized
ctggatcttatgatagttcaat

SEQ ID NO: 28554 - DNA, 22 bp, Artificial Sequence
  chemically synthesized
gatcttatgatagttcaatttt

SEQ ID NO: 28555 - DNA, 22 bp, Artificial Sequence
  chemically synthesized
atgatagttcaatttttagctt

SEQ ID NO: 28556 - DNA, 22 bp, Artificial Sequence
  chemically synthesized
tgatagttcaatttttagcttt

SEQ ID NO: 28557 - DNA, 22 bp, Artificial Sequence
  chemically synthesized
aatttttagctttttggtaaat

SEQ ID NO: 28558 - DNA, 22 bp, Artificial Sequence
  chemically synthesized
ttagctttttggtaaatctaca

SEQ ID NO: 28559 - DNA, 22 bp, Artificial Sequence
  chemically synthesized
tagctttttggtaaatctacat

SEQ ID NO: 28560 - DNA, 22 bp, Artificial Sequence
  chemically synthesized
agctttttggtaaatctacata

SEQ ID NO: 28561 - DNA, 22 bp, Artificial Sequence
  chemically synthesized
gctttttggtaaatctacatat

SEQ ID NO: 28562 - DNA, 22 bp, Artificial Sequence
  chemically synthesized
tttggtaaatctacatattgtt

SEQ ID NO: 28563 - DNA, 22 bp, Artificial Sequence
  chemically synthesized
ttggtaaatctacatattgttt

SEQ ID NO: 28564 - DNA, 22 bp, Artificial Sequence
  chemically synthesized
tggtaaatctacatattgtttt

SEQ ID NO: 28565 - DNA, 22 bp, Artificial Sequence
  chemically synthesized
ggtaaatctacatattgttttc

SEQ ID NO: 28566 - DNA, 22 bp, Artificial Sequence
  chemically synthesized
gtaaatctacatattgttttcc

SEQ ID NO: 28567 - DNA, 22 bp, Artificial Sequence
  chemically synthesized
catattgttttccatagtggct

SEQ ID NO: 28568 - DNA, 22 bp, Artificial Sequence
  chemically synthesized
ttttccatagtggctatactaa

SEQ ID NO: 28569 - DNA, 22 bp, Artificial Sequence
  chemically synthesized
tccatagtggctatactaattt

SEQ ID NO: 28570 - DNA, 22 bp, Artificial Sequence
  chemically synthesized
ccatagtggctatactaatttg

SEQ ID NO: 28571 - DNA, 22 bp, Artificial Sequence
  chemically synthesized
catagtggctatactaatttgc

SEQ ID NO: 28572 - DNA, 22 bp, Artificial Sequence
  chemically synthesized
tactaatttgcatgcttaccaa

SEQ ID NO: 28573 - DNA, 22 bp, Artificial Sequence
  chemically synthesized
atttgcatgcttaccaatagtg

SEQ ID NO: 28574 - DNA, 22 bp, Artificial Sequence
  chemically synthesized
gcatgcttaccaatagtgccta

SEQ ID NO: 28575 - DNA, 22 bp, Artificial Sequence
  chemically synthesized
catgcttaccaatagtgcctac

SEQ ID NO: 28576 - DNA, 22 bp, Artificial Sequence
  chemically synthesized
accaatagtgcctacgagtgcc

SEQ ID NO: 28577 - DNA, 22 bp, Artificial Sequence
  chemically synthesized
ccaatagtgcctacgagtgcct

SEQ ID NO: 28578 - DNA, 22 bp, Artificial Sequence
  chemically synthesized
cgagtgccttttccttcacatc

SEQ ID NO: 28579 - DNA, 22 bp, Artificial Sequence
  chemically synthesized
ttccttcacatccttgccagca

SEQ ID NO: 28580 - DNA, 22 bp, Artificial Sequence
  chemically synthesized
tccttcacatccttgccagcat

SEQ ID NO: 28581 - DNA, 22 bp, Artificial Sequence
  chemically synthesized
ccttcacatccttgccagcatg

SEQ ID NO: 28582 - DNA, 22 bp, Artificial Sequence
  chemically synthesized
cttcacatccttgccagcatgt

SEQ ID NO: 28583 - DNA, 22 bp, Artificial Sequence
  chemically synthesized
cacatccttgccagcatgtgtt

SEQ ID NO: 28584 - DNA, 22 bp, Artificial Sequence
  chemically synthesized
acatccttgccagcatgtgtta

SEQ ID NO: 28585 - DNA, 22 bp, Artificial Sequence
  chemically synthesized
gccagcatgtgttatttattta

SEQ ID NO: 28586 - DNA, 22 bp, Artificial Sequence
  chemically synthesized
ccagcatgtgttatttatttat

SEQ ID NO: 28587 - DNA, 22 bp, Artificial Sequence
  chemically synthesized
tttatttattaatttatttaaa

SEQ ID NO: 28588 - DNA, 22 bp, Artificial Sequence
  chemically synthesized
atttattaatttatttaaatca

SEQ ID NO: 28589 - DNA, 22 bp, Artificial Sequence
  chemically synthesized
tttattaatttatttaaatcat

SEQ ID NO: 28590 - DNA, 22 bp, Artificial Sequence
  chemically synthesized
attaatttatttaaatcatgat

SEQ ID NO: 28591 - DNA, 22 bp, Artificial Sequence
  chemically synthesized
ttaatttatttaaatcatgatg

SEQ ID NO: 28592 - DNA, 22 bp, Artificial Sequence
  chemically synthesized
atttatttaaatcatgatgatt

SEQ ID NO: 28593 - DNA, 22 bp, Artificial Sequence
  chemically synthesized
atttaaatcatgatgattctaa

SEQ ID NO: 28594 - DNA, 22 bp, Artificial Sequence
  chemically synthesized
tttaaatcatgatgattctaac

SEQ ID NO: 28595 - DNA, 22 bp, Artificial Sequence
  chemically synthesized
aaatcatgatgattctaactgg

SEQ ID NO: 28596 - DNA, 22 bp, Artificial Sequence
  chemically synthesized
aatcatgatgattctaactggc

SEQ ID NO: 28597 - DNA, 22 bp, Artificial Sequence
  chemically synthesized
taactggcataagatgatatct

SEQ ID NO: 28598 - DNA, 22 bp, Artificial Sequence
  chemically synthesized
actggcataagatgatatctca

SEQ ID NO: 28599 - DNA, 22 bp, Artificial Sequence
  chemically synthesized
gcataagatgatatctcattgt

SEQ ID NO: 28600 - DNA, 22 bp, Artificial Sequence
  chemically synthesized
attgtggttttgatttgcattt

SEQ ID NO: 28601 - DNA, 22 bp, Artificial Sequence
  chemically synthesized
tggttttgatttgcatttctct

SEQ ID NO: 28602 - DNA, 22 bp, Artificial Sequence
  chemically synthesized
tgatttgcatttctctgatgat

SEQ ID NO: 28603 - DNA, 22 bp, Artificial Sequence
  chemically synthesized
gatttgcatttctctgatgatt

SEQ ID NO: 28604 - DNA, 22 bp, Artificial Sequence
  chemically synthesized
atttgcatttctctgatgatta

SEQ ID NO: 28605 - DNA, 22 bp, Artificial Sequence
  chemically synthesized
gcatttctctgatgattagtaa

SEQ ID NO: 28606 - DNA, 22 bp, Artificial Sequence
  chemically synthesized
catttctctgatgattagtaat

SEQ ID NO: 28607 - DNA, 22 bp, Artificial Sequence
  chemically synthesized
ctctgatgattagtaatgttga

SEQ ID NO: 28608 - DNA, 22 bp, Artificial Sequence
  chemically synthesized
tctgatgattagtaatgttgag

SEQ ID NO: 28609 - DNA, 22 bp, Artificial Sequence
  chemically synthesized
tgatgattagtaatgttgagca

SEQ ID NO: 28610 - DNA, 22 bp, Artificial Sequence
  chemically synthesized
atgattagtaatgttgagcaat

SEQ ID NO: 28611 - DNA, 22 bp, Artificial Sequence
  chemically synthesized
gtaatgttgagcaatttcccca

SEQ ID NO: 28612 - DNA, 22 bp, Artificial Sequence
  chemically synthesized
agcaatttccccatacccattg

SEQ ID NO: 28613 - DNA, 22 bp, Artificial Sequence
  chemically synthesized
ccccatacccattgtgcatttg

SEQ ID NO: 28614 - DNA, 22 bp, Artificial Sequence
  chemically synthesized
cccatacccattgtgcatttgt

SEQ ID NO: 28615 - DNA, 22 bp, Artificial Sequence
  chemically synthesized
tgcatttgtatgtcttcttttg

SEQ ID NO: 28616 - DNA, 22 bp, Artificial Sequence
  chemically synthesized
gtatgtcttcttttgaaaaata

SEQ ID NO: 28617 - DNA, 22 bp, Artificial Sequence
  chemically synthesized
tatgtcttcttttgaaaaatat

SEQ ID NO: 28618 - DNA, 22 bp, Artificial Sequence
  chemically synthesized
cttttgaaaaatatcctttgcc

SEQ ID NO: 28619 - DNA, 22 bp, Artificial Sequence
  chemically synthesized
ttttgaaaaatatcctttgcca

SEQ ID NO: 28620 - DNA, 22 bp, Artificial Sequence
  chemically synthesized
ttgaaaaatatcctttgccaat

SEQ ID NO: 28621 - DNA, 22 bp, Artificial Sequence
  chemically synthesized
tgaaaaatatcctttgccaatt

SEQ ID NO: 28622 - DNA, 22 bp, Artificial Sequence
  chemically synthesized
gaaaaatatcctttgccaattt

SEQ ID NO: 28623 - DNA, 22 bp, Artificial Sequence
  chemically synthesized
aaaaatatcctttgccaatttt

SEQ ID NO: 28624 - DNA, 22 bp, Artificial Sequence
  chemically synthesized
tgccaattttttaatgagatta

SEQ ID NO: 28625 - DNA, 22 bp, Artificial Sequence
  chemically synthesized
gccaattttttaatgagattat

SEQ ID NO: 28626 - DNA, 22 bp, Artificial Sequence
  chemically synthesized
ccaattttttaatgagattatt

SEQ ID NO: 28627 - DNA, 22 bp, Artificial Sequence
  chemically synthesized
tttaatgagattatttgttttt

SEQ ID NO: 28628 - DNA, 22 bp, Artificial Sequence
  chemically synthesized
ttaatgagattatttgtttttc

SEQ ID NO: 28629 - DNA, 22 bp, Artificial Sequence
  chemically synthesized
taatgagattatttgtttttcc

SEQ ID NO: 28630 - DNA, 22 bp, Artificial Sequence
  chemically synthesized
aatgagattatttgtttttcca

SEQ ID NO: 28631 - DNA, 22 bp, Artificial Sequence
  chemically synthesized
atgagattatttgtttttccac

SEQ ID NO: 28632 - DNA, 22 bp, Artificial Sequence
  chemically synthesized
tttgtttttccactgttgagtt

SEQ ID NO: 28633 - DNA, 22 bp, Artificial Sequence
  chemically synthesized
gtttttccactgttgagttgtt

SEQ ID NO: 28634 - DNA, 22 bp, Artificial Sequence
  chemically synthesized
tttttccactgttgagttgttt

SEQ ID NO: 28635 - DNA, 22 bp, Artificial Sequence
  chemically synthesized
ttccactgttgagttgtttgag

SEQ ID NO: 28636 - DNA, 22 bp, Artificial Sequence
  chemically synthesized
tccactgttgagttgtttgagt

SEQ ID NO: 28637 - DNA, 22 bp, Artificial Sequence
  chemically synthesized
ccactgttgagttgtttgagtt

SEQ ID NO: 28638 - DNA, 22 bp, Artificial Sequence
  chemically synthesized
cactgttgagttgtttgagttt

SEQ ID NO: 28639 - DNA, 22 bp, Artificial Sequence
  chemically synthesized
ttgagttgtttgagtttcttat

SEQ ID NO: 28640 - DNA, 22 bp, Artificial Sequence
  chemically synthesized
agttgtttgagtttcttatata

SEQ ID NO: 28641 - DNA, 22 bp, Artificial Sequence
  chemically synthesized
tttgagtttcttatatattctg

SEQ ID NO: 28642 - DNA, 22 bp, Artificial Sequence
  chemically synthesized
gagtttcttatatattctggag

SEQ ID NO: 28643 - DNA, 22 bp, Artificial Sequence
  chemically synthesized
agtttcttatatattctggaga

SEQ ID NO: 28644 - DNA, 22 bp, Artificial Sequence
  chemically synthesized
cttatatattctggagattaat

SEQ ID NO: 28645 - DNA, 22 bp, Artificial Sequence
  chemically synthesized
ttatatattctggagattaatt

SEQ ID NO: 28646 - DNA, 22 bp, Artificial Sequence
  chemically synthesized
atatattctggagattaattcc

SEQ ID NO: 28647 - DNA, 22 bp, Artificial Sequence
  chemically synthesized
tatattctggagattaattcct

SEQ ID NO: 28648 - DNA, 22 bp, Artificial Sequence
  chemically synthesized
tggagattaattccttgtcaaa

SEQ ID NO: 28649 - DNA, 22 bp, Artificial Sequence
  chemically synthesized
gagattaattccttgtcaaatg

SEQ ID NO: 28650 - DNA, 22 bp, Artificial Sequence
  chemically synthesized
attccttgtcaaatgtatgcaa

SEQ ID NO: 28651 - DNA, 22 bp, Artificial Sequence
  chemically synthesized
cttgtcaaatgtatgcaaatat

SEQ ID NO: 28652 - DNA, 22 bp, Artificial Sequence
  chemically synthesized
gtcaaatgtatgcaaatatttt

SEQ ID NO: 28653 - DNA, 22 bp, Artificial Sequence
  chemically synthesized
tcaaatgtatgcaaatattttc

SEQ ID NO: 28654 - DNA, 22 bp, Artificial Sequence
  chemically synthesized
tctcgcattcaacagcttgtct

SEQ ID NO: 28655 - DNA, 22 bp, Artificial Sequence
  chemically synthesized
ctcgcattcaacagcttgtctc

SEQ ID NO: 28656 - DNA, 22 bp, Artificial Sequence
  chemically synthesized
tcgcattcaacagcttgtctct

SEQ ID NO: 28657 - DNA, 22 bp, Artificial Sequence
  chemically synthesized
gcattcaacagcttgtctcttc

SEQ ID NO: 28658 - DNA, 22 bp, Artificial Sequence
  chemically synthesized
aacagcttgtctcttcactgtg

SEQ ID NO: 28659 - DNA, 22 bp, Artificial Sequence
  chemically synthesized
gtctcttcactgtgttgattgt

SEQ ID NO: 28660 - DNA, 22 bp, Artificial Sequence
  chemically synthesized
tctcttcactgtgttgattgtt

SEQ ID NO: 28661 - DNA, 22 bp, Artificial Sequence
  chemically synthesized
ttcactgtgttgattgtttcct

SEQ ID NO: 28662 - DNA, 22 bp, Artificial Sequence
  chemically synthesized
cactgtgttgattgtttccttt

SEQ ID NO: 28663 - DNA, 22 bp, Artificial Sequence
  chemically synthesized
actgtgttgattgtttccttta

SEQ ID NO: 28664 - DNA, 22 bp, Artificial Sequence
  chemically synthesized
tgttgattgtttcctttactgt

SEQ ID NO: 28665 - DNA, 22 bp, Artificial Sequence
  chemically synthesized
attgtttcctttactgtgcaga

SEQ ID NO: 28666 - DNA, 22 bp, Artificial Sequence
  chemically synthesized
tttcctttactgtgcagatgta

SEQ ID NO: 28667 - DNA, 22 bp, Artificial Sequence
  chemically synthesized
cctttactgtgcagatgtattt

SEQ ID NO: 28668 - DNA, 22 bp, Artificial Sequence
  chemically synthesized
ctttactgtgcagatgtatttt

SEQ ID NO: 28669 - DNA, 22 bp, Artificial Sequence
  chemically synthesized
tactgtgcagatgtattttagc

SEQ ID NO: 28670 - DNA, 22 bp, Artificial Sequence
  chemically synthesized
actgtgcagatgtattttagct

SEQ ID NO: 28671 - DNA, 22 bp, Artificial Sequence
  chemically synthesized
ctgtgcagatgtattttagctt

SEQ ID NO: 28672 - DNA, 22 bp, Artificial Sequence
  chemically synthesized
tgcagatgtattttagcttaat

SEQ ID NO: 28673 - DNA, 22 bp, Artificial Sequence
  chemically synthesized
tagcttaatatagtcccatttg

SEQ ID NO: 28674 - DNA, 22 bp, Artificial Sequence
  chemically synthesized
agcttaatatagtcccatttgt

SEQ ID NO: 28675 - DNA, 22 bp, Artificial Sequence
  chemically synthesized
gcttaatatagtcccatttgtc

SEQ ID NO: 28676 - DNA, 22 bp, Artificial Sequence
  chemically synthesized
aatatagtcccatttgtctatt

SEQ ID NO: 28677 - DNA, 22 bp, Artificial Sequence
  chemically synthesized
atatagtcccatttgtctattt

SEQ ID NO: 28678 - DNA, 22 bp, Artificial Sequence
  chemically synthesized
gtctatttttgcttttgttgcc

SEQ ID NO: 28679 - DNA, 22 bp, Artificial Sequence
  chemically synthesized
tctatttttgcttttgttgcct

SEQ ID NO: 28680 - DNA, 22 bp, Artificial Sequence
  chemically synthesized
tttttgcttttgttgcctgtgc

SEQ ID NO: 28681 - DNA, 22 bp, Artificial Sequence
  chemically synthesized
ttgcttttgttgcctgtgcttt

SEQ ID NO: 28682 - DNA, 22 bp, Artificial Sequence
  chemically synthesized
tgcttttgttgcctgtgctttt

SEQ ID NO: 28683 - DNA, 22 bp, Artificial Sequence
  chemically synthesized
gcttttgttgcctgtgcttttg

SEQ ID NO: 28684 - DNA, 22 bp, Artificial Sequence
  chemically synthesized
cttttgttgcctgtgcttttga

SEQ ID NO: 28685 - DNA, 22 bp, Artificial Sequence
  chemically synthesized
ttgttgcctgtgcttttgaggt

SEQ ID NO: 28686 - DNA, 22 bp, Artificial Sequence
  chemically synthesized
tgttgcctgtgcttttgaggtc

SEQ ID NO: 28687 - DNA, 22 bp, Artificial Sequence
  chemically synthesized
gttgcctgtgcttttgaggtct

SEQ ID NO: 28688 - DNA, 22 bp, Artificial Sequence
  chemically synthesized
ttgcctgtgcttttgaggtctt

SEQ ID NO: 28689 - DNA, 22 bp, Artificial Sequence
  chemically synthesized
cctgtgcttttgaggtcttggc

SEQ ID NO: 28690 - DNA, 22 bp, Artificial Sequence
  chemically synthesized
tgcttttgaggtcttggccata

SEQ ID NO: 28691 - DNA, 22 bp, Artificial Sequence
  chemically synthesized
ttgaggtcttggccataaaatc

SEQ ID NO: 28692 - DNA, 22 bp, Artificial Sequence
  chemically synthesized
tgaggtcttggccataaaatct

SEQ ID NO: 28693 - DNA, 22 bp, Artificial Sequence
  chemically synthesized
gaggtcttggccataaaatctt

SEQ ID NO: 28694 - DNA, 22 bp, Artificial Sequence
  chemically synthesized
aggtcttggccataaaatcttt

SEQ ID NO: 28695 - DNA, 22 bp, Artificial Sequence
  chemically synthesized
ggccataaaatctttgcccaaa

SEQ ID NO: 28696 - DNA, 22 bp, Artificial Sequence
  chemically synthesized
gccataaaatctttgcccaaag

SEQ ID NO: 28697 - DNA, 22 bp, Artificial Sequence
  chemically synthesized
tgcccaaagccatgtcttgaag

SEQ ID NO: 28698 - DNA, 22 bp, Artificial Sequence
  chemically synthesized
gcccaaagccatgtcttgaagt

SEQ ID NO: 28699 - DNA, 22 bp, Artificial Sequence
  chemically synthesized
cccaaagccatgtcttgaagtg

SEQ ID NO: 28700 - DNA, 22 bp, Artificial Sequence
  chemically synthesized
gaagtgtctcccttatgttttc

SEQ ID NO: 28701 - DNA, 22 bp, Artificial Sequence
  chemically synthesized
aagtgtctcccttatgttttct

SEQ ID NO: 28702 - DNA, 22 bp, Artificial Sequence
  chemically synthesized
ccttatgttttcttttagtagt

SEQ ID NO: 28703 - DNA, 22 bp, Artificial Sequence
  chemically synthesized
atgttttcttttagtagtttta

SEQ ID NO: 28704 - DNA, 22 bp, Artificial Sequence
  chemically synthesized
tgttttcttttagtagttttat

SEQ ID NO: 28705 - DNA, 22 bp, Artificial Sequence
  chemically synthesized
tcttttagtagttttatagttt

SEQ ID NO: 28706 - DNA, 22 bp, Artificial Sequence
  chemically synthesized
cttttagtagttttatagtttt

SEQ ID NO: 28707 - DNA, 22 bp, Artificial Sequence
  chemically synthesized
ttttagtagttttatagtttta

SEQ ID NO: 28708 - DNA, 22 bp, Artificial Sequence
  chemically synthesized
ttagtagttttatagttttaag

SEQ ID NO: 28709 - DNA, 22 bp, Artificial Sequence
  chemically synthesized
tagtagttttatagttttaagt

SEQ ID NO: 28710 - DNA, 22 bp, Artificial Sequence
  chemically synthesized
agtagttttatagttttaagtt

SEQ ID NO: 28711 - DNA, 22 bp, Artificial Sequence
  chemically synthesized
gtagttttatagttttaagttt

SEQ ID NO: 28712 - DNA, 22 bp, Artificial Sequence
  chemically synthesized
tatagttttaagttttatattt

SEQ ID NO: 28713 - DNA, 22 bp, Artificial Sequence
  chemically synthesized
atagttttaagttttatattta

SEQ ID NO: 28714 - DNA, 22 bp, Artificial Sequence
  chemically synthesized
tagttttaagttttatatttaa

SEQ ID NO: 28715 - DNA, 22 bp, Artificial Sequence
  chemically synthesized
taagttttatatttaagtcttt

SEQ ID NO: 28716 - DNA, 22 bp, Artificial Sequence
  chemically synthesized
aagttttatatttaagtcttta

SEQ ID NO: 28717 - DNA, 22 bp, Artificial Sequence
  chemically synthesized
agttttatatttaagtctttaa

SEQ ID NO: 28718 - DNA, 22 bp, Artificial Sequence
  chemically synthesized
tatatttaagtctttaatccat

SEQ ID NO: 28719 - DNA, 22 bp, Artificial Sequence
  chemically synthesized
atatttaagtctttaatccatc

SEQ ID NO: 28720 - DNA, 22 bp, Artificial Sequence
  chemically synthesized
tatttaagtctttaatccatct

SEQ ID NO: 28721 - DNA, 22 bp, Artificial Sequence
  chemically synthesized
aagtctttaatccatcttgaga

SEQ ID NO: 28722 - DNA, 22 bp, Artificial Sequence
  chemically synthesized
agtctttaatccatcttgagag

SEQ ID NO: 28723 - DNA, 22 bp, Artificial Sequence
  chemically synthesized
taatccatcttgagagtacgtt

SEQ ID NO: 28724 - DNA, 22 bp, Artificial Sequence
  chemically synthesized
aatccatcttgagagtacgttt

SEQ ID NO: 28725 - DNA, 22 bp, Artificial Sequence
  chemically synthesized
atccatcttgagagtacgtttt

SEQ ID NO: 28726 - DNA, 22 bp, Artificial Sequence
  chemically synthesized
gagagtacgttttatatggcaa

SEQ ID NO: 28727 - DNA, 22 bp, Artificial Sequence
  chemically synthesized
agagtacgttttatatggcaat

SEQ ID NO: 28728 - DNA, 22 bp, Artificial Sequence
  chemically synthesized
tatatggcaataaataggggtt

SEQ ID NO: 28729 - DNA, 22 bp, Artificial Sequence
  chemically synthesized
atatggcaataaataggggttg

SEQ ID NO: 28730 - DNA, 22 bp, Artificial Sequence
  chemically synthesized
tatggcaataaataggggttgt

SEQ ID NO: 28731 - DNA, 22 bp, Artificial Sequence
  chemically synthesized
tattaggccatttttgcatcta

SEQ ID NO: 28732 - DNA, 22 bp, Artificial Sequence
  chemically synthesized
ggccatttttgcatctattgta

SEQ ID NO: 28733 - DNA, 22 bp, Artificial Sequence
  chemically synthesized
ttgcatctattgtacaaggggt

SEQ ID NO: 28734 - DNA, 22 bp, Artificial Sequence
  chemically synthesized
tgcatctattgtacaaggggtt

SEQ ID NO: 28735 - DNA, 22 bp, Artificial Sequence
  chemically synthesized
gcatctattgtacaaggggttg

SEQ ID NO: 28736 - DNA, 22 bp, Artificial Sequence
  chemically synthesized
catctattgtacaaggggttga

SEQ ID NO: 28737 - DNA, 22 bp, Artificial Sequence
  chemically synthesized
ttgtacaaggggttgagttctt

SEQ ID NO: 28738 - DNA, 22 bp, Artificial Sequence
  chemically synthesized
tacaaggggttgagttcttgat

SEQ ID NO: 28739 - DNA, 22 bp, Artificial Sequence
  chemically synthesized
agttcttgatttgattctccat

SEQ ID NO: 28740 - DNA, 22 bp, Artificial Sequence
  chemically synthesized
ttgatttgattctccatttggt

SEQ ID NO: 28741 - DNA, 22 bp, Artificial Sequence
  chemically synthesized
gatttgattctccatttggttg

SEQ ID NO: 28742 - DNA, 22 bp, Artificial Sequence
  chemically synthesized
atttgattctccatttggttgc

SEQ ID NO: 28743 - DNA, 22 bp, Artificial Sequence
  chemically synthesized
gattctccatttggttgctgtt

SEQ ID NO: 28744 - DNA, 22 bp, Artificial Sequence
  chemically synthesized
attctccatttggttgctgttg

SEQ ID NO: 28745 - DNA, 22 bp, Artificial Sequence
  chemically synthesized
tccatttggttgctgttggtgt

SEQ ID NO: 28746 - DNA, 22 bp, Artificial Sequence
  chemically synthesized
catttggttgctgttggtgtat

SEQ ID NO: 28747 - DNA, 22 bp, Artificial Sequence
  chemically synthesized
ggttgctgttggtgtatagaag

SEQ ID NO: 28748 - DNA, 22 bp, Artificial Sequence
  chemically synthesized
gttgctgttggtgtatagaaga

SEQ ID NO: 28749 - DNA, 22 bp, Artificial Sequence
  chemically synthesized
ctgttggtgtatagaagagtta

SEQ ID NO: 28750 - DNA, 22 bp, Artificial Sequence
  chemically synthesized
ttggtgtatagaagagttactg

SEQ ID NO: 28751 - DNA, 22 bp, Artificial Sequence
  chemically synthesized
gtgtatagaagagttactgatt

SEQ ID NO: 28752 - DNA, 22 bp, Artificial Sequence
  chemically synthesized
ctgatttgtgtgcattcatctt

SEQ ID NO: 28753 - DNA, 22 bp, Artificial Sequence
  chemically synthesized
atttgtgtgcattcatcttgta

SEQ ID NO: 28754 - DNA, 22 bp, Artificial Sequence
  chemically synthesized
gtgtgcattcatcttgtatctg

SEQ ID NO: 28755 - DNA, 22 bp, Artificial Sequence
  chemically synthesized
tgtgcattcatcttgtatctgg

SEQ ID NO: 28756 - DNA, 22 bp, Artificial Sequence
  chemically synthesized
atcttgtatctggaaactttgc

SEQ ID NO: 28757 - DNA, 22 bp, Artificial Sequence
  chemically synthesized
gtatctggaaactttgctgaat

SEQ ID NO: 28758 - DNA, 22 bp, Artificial Sequence
  chemically synthesized
tatctggaaactttgctgaatt

SEQ ID NO: 28759 - DNA, 22 bp, Artificial Sequence
  chemically synthesized
gaaactttgctgaattatttta

SEQ ID NO: 28760 - DNA, 22 bp, Artificial Sequence
  chemically synthesized
tgctgaattattttatcagttc

SEQ ID NO: 28761 - DNA, 22 bp, Artificial Sequence
  chemically synthesized
gctgaattattttatcagttct

SEQ ID NO: 28762 - DNA, 22 bp, Artificial Sequence
  chemically synthesized
ctgaattattttatcagttcta

SEQ ID NO: 28763 - DNA, 22 bp, Artificial Sequence
  chemically synthesized
aattattttatcagttctagga

SEQ ID NO: 28764 - DNA, 22 bp, Artificial Sequence
  chemically synthesized
ttttatcagttctaggagcttt

SEQ ID NO: 28765 - DNA, 22 bp, Artificial Sequence
  chemically synthesized
tatcagttctaggagctttctg

SEQ ID NO: 28766 - DNA, 22 bp, Artificial Sequence
  chemically synthesized
atcagttctaggagctttctgg

SEQ ID NO: 28767 - DNA, 22 bp, Artificial Sequence
  chemically synthesized
tcagttctaggagctttctgga

SEQ ID NO: 28768 - DNA, 22 bp, Artificial Sequence
  chemically synthesized
taggagctttctggaggagtct

SEQ ID NO: 28769 - DNA, 22 bp, Artificial Sequence
  chemically synthesized
ggagctttctggaggagtcttt

SEQ ID NO: 28770 - DNA, 22 bp, Artificial Sequence
  chemically synthesized
tctggaggagtctttagggttt

SEQ ID NO: 28771 - DNA, 22 bp, Artificial Sequence
  chemically synthesized
ctggaggagtctttagggtttt

SEQ ID NO: 28772 - DNA, 22 bp, Artificial Sequence
  chemically synthesized
tggaggagtctttagggtttta

SEQ ID NO: 28773 - DNA, 22 bp, Artificial Sequence
  chemically synthesized
gaggagtctttagggttttaaa

SEQ ID NO: 28774 - DNA, 22 bp, Artificial Sequence
  chemically synthesized
tagggttttaaaggtaaatgat

SEQ ID NO: 28775 - DNA, 22 bp, Artificial Sequence
  chemically synthesized
agggttttaaaggtaaatgatc

SEQ ID NO: 28776 - DNA, 22 bp, Artificial Sequence
  chemically synthesized
gggttttaaaggtaaatgatca

SEQ ID NO: 28777 - DNA, 22 bp, Artificial Sequence
  chemically synthesized
taaaggtaaatgatcatatcat

SEQ ID NO: 28778 - DNA, 22 bp, Artificial Sequence
  chemically synthesized
aaaggtaaatgatcatatcatc

SEQ ID NO: 28779 - DNA, 22 bp, Artificial Sequence
  chemically synthesized
aaggtaaatgatcatatcatca

SEQ ID NO: 28780 - DNA, 22 bp, Artificial Sequence
  chemically synthesized
gacttcctctttactgatttga

SEQ ID NO: 28781 - DNA, 22 bp, Artificial Sequence
  chemically synthesized
acttcctctttactgatttgaa

SEQ ID NO: 28782 - DNA, 22 bp, Artificial Sequence
  chemically synthesized
cctctttactgatttgaatgcc

SEQ ID NO: 28783 - DNA, 22 bp, Artificial Sequence
  chemically synthesized
ctctttactgatttgaatgccc

SEQ ID NO: 28784 - DNA, 22 bp, Artificial Sequence
  chemically synthesized
tttactgatttgaatgcccttt

SEQ ID NO: 28785 - DNA, 22 bp, Artificial Sequence
  chemically synthesized
tactgatttgaatgccctttat

SEQ ID NO: 28786 - DNA, 22 bp, Artificial Sequence
  chemically synthesized
actgatttgaatgccctttatt

SEQ ID NO: 28787 - DNA, 22 bp, Artificial Sequence
  chemically synthesized
ctgatttgaatgccctttattt

SEQ ID NO: 28788 - DNA, 22 bp, Artificial Sequence
  chemically synthesized
atttgaatgccctttatttctt

SEQ ID NO: 28789 - DNA, 22 bp, Artificial Sequence
  chemically synthesized
gaatgccctttatttctttgtt

SEQ ID NO: 28790 - DNA, 22 bp, Artificial Sequence
  chemically synthesized
aatgccctttatttctttgttt

SEQ ID NO: 28791 - DNA, 22 bp, Artificial Sequence
  chemically synthesized
tatttctttgttttgtctgatt

SEQ ID NO: 28792 - DNA, 22 bp, Artificial Sequence
  chemically synthesized
atttctttgttttgtctgattg

SEQ ID NO: 28793 - DNA, 22 bp, Artificial Sequence
  chemically synthesized
tttctttgttttgtctgattgc

SEQ ID NO: 28794 - DNA, 22 bp, Artificial Sequence
  chemically synthesized
ctttgttttgtctgattgccct

SEQ ID NO: 28795 - DNA, 22 bp, Artificial Sequence
  chemically synthesized
tttgttttgtctgattgccctg

SEQ ID NO: 28796 - DNA, 22 bp, Artificial Sequence
  chemically synthesized
tgttttgtctgattgccctggc

SEQ ID NO: 28797 - DNA, 22 bp, Artificial Sequence
  chemically synthesized
gttttgtctgattgccctggct

SEQ ID NO: 28798 - DNA, 22 bp, Artificial Sequence
  chemically synthesized
ttttgtctgattgccctggcta

SEQ ID NO: 28799 - DNA, 22 bp, Artificial Sequence
  chemically synthesized
tgtctgattgccctggctagga

SEQ ID NO: 28800 - DNA, 22 bp, Artificial Sequence
  chemically synthesized
gtctgattgccctggctaggac

SEQ ID NO: 28801 - DNA, 22 bp, Artificial Sequence
  chemically synthesized
tctgattgccctggctaggact

SEQ ID NO: 28802 - DNA, 22 bp, Artificial Sequence
  chemically synthesized
attgccctggctaggacttcca

SEQ ID NO: 28803 - DNA, 22 bp, Artificial Sequence
  chemically synthesized
ccctggctaggacttccagtac

SEQ ID NO: 28804 - DNA, 22 bp, Artificial Sequence
  chemically synthesized
gctaggacttccagtactatgt

SEQ ID NO: 28805 - DNA, 22 bp, Artificial Sequence
  chemically synthesized
ggacttccagtactatgttgaa

SEQ ID NO: 28806 - DNA, 22 bp, Artificial Sequence
  chemically synthesized
ccagtactatgttgaagaggag

SEQ ID NO: 28807 - DNA, 22 bp, Artificial Sequence
  chemically synthesized
cagtactatgttgaagaggagt

SEQ ID NO: 28808 - DNA, 22 bp, Artificial Sequence
  chemically synthesized
tgttgaagaggagtggtgagag

SEQ ID NO: 28809 - DNA, 22 bp, Artificial Sequence
  chemically synthesized
aagaggagtggtgagagtgggc

SEQ ID NO: 28810 - DNA, 22 bp, Artificial Sequence
  chemically synthesized
gtcttgttccagttctcagagg

SEQ ID NO: 28811 - DNA, 22 bp, Artificial Sequence
  chemically synthesized
tcttgttccagttctcagaggg

SEQ ID NO: 28812 - DNA, 22 bp, Artificial Sequence
  chemically synthesized
gttccagttctcagagggaatg

SEQ ID NO: 28813 - DNA, 22 bp, Artificial Sequence
  chemically synthesized
ttccagttctcagagggaatgc

SEQ ID NO: 28814 - DNA, 22 bp, Artificial Sequence
  chemically synthesized
cagttctcagagggaatgcttt

SEQ ID NO: 28815 - DNA, 22 bp, Artificial Sequence
  chemically synthesized
tcagagggaatgctttcaactt

SEQ ID NO: 28816 - DNA, 22 bp, Artificial Sequence
  chemically synthesized
agagggaatgctttcaactttt

SEQ ID NO: 28817 - DNA, 22 bp, Artificial Sequence
  chemically synthesized
tcaacttttccccattcaatat

SEQ ID NO: 28818 - DNA, 22 bp, Artificial Sequence
  chemically synthesized
caacttttccccattcaatatt

SEQ ID NO: 28819 - DNA, 22 bp, Artificial Sequence
  chemically synthesized
aacttttccccattcaatatta

SEQ ID NO: 28820 - DNA, 22 bp, Artificial Sequence
  chemically synthesized
ttccccattcaatattatgttg

SEQ ID NO: 28821 - DNA, 22 bp, Artificial Sequence
  chemically synthesized
tccccattcaatattatgttgg

SEQ ID NO: 28822 - DNA, 22 bp, Artificial Sequence
  chemically synthesized
ccccattcaatattatgttggc

SEQ ID NO: 28823 - DNA, 22 bp, Artificial Sequence
  chemically synthesized
cccattcaatattatgttggct

SEQ ID NO: 28824 - DNA, 22 bp, Artificial Sequence
  chemically synthesized
aatattatgttggctgtgggtt

SEQ ID NO: 28825 - DNA, 22 bp, Artificial Sequence
  chemically synthesized
tgttggctgtgggtttgtcaca

SEQ ID NO: 28826 - DNA, 22 bp, Artificial Sequence
  chemically synthesized
gctgtgggtttgtcacagatgg

SEQ ID NO: 28827 - DNA, 22 bp, Artificial Sequence
  chemically synthesized
tgggtttgtcacagatggcttt

SEQ ID NO: 28828 - DNA, 22 bp, Artificial Sequence
  chemically synthesized
gtcacagatggcttttattaca

SEQ ID NO: 28829 - DNA, 22 bp, Artificial Sequence
  chemically synthesized
tcacagatggcttttattacac

SEQ ID NO: 28830 - DNA, 22 bp, Artificial Sequence
  chemically synthesized
ttattacactgaggtatgtctc

SEQ ID NO: 28831 - DNA, 22 bp, Artificial Sequence
  chemically synthesized
tattacactgaggtatgtctct

SEQ ID NO: 28832 - DNA, 22 bp, Artificial Sequence
  chemically synthesized
attacactgaggtatgtctctt

SEQ ID NO: 28833 - DNA, 22 bp, Artificial Sequence
  chemically synthesized
ttacactgaggtatgtctcttg

SEQ ID NO: 28834 - DNA, 22 bp, Artificial Sequence
  chemically synthesized
cactgaggtatgtctcttgtat

SEQ ID NO: 28835 - DNA, 22 bp, Artificial Sequence
  chemically synthesized
aggtatgtctcttgtatgctga

SEQ ID NO: 28836 - DNA, 22 bp, Artificial Sequence
  chemically synthesized
ttgtatgctgattttgctgagc

SEQ ID NO: 28837 - DNA, 22 bp, Artificial Sequence
  chemically synthesized
gtatgctgattttgctgagcat

SEQ ID NO: 28838 - DNA, 22 bp, Artificial Sequence
  chemically synthesized
tatgctgattttgctgagcatt

SEQ ID NO: 28839 - DNA, 22 bp, Artificial Sequence
  chemically synthesized
attttgctgagcattttaatca

SEQ ID NO: 28840 - DNA, 22 bp, Artificial Sequence
  chemically synthesized
tgctgagcattttaatcataaa

SEQ ID NO: 28841 - DNA, 22 bp, Artificial Sequence
  chemically synthesized
gctgagcattttaatcataaat

SEQ ID NO: 28842 - DNA, 22 bp, Artificial Sequence
  chemically synthesized
ctgagcattttaatcataaatg

SEQ ID NO: 28843 - DNA, 22 bp, Artificial Sequence
  chemically synthesized
agcattttaatcataaatgtat

SEQ ID NO: 28844 - DNA, 22 bp, Artificial Sequence
  chemically synthesized
taatcataaatgtatgctggat

SEQ ID NO: 28845 - DNA, 22 bp, Artificial Sequence
  chemically synthesized
aatcataaatgtatgctggatt

SEQ ID NO: 28846 - DNA, 22 bp, Artificial Sequence
  chemically synthesized
atcataaatgtatgctggattt

SEQ ID NO: 28847 - DNA, 22 bp, Artificial Sequence
  chemically synthesized
gattttgttgaatgctttttct

SEQ ID NO: 28848 - DNA, 22 bp, Artificial Sequence
  chemically synthesized
tgttgaatgctttttctgcatc

SEQ ID NO: 28849 - DNA, 22 bp, Artificial Sequence
  chemically synthesized
gttgaatgctttttctgcatct

SEQ ID NO: 28850 - DNA, 22 bp, Artificial Sequence
  chemically synthesized
ttgaatgctttttctgcatcta

SEQ ID NO: 28851 - DNA, 22 bp, Artificial Sequence
  chemically synthesized
aatgctttttctgcatctattg

SEQ ID NO: 28852 - DNA, 22 bp, Artificial Sequence
  chemically synthesized
tttctgcatctattgagatgat

SEQ ID NO: 28853 - DNA, 22 bp, Artificial Sequence
  chemically synthesized
ttctgcatctattgagatgatc

SEQ ID NO: 28854 - DNA, 22 bp, Artificial Sequence
  chemically synthesized
tctgcatctattgagatgatca

SEQ ID NO: 28855 - DNA, 22 bp, Artificial Sequence
  chemically synthesized
ctgcatctattgagatgatcat

SEQ ID NO: 28856 - DNA, 22 bp, Artificial Sequence
  chemically synthesized
tgcatctattgagatgatcatg

SEQ ID NO: 28857 - DNA, 22 bp, Artificial Sequence
  chemically synthesized
catctattgagatgatcatgta

SEQ ID NO: 28858 - DNA, 22 bp, Artificial Sequence
  chemically synthesized
ttgagatgatcatgtaattttt

SEQ ID NO: 28859 - DNA, 22 bp, Artificial Sequence
  chemically synthesized
agatgatcatgtaatttttgtt

SEQ ID NO: 28860 - DNA, 22 bp, Artificial Sequence
  chemically synthesized
ttgtttttaaatctgtttatgt

SEQ ID NO: 28861 - DNA, 22 bp, Artificial Sequence
  chemically synthesized
tgtttttaaatctgtttatgtg

SEQ ID NO: 28862 - DNA, 22 bp, Artificial Sequence
  chemically synthesized
gtttttaaatctgtttatgtgg

SEQ ID NO: 28863 - DNA, 22 bp, Artificial Sequence
  chemically synthesized
tttttaaatctgtttatgtggt

SEQ ID NO: 28864 - DNA, 22 bp, Artificial Sequence
  chemically synthesized
ttaaatctgtttatgtggtgta

SEQ ID NO: 28865 - DNA, 22 bp, Artificial Sequence
  chemically synthesized
taaatctgtttatgtggtgtat

SEQ ID NO: 28866 - DNA, 22 bp, Artificial Sequence
  chemically synthesized
aaatctgtttatgtggtgtatc

SEQ ID NO: 28867 - DNA, 22 bp, Artificial Sequence
  chemically synthesized
aatctgtttatgtggtgtatca

SEQ ID NO: 28868 - DNA, 22 bp, Artificial Sequence
  chemically synthesized
tttatgtggtgtatcacactta

SEQ ID NO: 28869 - DNA, 22 bp, Artificial Sequence
  chemically synthesized
atgtggtgtatcacacttattg

SEQ ID NO: 28870 - DNA, 22 bp, Artificial Sequence
  chemically synthesized
tgtggtgtatcacacttattga

SEQ ID NO: 28871 - DNA, 22 bp, Artificial Sequence
  chemically synthesized
attgacttgcagatgtcaaacc

SEQ ID NO: 28872 - DNA, 22 bp, Artificial Sequence
  chemically synthesized
ttgacttgcagatgtcaaacca

SEQ ID NO: 28873 - DNA, 22 bp, Artificial Sequence
  chemically synthesized
acttgcagatgtcaaaccaacc

SEQ ID NO: 28874 - DNA, 22 bp, Artificial Sequence
  chemically synthesized
gcagatgtcaaaccaaccctgc

SEQ ID NO: 28875 - DNA, 22 bp, Artificial Sequence
  chemically synthesized
cagatgtcaaaccaaccctgca

SEQ ID NO: 28876 - DNA, 22 bp, Artificial Sequence
  chemically synthesized
catccctggcatggaacctgct

SEQ ID NO: 28877 - DNA, 22 bp, Artificial Sequence
  chemically synthesized
gcatggaacctgcttgatcatg

SEQ ID NO: 28878 - DNA, 22 bp, Artificial Sequence
  chemically synthesized
cttgatcatggtggattatctt

SEQ ID NO: 28879 - DNA, 22 bp, Artificial Sequence
  chemically synthesized
gatcatggtggattatcttttt

SEQ ID NO: 28880 - DNA, 22 bp, Artificial Sequence
  chemically synthesized
atcatggtggattatctttttg

SEQ ID NO: 28881 - DNA, 22 bp, Artificial Sequence
  chemically synthesized
tctttttgttatgttgttgaat

SEQ ID NO: 28882 - DNA, 22 bp, Artificial Sequence
  chemically synthesized
tttgttatgttgttgaatttgg

SEQ ID NO: 28883 - DNA, 22 bp, Artificial Sequence
  chemically synthesized
ttgttatgttgttgaatttggt

SEQ ID NO: 28884 - DNA, 22 bp, Artificial Sequence
  chemically synthesized
tgttatgttgttgaatttggtt

SEQ ID NO: 28885 - DNA, 22 bp, Artificial Sequence
  chemically synthesized
gttatgttgttgaatttggtta

SEQ ID NO: 28886 - DNA, 22 bp, Artificial Sequence
  chemically synthesized
ttatgttgttgaatttggttat

SEQ ID NO: 28887 - DNA, 22 bp, Artificial Sequence
  chemically synthesized
tgttgttgaatttggttatcta

SEQ ID NO: 28888 - DNA, 22 bp, Artificial Sequence
  chemically synthesized
ttgaatttggttatctagtatt

SEQ ID NO: 28889 - DNA, 22 bp, Artificial Sequence
  chemically synthesized
aatttggttatctagtattttg

SEQ ID NO: 28890 - DNA, 22 bp, Artificial Sequence
  chemically synthesized
ggttatctagtattttgttaag

SEQ ID NO: 28891 - DNA, 22 bp, Artificial Sequence
  chemically synthesized
gttatctagtattttgttaagg

SEQ ID NO: 28892 - DNA, 22 bp, Artificial Sequence
  chemically synthesized
tctagtattttgttaaggattt

SEQ ID NO: 28893 - DNA, 22 bp, Artificial Sequence
  chemically synthesized
gtattttgttaaggattttagc

SEQ ID NO: 28894 - DNA, 22 bp, Artificial Sequence
  chemically synthesized
tgttaaggattttagcatctat

SEQ ID NO: 28895 - DNA, 22 bp, Artificial Sequence
  chemically synthesized
gttaaggattttagcatctatg

SEQ ID NO: 28896 - DNA, 22 bp, Artificial Sequence
  chemically synthesized
ttaaggattttagcatctatgt

SEQ ID NO: 28897 - DNA, 22 bp, Artificial Sequence
  chemically synthesized
aggattttagcatctatgttca

SEQ ID NO: 28898 - DNA, 22 bp, Artificial Sequence
  chemically synthesized
tagcatctatgttcatcaaggc

SEQ ID NO: 28899 - DNA, 22 bp, Artificial Sequence
  chemically synthesized
agcatctatgttcatcaaggct

SEQ ID NO: 28900 - DNA, 22 bp, Artificial Sequence
  chemically synthesized
gcatctatgttcatcaaggcta

SEQ ID NO: 28901 - DNA, 22 bp, Artificial Sequence
  chemically synthesized
tgttcatcaaggctatcagtct

SEQ ID NO: 28902 - DNA, 22 bp, Artificial Sequence
  chemically synthesized
atcaaggctatcagtctgtagt

SEQ ID NO: 28903 - DNA, 22 bp, Artificial Sequence
  chemically synthesized
tcagtctgtagttttctttttt

SEQ ID NO: 28904 - DNA, 22 bp, Artificial Sequence
  chemically synthesized
tagttttcttttttggttatgt

SEQ ID NO: 28905 - DNA, 22 bp, Artificial Sequence
  chemically synthesized
tcttttttggttatgtccttcc

SEQ ID NO: 28906 - DNA, 22 bp, Artificial Sequence
  chemically synthesized
cttttttggttatgtccttccc

SEQ ID NO: 28907 - DNA, 22 bp, Artificial Sequence
  chemically synthesized
ttttttggttatgtccttccct

SEQ ID NO: 28908 - DNA, 22 bp, Artificial Sequence
  chemically synthesized
ttttggttatgtccttccctgg

SEQ ID NO: 28909 - DNA, 22 bp, Artificial Sequence
  chemically synthesized
tttggttatgtccttccctggt

SEQ ID NO: 28910 - DNA, 22 bp, Artificial Sequence
  chemically synthesized
ttggttatgtccttccctggtt

SEQ ID NO: 28911 - DNA, 22 bp, Artificial Sequence
  chemically synthesized
tggttatgtccttccctggttt

SEQ ID NO: 28912 - DNA, 22 bp, Artificial Sequence
  chemically synthesized
ggttatgtccttccctggtttt

SEQ ID NO: 28913 - DNA, 22 bp, Artificial Sequence
  chemically synthesized
gttatgtccttccctggttttg

SEQ ID NO: 28914 - DNA, 22 bp, Artificial Sequence
  chemically synthesized
tgtccttccctggttttggtgt

SEQ ID NO: 28915 - DNA, 22 bp, Artificial Sequence
  chemically synthesized
ccctggttttggtgtgatgctg

SEQ ID NO: 28916 - DNA, 22 bp, Artificial Sequence
  chemically synthesized
cctggttttggtgtgatgctgg

SEQ ID NO: 28917 - DNA, 22 bp, Artificial Sequence
  chemically synthesized
gttttggtgtgatgctggcttc

SEQ ID NO: 28918 - DNA, 22 bp, Artificial Sequence
  chemically synthesized
tggtgtgatgctggcttcatag

SEQ ID NO: 28919 - DNA, 22 bp, Artificial Sequence
  chemically synthesized
ggtgtgatgctggcttcataga

SEQ ID NO: 28920 - DNA, 22 bp, Artificial Sequence
  chemically synthesized
gtgtgatgctggcttcatagaa

SEQ ID NO: 28921 - DNA, 22 bp, Artificial Sequence
  chemically synthesized
gcttcatagaatgaattagggc

SEQ ID NO: 28922 - DNA, 22 bp, Artificial Sequence
  chemically synthesized
catagaatgaattagggcaggt

SEQ ID NO: 28923 - DNA, 22 bp, Artificial Sequence
  chemically synthesized
atagaatgaattagggcaggtt

SEQ ID NO: 28924 - DNA, 22 bp, Artificial Sequence
  chemically synthesized
gggcaggttccttctttatctg

SEQ ID NO: 28925 - DNA, 22 bp, Artificial Sequence
  chemically synthesized
cttctttatctgtcttgtagaa

SEQ ID NO: 28926 - DNA, 22 bp, Artificial Sequence
  chemically synthesized
ctttatctgtcttgtagaatag

SEQ ID NO: 28927 - DNA, 22 bp, Artificial Sequence
  chemically synthesized
tttatctgtcttgtagaatagt

SEQ ID NO: 28928 - DNA, 22 bp, Artificial Sequence
  chemically synthesized
tatctgtcttgtagaatagtgt

SEQ ID NO: 28929 - DNA, 22 bp, Artificial Sequence
  chemically synthesized
atctgtcttgtagaatagtgtc

SEQ ID NO: 28930 - DNA, 22 bp, Artificial Sequence
  chemically synthesized
tctgtcttgtagaatagtgtca

SEQ ID NO: 28931 - DNA, 22 bp, Artificial Sequence
  chemically synthesized
tcttgtagaatagtgtcaaaaa

SEQ ID NO: 28932 - DNA, 22 bp, Artificial Sequence
  chemically synthesized
gtagaatagtgtcaaaaagatg

SEQ ID NO: 28933 - DNA, 22 bp, Artificial Sequence
  chemically synthesized
tagaatagtgtcaaaaagatgg

SEQ ID NO: 28934 - DNA, 22 bp, Artificial Sequence
  chemically synthesized
ctctttgaatgtctagtagaat

SEQ ID NO: 28935 - DNA, 22 bp, Artificial Sequence
  chemically synthesized
tttgaatgtctagtagaattct

SEQ ID NO: 28936 - DNA, 22 bp, Artificial Sequence
  chemically synthesized
tgaatgtctagtagaattctgt

SEQ ID NO: 28937 - DNA, 22 bp, Artificial Sequence
  chemically synthesized
gaatgtctagtagaattctgtt

SEQ ID NO: 28938 - DNA, 22 bp, Artificial Sequence
  chemically synthesized
aatgtctagtagaattctgttg

SEQ ID NO: 28939 - DNA, 22 bp, Artificial Sequence
  chemically synthesized
gtagaattctgttgtgaatcca

SEQ ID NO: 28940 - DNA, 22 bp, Artificial Sequence
  chemically synthesized
tgttgtgaatccatctggtcct

SEQ ID NO: 28941 - DNA, 22 bp, Artificial Sequence
  chemically synthesized
ttgtgaatccatctggtcctga

SEQ ID NO: 28942 - DNA, 22 bp, Artificial Sequence
  chemically synthesized
tgaatccatctggtcctgaact

SEQ ID NO: 28943 - DNA, 22 bp, Artificial Sequence
  chemically synthesized
gtcctgaacttttttttggttg

SEQ ID NO: 28944 - DNA, 22 bp, Artificial Sequence
  chemically synthesized
aacttttttttggttggtaatt

SEQ ID NO: 28945 - DNA, 22 bp, Artificial Sequence
  chemically synthesized
ttttttggttggtaatttttta

SEQ ID NO: 28946 - DNA, 22 bp, Artificial Sequence
  chemically synthesized
tttttggttggtaattttttaa

SEQ ID NO: 28947 - DNA, 22 bp, Artificial Sequence
  chemically synthesized
ttttggttggtaattttttaat

SEQ ID NO: 28948 - DNA, 22 bp, Artificial Sequence
  chemically synthesized
tttggttggtaattttttaatt

SEQ ID NO: 28949 - DNA, 22 bp, Artificial Sequence
  chemically synthesized
ttggttggtaattttttaatta

SEQ ID NO: 28950 - DNA, 22 bp, Artificial Sequence
  chemically synthesized
tggttggtaattttttaattac

SEQ ID NO: 28951 - DNA, 22 bp, Artificial Sequence
  chemically synthesized
ggttggtaattttttaattacc

SEQ ID NO: 28952 - DNA, 22 bp, Artificial Sequence
  chemically synthesized
gttggtaattttttaattacca

SEQ ID NO: 28953 - DNA, 22 bp, Artificial Sequence
  chemically synthesized
gtaattttttaattaccaatta

SEQ ID NO: 28954 - DNA, 22 bp, Artificial Sequence
  chemically synthesized
tttaattaccaattaaatctca

SEQ ID NO: 28955 - DNA, 22 bp, Artificial Sequence
  chemically synthesized
ttaattaccaattaaatctcac

SEQ ID NO: 28956 - DNA, 22 bp, Artificial Sequence
  chemically synthesized
taattaccaattaaatctcact

SEQ ID NO: 28957 - DNA, 22 bp, Artificial Sequence
  chemically synthesized
aattaccaattaaatctcactg

SEQ ID NO: 28958 - DNA, 22 bp, Artificial Sequence
  chemically synthesized
attaccaattaaatctcactgc

SEQ ID NO: 28959 - DNA, 22 bp, Artificial Sequence
  chemically synthesized
ccaattaaatctcactgcttgt

SEQ ID NO: 28960 - DNA, 22 bp, Artificial Sequence
  chemically synthesized
aatctcactgcttgttattggt

SEQ ID NO: 28961 - DNA, 22 bp, Artificial Sequence
  chemically synthesized
actgcttgttattggtctgtta

SEQ ID NO: 28962 - DNA, 22 bp, Artificial Sequence
  chemically synthesized
cttgttattggtctgttagtaa

SEQ ID NO: 28963 - DNA, 22 bp, Artificial Sequence
  chemically synthesized
gttattggtctgttagtaaatt

SEQ ID NO: 28964 - DNA, 22 bp, Artificial Sequence
  chemically synthesized
ttattggtctgttagtaaattt

SEQ ID NO: 28965 - DNA, 22 bp, Artificial Sequence
  chemically synthesized
ttggtctgttagtaaatttatt

SEQ ID NO: 28966 - DNA, 22 bp, Artificial Sequence
  chemically synthesized
gtctgttagtaaatttattgag

SEQ ID NO: 28967 - DNA, 22 bp, Artificial Sequence
  chemically synthesized
ttagtaaatttattgaggctca

SEQ ID NO: 28968 - DNA, 22 bp, Artificial Sequence
  chemically synthesized
gtaaatttattgaggctcattt

SEQ ID NO: 28969 - DNA, 22 bp, Artificial Sequence
  chemically synthesized
attgaggctcatttcatggcct

SEQ ID NO: 28970 - DNA, 22 bp, Artificial Sequence
  chemically synthesized
ttgaggctcatttcatggccta

SEQ ID NO: 28971 - DNA, 22 bp, Artificial Sequence
  chemically synthesized
aggctcatttcatggcctatca

SEQ ID NO: 28972 - DNA, 22 bp, Artificial Sequence
  chemically synthesized
atttcatggcctatcatatggt

SEQ ID NO: 28973 - DNA, 22 bp, Artificial Sequence
  chemically synthesized
catggcctatcatatggtctac

SEQ ID NO: 28974 - DNA, 22 bp, Artificial Sequence
  chemically synthesized
atggcctatcatatggtctacc

SEQ ID NO: 28975 - DNA, 22 bp, Artificial Sequence
  chemically synthesized
tcatatggtctaccttggagaa

SEQ ID NO: 28976 - DNA, 22 bp, Artificial Sequence
  chemically synthesized
ccttggagaaatttccacgcgc

SEQ ID NO: 28977 - DNA, 22 bp, Artificial Sequence
  chemically synthesized
ggagaaatttccacgcgctgtt

SEQ ID NO: 28978 - DNA, 22 bp, Artificial Sequence
  chemically synthesized
gagaaatttccacgcgctgttg

SEQ ID NO: 28979 - DNA, 22 bp, Artificial Sequence
  chemically synthesized
ccacgcgctgttgaatagaatg

SEQ ID NO: 28980 - DNA, 22 bp, Artificial Sequence
  chemically synthesized
cacgcgctgttgaatagaatgt

SEQ ID NO: 28981 - DNA, 22 bp, Artificial Sequence
  chemically synthesized
ttgaatagaatgtgtgttctgt

SEQ ID NO: 28982 - DNA, 22 bp, Artificial Sequence
  chemically synthesized
aatagaatgtgtgttctgtggt

SEQ ID NO: 28983 - DNA, 22 bp, Artificial Sequence
  chemically synthesized
tgtggttattggatgaaatgtt

SEQ ID NO: 28984 - DNA, 22 bp, Artificial Sequence
  chemically synthesized
tggttattggatgaaatgttct

SEQ ID NO: 28985 - DNA, 22 bp, Artificial Sequence
  chemically synthesized
ttggatgaaatgttctgtatat

SEQ ID NO: 28986 - DNA, 22 bp, Artificial Sequence
  chemically synthesized
gatgaaatgttctgtatataac

SEQ ID NO: 28987 - DNA, 22 bp, Artificial Sequence
  chemically synthesized
tgtatataactgttaagtccat

SEQ ID NO: 28988 - DNA, 22 bp, Artificial Sequence
  chemically synthesized
tatataactgttaagtccattt

SEQ ID NO: 28989 - DNA, 22 bp, Artificial Sequence
  chemically synthesized
ttaagtccatttgttctaaggt

SEQ ID NO: 28990 - DNA, 22 bp, Artificial Sequence
  chemically synthesized
agtccatttgttctaaggtata

SEQ ID NO: 28991 - DNA, 22 bp, Artificial Sequence
  chemically synthesized
gttctaaggtataatttaaatc

SEQ ID NO: 28992 - DNA, 22 bp, Artificial Sequence
  chemically synthesized
ttctaaggtataatttaaatcc

SEQ ID NO: 28993 - DNA, 22 bp, Artificial Sequence
  chemically synthesized
taaggtataatttaaatccatt

SEQ ID NO: 28994 - DNA, 22 bp, Artificial Sequence
  chemically synthesized
aggtataatttaaatccattat

SEQ ID NO: 28995 - DNA, 22 bp, Artificial Sequence
  chemically synthesized
aaatccattatttttttgttga

SEQ ID NO: 28996 - DNA, 22 bp, Artificial Sequence
  chemically synthesized
aatccattatttttttgttgac

SEQ ID NO: 28997 - DNA, 22 bp, Artificial Sequence
  chemically synthesized
tttttttgttgactttctgtct

SEQ ID NO: 28998 - DNA, 22 bp, Artificial Sequence
  chemically synthesized
ttttgttgactttctgtcttga

SEQ ID NO: 28999 - DNA, 22 bp, Artificial Sequence
  chemically synthesized
tttgttgactttctgtcttgat

SEQ ID NO: 29000 - DNA, 22 bp, Artificial Sequence
  chemically synthesized
ttgttgactttctgtcttgatg

SEQ ID NO: 29001 - DNA, 22 bp, Artificial Sequence
  chemically synthesized
tgttgactttctgtcttgatga

SEQ ID NO: 29002 - DNA, 22 bp, Artificial Sequence
  chemically synthesized
gttgactttctgtcttgatgaa

SEQ ID NO: 29003 - DNA, 22 bp, Artificial Sequence
  chemically synthesized
ttgactttctgtcttgatgaac

SEQ ID NO: 29004 - DNA, 22 bp, Artificial Sequence
  chemically synthesized
actttctgtcttgatgaactgt

SEQ ID NO: 29005 - DNA, 22 bp, Artificial Sequence
  chemically synthesized
tctgtcttgatgaactgtctag

SEQ ID NO: 29006 - DNA, 22 bp, Artificial Sequence
  chemically synthesized
ctgtcttgatgaactgtctagt

SEQ ID NO: 29007 - DNA, 22 bp, Artificial Sequence
  chemically synthesized
tgtcttgatgaactgtctagtg

SEQ ID NO: 29008 - DNA, 22 bp, Artificial Sequence
  chemically synthesized
tcttgatgaactgtctagtgct

SEQ ID NO: 29009 - DNA, 22 bp, Artificial Sequence
  chemically synthesized
gatgaactgtctagtgctgtca

SEQ ID NO: 29010 - DNA, 22 bp, Artificial Sequence
  chemically synthesized
atgaactgtctagtgctgtcaa

SEQ ID NO: 29011 - DNA, 22 bp, Artificial Sequence
  chemically synthesized
tctagtgctgtcaatgaagtat

SEQ ID NO: 29012 - DNA, 22 bp, Artificial Sequence
  chemically synthesized
gtgctgtcaatgaagtattgaa

SEQ ID NO: 29013 - DNA, 22 bp, Artificial Sequence
  chemically synthesized
tcaatgaagtattgaagtcccc

SEQ ID NO: 29014 - DNA, 22 bp, Artificial Sequence
  chemically synthesized
aagtcccccactattattgtgt

SEQ ID NO: 29015 - DNA, 22 bp, Artificial Sequence
  chemically synthesized
ttattgtgttgctgtctatctc

SEQ ID NO: 29016 - DNA, 22 bp, Artificial Sequence
  chemically synthesized
ttgtgttgctgtctatctcatt

SEQ ID NO: 29017 - DNA, 22 bp, Artificial Sequence
  chemically synthesized
tgttgctgtctatctcatttct

SEQ ID NO: 29018 - DNA, 22 bp, Artificial Sequence
  chemically synthesized
ctgtctatctcatttcttaggt

SEQ ID NO: 29019 - DNA, 22 bp, Artificial Sequence
  chemically synthesized
tctatctcatttcttaggtcta

SEQ ID NO: 29020 - DNA, 22 bp, Artificial Sequence
  chemically synthesized
tctcatttcttaggtctattag

SEQ ID NO: 29021 - DNA, 22 bp, Artificial Sequence
  chemically synthesized
atttcttaggtctattagtaat

SEQ ID NO: 29022 - DNA, 22 bp, Artificial Sequence
  chemically synthesized
cttaggtctattagtaattgtt

SEQ ID NO: 29023 - DNA, 22 bp, Artificial Sequence
  chemically synthesized
ttaggtctattagtaattgttc

SEQ ID NO: 29024 - DNA, 22 bp, Artificial Sequence
  chemically synthesized
aggtctattagtaattgttcta

SEQ ID NO: 29025 - DNA, 22 bp, Artificial Sequence
  chemically synthesized
ggtctattagtaattgttctat

SEQ ID NO: 29026 - DNA, 22 bp, Artificial Sequence
  chemically synthesized
ttagtaattgttctataaattt

SEQ ID NO: 29027 - DNA, 22 bp, Artificial Sequence
  chemically synthesized
gtaattgttctataaatttggg

SEQ ID NO: 29028 - DNA, 22 bp, Artificial Sequence
  chemically synthesized
ttctataaatttgggagctcca

SEQ ID NO: 29029 - DNA, 22 bp, Artificial Sequence
  chemically synthesized
tataaatttgggagctccagtg

SEQ ID NO: 29030 - DNA, 22 bp, Artificial Sequence
  chemically synthesized
taaatttgggagctccagtgtt

SEQ ID NO: 29031 - DNA, 22 bp, Artificial Sequence
  chemically synthesized
gggagctccagtgttaggtgca

SEQ ID NO: 29032 - DNA, 22 bp, Artificial Sequence
  chemically synthesized
ggagctccagtgttaggtgcat

SEQ ID NO: 29033 - DNA, 22 bp, Artificial Sequence
  chemically synthesized
cagtgttaggtgcatatatgtt

SEQ ID NO: 29034 - DNA, 22 bp, Artificial Sequence
  chemically synthesized
ggtgcatatatgtttaagattg

SEQ ID NO: 29035 - DNA, 22 bp, Artificial Sequence
  chemically synthesized
aagattgtgatattttcctgtt

SEQ ID NO: 29036 - DNA, 22 bp, Artificial Sequence
  chemically synthesized
agattgtgatattttcctgttg

SEQ ID NO: 29037 - DNA, 22 bp, Artificial Sequence
  chemically synthesized
tgatattttcctgttggacaag

SEQ ID NO: 29038 - DNA, 22 bp, Artificial Sequence
  chemically synthesized
tcctgttggacaaggcctttta

SEQ ID NO: 29039 - DNA, 22 bp, Artificial Sequence
  chemically synthesized
cctgttggacaaggccttttac

SEQ ID NO: 29040 - DNA, 22 bp, Artificial Sequence
  chemically synthesized
ctgttggacaaggccttttacc

SEQ ID NO: 29041 - DNA, 22 bp, Artificial Sequence
  chemically synthesized
ttggacaaggccttttaccatt

SEQ ID NO: 29042 - DNA, 22 bp, Artificial Sequence
  chemically synthesized
gacaaggccttttaccattata

SEQ ID NO: 29043 - DNA, 22 bp, Artificial Sequence
  chemically synthesized
ttaccattatataatgtccctc

SEQ ID NO: 29044 - DNA, 22 bp, Artificial Sequence
  chemically synthesized
taccattatataatgtccctct

SEQ ID NO: 29045 - DNA, 22 bp, Artificial Sequence
  chemically synthesized
accattatataatgtccctctt

SEQ ID NO: 29046 - DNA, 22 bp, Artificial Sequence
  chemically synthesized
ccattatataatgtccctcttt

SEQ ID NO: 29047 - DNA, 22 bp, Artificial Sequence
  chemically synthesized
tataatgtccctctttgtctct

SEQ ID NO: 29048 - DNA, 22 bp, Artificial Sequence
  chemically synthesized
tttgtctcttttaactgctgtt

SEQ ID NO: 29049 - DNA, 22 bp, Artificial Sequence
  chemically synthesized
tgtctcttttaactgctgttgc

SEQ ID NO: 29050 - DNA, 22 bp, Artificial Sequence
  chemically synthesized
gtctcttttaactgctgttgct

SEQ ID NO: 29051 - DNA, 22 bp, Artificial Sequence
  chemically synthesized
tctcttttaactgctgttgctt

SEQ ID NO: 29052 - DNA, 22 bp, Artificial Sequence
  chemically synthesized
ttttaactgctgttgctttaaa

SEQ ID NO: 29053 - DNA, 22 bp, Artificial Sequence
  chemically synthesized
ttaactgctgttgctttaaagt

SEQ ID NO: 29054 - DNA, 22 bp, Artificial Sequence
  chemically synthesized
taactgctgttgctttaaagtt

SEQ ID NO: 29055 - DNA, 22 bp, Artificial Sequence
  chemically synthesized
aactgctgttgctttaaagttt

SEQ ID NO: 29056 - DNA, 22 bp, Artificial Sequence
  chemically synthesized
actgctgttgctttaaagtttg

SEQ ID NO: 29057 - DNA, 22 bp, Artificial Sequence
  chemically synthesized
ctgttgctttaaagtttgtttt

SEQ ID NO: 29058 - DNA, 22 bp, Artificial Sequence
  chemically synthesized
ttgctttaaagtttgttttgcc

SEQ ID NO: 29059 - DNA, 22 bp, Artificial Sequence
  chemically synthesized
ctttaaagtttgttttgcctac

SEQ ID NO: 29060 - DNA, 22 bp, Artificial Sequence
  chemically synthesized
taaagtttgttttgcctactca

SEQ ID NO: 29061 - DNA, 22 bp, Artificial Sequence
  chemically synthesized
aaagtttgttttgcctactcac

SEQ ID NO: 29062 - DNA, 22 bp, Artificial Sequence
  chemically synthesized
aagtttgttttgcctactcact

SEQ ID NO: 29063 - DNA, 22 bp, Artificial Sequence
  chemically synthesized
gttttgcctactcacttttggt

SEQ ID NO: 29064 - DNA, 22 bp, Artificial Sequence
  chemically synthesized
ttttgcctactcacttttggtg

SEQ ID NO: 29065 - DNA, 22 bp, Artificial Sequence
  chemically synthesized
tgcctactcacttttggtggcc

SEQ ID NO: 29066 - DNA, 22 bp, Artificial Sequence
  chemically synthesized
gcctactcacttttggtggcca

SEQ ID NO: 29067 - DNA, 22 bp, Artificial Sequence
  chemically synthesized
cctactcacttttggtggccat

SEQ ID NO: 29068 - DNA, 22 bp, Artificial Sequence
  chemically synthesized
ctcacttttggtggccatttgc

SEQ ID NO: 29069 - DNA, 22 bp, Artificial Sequence
  chemically synthesized
acttttggtggccatttgcatg

SEQ ID NO: 29070 - DNA, 22 bp, Artificial Sequence
  chemically synthesized
ttggtggccatttgcatgaaat

SEQ ID NO: 29071 - DNA, 22 bp, Artificial Sequence
  chemically synthesized
tggtggccatttgcatgaaata

SEQ ID NO: 29072 - DNA, 22 bp, Artificial Sequence
  chemically synthesized
ggtggccatttgcatgaaatac

SEQ ID NO: 29073 - DNA, 22 bp, Artificial Sequence
  chemically synthesized
gtggccatttgcatgaaatacc

SEQ ID NO: 29074 - DNA, 22 bp, Artificial Sequence
  chemically synthesized
gcatgaaatacctttttcaccc

SEQ ID NO: 29075 - DNA, 22 bp, Artificial Sequence
  chemically synthesized
catgaaatacctttttcaccct

SEQ ID NO: 29076 - DNA, 22 bp, Artificial Sequence
  chemically synthesized
tttcacccttttaagtggagca

SEQ ID NO: 29077 - DNA, 22 bp, Artificial Sequence
  chemically synthesized
ttcacccttttaagtggagcat

SEQ ID NO: 29078 - DNA, 22 bp, Artificial Sequence
  chemically synthesized
tcacccttttaagtggagcatt

SEQ ID NO: 29079 - DNA, 22 bp, Artificial Sequence
  chemically synthesized
cacccttttaagtggagcattt

SEQ ID NO: 29080 - DNA, 22 bp, Artificial Sequence
  chemically synthesized
acccttttaagtggagcattta

SEQ ID NO: 29081 - DNA, 22 bp, Artificial Sequence
  chemically synthesized
ttaagtggagcatttaggccat

SEQ ID NO: 29082 - DNA, 22 bp, Artificial Sequence
  chemically synthesized
taagtggagcatttaggccatt

SEQ ID NO: 29083 - DNA, 22 bp, Artificial Sequence
  chemically synthesized
aagtggagcatttaggccattt

SEQ ID NO: 29084 - DNA, 22 bp, Artificial Sequence
  chemically synthesized
agtggagcatttaggccattta

SEQ ID NO: 29085 - DNA, 22 bp, Artificial Sequence
  chemically synthesized
aggccatttacattcaatgtta

SEQ ID NO: 29086 - DNA, 22 bp, Artificial Sequence
  chemically synthesized
ggccatttacattcaatgttag

SEQ ID NO: 29087 - DNA, 22 bp, Artificial Sequence
  chemically synthesized
acattcaatgttagtaatgtaa

SEQ ID NO: 29088 - DNA, 22 bp, Artificial Sequence
  chemically synthesized
cattcaatgttagtaatgtaaa

SEQ ID NO: 29089 - DNA, 22 bp, Artificial Sequence
  chemically synthesized
aatgttagtaatgtaaatgcct

SEQ ID NO: 29090 - DNA, 22 bp, Artificial Sequence
  chemically synthesized
gtaatgtaaatgcctggctatg

SEQ ID NO: 29091 - DNA, 22 bp, Artificial Sequence
  chemically synthesized
gctatgccaggcaggaatggcc

SEQ ID NO: 29092 - DNA, 22 bp, Artificial Sequence
  chemically synthesized
tgccaggcaggaatggcctgct

SEQ ID NO: 29093 - DNA, 22 bp, Artificial Sequence
  chemically synthesized
ctcagggacccagtgagctccc

SEQ ID NO: 29094 - DNA, 22 bp, Artificial Sequence
  chemically synthesized
agggacccagtgagctcccagg

SEQ ID NO: 29095 - DNA, 22 bp, Artificial Sequence
  chemically synthesized
ccagggcctttctcactgcttc

SEQ ID NO: 29096 - DNA, 22 bp, Artificial Sequence
  chemically synthesized
tctcactgcttcctctacacct

SEQ ID NO: 29097 - DNA, 22 bp, Artificial Sequence
  chemically synthesized
ctcactgcttcctctacacctg

SEQ ID NO: 29098 - DNA, 22 bp, Artificial Sequence
  chemically synthesized
tcactgcttcctctacacctgt

SEQ ID NO: 29099 - DNA, 22 bp, Artificial Sequence
  chemically synthesized
actgcttcctctacacctgtat

SEQ ID NO: 29100 - DNA, 22 bp, Artificial Sequence
  chemically synthesized
cttcctctacacctgtattttg

SEQ ID NO: 29101 - DNA, 22 bp, Artificial Sequence
  chemically synthesized
cctctacacctgtattttgctc

SEQ ID NO: 29102 - DNA, 22 bp, Artificial Sequence
  chemically synthesized
ctctacacctgtattttgctca

SEQ ID NO: 29103 - DNA, 22 bp, Artificial Sequence
  chemically synthesized
tacacctgtattttgctcagct

SEQ ID NO: 29104 - DNA, 22 bp, Artificial Sequence
  chemically synthesized
cacctgtattttgctcagctct

SEQ ID NO: 29105 - DNA, 22 bp, Artificial Sequence
  chemically synthesized
tattttgctcagctctctaagt

SEQ ID NO: 29106 - DNA, 22 bp, Artificial Sequence
  chemically synthesized
tgctcagctctctaagttaact

SEQ ID NO: 29107 - DNA, 22 bp, Artificial Sequence
  chemically synthesized
gctcagctctctaagttaactc

SEQ ID NO: 29108 - DNA, 22 bp, Artificial Sequence
  chemically synthesized
ctcagctctctaagttaactca

SEQ ID NO: 29109 - DNA, 22 bp, Artificial Sequence
  chemically synthesized
agctctctaagttaactcaact

SEQ ID NO: 29110 - DNA, 22 bp, Artificial Sequence
  chemically synthesized
tctaagttaactcaactccagg

SEQ ID NO: 29111 - DNA, 22 bp, Artificial Sequence
  chemically synthesized
taagttaactcaactccaggta

SEQ ID NO: 29112 - DNA, 22 bp, Artificial Sequence
  chemically synthesized
agttaactcaactccaggtaag

SEQ ID NO: 29113 - DNA, 22 bp, Artificial Sequence
  chemically synthesized
actcaactccaggtaaggtcag

SEQ ID NO: 29114 - DNA, 22 bp, Artificial Sequence
  chemically synthesized
aactccaggtaaggtcagaaac

SEQ ID NO: 29115 - DNA, 22 bp, Artificial Sequence
  chemically synthesized
caggtaaggtcagaaacttctc

SEQ ID NO: 29116 - DNA, 22 bp, Artificial Sequence
  chemically synthesized
ctcccacaaacagaccttcagt

SEQ ID NO: 29117 - DNA, 22 bp, Artificial Sequence
  chemically synthesized
tcccacaaacagaccttcagtt

SEQ ID NO: 29118 - DNA, 22 bp, Artificial Sequence
  chemically synthesized
ccacaaacagaccttcagtttc

SEQ ID NO: 29119 - DNA, 22 bp, Artificial Sequence
  chemically synthesized
cagtttctccagtgggagtgtg

SEQ ID NO: 29120 - DNA, 22 bp, Artificial Sequence
  chemically synthesized
agtttctccagtgggagtgtgt

SEQ ID NO: 29121 - DNA, 22 bp, Artificial Sequence
  chemically synthesized
ctccagtgggagtgtgtgttta

SEQ ID NO: 29122 - DNA, 22 bp, Artificial Sequence
  chemically synthesized
tccagtgggagtgtgtgtttag

SEQ ID NO: 29123 - DNA, 22 bp, Artificial Sequence
  chemically synthesized
cagtgggagtgtgtgtttagga

SEQ ID NO: 29124 - DNA, 22 bp, Artificial Sequence
  chemically synthesized
aggagaggaggatctccctttc

SEQ ID NO: 29125 - DNA, 22 bp, Artificial Sequence
  chemically synthesized
ggagaggaggatctccctttcc

SEQ ID NO: 29126 - DNA, 22 bp, Artificial Sequence
  chemically synthesized
cctttcccacttccgcagttgg

SEQ ID NO: 29127 - DNA, 22 bp, Artificial Sequence
  chemically synthesized
tcccacttccgcagttggggca

SEQ ID NO: 29128 - DNA, 22 bp, Artificial Sequence
  chemically synthesized
cccacttccgcagttggggcac

SEQ ID NO: 29129 - DNA, 22 bp, Artificial Sequence
  chemically synthesized
ccacttccgcagttggggcact

SEQ ID NO: 29130 - DNA, 22 bp, Artificial Sequence
  chemically synthesized
ccgcagttggggcactcacagt

SEQ ID NO: 29131 - DNA, 22 bp, Artificial Sequence
  chemically synthesized
cgcagttggggcactcacagta

SEQ ID NO: 29132 - DNA, 22 bp, Artificial Sequence
  chemically synthesized
gggcactcacagtatttggggt

SEQ ID NO: 29133 - DNA, 22 bp, Artificial Sequence
  chemically synthesized
acagtatttggggtgtctcctg

SEQ ID NO: 29134 - DNA, 22 bp, Artificial Sequence
  chemically synthesized
ggggtgtctcctgggtcctgca

SEQ ID NO: 29135 - DNA, 22 bp, Artificial Sequence
  chemically synthesized
gggtgtctcctgggtcctgcag

SEQ ID NO: 29136 - DNA, 22 bp, Artificial Sequence
  chemically synthesized
ctgggtcctgcaggagcaatct

SEQ ID NO: 29137 - DNA, 22 bp, Artificial Sequence
  chemically synthesized
ggtcctgcaggagcaatctact

SEQ ID NO: 29138 - DNA, 22 bp, Artificial Sequence
  chemically synthesized
caggagcaatctacttccttca

SEQ ID NO: 29139 - DNA, 22 bp, Artificial Sequence
  chemically synthesized
cttccttcagagggtctgtggg

SEQ ID NO: 29140 - DNA, 22 bp, Artificial Sequence
  chemically synthesized
ccttcagagggtctgtgggtcc

SEQ ID NO: 29141 - DNA, 22 bp, Artificial Sequence
  chemically synthesized
cttcagagggtctgtgggtcct

SEQ ID NO: 29142 - DNA, 22 bp, Artificial Sequence
  chemically synthesized
cagagggtctgtgggtcctctc

SEQ ID NO: 29143 - DNA, 22 bp, Artificial Sequence
  chemically synthesized
agagggtctgtgggtcctctca

SEQ ID NO: 29144 - DNA, 22 bp, Artificial Sequence
  chemically synthesized
tgggtcctctcaggattgctgg

SEQ ID NO: 29145 - DNA, 22 bp, Artificial Sequence
  chemically synthesized
tcaggattgctggtttgttctt

SEQ ID NO: 29146 - DNA, 22 bp, Artificial Sequence
  chemically synthesized
aggattgctggtttgttcttgc

SEQ ID NO: 29147 - DNA, 22 bp, Artificial Sequence
  chemically synthesized
ctggtttgttcttgcagtctat

SEQ ID NO: 29148 - DNA, 22 bp, Artificial Sequence
  chemically synthesized
gtttgttcttgcagtctatctg

SEQ ID NO: 29149 - DNA, 22 bp, Artificial Sequence
  chemically synthesized
gttcttgcagtctatctgcagc

SEQ ID NO: 29150 - DNA, 22 bp, Artificial Sequence
  chemically synthesized
ttcttgcagtctatctgcagct

SEQ ID NO: 29151 - DNA, 22 bp, Artificial Sequence
  chemically synthesized
ttgcagtctatctgcagctaaa

SEQ ID NO: 29152 - DNA, 22 bp, Artificial Sequence
  chemically synthesized
gcagtctatctgcagctaaaat

SEQ ID NO: 29153 - DNA, 22 bp, Artificial Sequence
  chemically synthesized
cagtctatctgcagctaaaatt

SEQ ID NO: 29154 - DNA, 22 bp, Artificial Sequence
  chemically synthesized
tctgcagctaaaattcacaatg

SEQ ID NO: 29155 - DNA, 22 bp, Artificial Sequence
  chemically synthesized
cagctaaaattcacaatgcgag

SEQ ID NO: 29156 - DNA, 22 bp, Artificial Sequence
  chemically synthesized
aaattcacaatgcgagcctcca

SEQ ID NO: 29157 - DNA, 22 bp, Artificial Sequence
  chemically synthesized
acaatgcgagcctccacatgct

SEQ ID NO: 29158 - DNA, 22 bp, Artificial Sequence
  chemically synthesized
cacatgctgctctgtccatctg

SEQ ID NO: 29159 - DNA, 22 bp, Artificial Sequence
  chemically synthesized
ctctgtccatctgagttggagc

SEQ ID NO: 29160 - DNA, 22 bp, Artificial Sequence
  chemically synthesized
tgtccatctgagttggagctgc

SEQ ID NO: 29161 - DNA, 22 bp, Artificial Sequence
  chemically synthesized
tccatctgagttggagctgcaa

SEQ ID NO: 29162 - DNA, 22 bp, Artificial Sequence
  chemically synthesized
agttggagctgcaatctaggcc

SEQ ID NO: 29163 - DNA, 22 bp, Artificial Sequence
  chemically synthesized
gagctgcaatctaggcctacct

SEQ ID NO: 29164 - DNA, 22 bp, Artificial Sequence
  chemically synthesized
caatctaggcctacctcccatc

SEQ ID NO: 29165 - DNA, 22 bp, Artificial Sequence
  chemically synthesized
ggcctacctcccatccgccaag

SEQ ID NO: 29166 - DNA, 22 bp, Artificial Sequence
  chemically synthesized
cctcccatccgccaagatcctg

SEQ ID NO: 29167 - DNA, 22 bp, Artificial Sequence
  chemically synthesized
ccatccgccaagatcctgagaa

SEQ ID NO: 29168 - DNA, 22 bp, Artificial Sequence
  chemically synthesized
agaagttggggattatatttca

SEQ ID NO: 29169 - DNA, 22 bp, Artificial Sequence
  chemically synthesized
gggattatatttcaacatgaga

SEQ ID NO: 29170 - DNA, 22 bp, Artificial Sequence
  chemically synthesized
tatttcaacatgagatttggag

SEQ ID NO: 29171 - DNA, 22 bp, Artificial Sequence
  chemically synthesized
caacatgagatttggagggaac

SEQ ID NO: 29172 - DNA, 22 bp, Artificial Sequence
  chemically synthesized
aacatgagatttggagggaaca

SEQ ID NO: 29173 - DNA, 22 bp, Artificial Sequence
  chemically synthesized
ggagggaacaaacatccaaacc

SEQ ID NO: 29174 - DNA, 22 bp, Artificial Sequence
  chemically synthesized
gagggaacaaacatccaaacca

SEQ ID NO: 29175 - DNA, 22 bp, Artificial Sequence
  chemically synthesized
tattcttttgcacatggatatc

SEQ ID NO: 29176 - DNA, 22 bp, Artificial Sequence
  chemically synthesized
attcttttgcacatggatatcc

SEQ ID NO: 29177 - DNA, 22 bp, Artificial Sequence
  chemically synthesized
ttcttttgcacatggatatcca

SEQ ID NO: 29178 - DNA, 22 bp, Artificial Sequence
  chemically synthesized
ttttgcacatggatatccaatg

SEQ ID NO: 29179 - DNA, 22 bp, Artificial Sequence
  chemically synthesized
ttgcacatggatatccaatgga

SEQ ID NO: 29180 - DNA, 22 bp, Artificial Sequence
  chemically synthesized
tgcacatggatatccaatggat

SEQ ID NO: 29181 - DNA, 22 bp, Artificial Sequence
  chemically synthesized
gcacatggatatccaatggata

SEQ ID NO: 29182 - DNA, 22 bp, Artificial Sequence
  chemically synthesized
cacatggatatccaatggatat

SEQ ID NO: 29183 - DNA, 22 bp, Artificial Sequence
  chemically synthesized
tttcagcaccatttcttgaaca

SEQ ID NO: 29184 - DNA, 22 bp, Artificial Sequence
  chemically synthesized
ttcagcaccatttcttgaacac

SEQ ID NO: 29185 - DNA, 22 bp, Artificial Sequence
  chemically synthesized
tcagcaccatttcttgaacact

SEQ ID NO: 29186 - DNA, 22 bp, Artificial Sequence
  chemically synthesized
cagcaccatttcttgaacactg

SEQ ID NO: 29187 - DNA, 22 bp, Artificial Sequence
  chemically synthesized
agcaccatttcttgaacactgt

SEQ ID NO: 29188 - DNA, 22 bp, Artificial Sequence
  chemically synthesized
cttgaacactgtgtcctttcct

SEQ ID NO: 29189 - DNA, 22 bp, Artificial Sequence
  chemically synthesized
ttgaacactgtgtcctttcctc

SEQ ID NO: 29190 - DNA, 22 bp, Artificial Sequence
  chemically synthesized
gaacactgtgtcctttcctcaa

SEQ ID NO: 29191 - DNA, 22 bp, Artificial Sequence
  chemically synthesized
aacactgtgtcctttcctcaat

SEQ ID NO: 29192 - DNA, 22 bp, Artificial Sequence
  chemically synthesized
tgtcctttcctcaatgtatatt

SEQ ID NO: 29193 - DNA, 22 bp, Artificial Sequence
  chemically synthesized
tcctcaatgtatattcttgtca

SEQ ID NO: 29194 - DNA, 22 bp, Artificial Sequence
  chemically synthesized
cctcaatgtatattcttgtcac

SEQ ID NO: 29195 - DNA, 22 bp, Artificial Sequence
  chemically synthesized
ctcaatgtatattcttgtcacc

SEQ ID NO: 29196 - DNA, 22 bp, Artificial Sequence
  chemically synthesized
aatgtatattcttgtcaccttt

SEQ ID NO: 29197 - DNA, 22 bp, Artificial Sequence
  chemically synthesized
ttgtcacctttgttgaaaatct

SEQ ID NO: 29198 - DNA, 22 bp, Artificial Sequence
  chemically synthesized
gtcacctttgttgaaaatctgt

SEQ ID NO: 29199 - DNA, 22 bp, Artificial Sequence
  chemically synthesized
tcacctttgttgaaaatctgtt

SEQ ID NO: 29200 - DNA, 22 bp, Artificial Sequence
  chemically synthesized
tgttgaaaatctgttggctata

SEQ ID NO: 29201 - DNA, 22 bp, Artificial Sequence
  chemically synthesized
gttgaaaatctgttggctataa

SEQ ID NO: 29202 - DNA, 22 bp, Artificial Sequence
  chemically synthesized
ttgaaaatctgttggctataaa

SEQ ID NO: 29203 - DNA, 22 bp, Artificial Sequence
  chemically synthesized
aaaatctgttggctataaatat

SEQ ID NO: 29204 - DNA, 22 bp, Artificial Sequence
  chemically synthesized
ttggctataaatatgtggatgc

SEQ ID NO: 29205 - DNA, 22 bp, Artificial Sequence
  chemically synthesized
gctataaatatgtggatgcatt

SEQ ID NO: 29206 - DNA, 22 bp, Artificial Sequence
  chemically synthesized
taaatatgtggatgcatttcta

SEQ ID NO: 29207 - DNA, 22 bp, Artificial Sequence
  chemically synthesized
ctaggttctctattctcttcca

SEQ ID NO: 29208 - DNA, 22 bp, Artificial Sequence
  chemically synthesized
taggttctctattctcttccat

SEQ ID NO: 29209 - DNA, 22 bp, Artificial Sequence
  chemically synthesized
ggttctctattctcttccattg

SEQ ID NO: 29210 - DNA, 22 bp, Artificial Sequence
  chemically synthesized
tctattctcttccattggtcta

SEQ ID NO: 29211 - DNA, 22 bp, Artificial Sequence
  chemically synthesized
tattctcttccattggtctaag

SEQ ID NO: 29212 - DNA, 22 bp, Artificial Sequence
  chemically synthesized
ttctcttccattggtctaagtg

SEQ ID NO: 29213 - DNA, 22 bp, Artificial Sequence
  chemically synthesized
tcttccattggtctaagtgtct

SEQ ID NO: 29214 - DNA, 22 bp, Artificial Sequence
  chemically synthesized
ttccattggtctaagtgtctgt

SEQ ID NO: 29215 - DNA, 22 bp, Artificial Sequence
  chemically synthesized
ccattggtctaagtgtctgttc

SEQ ID NO: 29216 - DNA, 22 bp, Artificial Sequence
  chemically synthesized
cattggtctaagtgtctgttct

SEQ ID NO: 29217 - DNA, 22 bp, Artificial Sequence
  chemically synthesized
gtctaagtgtctgttctaatgt

SEQ ID NO: 29218 - DNA, 22 bp, Artificial Sequence
  chemically synthesized
agtgtctgttctaatgtcagta

SEQ ID NO: 29219 - DNA, 22 bp, Artificial Sequence
  chemically synthesized
ttctaatgtcagtatcatgctg

SEQ ID NO: 29220 - DNA, 22 bp, Artificial Sequence
  chemically synthesized
taatgtcagtatcatgctgttt

SEQ ID NO: 29221 - DNA, 22 bp, Artificial Sequence
  chemically synthesized
atgtcagtatcatgctgtttag

SEQ ID NO: 29222 - DNA, 22 bp, Artificial Sequence
  chemically synthesized
tttaggttcctatacttttgta

SEQ ID NO: 29223 - DNA, 22 bp, Artificial Sequence
  chemically synthesized
aggttcctatacttttgtaata

SEQ ID NO: 29224 - DNA, 22 bp, Artificial Sequence
  chemically synthesized
ggttcctatacttttgtaatat

SEQ ID NO: 29225 - DNA, 22 bp, Artificial Sequence
  chemically synthesized
ctatacttttgtaatatacttt

SEQ ID NO: 29226 - DNA, 22 bp, Artificial Sequence
  chemically synthesized
tacttttgtaatatactttgaa

SEQ ID NO: 29227 - DNA, 22 bp, Artificial Sequence
  chemically synthesized
ttgtaatatactttgaaatcag

SEQ ID NO: 29228 - DNA, 22 bp, Artificial Sequence
  chemically synthesized
tgtaatatactttgaaatcagg

SEQ ID NO: 29229 - DNA, 22 bp, Artificial Sequence
  chemically synthesized
gtaatatactttgaaatcaggt

SEQ ID NO: 29230 - DNA, 22 bp, Artificial Sequence
  chemically synthesized
taatatactttgaaatcaggta

SEQ ID NO: 29231 - DNA, 22 bp, Artificial Sequence
  chemically synthesized
tgaaatcaggtagtatgatacc

SEQ ID NO: 29232 - DNA, 22 bp, Artificial Sequence
  chemically synthesized
gaaatcaggtagtatgatacct

SEQ ID NO: 29233 - DNA, 22 bp, Artificial Sequence
  chemically synthesized
aaatcaggtagtatgatacctc

SEQ ID NO: 29234 - DNA, 22 bp, Artificial Sequence
  chemically synthesized
tagcattgttcttttttcacag

SEQ ID NO: 29235 - DNA, 22 bp, Artificial Sequence
  chemically synthesized
gcattgttcttttttcacagga

SEQ ID NO: 29236 - DNA, 22 bp, Artificial Sequence
  chemically synthesized
ttcttttttcacaggatgactt

SEQ ID NO: 29237 - DNA, 22 bp, Artificial Sequence
  chemically synthesized
ttttttcacaggatgactttgg

SEQ ID NO: 29238 - DNA, 22 bp, Artificial Sequence
  chemically synthesized
ttttcacaggatgactttggct

SEQ ID NO: 29239 - DNA, 22 bp, Artificial Sequence
  chemically synthesized
tttcacaggatgactttggcta

SEQ ID NO: 29240 - DNA, 22 bp, Artificial Sequence
  chemically synthesized
ttcacaggatgactttggctac

SEQ ID NO: 29241 - DNA, 22 bp, Artificial Sequence
  chemically synthesized
tcacaggatgactttggctact

SEQ ID NO: 29242 - DNA, 22 bp, Artificial Sequence
  chemically synthesized
cacaggatgactttggctactg

SEQ ID NO: 29243 - DNA, 22 bp, Artificial Sequence
  chemically synthesized
acaggatgactttggctactgg

SEQ ID NO: 29244 - DNA, 22 bp, Artificial Sequence
  chemically synthesized
tggctactggagctatttttta

SEQ ID NO: 29245 - DNA, 22 bp, Artificial Sequence
  chemically synthesized
ggctactggagctattttttaa

SEQ ID NO: 29246 - DNA, 22 bp, Artificial Sequence
  chemically synthesized
gctactggagctattttttaat

SEQ ID NO: 29247 - DNA, 22 bp, Artificial Sequence
  chemically synthesized
ctggagctattttttaatttca

SEQ ID NO: 29248 - DNA, 22 bp, Artificial Sequence
  chemically synthesized
gagctattttttaatttcatac

SEQ ID NO: 29249 - DNA, 22 bp, Artificial Sequence
  chemically synthesized
ttttttaatttcatacaaattt

SEQ ID NO: 29250 - DNA, 22 bp, Artificial Sequence
  chemically synthesized
tttaatttcatacaaattttag

SEQ ID NO: 29251 - DNA, 22 bp, Artificial Sequence
  chemically synthesized
ttaatttcatacaaattttaga

SEQ ID NO: 29252 - DNA, 22 bp, Artificial Sequence
  chemically synthesized
taatttcatacaaattttagat

SEQ ID NO: 29253 - DNA, 22 bp, Artificial Sequence
  chemically synthesized
aatttcatacaaattttagatt

SEQ ID NO: 29254 - DNA, 22 bp, Artificial Sequence
  chemically synthesized
atttcatacaaattttagattg

SEQ ID NO: 29255 - DNA, 22 bp, Artificial Sequence
  chemically synthesized
catacaaattttagattggttt

SEQ ID NO: 29256 - DNA, 22 bp, Artificial Sequence
  chemically synthesized
atacaaattttagattggtttt

SEQ ID NO: 29257 - DNA, 22 bp, Artificial Sequence
  chemically synthesized
tagattggtttttccatttctg

SEQ ID NO: 29258 - DNA, 22 bp, Artificial Sequence
  chemically synthesized
agattggtttttccatttctgt

SEQ ID NO: 29259 - DNA, 22 bp, Artificial Sequence
  chemically synthesized
gattggtttttccatttctgtg

SEQ ID NO: 29260 - DNA, 22 bp, Artificial Sequence
  chemically synthesized
gtttttccatttctgtgaaaaa

SEQ ID NO: 29261 - DNA, 22 bp, Artificial Sequence
  chemically synthesized
ttccatttctgtgaaaaatgac

SEQ ID NO: 29262 - DNA, 22 bp, Artificial Sequence
  chemically synthesized
tccatttctgtgaaaaatgaca

SEQ ID NO: 29263 - DNA, 22 bp, Artificial Sequence
  chemically synthesized
ccatttctgtgaaaaatgacat

SEQ ID NO: 29264 - DNA, 22 bp, Artificial Sequence
  chemically synthesized
catttctgtgaaaaatgacatt

SEQ ID NO: 29265 - DNA, 22 bp, Artificial Sequence
  chemically synthesized
ctgtgaaaaatgacattgctat

SEQ ID NO: 29266 - DNA, 22 bp, Artificial Sequence
  chemically synthesized
tgtgaaaaatgacattgctatt

SEQ ID NO: 29267 - DNA, 22 bp, Artificial Sequence
  chemically synthesized
tgaaaaatgacattgctatttt

SEQ ID NO: 29268 - DNA, 22 bp, Artificial Sequence
  chemically synthesized
ctattttgatagcggtcatata

SEQ ID NO: 29269 - DNA, 22 bp, Artificial Sequence
  chemically synthesized
ttttgatagcggtcatatagaa

SEQ ID NO: 29270 - DNA, 22 bp, Artificial Sequence
  chemically synthesized
tgatagcggtcatatagaatct

SEQ ID NO: 29271 - DNA, 22 bp, Artificial Sequence
  chemically synthesized
gatagcggtcatatagaatctg

SEQ ID NO: 29272 - DNA, 22 bp, Artificial Sequence
  chemically synthesized
atagcggtcatatagaatctgt

SEQ ID NO: 29273 - DNA, 22 bp, Artificial Sequence
  chemically synthesized
tagattgctttgggtagtatgg

SEQ ID NO: 29274 - DNA, 22 bp, Artificial Sequence
  chemically synthesized
ctttgggtagtatggccatttt

SEQ ID NO: 29275 - DNA, 22 bp, Artificial Sequence
  chemically synthesized
tgggtagtatggccattttaac

SEQ ID NO: 29276 - DNA, 22 bp, Artificial Sequence
  chemically synthesized
gggtagtatggccattttaaca

SEQ ID NO: 29277 - DNA, 22 bp, Artificial Sequence
  chemically synthesized
ggtagtatggccattttaacaa

SEQ ID NO: 29278 - DNA, 22 bp, Artificial Sequence
  chemically synthesized
taacaatattaatttttctgat

SEQ ID NO: 29279 - DNA, 22 bp, Artificial Sequence
  chemically synthesized
aacaatattaatttttctgatc

SEQ ID NO: 29280 - DNA, 22 bp, Artificial Sequence
  chemically synthesized
acaatattaatttttctgatcc

SEQ ID NO: 29281 - DNA, 22 bp, Artificial Sequence
  chemically synthesized
atttttctgatccatgaacata

SEQ ID NO: 29282 - DNA, 22 bp, Artificial Sequence
  chemically synthesized
ttctgatccatgaacataggat

SEQ ID NO: 29283 - DNA, 22 bp, Artificial Sequence
  chemically synthesized
tctgatccatgaacataggata

SEQ ID NO: 29284 - DNA, 22 bp, Artificial Sequence
  chemically synthesized
ctgatccatgaacataggatat

SEQ ID NO: 29285 - DNA, 22 bp, Artificial Sequence
  chemically synthesized
tgatccatgaacataggatatc

SEQ ID NO: 29286 - DNA, 22 bp, Artificial Sequence
  chemically synthesized
atccatgaacataggatatctc

SEQ ID NO: 29287 - DNA, 22 bp, Artificial Sequence
  chemically synthesized
tccatttgtttctgtccttttc

SEQ ID NO: 29288 - DNA, 22 bp, Artificial Sequence
  chemically synthesized
catttgtttctgtccttttcaa

SEQ ID NO: 29289 - DNA, 22 bp, Artificial Sequence
  chemically synthesized
gtttctgtccttttcaattctt

SEQ ID NO: 29290 - DNA, 22 bp, Artificial Sequence
  chemically synthesized
tttctgtccttttcaattcttt

SEQ ID NO: 29291 - DNA, 22 bp, Artificial Sequence
  chemically synthesized
ctgtccttttcaattcttttat

SEQ ID NO: 29292 - DNA, 22 bp, Artificial Sequence
  chemically synthesized
tgtccttttcaattcttttatc

SEQ ID NO: 29293 - DNA, 22 bp, Artificial Sequence
  chemically synthesized
tccttttcaattcttttatcag

SEQ ID NO: 29294 - DNA, 22 bp, Artificial Sequence
  chemically synthesized
ttcaattcttttatcagtgttt

SEQ ID NO: 29295 - DNA, 22 bp, Artificial Sequence
  chemically synthesized
tcaattcttttatcagtgtttt

SEQ ID NO: 29296 - DNA, 22 bp, Artificial Sequence
  chemically synthesized
caattcttttatcagtgttttg

SEQ ID NO: 29297 - DNA, 22 bp, Artificial Sequence
  chemically synthesized
aattcttttatcagtgttttgt

SEQ ID NO: 29298 - DNA, 22 bp, Artificial Sequence
  chemically synthesized
ttttatcagtgttttgtagttt

SEQ ID NO: 29299 - DNA, 22 bp, Artificial Sequence
  chemically synthesized
ttatcagtgttttgtagttttc

SEQ ID NO: 29300 - DNA, 22 bp, Artificial Sequence
  chemically synthesized
tatcagtgttttgtagttttcc

SEQ ID NO: 29301 - DNA, 22 bp, Artificial Sequence
  chemically synthesized
atcagtgttttgtagttttccg

SEQ ID NO: 29302 - DNA, 22 bp, Artificial Sequence
  chemically synthesized
tcagtgttttgtagttttccga

SEQ ID NO: 29303 - DNA, 22 bp, Artificial Sequence
  chemically synthesized
tgtagttttccgaatagaggtt

SEQ ID NO: 29304 - DNA, 22 bp, Artificial Sequence
  chemically synthesized
gtagttttccgaatagaggttt

SEQ ID NO: 29305 - DNA, 22 bp, Artificial Sequence
  chemically synthesized
tagttttccgaatagaggtttt

SEQ ID NO: 29306 - DNA, 22 bp, Artificial Sequence
  chemically synthesized
tccgaatagaggtttttcggtt

SEQ ID NO: 29307 - DNA, 22 bp, Artificial Sequence
  chemically synthesized
ccgaatagaggtttttcggttc

SEQ ID NO: 29308 - DNA, 22 bp, Artificial Sequence
  chemically synthesized
cgaatagaggtttttcggttcc

SEQ ID NO: 29309 - DNA, 22 bp, Artificial Sequence
  chemically synthesized
ttcggttccttggttaaattta

SEQ ID NO: 29310 - DNA, 22 bp, Artificial Sequence
  chemically synthesized
tcggttccttggttaaatttat

SEQ ID NO: 29311 - DNA, 22 bp, Artificial Sequence
  chemically synthesized
cggttccttggttaaatttatc

SEQ ID NO: 29312 - DNA, 22 bp, Artificial Sequence
  chemically synthesized
ggttccttggttaaatttatcc

SEQ ID NO: 29313 - DNA, 22 bp, Artificial Sequence
  chemically synthesized
cttggttaaatttatccctaaa

SEQ ID NO: 29314 - DNA, 22 bp, Artificial Sequence
  chemically synthesized
ggttaaatttatccctaaatat

SEQ ID NO: 29315 - DNA, 22 bp, Artificial Sequence
  chemically synthesized
gttaaatttatccctaaatatt

SEQ ID NO: 29316 - DNA, 22 bp, Artificial Sequence
  chemically synthesized
aatttatccctaaatattttat

SEQ ID NO: 29317 - DNA, 22 bp, Artificial Sequence
  chemically synthesized
atccctaaatattttatttttt

SEQ ID NO: 29318 - DNA, 22 bp, Artificial Sequence
  chemically synthesized
tccctaaatattttatttttta

SEQ ID NO: 29319 - DNA, 22 bp, Artificial Sequence
  chemically synthesized
aatattttattttttagctatt

SEQ ID NO: 29320 - DNA, 22 bp, Artificial Sequence
  chemically synthesized
tattttttagctattgtaaatg

SEQ ID NO: 29321 - DNA, 22 bp, Artificial Sequence
  chemically synthesized
attttttagctattgtaaatgg

SEQ ID NO: 29322 - DNA, 22 bp, Artificial Sequence
  chemically synthesized
ttttttagctattgtaaatggg

SEQ ID NO: 29323 - DNA, 22 bp, Artificial Sequence
  chemically synthesized
tttagctattgtaaatgggatt

SEQ ID NO: 29324 - DNA, 22 bp, Artificial Sequence
  chemically synthesized
ttagctattgtaaatgggattg

SEQ ID NO: 29325 - DNA, 22 bp, Artificial Sequence
  chemically synthesized
tagctattgtaaatgggattgc

SEQ ID NO: 29326 - DNA, 22 bp, Artificial Sequence
  chemically synthesized
agctattgtaaatgggattgcc

SEQ ID NO: 29327 - DNA, 22 bp, Artificial Sequence
  chemically synthesized
gctattgtaaatgggattgcct

SEQ ID NO: 29328 - DNA, 22 bp, Artificial Sequence
  chemically synthesized
ttgtaaatgggattgccttctt

SEQ ID NO: 29329 - DNA, 22 bp, Artificial Sequence
  chemically synthesized
taaatgggattgccttcttaat

SEQ ID NO: 29330 - DNA, 22 bp, Artificial Sequence
  chemically synthesized
ccttcttaatttccttctcagc

SEQ ID NO: 29331 - DNA, 22 bp, Artificial Sequence
  chemically synthesized
cttaatttccttctcagctagt

SEQ ID NO: 29332 - DNA, 22 bp, Artificial Sequence
  chemically synthesized
ttaatttccttctcagctagtt

SEQ ID NO: 29333 - DNA, 22 bp, Artificial Sequence
  chemically synthesized
aatttccttctcagctagttta

SEQ ID NO: 29334 - DNA, 22 bp, Artificial Sequence
  chemically synthesized
atttccttctcagctagtttat

SEQ ID NO: 29335 - DNA, 22 bp, Artificial Sequence
  chemically synthesized
ccttctcagctagtttattatt

SEQ ID NO: 29336 - DNA, 22 bp, Artificial Sequence
  chemically synthesized
cttctcagctagtttattattg

SEQ ID NO: 29337 - DNA, 22 bp, Artificial Sequence
  chemically synthesized
ctcagctagtttattattggtg

SEQ ID NO: 29338 - DNA, 22 bp, Artificial Sequence
  chemically synthesized
tcagctagtttattattggtgt

SEQ ID NO: 29339 - DNA, 22 bp, Artificial Sequence
  chemically synthesized
agctagtttattattggtgtgt

SEQ ID NO: 29340 - DNA, 22 bp, Artificial Sequence
  chemically synthesized
gtttattattggtgtgtagaaa

SEQ ID NO: 29341 - DNA, 22 bp, Artificial Sequence
  chemically synthesized
attattggtgtgtagaaacatt

SEQ ID NO: 29342 - DNA, 22 bp, Artificial Sequence
  chemically synthesized
ttattggtgtgtagaaacattg

SEQ ID NO: 29343 - DNA, 22 bp, Artificial Sequence
  chemically synthesized
ttggtgtgtagaaacattgctt

SEQ ID NO: 29344 - DNA, 22 bp, Artificial Sequence
  chemically synthesized
gtgtgtagaaacattgcttgtt

SEQ ID NO: 29345 - DNA, 22 bp, Artificial Sequence
  chemically synthesized
cttgtttcatatgctgattttg

SEQ ID NO: 29346 - DNA, 22 bp, Artificial Sequence
  chemically synthesized
gtttcatatgctgattttgtct

SEQ ID NO: 29347 - DNA, 22 bp, Artificial Sequence
  chemically synthesized
tttcatatgctgattttgtctc

SEQ ID NO: 29348 - DNA, 22 bp, Artificial Sequence
  chemically synthesized
catatgctgattttgtctcctg

SEQ ID NO: 29349 - DNA, 22 bp, Artificial Sequence
  chemically synthesized
atatgctgattttgtctcctgt

SEQ ID NO: 29350 - DNA, 22 bp, Artificial Sequence
  chemically synthesized
attttgtctcctgtaactttac

SEQ ID NO: 29351 - DNA, 22 bp, Artificial Sequence
  chemically synthesized
tgtctcctgtaactttactgaa

SEQ ID NO: 29352 - DNA, 22 bp, Artificial Sequence
  chemically synthesized
gtctcctgtaactttactgaat

SEQ ID NO: 29353 - DNA, 22 bp, Artificial Sequence
  chemically synthesized
tctcctgtaactttactgaatt

SEQ ID NO: 29354 - DNA, 22 bp, Artificial Sequence
  chemically synthesized
ctgtaactttactgaatttatt

SEQ ID NO: 29355 - DNA, 22 bp, Artificial Sequence
  chemically synthesized
taactttactgaatttattttt

SEQ ID NO: 29356 - DNA, 22 bp, Artificial Sequence
  chemically synthesized
tactgaatttatttttcagcgc

SEQ ID NO: 29357 - DNA, 22 bp, Artificial Sequence
  chemically synthesized
actgaatttatttttcagcgct

SEQ ID NO: 29358 - DNA, 22 bp, Artificial Sequence
  chemically synthesized
ctgaatttatttttcagcgcta

SEQ ID NO: 29359 - DNA, 22 bp, Artificial Sequence
  chemically synthesized
aatttatttttcagcgctaaga

SEQ ID NO: 29360 - DNA, 22 bp, Artificial Sequence
  chemically synthesized
atttttcagcgctaagagtgct

SEQ ID NO: 29361 - DNA, 22 bp, Artificial Sequence
  chemically synthesized
tttttcagcgctaagagtgctt

SEQ ID NO: 29362 - DNA, 22 bp, Artificial Sequence
  chemically synthesized
ttcagcgctaagagtgctttgg

SEQ ID NO: 29363 - DNA, 22 bp, Artificial Sequence
  chemically synthesized
tcagcgctaagagtgctttggt

SEQ ID NO: 29364 - DNA, 22 bp, Artificial Sequence
  chemically synthesized
cagcgctaagagtgctttggtg

SEQ ID NO: 29365 - DNA, 22 bp, Artificial Sequence
  chemically synthesized
agcgctaagagtgctttggtgg

SEQ ID NO: 29366 - DNA, 22 bp, Artificial Sequence
  chemically synthesized
agagtgctttggtggagtcttg

SEQ ID NO: 29367 - DNA, 22 bp, Artificial Sequence
  chemically synthesized
tggtggagtcttggtttttcta

SEQ ID NO: 29368 - DNA, 22 bp, Artificial Sequence
  chemically synthesized
ggtggagtcttggtttttctag

SEQ ID NO: 29369 - DNA, 22 bp, Artificial Sequence
  chemically synthesized
gtggagtcttggtttttctagg

SEQ ID NO: 29370 - DNA, 22 bp, Artificial Sequence
  chemically synthesized
ggtttttctaggtataaaatca

SEQ ID NO: 29371 - DNA, 22 bp, Artificial Sequence
  chemically synthesized
gtttttctaggtataaaatcat

SEQ ID NO: 29372 - DNA, 22 bp, Artificial Sequence
  chemically synthesized
ttctaggtataaaatcatgtca

SEQ ID NO: 29373 - DNA, 22 bp, Artificial Sequence
  chemically synthesized
tctaggtataaaatcatgtcat

SEQ ID NO: 29374 - DNA, 22 bp, Artificial Sequence
  chemically synthesized
ctaggtataaaatcatgtcatc

SEQ ID NO: 29375 - DNA, 22 bp, Artificial Sequence
  chemically synthesized
taggtataaaatcatgtcatct

SEQ ID NO: 29376 - DNA, 22 bp, Artificial Sequence
  chemically synthesized
ggtataaaatcatgtcatctgg

SEQ ID NO: 29377 - DNA, 22 bp, Artificial Sequence
  chemically synthesized
gaaagatggacagtttgacttc

SEQ ID NO: 29378 - DNA, 22 bp, Artificial Sequence
  chemically synthesized
gacttcatcttttcctatttgc

SEQ ID NO: 29379 - DNA, 22 bp, Artificial Sequence
  chemically synthesized
acttcatcttttcctatttgca

SEQ ID NO: 29380 - DNA, 22 bp, Artificial Sequence
  chemically synthesized
catcttttcctatttgcatgcc

SEQ ID NO: 29381 - DNA, 22 bp, Artificial Sequence
  chemically synthesized
atcttttcctatttgcatgcct

SEQ ID NO: 29382 - DNA, 22 bp, Artificial Sequence
  chemically synthesized
ttcctatttgcatgccttttct

SEQ ID NO: 29383 - DNA, 22 bp, Artificial Sequence
  chemically synthesized
tcctatttgcatgccttttctt

SEQ ID NO: 29384 - DNA, 22 bp, Artificial Sequence
  chemically synthesized
cctatttgcatgccttttcttt

SEQ ID NO: 29385 - DNA, 22 bp, Artificial Sequence
  chemically synthesized
ctatttgcatgccttttctttc

SEQ ID NO: 29386 - DNA, 22 bp, Artificial Sequence
  chemically synthesized
tttgcatgccttttctttcttt

SEQ ID NO: 29387 - DNA, 22 bp, Artificial Sequence
  chemically synthesized
gcatgccttttctttctttctt

SEQ ID NO: 29388 - DNA, 22 bp, Artificial Sequence
  chemically synthesized
catgccttttctttctttcttt

SEQ ID NO: 29389 - DNA, 22 bp, Artificial Sequence
  chemically synthesized
ttctttctttctttctctgacc

SEQ ID NO: 29390 - DNA, 22 bp, Artificial Sequence
  chemically synthesized
tctttctttctttctctgacct

SEQ ID NO: 29391 - DNA, 22 bp, Artificial Sequence
  chemically synthesized
ctttctttctttctctgacctg

SEQ ID NO: 29392 - DNA, 22 bp, Artificial Sequence
  chemically synthesized
tttctttctttctctgacctga

SEQ ID NO: 29393 - DNA, 22 bp, Artificial Sequence
  chemically synthesized
tctttctttctctgacctgaaa

SEQ ID NO: 29394 - DNA, 22 bp, Artificial Sequence
  chemically synthesized
ctttctttctctgacctgaaag

SEQ ID NO: 29395 - DNA, 22 bp, Artificial Sequence
  chemically synthesized
tttctttctctgacctgaaagc

SEQ ID NO: 29396 - DNA, 22 bp, Artificial Sequence
  chemically synthesized
tctttctctgacctgaaagctg

SEQ ID NO: 29397 - DNA, 22 bp, Artificial Sequence
  chemically synthesized
ctttctctgacctgaaagctgt

SEQ ID NO: 29398 - DNA, 22 bp, Artificial Sequence
  chemically synthesized
tttctctgacctgaaagctgtg

SEQ ID NO: 29399 - DNA, 22 bp, Artificial Sequence
  chemically synthesized
tctctgacctgaaagctgtggc

SEQ ID NO: 29400 - DNA, 22 bp, Artificial Sequence
  chemically synthesized
ctctgacctgaaagctgtggct

SEQ ID NO: 29401 - DNA, 22 bp, Artificial Sequence
  chemically synthesized
tctgacctgaaagctgtggcta

SEQ ID NO: 29402 - DNA, 22 bp, Artificial Sequence
  chemically synthesized
tgacctgaaagctgtggctagg

SEQ ID NO: 29403 - DNA, 22 bp, Artificial Sequence
  chemically synthesized
acctgaaagctgtggctaggac

SEQ ID NO: 29404 - DNA, 22 bp, Artificial Sequence
  chemically synthesized
aaagctgtggctaggacttcca

SEQ ID NO: 29405 - DNA, 22 bp, Artificial Sequence
  chemically synthesized
tggctaggacttccagtattat

SEQ ID NO: 29406 - DNA, 22 bp, Artificial Sequence
  chemically synthesized
ggacttccagtattatattgaa

SEQ ID NO: 29407 - DNA, 22 bp, Artificial Sequence
  chemically synthesized
ccagtattatattgaataggag

SEQ ID NO: 29408 - DNA, 22 bp, Artificial Sequence
  chemically synthesized
cagtattatattgaataggagt

SEQ ID NO: 29409 - DNA, 22 bp, Artificial Sequence
  chemically synthesized
tattgaataggagtgatggaag

SEQ ID NO: 29410 - DNA, 22 bp, Artificial Sequence
  chemically synthesized
aataggagtgatggaagtgggc

SEQ ID NO: 29411 - DNA, 22 bp, Artificial Sequence
  chemically synthesized
attttgtttcagttcttagagg

SEQ ID NO: 29412 - DNA, 22 bp, Artificial Sequence
  chemically synthesized
ttttgtttcagttcttagagga

SEQ ID NO: 29413 - DNA, 22 bp, Artificial Sequence
  chemically synthesized
tgtttcagttcttagaggaaag

SEQ ID NO: 29414 - DNA, 22 bp, Artificial Sequence
  chemically synthesized
gtttcagttcttagaggaaagg

SEQ ID NO: 29415 - DNA, 22 bp, Artificial Sequence
  chemically synthesized
tttcagttcttagaggaaaggc

SEQ ID NO: 29416 - DNA, 22 bp, Artificial Sequence
  chemically synthesized
cagttcttagaggaaaggcttc

SEQ ID NO: 29417 - DNA, 22 bp, Artificial Sequence
  chemically synthesized
agttcttagaggaaaggcttcc

SEQ ID NO: 29418 - DNA, 22 bp, Artificial Sequence
  chemically synthesized
ttagaggaaaggcttccagctt

SEQ ID NO: 29419 - DNA, 22 bp, Artificial Sequence
  chemically synthesized
agaggaaaggcttccagctttt

SEQ ID NO: 29420 - DNA, 22 bp, Artificial Sequence
  chemically synthesized
gaggaaaggcttccagcttttc

SEQ ID NO: 29421 - DNA, 22 bp, Artificial Sequence
  chemically synthesized
ccagcttttcccaattcagtat

SEQ ID NO: 29422 - DNA, 22 bp, Artificial Sequence
  chemically synthesized
cagcttttcccaattcagtatg

SEQ ID NO: 29423 - DNA, 22 bp, Artificial Sequence
  chemically synthesized
ttcccaattcagtatgatgtta

SEQ ID NO: 29424 - DNA, 22 bp, Artificial Sequence
  chemically synthesized
tcccaattcagtatgatgttag

SEQ ID NO: 29425 - DNA, 22 bp, Artificial Sequence
  chemically synthesized
cccaattcagtatgatgttagc

SEQ ID NO: 29426 - DNA, 22 bp, Artificial Sequence
  chemically synthesized
ccaattcagtatgatgttagct

SEQ ID NO: 29427 - DNA, 22 bp, Artificial Sequence
  chemically synthesized
agtatgatgttagctgtgggtt

SEQ ID NO: 29428 - DNA, 22 bp, Artificial Sequence
  chemically synthesized
gctgtgggtttgtcatatatga

SEQ ID NO: 29429 - DNA, 22 bp, Artificial Sequence
  chemically synthesized
tgggtttgtcatatatgacttt

SEQ ID NO: 29430 - DNA, 22 bp, Artificial Sequence
  chemically synthesized
gtcatatatgacttttattata

SEQ ID NO: 29431 - DNA, 22 bp, Artificial Sequence
  chemically synthesized
tcatatatgacttttattatat

SEQ ID NO: 29432 - DNA, 22 bp, Artificial Sequence
  chemically synthesized
ttattatattgagatatgttcc

SEQ ID NO: 29433 - DNA, 22 bp, Artificial Sequence
  chemically synthesized
tattatattgagatatgttcct

SEQ ID NO: 29434 - DNA, 22 bp, Artificial Sequence
  chemically synthesized
attatattgagatatgttcctt

SEQ ID NO: 29435 - DNA, 22 bp, Artificial Sequence
  chemically synthesized
ttatattgagatatgttccttc

SEQ ID NO: 29436 - DNA, 22 bp, Artificial Sequence
  chemically synthesized
tattgagatatgttccttctat

SEQ ID NO: 29437 - DNA, 22 bp, Artificial Sequence
  chemically synthesized
agatatgttccttctatgattg

SEQ ID NO: 29438 - DNA, 22 bp, Artificial Sequence
  chemically synthesized
cttctatgattggctgcagata

SEQ ID NO: 29439 - DNA, 22 bp, Artificial Sequence
  chemically synthesized
ctatgattggctgcagatagtt

SEQ ID NO: 29440 - DNA, 22 bp, Artificial Sequence
  chemically synthesized
tatgattggctgcagatagttt

SEQ ID NO: 29441 - DNA, 22 bp, Artificial Sequence
  chemically synthesized
tgattggctgcagatagttttt

SEQ ID NO: 29442 - DNA, 22 bp, Artificial Sequence
  chemically synthesized
gctgcagatagtttttatcatg

SEQ ID NO: 29443 - DNA, 22 bp, Artificial Sequence
  chemically synthesized
cagatagtttttatcatgaagg

SEQ ID NO: 29444 - DNA, 22 bp, Artificial Sequence
  chemically synthesized
ttatcatgaaggaatgttaaat

SEQ ID NO: 29445 - DNA, 22 bp, Artificial Sequence
  chemically synthesized
tatcatgaaggaatgttaaatt

SEQ ID NO: 29446 - DNA, 22 bp, Artificial Sequence
  chemically synthesized
atcatgaaggaatgttaaattt

SEQ ID NO: 29447 - DNA, 22 bp, Artificial Sequence
  chemically synthesized
tcatgaaggaatgttaaatttt

SEQ ID NO: 29448 - DNA, 22 bp, Artificial Sequence
  chemically synthesized
aattttatcaaatactttttct

SEQ ID NO: 29449 - DNA, 22 bp, Artificial Sequence
  chemically synthesized
tatcaaatactttttctgtatc

SEQ ID NO: 29450 - DNA, 22 bp, Artificial Sequence
  chemically synthesized
atcaaatactttttctgtatct

SEQ ID NO: 29451 - DNA, 22 bp, Artificial Sequence
  chemically synthesized
tcaaatactttttctgtatcta

SEQ ID NO: 29452 - DNA, 22 bp, Artificial Sequence
  chemically synthesized
tttctgtatctattgagatgat

SEQ ID NO: 29453 - DNA, 22 bp, Artificial Sequence
  chemically synthesized
ttctgtatctattgagatgatc

SEQ ID NO: 29454 - DNA, 22 bp, Artificial Sequence
  chemically synthesized
tctgtatctattgagatgatca

SEQ ID NO: 29455 - DNA, 22 bp, Artificial Sequence
  chemically synthesized
ctgtatctattgagatgatcat

SEQ ID NO: 29456 - DNA, 22 bp, Artificial Sequence
  chemically synthesized
tgtatctattgagatgatcata

SEQ ID NO: 29457 - DNA, 22 bp, Artificial Sequence
  chemically synthesized
tatctattgagatgatcatatg

SEQ ID NO: 29458 - DNA, 22 bp, Artificial Sequence
  chemically synthesized
ttgagatgatcatatggttttt

SEQ ID NO: 29459 - DNA, 22 bp, Artificial Sequence
  chemically synthesized
agatgatcatatggtttttgtt

SEQ ID NO: 29460 - DNA, 22 bp, Artificial Sequence
  chemically synthesized
ttgttctttttgttgatgtgat

SEQ ID NO: 29461 - DNA, 22 bp, Artificial Sequence
  chemically synthesized
tgttctttttgttgatgtgatg

SEQ ID NO: 29462 - DNA, 22 bp, Artificial Sequence
  chemically synthesized
gttctttttgttgatgtgatgt

SEQ ID NO: 29463 - DNA, 22 bp, Artificial Sequence
  chemically synthesized
ttctttttgttgatgtgatgta

SEQ ID NO: 29464 - DNA, 22 bp, Artificial Sequence
  chemically synthesized
tttttgttgatgtgatgtatca

SEQ ID NO: 29465 - DNA, 22 bp, Artificial Sequence
  chemically synthesized
tttgttgatgtgatgtatcaca

SEQ ID NO: 29466 - DNA, 22 bp, Artificial Sequence
  chemically synthesized
ttgttgatgtgatgtatcacat

SEQ ID NO: 29467 - DNA, 22 bp, Artificial Sequence
  chemically synthesized
tgttgatgtgatgtatcacatt

SEQ ID NO: 29468 - DNA, 22 bp, Artificial Sequence
  chemically synthesized
gttgatgtgatgtatcacattt

SEQ ID NO: 29469 - DNA, 22 bp, Artificial Sequence
  chemically synthesized
ttgatgtgatgtatcacattta

SEQ ID NO: 29470 - DNA, 22 bp, Artificial Sequence
  chemically synthesized
atgtgatgtatcacatttattg

SEQ ID NO: 29471 - DNA, 22 bp, Artificial Sequence
  chemically synthesized
attgatttgaactgttcttgca

SEQ ID NO: 29472 - DNA, 22 bp, Artificial Sequence
  chemically synthesized
ttgatttgaactgttcttgcaa

SEQ ID NO: 29473 - DNA, 22 bp, Artificial Sequence
  chemically synthesized
atttgaactgttcttgcaaccc

SEQ ID NO: 29474 - DNA, 22 bp, Artificial Sequence
  chemically synthesized
gaactgttcttgcaaccctagt

SEQ ID NO: 29475 - DNA, 22 bp, Artificial Sequence
  chemically synthesized
aactgttcttgcaaccctagta

SEQ ID NO: 29476 - DNA, 22 bp, Artificial Sequence
  chemically synthesized
ttcttgcaaccctagtataaat

SEQ ID NO: 29477 - DNA, 22 bp, Artificial Sequence
  chemically synthesized
ttgcaaccctagtataaatccc

SEQ ID NO: 29478 - DNA, 22 bp, Artificial Sequence
  chemically synthesized
gcaaccctagtataaatcccac

SEQ ID NO: 29479 - DNA, 22 bp, Artificial Sequence
  chemically synthesized
caaccctagtataaatcccact

SEQ ID NO: 29480 - DNA, 22 bp, Artificial Sequence
  chemically synthesized
gtataaatcccacttgatcatg

SEQ ID NO: 29481 - DNA, 22 bp, Artificial Sequence
  chemically synthesized
gatcatggtgtattatcttttg

SEQ ID NO: 29482 - DNA, 22 bp, Artificial Sequence
  chemically synthesized
atcatggtgtattatcttttgg

SEQ ID NO: 29483 - DNA, 22 bp, Artificial Sequence
  chemically synthesized
tcttttggatgtactgttggat

SEQ ID NO: 29484 - DNA, 22 bp, Artificial Sequence
  chemically synthesized
ttggatgtactgttggattcag

SEQ ID NO: 29485 - DNA, 22 bp, Artificial Sequence
  chemically synthesized
tggatgtactgttggattcagt

SEQ ID NO: 29486 - DNA, 22 bp, Artificial Sequence
  chemically synthesized
ggatgtactgttggattcagtt

SEQ ID NO: 29487 - DNA, 22 bp, Artificial Sequence
  chemically synthesized
gatgtactgttggattcagttt

SEQ ID NO: 29488 - DNA, 22 bp, Artificial Sequence
  chemically synthesized
ttggattcagtttgctagtatt

SEQ ID NO: 29489 - DNA, 22 bp, Artificial Sequence
  chemically synthesized
gattcagtttgctagtattttg

SEQ ID NO: 29490 - DNA, 22 bp, Artificial Sequence
  chemically synthesized
agtttgctagtattttgttgag

SEQ ID NO: 29491 - DNA, 22 bp, Artificial Sequence
  chemically synthesized
gctagtattttgttgaggattt

SEQ ID NO: 29492 - DNA, 22 bp, Artificial Sequence
  chemically synthesized
ctagtattttgttgaggatttt

SEQ ID NO: 29493 - DNA, 22 bp, Artificial Sequence
  chemically synthesized
gtattttgttgaggattttcac

SEQ ID NO: 29494 - DNA, 22 bp, Artificial Sequence
  chemically synthesized
tgttgaggattttcacacctat

SEQ ID NO: 29495 - DNA, 22 bp, Artificial Sequence
  chemically synthesized
gttgaggattttcacacctatg

SEQ ID NO: 29496 - DNA, 22 bp, Artificial Sequence
  chemically synthesized
ttgaggattttcacacctatgt

SEQ ID NO: 29497 - DNA, 22 bp, Artificial Sequence
  chemically synthesized
aggattttcacacctatgttcc

SEQ ID NO: 29498 - DNA, 22 bp, Artificial Sequence
  chemically synthesized
tcacacctatgttccatcaggg

SEQ ID NO: 29499 - DNA, 22 bp, Artificial Sequence
  chemically synthesized
cacacctatgttccatcaggga

SEQ ID NO: 29500 - DNA, 22 bp, Artificial Sequence
  chemically synthesized
acacctatgttccatcagggat

SEQ ID NO: 29501 - DNA, 22 bp, Artificial Sequence
  chemically synthesized
tgttccatcagggatattgacc

SEQ ID NO: 29502 - DNA, 22 bp, Artificial Sequence
  chemically synthesized
catcagggatattgacctgcag

SEQ ID NO: 29503 - DNA, 22 bp, Artificial Sequence
  chemically synthesized
acctgcagttttatttttactt

SEQ ID NO: 29504 - DNA, 22 bp, Artificial Sequence
  chemically synthesized
cagttttatttttacttgcatc

SEQ ID NO: 29505 - DNA, 22 bp, Artificial Sequence
  chemically synthesized
tatttttacttgcatccttgtc

SEQ ID NO: 29506 - DNA, 22 bp, Artificial Sequence
  chemically synthesized
atttttacttgcatccttgtct

SEQ ID NO: 29507 - DNA, 22 bp, Artificial Sequence
  chemically synthesized
tttttacttgcatccttgtctg

SEQ ID NO: 29508 - DNA, 22 bp, Artificial Sequence
  chemically synthesized
ttacttgcatccttgtctggtt

SEQ ID NO: 29509 - DNA, 22 bp, Artificial Sequence
  chemically synthesized
tacttgcatccttgtctggtta

SEQ ID NO: 29510 - DNA, 22 bp, Artificial Sequence
  chemically synthesized
acttgcatccttgtctggttat

SEQ ID NO: 29511 - DNA, 22 bp, Artificial Sequence
  chemically synthesized
cttgcatccttgtctggttatg

SEQ ID NO: 29512 - DNA, 22 bp, Artificial Sequence
  chemically synthesized
gcatccttgtctggttatggaa

SEQ ID NO: 29513 - DNA, 22 bp, Artificial Sequence
  chemically synthesized
catccttgtctggttatggaat

SEQ ID NO: 29514 - DNA, 22 bp, Artificial Sequence
  chemically synthesized
gtctggttatggaatcaggata

SEQ ID NO: 29515 - DNA, 22 bp, Artificial Sequence
  chemically synthesized
tctggttatggaatcaggataa

SEQ ID NO: 29516 - DNA, 22 bp, Artificial Sequence
  chemically synthesized
gttatggaatcaggataatact

SEQ ID NO: 29517 - DNA, 22 bp, Artificial Sequence
  chemically synthesized
tggaatcaggataatactggcc

SEQ ID NO: 29518 - DNA, 22 bp, Artificial Sequence
  chemically synthesized
gcctcagagaatgagttaggga

SEQ ID NO: 29519 - DNA, 22 bp, Artificial Sequence
  chemically synthesized
agagaatgagttagggagaatt

SEQ ID NO: 29520 - DNA, 22 bp, Artificial Sequence
  chemically synthesized
gggagaattccttcctgtttaa

SEQ ID NO: 29521 - DNA, 22 bp, Artificial Sequence
  chemically synthesized
cttcctgtttaatttttaaaag

SEQ ID NO: 29522 - DNA, 22 bp, Artificial Sequence
  chemically synthesized
cctgtttaatttttaaaagaat

SEQ ID NO: 29523 - DNA, 22 bp, Artificial Sequence
  chemically synthesized
ctgtttaatttttaaaagaatt

SEQ ID NO: 29524 - DNA, 22 bp, Artificial Sequence
  chemically synthesized
tttaatttttaaaagaatttaa

SEQ ID NO: 29525 - DNA, 22 bp, Artificial Sequence
  chemically synthesized
aatttttaaaagaatttaagga

SEQ ID NO: 29526 - DNA, 22 bp, Artificial Sequence
  chemically synthesized
atttttaaaagaatttaaggag

SEQ ID NO: 29527 - DNA, 22 bp, Artificial Sequence
  chemically synthesized
ttaaaagaatttaaggagactt

SEQ ID NO: 29528 - DNA, 22 bp, Artificial Sequence
  chemically synthesized
taaaagaatttaaggagacttg

SEQ ID NO: 29529 - DNA, 22 bp, Artificial Sequence
  chemically synthesized
aaaagaatttaaggagacttgt

SEQ ID NO: 29530 - DNA, 22 bp, Artificial Sequence
  chemically synthesized
aaagaatttaaggagacttgtt

SEQ ID NO: 29531 - DNA, 22 bp, Artificial Sequence
  chemically synthesized
aaggagacttgttagttttctt

SEQ ID NO: 29532 - DNA, 22 bp, Artificial Sequence
  chemically synthesized
aggagacttgttagttttcttt

SEQ ID NO: 29533 - DNA, 22 bp, Artificial Sequence
  chemically synthesized
gttagttttctttgaaagtttg

SEQ ID NO: 29534 - DNA, 22 bp, Artificial Sequence
  chemically synthesized
ttagttttctttgaaagtttgg

SEQ ID NO: 29535 - DNA, 22 bp, Artificial Sequence
  chemically synthesized
gttttctttgaaagtttggtaa

SEQ ID NO: 29536 - DNA, 22 bp, Artificial Sequence
  chemically synthesized
tctttgaaagtttggtaaaatt

SEQ ID NO: 29537 - DNA, 22 bp, Artificial Sequence
  chemically synthesized
ctttgaaagtttggtaaaattt

SEQ ID NO: 29538 - DNA, 22 bp, Artificial Sequence
  chemically synthesized
tttgaaagtttggtaaaatttg

SEQ ID NO: 29539 - DNA, 22 bp, Artificial Sequence
  chemically synthesized
tgaaagtttggtaaaatttgac

SEQ ID NO: 29540 - DNA, 22 bp, Artificial Sequence
  chemically synthesized
gaaagtttggtaaaatttgaca

SEQ ID NO: 29541 - DNA, 22 bp, Artificial Sequence
  chemically synthesized
aaagtttggtaaaatttgacag

SEQ ID NO: 29542 - DNA, 22 bp, Artificial Sequence
  chemically synthesized
ggtaaaatttgacagtaaagcc

SEQ ID NO: 29543 - DNA, 22 bp, Artificial Sequence
  chemically synthesized
gtaaaatttgacagtaaagcca

SEQ ID NO: 29544 - DNA, 22 bp, Artificial Sequence
  chemically synthesized
gacagtaaagccatctggtctt

SEQ ID NO: 29545 - DNA, 22 bp, Artificial Sequence
  chemically synthesized
acagtaaagccatctggtcttg

SEQ ID NO: 29546 - DNA, 22 bp, Artificial Sequence
  chemically synthesized
gtcttgaaattttcttttttgg

SEQ ID NO: 29547 - DNA, 22 bp, Artificial Sequence
  chemically synthesized
gaaattttcttttttgggagac

SEQ ID NO: 29548 - DNA, 22 bp, Artificial Sequence
  chemically synthesized
aaattttcttttttgggagact

SEQ ID NO: 29549 - DNA, 22 bp, Artificial Sequence
  chemically synthesized
tcttttttgggagactttttac

SEQ ID NO: 29550 - DNA, 22 bp, Artificial Sequence
  chemically synthesized
cttttttgggagactttttact

SEQ ID NO: 29551 - DNA, 22 bp, Artificial Sequence
  chemically synthesized
ttttttgggagactttttacta

SEQ ID NO: 29552 - DNA, 22 bp, Artificial Sequence
  chemically synthesized
ttttgggagactttttactact

SEQ ID NO: 29553 - DNA, 22 bp, Artificial Sequence
  chemically synthesized
tttgggagactttttactactg

SEQ ID NO: 29554 - DNA, 22 bp, Artificial Sequence
  chemically synthesized
ttgggagactttttactactga

SEQ ID NO: 29555 - DNA, 22 bp, Artificial Sequence
  chemically synthesized
tgggagactttttactactgat

SEQ ID NO: 29556 - DNA, 22 bp, Artificial Sequence
  chemically synthesized
gggagactttttactactgatt

SEQ ID NO: 29557 - DNA, 22 bp, Artificial Sequence
  chemically synthesized
ggagactttttactactgattc

SEQ ID NO: 29558 - DNA, 22 bp, Artificial Sequence
  chemically synthesized
tttactactgattcaatttcat

SEQ ID NO: 29559 - DNA, 22 bp, Artificial Sequence
  chemically synthesized
ttactactgattcaatttcatt

SEQ ID NO: 29560 - DNA, 22 bp, Artificial Sequence
  chemically synthesized
tactactgattcaatttcatta

SEQ ID NO: 29561 - DNA, 22 bp, Artificial Sequence
  chemically synthesized
actactgattcaatttcattat

SEQ ID NO: 29562 - DNA, 22 bp, Artificial Sequence
  chemically synthesized
ctactgattcaatttcattatt

SEQ ID NO: 29563 - DNA, 22 bp, Artificial Sequence
  chemically synthesized
ctgattcaatttcattattcat

SEQ ID NO: 29564 - DNA, 22 bp, Artificial Sequence
  chemically synthesized
attcaatttcattattcattac

SEQ ID NO: 29565 - DNA, 22 bp, Artificial Sequence
  chemically synthesized
aatttcattattcattactggt

SEQ ID NO: 29566 - DNA, 22 bp, Artificial Sequence
  chemically synthesized
cattattcattactggtctgtt

SEQ ID NO: 29567 - DNA, 22 bp, Artificial Sequence
  chemically synthesized
attattcattactggtctgttc

SEQ ID NO: 29568 - DNA, 22 bp, Artificial Sequence
  chemically synthesized
ttcattactggtctgttcaggt

SEQ ID NO: 29569 - DNA, 22 bp, Artificial Sequence
  chemically synthesized
attactggtctgttcaggtttt

SEQ ID NO: 29570 - DNA, 22 bp, Artificial Sequence
  chemically synthesized
ctggtctgttcaggttttctat

SEQ ID NO: 29571 - DNA, 22 bp, Artificial Sequence
  chemically synthesized
gtctgttcaggttttctattct

SEQ ID NO: 29572 - DNA, 22 bp, Artificial Sequence
  chemically synthesized
ttcaggttttctattctttctt

SEQ ID NO: 29573 - DNA, 22 bp, Artificial Sequence
  chemically synthesized
aggttttctattctttcttaat

SEQ ID NO: 29574 - DNA, 22 bp, Artificial Sequence
  chemically synthesized
tctattctttcttaattcaatc

SEQ ID NO: 29575 - DNA, 22 bp, Artificial Sequence
  chemically synthesized
ctattctttcttaattcaatct

SEQ ID NO: 29576 - DNA, 22 bp, Artificial Sequence
  chemically synthesized
tattctttcttaattcaatctt

SEQ ID NO: 29577 - DNA, 22 bp, Artificial Sequence
  chemically synthesized
ttctttcttaattcaatcttgg

SEQ ID NO: 29578 - DNA, 22 bp, Artificial Sequence
  chemically synthesized
tttcttaattcaatcttggtag

SEQ ID NO: 29579 - DNA, 22 bp, Artificial Sequence
  chemically synthesized
tcttaattcaatcttggtaggt

SEQ ID NO: 29580 - DNA, 22 bp, Artificial Sequence
  chemically synthesized
cttaattcaatcttggtaggtg

SEQ ID NO: 29581 - DNA, 22 bp, Artificial Sequence
  chemically synthesized
ttaattcaatcttggtaggtgg

SEQ ID NO: 29582 - DNA, 22 bp, Artificial Sequence
  chemically synthesized
aattcaatcttggtaggtggta

SEQ ID NO: 29583 - DNA, 22 bp, Artificial Sequence
  chemically synthesized
attcaatcttggtaggtggtat

SEQ ID NO: 29584 - DNA, 22 bp, Artificial Sequence
  chemically synthesized
aatcttggtaggtggtatgtgt

SEQ ID NO: 29585 - DNA, 22 bp, Artificial Sequence
  chemically synthesized
ggtaggtggtatgtgtccagaa

SEQ ID NO: 29586 - DNA, 22 bp, Artificial Sequence
  chemically synthesized
gtaggtggtatgtgtccagaaa

SEQ ID NO: 29587 - DNA, 22 bp, Artificial Sequence
  chemically synthesized
attaatttcctctagatttttc

SEQ ID NO: 29588 - DNA, 22 bp, Artificial Sequence
  chemically synthesized
ttaatttcctctagatttttca

SEQ ID NO: 29589 - DNA, 22 bp, Artificial Sequence
  chemically synthesized
atttcctctagatttttcagtt

SEQ ID NO: 29590 - DNA, 22 bp, Artificial Sequence
  chemically synthesized
cctctagatttttcagtttttt

SEQ ID NO: 29591 - DNA, 22 bp, Artificial Sequence
  chemically synthesized
ctctagatttttcagtttttta

SEQ ID NO: 29592 - DNA, 22 bp, Artificial Sequence
  chemically synthesized
tagatttttcagttttttagtg

SEQ ID NO: 29593 - DNA, 22 bp, Artificial Sequence
  chemically synthesized
gatttttcagttttttagtgta

SEQ ID NO: 29594 - DNA, 22 bp, Artificial Sequence
  chemically synthesized
ttcagttttttagtgtatggtt

SEQ ID NO: 29595 - DNA, 22 bp, Artificial Sequence
  chemically synthesized
tcagttttttagtgtatggttg

SEQ ID NO: 29596 - DNA, 22 bp, Artificial Sequence
  chemically synthesized
cagttttttagtgtatggttgt

SEQ ID NO: 29597 - DNA, 22 bp, Artificial Sequence
  chemically synthesized
agttttttagtgtatggttgtt

SEQ ID NO: 29598 - DNA, 22 bp, Artificial Sequence
  chemically synthesized
tttagtgtatggttgttcataa

SEQ ID NO: 29599 - DNA, 22 bp, Artificial Sequence
  chemically synthesized
ttagtgtatggttgttcataat

SEQ ID NO: 29600 - DNA, 22 bp, Artificial Sequence
  chemically synthesized
tagtgtatggttgttcataata

SEQ ID NO: 29601 - DNA, 22 bp, Artificial Sequence
  chemically synthesized
agtgtatggttgttcataatag

SEQ ID NO: 29602 - DNA, 22 bp, Artificial Sequence
  chemically synthesized
gtgtatggttgttcataatagt

SEQ ID NO: 29603 - DNA, 22 bp, Artificial Sequence
  chemically synthesized
ttcataatagtctctgataatc

SEQ ID NO: 29604 - DNA, 22 bp, Artificial Sequence
  chemically synthesized
ataatagtctctgataatcttt

SEQ ID NO: 29605 - DNA, 22 bp, Artificial Sequence
  chemically synthesized
tgataatcttttctatttctgt

SEQ ID NO: 29606 - DNA, 22 bp, Artificial Sequence
  chemically synthesized
ataatcttttctatttctgtgg

SEQ ID NO: 29607 - DNA, 22 bp, Artificial Sequence
  chemically synthesized
ttctatttctgtggtatcggtt

SEQ ID NO: 29608 - DNA, 22 bp, Artificial Sequence
  chemically synthesized
tctatttctgtggtatcggttg

SEQ ID NO: 29609 - DNA, 22 bp, Artificial Sequence
  chemically synthesized
ctatttctgtggtatcggttgt

SEQ ID NO: 29610 - DNA, 22 bp, Artificial Sequence
  chemically synthesized
tatttctgtggtatcggttgta

SEQ ID NO: 29611 - DNA, 22 bp, Artificial Sequence
  chemically synthesized
tttctgtggtatcggttgtaat

SEQ ID NO: 29612 - DNA, 22 bp, Artificial Sequence
  chemically synthesized
ctgtggtatcggttgtaatata

SEQ ID NO: 29613 - DNA, 22 bp, Artificial Sequence
  chemically synthesized
tgtggtatcggttgtaatatat

SEQ ID NO: 29614 - DNA, 22 bp, Artificial Sequence
  chemically synthesized
tggtatcggttgtaatatattt

SEQ ID NO: 29615 - DNA, 22 bp, Artificial Sequence
  chemically synthesized
taatatattttcttttttattt

SEQ ID NO: 29616 - DNA, 22 bp, Artificial Sequence
  chemically synthesized
tcttttttatttctgattttct

SEQ ID NO: 29617 - DNA, 22 bp, Artificial Sequence
  chemically synthesized
cttttttatttctgattttctt

SEQ ID NO: 29618 - DNA, 22 bp, Artificial Sequence
  chemically synthesized
ttttttatttctgattttcttt

SEQ ID NO: 29619 - DNA, 22 bp, Artificial Sequence
  chemically synthesized
ttttatttctgattttctttat

SEQ ID NO: 29620 - DNA, 22 bp, Artificial Sequence
  chemically synthesized
tttatttctgattttctttatt

SEQ ID NO: 29621 - DNA, 22 bp, Artificial Sequence
  chemically synthesized
ttatttctgattttctttattt

SEQ ID NO: 29622 - DNA, 22 bp, Artificial Sequence
  chemically synthesized
tatttctgattttctttatttc

SEQ ID NO: 29623 - DNA, 22 bp, Artificial Sequence
  chemically synthesized
atttctgattttctttatttca

SEQ ID NO: 29624 - DNA, 22 bp, Artificial Sequence
  chemically synthesized
tttctgattttctttatttcag

SEQ ID NO: 29625 - DNA, 22 bp, Artificial Sequence
  chemically synthesized
ctgattttctttatttcagtct

SEQ ID NO: 29626 - DNA, 22 bp, Artificial Sequence
  chemically synthesized
tgattttctttatttcagtctc

SEQ ID NO: 29627 - DNA, 22 bp, Artificial Sequence
  chemically synthesized
attttctttatttcagtctctt

SEQ ID NO: 29628 - DNA, 22 bp, Artificial Sequence
  chemically synthesized
tctttatttcagtctcttctct

SEQ ID NO: 29629 - DNA, 22 bp, Artificial Sequence
  chemically synthesized
ctttatttcagtctcttctctt

SEQ ID NO: 29630 - DNA, 22 bp, Artificial Sequence
  chemically synthesized
tttatttcagtctcttctcttt

SEQ ID NO: 29631 - DNA, 22 bp, Artificial Sequence
  chemically synthesized
tatttcagtctcttctcttttt

SEQ ID NO: 29632 - DNA, 22 bp, Artificial Sequence
  chemically synthesized
atttcagtctcttctctttttc

SEQ ID NO: 29633 - DNA, 22 bp, Artificial Sequence
  chemically synthesized
tttcagtctcttctctttttct

SEQ ID NO: 29634 - DNA, 22 bp, Artificial Sequence
  chemically synthesized
cagtctcttctctttttcttgg

SEQ ID NO: 29635 - DNA, 22 bp, Artificial Sequence
  chemically synthesized
agtctcttctctttttcttggt

SEQ ID NO: 29636 - DNA, 22 bp, Artificial Sequence
  chemically synthesized
ttctctttttcttggttagtct

SEQ ID NO: 29637 - DNA, 22 bp, Artificial Sequence
  chemically synthesized
ctctttttcttggttagtctag

SEQ ID NO: 29638 - DNA, 22 bp, Artificial Sequence
  chemically synthesized
tctttttcttggttagtctagc

SEQ ID NO: 29639 - DNA, 22 bp, Artificial Sequence
  chemically synthesized
tttttcttggttagtctagcta

SEQ ID NO: 29640 - DNA, 22 bp, Artificial Sequence
  chemically synthesized
tttcttggttagtctagctaga

SEQ ID NO: 29641 - DNA, 22 bp, Artificial Sequence
  chemically synthesized
ttcttggttagtctagctagag

SEQ ID NO: 29642 - DNA, 22 bp, Artificial Sequence
  chemically synthesized
tcttggttagtctagctagagc

SEQ ID NO: 29643 - DNA, 22 bp, Artificial Sequence
  chemically synthesized
cttggttagtctagctagagct

SEQ ID NO: 29644 - DNA, 22 bp, Artificial Sequence
  chemically synthesized
ttggttagtctagctagagcta

SEQ ID NO: 29645 - DNA, 22 bp, Artificial Sequence
  chemically synthesized
ggttagtctagctagagctata

SEQ ID NO: 29646 - DNA, 22 bp, Artificial Sequence
  chemically synthesized
gttagtctagctagagctatat

SEQ ID NO: 29647 - DNA, 22 bp, Artificial Sequence
  chemically synthesized
gtctagctagagctatatccat

SEQ ID NO: 29648 - DNA, 22 bp, Artificial Sequence
  chemically synthesized
gctagagctatatccattttat

SEQ ID NO: 29649 - DNA, 22 bp, Artificial Sequence
  chemically synthesized
gagctatatccattttatcttt

SEQ ID NO: 29650 - DNA, 22 bp, Artificial Sequence
  chemically synthesized
tatccattttatcttttttaaa

SEQ ID NO: 29651 - DNA, 22 bp, Artificial Sequence
  chemically synthesized
tatcttttttaaataacaactt

SEQ ID NO: 29652 - DNA, 22 bp, Artificial Sequence
  chemically synthesized
atcttttttaaataacaacttt

SEQ ID NO: 29653 - DNA, 22 bp, Artificial Sequence
  chemically synthesized
tcttttttaaataacaactttt

SEQ ID NO: 29654 - DNA, 22 bp, Artificial Sequence
  chemically synthesized
ttttaaataacaacttttcatt

SEQ ID NO: 29655 - DNA, 22 bp, Artificial Sequence
  chemically synthesized
tttaaataacaacttttcattt

SEQ ID NO: 29656 - DNA, 22 bp, Artificial Sequence
  chemically synthesized
ttaaataacaacttttcatttt

SEQ ID NO: 29657 - DNA, 22 bp, Artificial Sequence
  chemically synthesized
taaataacaacttttcattttg

SEQ ID NO: 29658 - DNA, 22 bp, Artificial Sequence
  chemically synthesized
aaataacaacttttcattttgc

SEQ ID NO: 29659 - DNA, 22 bp, Artificial Sequence
  chemically synthesized
aataacaacttttcattttgct

SEQ ID NO: 29660 - DNA, 22 bp, Artificial Sequence
  chemically synthesized
ttcattttgctaatcccttgtt

SEQ ID NO: 29661 - DNA, 22 bp, Artificial Sequence
  chemically synthesized
tcattttgctaatcccttgttg

SEQ ID NO: 29662 - DNA, 22 bp, Artificial Sequence
  chemically synthesized
cattttgctaatcccttgttgt

SEQ ID NO: 29663 - DNA, 22 bp, Artificial Sequence
  chemically synthesized
attttgctaatcccttgttgtt

SEQ ID NO: 29664 - DNA, 22 bp, Artificial Sequence
  chemically synthesized
tgctaatcccttgttgttgttt

SEQ ID NO: 29665 - DNA, 22 bp, Artificial Sequence
  chemically synthesized
gctaatcccttgttgttgtttt

SEQ ID NO: 29666 - DNA, 22 bp, Artificial Sequence
  chemically synthesized
ctaatcccttgttgttgttttt

SEQ ID NO: 29667 - DNA, 22 bp, Artificial Sequence
  chemically synthesized
atcccttgttgttgtttttctc

SEQ ID NO: 29668 - DNA, 22 bp, Artificial Sequence
  chemically synthesized
gttgttgtttttctctatttca

SEQ ID NO: 29669 - DNA, 22 bp, Artificial Sequence
  chemically synthesized
ttgttgtttttctctatttcat

SEQ ID NO: 29670 - DNA, 22 bp, Artificial Sequence
  chemically synthesized
ttgtttttctctatttcattaa

SEQ ID NO: 29671 - DNA, 22 bp, Artificial Sequence
  chemically synthesized
tttttctctatttcattaagtt

SEQ ID NO: 29672 - DNA, 22 bp, Artificial Sequence
  chemically synthesized
ttctctatttcattaagttctt

SEQ ID NO: 29673 - DNA, 22 bp, Artificial Sequence
  chemically synthesized
tctctatttcattaagttcttc

SEQ ID NO: 29674 - DNA, 22 bp, Artificial Sequence
  chemically synthesized
ctctatttcattaagttcttct

SEQ ID NO: 29675 - DNA, 22 bp, Artificial Sequence
  chemically synthesized
tctatttcattaagttcttctg

SEQ ID NO: 29676 - DNA, 22 bp, Artificial Sequence
  chemically synthesized
tatttcattaagttcttctgtt

SEQ ID NO: 29677 - DNA, 22 bp, Artificial Sequence
  chemically synthesized
tttcattaagttcttctgttct

SEQ ID NO: 29678 - DNA, 22 bp, Artificial Sequence
  chemically synthesized
cattaagttcttctgttcttca

SEQ ID NO: 29679 - DNA, 22 bp, Artificial Sequence
  chemically synthesized
attaagttcttctgttcttcat

SEQ ID NO: 29680 - DNA, 22 bp, Artificial Sequence
  chemically synthesized
agttcttctgttcttcattttt

SEQ ID NO: 29681 - DNA, 22 bp, Artificial Sequence
  chemically synthesized
ttctgttcttcattttttcttt

SEQ ID NO: 29682 - DNA, 22 bp, Artificial Sequence
  chemically synthesized
ctgttcttcattttttctttcc

SEQ ID NO: 29683 - DNA, 22 bp, Artificial Sequence
  chemically synthesized
tgttcttcattttttctttcct

SEQ ID NO: 29684 - DNA, 22 bp, Artificial Sequence
  chemically synthesized
ttcttcattttttctttccttc

SEQ ID NO: 29685 - DNA, 22 bp, Artificial Sequence
  chemically synthesized
ttcattttttctttccttctgc

SEQ ID NO: 29686 - DNA, 22 bp, Artificial Sequence
  chemically synthesized
cattttttctttccttctgcta

SEQ ID NO: 29687 - DNA, 22 bp, Artificial Sequence
  chemically synthesized
attttttctttccttctgctag

SEQ ID NO: 29688 - DNA, 22 bp, Artificial Sequence
  chemically synthesized
tttctttccttctgctagtttt

SEQ ID NO: 29689 - DNA, 22 bp, Artificial Sequence
  chemically synthesized
ttctttccttctgctagttttg

SEQ ID NO: 29690 - DNA, 22 bp, Artificial Sequence
  chemically synthesized
tctttccttctgctagttttgg

SEQ ID NO: 29691 - DNA, 22 bp, Artificial Sequence
  chemically synthesized
ctttccttctgctagttttggg

SEQ ID NO: 29692 - DNA, 22 bp, Artificial Sequence
  chemically synthesized
tttccttctgctagttttgggt

SEQ ID NO: 29693 - DNA, 22 bp, Artificial Sequence
  chemically synthesized
tccttctgctagttttgggttt

SEQ ID NO: 29694 - DNA, 22 bp, Artificial Sequence
  chemically synthesized
ccttctgctagttttgggtttt

SEQ ID NO: 29695 - DNA, 22 bp, Artificial Sequence
  chemically synthesized
cttctgctagttttgggttttg

SEQ ID NO: 29696 - DNA, 22 bp, Artificial Sequence
  chemically synthesized
ctgctagttttgggttttgttc

SEQ ID NO: 29697 - DNA, 22 bp, Artificial Sequence
  chemically synthesized
tgctagttttgggttttgttct

SEQ ID NO: 29698 - DNA, 22 bp, Artificial Sequence
  chemically synthesized
ctagttttgggttttgttcttg

SEQ ID NO: 29699 - DNA, 22 bp, Artificial Sequence
  chemically synthesized
gttttgggttttgttcttgctt

SEQ ID NO: 29700 - DNA, 22 bp, Artificial Sequence
  chemically synthesized
tgggttttgttcttgcttttct

SEQ ID NO: 29701 - DNA, 22 bp, Artificial Sequence
  chemically synthesized
gggttttgttcttgcttttcta

SEQ ID NO: 29702 - DNA, 22 bp, Artificial Sequence
  chemically synthesized
ggttttgttcttgcttttctag

SEQ ID NO: 29703 - DNA, 22 bp, Artificial Sequence
  chemically synthesized
tgttcttgcttttctagcttgt

SEQ ID NO: 29704 - DNA, 22 bp, Artificial Sequence
  chemically synthesized
gttcttgcttttctagcttgtt

SEQ ID NO: 29705 - DNA, 22 bp, Artificial Sequence
  chemically synthesized
ttcttgcttttctagcttgttg

SEQ ID NO: 29706 - DNA, 22 bp, Artificial Sequence
  chemically synthesized
ttgcttttctagcttgttgagg

SEQ ID NO: 29707 - DNA, 22 bp, Artificial Sequence
  chemically synthesized
gcttttctagcttgttgaggta

SEQ ID NO: 29708 - DNA, 22 bp, Artificial Sequence
  chemically synthesized
cttttctagcttgttgaggtac

SEQ ID NO: 29709 - DNA, 22 bp, Artificial Sequence
  chemically synthesized
ttctagcttgttgaggtacatg

SEQ ID NO: 29710 - DNA, 22 bp, Artificial Sequence
  chemically synthesized
tctagcttgttgaggtacatga

SEQ ID NO: 29711 - DNA, 22 bp, Artificial Sequence
  chemically synthesized
ctagcttgttgaggtacatgat

SEQ ID NO: 29712 - DNA, 22 bp, Artificial Sequence
  chemically synthesized
tagcttgttgaggtacatgatt

SEQ ID NO: 29713 - DNA, 22 bp, Artificial Sequence
  chemically synthesized
gcttgttgaggtacatgattag

SEQ ID NO: 29714 - DNA, 22 bp, Artificial Sequence
  chemically synthesized
gttgaggtacatgattagatta

SEQ ID NO: 29715 - DNA, 22 bp, Artificial Sequence
  chemically synthesized
ttgaggtacatgattagattat

SEQ ID NO: 29716 - DNA, 22 bp, Artificial Sequence
  chemically synthesized
aggtacatgattagattatata

SEQ ID NO: 29717 - DNA, 22 bp, Artificial Sequence
  chemically synthesized
gattatatatttgaaatctttc

SEQ ID NO: 29718 - DNA, 22 bp, Artificial Sequence
  chemically synthesized
tatatttgaaatctttctatgt

SEQ ID NO: 29719 - DNA, 22 bp, Artificial Sequence
  chemically synthesized
gaaatctttctatgtttttaat

SEQ ID NO: 29720 - DNA, 22 bp, Artificial Sequence
  chemically synthesized
aaatctttctatgtttttaatt

SEQ ID NO: 29721 - DNA, 22 bp, Artificial Sequence
  chemically synthesized
tctatgtttttaatttaagtgt

SEQ ID NO: 29722 - DNA, 22 bp, Artificial Sequence
  chemically synthesized
ctatgtttttaatttaagtgtt

SEQ ID NO: 29723 - DNA, 22 bp, Artificial Sequence
  chemically synthesized
tatgtttttaatttaagtgttt

SEQ ID NO: 29724 - DNA, 22 bp, Artificial Sequence
  chemically synthesized
tgtttttaatttaagtgtttat

SEQ ID NO: 29725 - DNA, 22 bp, Artificial Sequence
  chemically synthesized
ttaatttaagtgtttattgata

SEQ ID NO: 29726 - DNA, 22 bp, Artificial Sequence
  chemically synthesized
taatttaagtgtttattgataa

SEQ ID NO: 29727 - DNA, 22 bp, Artificial Sequence
  chemically synthesized
aatttaagtgtttattgataag

SEQ ID NO: 29728 - DNA, 22 bp, Artificial Sequence
  chemically synthesized
atttaagtgtttattgataagc

SEQ ID NO: 29729 - DNA, 22 bp, Artificial Sequence
  chemically synthesized
aagtgtttattgataagcttct

SEQ ID NO: 29730 - DNA, 22 bp, Artificial Sequence
  chemically synthesized
agtgtttattgataagcttctc

SEQ ID NO: 29731 - DNA, 22 bp, Artificial Sequence
  chemically synthesized
attgataagcttctctcttagc

SEQ ID NO: 29732 - DNA, 22 bp, Artificial Sequence
  chemically synthesized
ttgataagcttctctcttagca

SEQ ID NO: 29733 - DNA, 22 bp, Artificial Sequence
  chemically synthesized
ataagcttctctcttagcactg

SEQ ID NO: 29734 - DNA, 22 bp, Artificial Sequence
  chemically synthesized
ctctcttagcactgcttttgct

SEQ ID NO: 29735 - DNA, 22 bp, Artificial Sequence
  chemically synthesized
tctcttagcactgcttttgctg

SEQ ID NO: 29736 - DNA, 22 bp, Artificial Sequence
  chemically synthesized
tcttagcactgcttttgctgta

SEQ ID NO: 29737 - DNA, 22 bp, Artificial Sequence
  chemically synthesized
ttagcactgcttttgctgtatc

SEQ ID NO: 29738 - DNA, 22 bp, Artificial Sequence
  chemically synthesized
agcactgcttttgctgtatccc

SEQ ID NO: 29739 - DNA, 22 bp, Artificial Sequence
  chemically synthesized
gcactgcttttgctgtatccca

SEQ ID NO: 29740 - DNA, 22 bp, Artificial Sequence
  chemically synthesized
cttttgctgtatcccatggctt

SEQ ID NO: 29741 - DNA, 22 bp, Artificial Sequence
  chemically synthesized
ttgctgtatcccatggcttttc

SEQ ID NO: 29742 - DNA, 22 bp, Artificial Sequence
  chemically synthesized
tgctgtatcccatggcttttcc

SEQ ID NO: 29743 - DNA, 22 bp, Artificial Sequence
  chemically synthesized
gctgtatcccatggcttttcct

SEQ ID NO: 29744 - DNA, 22 bp, Artificial Sequence
  chemically synthesized
ctgtatcccatggcttttccta

SEQ ID NO: 29745 - DNA, 22 bp, Artificial Sequence
  chemically synthesized
tatcccatggcttttcctatgt

SEQ ID NO: 29746 - DNA, 22 bp, Artificial Sequence
  chemically synthesized
ttcctatgttgtatttcaattt

SEQ ID NO: 29747 - DNA, 22 bp, Artificial Sequence
  chemically synthesized
tcctatgttgtatttcaatttt

SEQ ID NO: 29748 - DNA, 22 bp, Artificial Sequence
  chemically synthesized
cctatgttgtatttcaattttc

SEQ ID NO: 29749 - DNA, 22 bp, Artificial Sequence
  chemically synthesized
ctatgttgtatttcaattttca

SEQ ID NO: 29750 - DNA, 22 bp, Artificial Sequence
  chemically synthesized
tgttgtatttcaattttcattt

SEQ ID NO: 29751 - DNA, 22 bp, Artificial Sequence
  chemically synthesized
tatttcaattttcatttgtttc

SEQ ID NO: 29752 - DNA, 22 bp, Artificial Sequence
  chemically synthesized
caattttcatttgtttcaaaaa

SEQ ID NO: 29753 - DNA, 22 bp, Artificial Sequence
  chemically synthesized
aattttcatttgtttcaaaaaa

SEQ ID NO: 29754 - DNA, 22 bp, Artificial Sequence
  chemically synthesized
tcatttgtttcaaaaaattttt

SEQ ID NO: 29755 - DNA, 22 bp, Artificial Sequence
  chemically synthesized
catttgtttcaaaaaatttttg

SEQ ID NO: 29756 - DNA, 22 bp, Artificial Sequence
  chemically synthesized
atttgtttcaaaaaatttttga

SEQ ID NO: 29757 - DNA, 22 bp, Artificial Sequence
  chemically synthesized
gtttcaaaaaatttttgatttc

SEQ ID NO: 29758 - DNA, 22 bp, Artificial Sequence
  chemically synthesized
tttcaaaaaatttttgatttcc

SEQ ID NO: 29759 - DNA, 22 bp, Artificial Sequence
  chemically synthesized
caaaaaatttttgatttccttc

SEQ ID NO: 29760 - DNA, 22 bp, Artificial Sequence
  chemically synthesized
aaaaaatttttgatttccttct

SEQ ID NO: 29761 - DNA, 22 bp, Artificial Sequence
  chemically synthesized
ttgatttccttcttaattttct

SEQ ID NO: 29762 - DNA, 22 bp, Artificial Sequence
  chemically synthesized
tgatttccttcttaattttctt

SEQ ID NO: 29763 - DNA, 22 bp, Artificial Sequence
  chemically synthesized
gatttccttcttaattttcttc

SEQ ID NO: 29764 - DNA, 22 bp, Artificial Sequence
  chemically synthesized
atttccttcttaattttcttct

SEQ ID NO: 29765 - DNA, 22 bp, Artificial Sequence
  chemically synthesized
ccttcttaattttcttcttgac

SEQ ID NO: 29766 - DNA, 22 bp, Artificial Sequence
  chemically synthesized
cttcttaattttcttcttgaca

SEQ ID NO: 29767 - DNA, 22 bp, Artificial Sequence
  chemically synthesized
cttaattttcttcttgacataa

SEQ ID NO: 29768 - DNA, 22 bp, Artificial Sequence
  chemically synthesized
ttaattttcttcttgacataac

SEQ ID NO: 29769 - DNA, 22 bp, Artificial Sequence
  chemically synthesized
aattttcttcttgacataacgt

SEQ ID NO: 29770 - DNA, 22 bp, Artificial Sequence
  chemically synthesized
attttcttcttgacataacgtt

SEQ ID NO: 29771 - DNA, 22 bp, Artificial Sequence
  chemically synthesized
tcttcttgacataacgttcatt

SEQ ID NO: 29772 - DNA, 22 bp, Artificial Sequence
  chemically synthesized
cttcttgacataacgttcattc

SEQ ID NO: 29773 - DNA, 22 bp, Artificial Sequence
  chemically synthesized
ttcttgacataacgttcattca

SEQ ID NO: 29774 - DNA, 22 bp, Artificial Sequence
  chemically synthesized
cttgacataacgttcattcagg

SEQ ID NO: 29775 - DNA, 22 bp, Artificial Sequence
  chemically synthesized
ttgacataacgttcattcagga

SEQ ID NO: 29776 - DNA, 22 bp, Artificial Sequence
  chemically synthesized
gacataacgttcattcaggagc

SEQ ID NO: 29777 - DNA, 22 bp, Artificial Sequence
  chemically synthesized
acataacgttcattcaggagca

SEQ ID NO: 29778 - DNA, 22 bp, Artificial Sequence
  chemically synthesized
attcaggagcatgttgtttaat

SEQ ID NO: 29779 - DNA, 22 bp, Artificial Sequence
  chemically synthesized
aggagcatgttgtttaatttcc

SEQ ID NO: 29780 - DNA, 22 bp, Artificial Sequence
  chemically synthesized
tttaatttccatgtatttgtat

SEQ ID NO: 29781 - DNA, 22 bp, Artificial Sequence
  chemically synthesized
aatttccatgtatttgtatagg

SEQ ID NO: 29782 - DNA, 22 bp, Artificial Sequence
  chemically synthesized
atttccatgtatttgtataggt

SEQ ID NO: 29783 - DNA, 22 bp, Artificial Sequence
  chemically synthesized
ccatgtatttgtataggtttta

SEQ ID NO: 29784 - DNA, 22 bp, Artificial Sequence
  chemically synthesized
catgtatttgtataggttttaa

SEQ ID NO: 29785 - DNA, 22 bp, Artificial Sequence
  chemically synthesized
gtataggttttaaagtttttct

SEQ ID NO: 29786 - DNA, 22 bp, Artificial Sequence
  chemically synthesized
tataggttttaaagtttttctt

SEQ ID NO: 29787 - DNA, 22 bp, Artificial Sequence
  chemically synthesized
taaagtttttcttgttattgat

SEQ ID NO: 29788 - DNA, 22 bp, Artificial Sequence
  chemically synthesized
aaagtttttcttgttattgatt

SEQ ID NO: 29789 - DNA, 22 bp, Artificial Sequence
  chemically synthesized
aagtttttcttgttattgattt

SEQ ID NO: 29790 - DNA, 22 bp, Artificial Sequence
  chemically synthesized
ttcttgttattgatttctagtt

SEQ ID NO: 29791 - DNA, 22 bp, Artificial Sequence
  chemically synthesized
tcttgttattgatttctagttt

SEQ ID NO: 29792 - DNA, 22 bp, Artificial Sequence
  chemically synthesized
cttgttattgatttctagtttt

SEQ ID NO: 29793 - DNA, 22 bp, Artificial Sequence
  chemically synthesized
ttgttattgatttctagtttta

SEQ ID NO: 29794 - DNA, 22 bp, Artificial Sequence
  chemically synthesized
gttattgatttctagttttatt

SEQ ID NO: 29795 - DNA, 22 bp, Artificial Sequence
  chemically synthesized
ttattgatttctagttttattc

SEQ ID NO: 29796 - DNA, 22 bp, Artificial Sequence
  chemically synthesized
ttgatttctagttttattccat

SEQ ID NO: 29797 - DNA, 22 bp, Artificial Sequence
  chemically synthesized
atttctagttttattccattgt

SEQ ID NO: 29798 - DNA, 22 bp, Artificial Sequence
  chemically synthesized
ctagttttattccattgtggtc

SEQ ID NO: 29799 - DNA, 22 bp, Artificial Sequence
  chemically synthesized
tagttttattccattgtggtct

SEQ ID NO: 29800 - DNA, 22 bp, Artificial Sequence
  chemically synthesized
gttttattccattgtggtctga

SEQ ID NO: 29801 - DNA, 22 bp, Artificial Sequence
  chemically synthesized
tattccattgtggtctgagaag

SEQ ID NO: 29802 - DNA, 22 bp, Artificial Sequence
  chemically synthesized
attccattgtggtctgagaaga

SEQ ID NO: 29803 - DNA, 22 bp, Artificial Sequence
  chemically synthesized
ttccattgtggtctgagaagat

SEQ ID NO: 29804 - DNA, 22 bp, Artificial Sequence
  chemically synthesized
cattgtggtctgagaagatgct

SEQ ID NO: 29805 - DNA, 22 bp, Artificial Sequence
  chemically synthesized
tggtctgagaagatgcttaata

SEQ ID NO: 29806 - DNA, 22 bp, Artificial Sequence
  chemically synthesized
agaagatgcttaatatgatttc

SEQ ID NO: 29807 - DNA, 22 bp, Artificial Sequence
  chemically synthesized
aatatgatttcaaatatttcaa

SEQ ID NO: 29808 - DNA, 22 bp, Artificial Sequence
  chemically synthesized
atatgatttcaaatatttcaaa

SEQ ID NO: 29809 - DNA, 22 bp, Artificial Sequence
  chemically synthesized
caaatatttcaaattagttgag

SEQ ID NO: 29810 - DNA, 22 bp, Artificial Sequence
  chemically synthesized
aaatatttcaaattagttgaga

SEQ ID NO: 29811 - DNA, 22 bp, Artificial Sequence
  chemically synthesized
caaattagttgagacttctttt

SEQ ID NO: 29812 - DNA, 22 bp, Artificial Sequence
  chemically synthesized
aaattagttgagacttcttttg

SEQ ID NO: 29813 - DNA, 22 bp, Artificial Sequence
  chemically synthesized
gttgagacttcttttgtgttct

SEQ ID NO: 29814 - DNA, 22 bp, Artificial Sequence
  chemically synthesized
agacttcttttgtgttctaaca

SEQ ID NO: 29815 - DNA, 22 bp, Artificial Sequence
  chemically synthesized
cttttgtgttctaacatatggt

SEQ ID NO: 29816 - DNA, 22 bp, Artificial Sequence
  chemically synthesized
ttttgtgttctaacatatggtg

SEQ ID NO: 29817 - DNA, 22 bp, Artificial Sequence
  chemically synthesized
ttgtgttctaacatatggtgta

SEQ ID NO: 29818 - DNA, 22 bp, Artificial Sequence
  chemically synthesized
tgtgttctaacatatggtgtat

SEQ ID NO: 29819 - DNA, 22 bp, Artificial Sequence
  chemically synthesized
gtgttctaacatatggtgtatc

SEQ ID NO: 29820 - DNA, 22 bp, Artificial Sequence
  chemically synthesized
tgttctaacatatggtgtatcc

SEQ ID NO: 29821 - DNA, 22 bp, Artificial Sequence
  chemically synthesized
taacatatggtgtatcctgggg

SEQ ID NO: 29822 - DNA, 22 bp, Artificial Sequence
  chemically synthesized
acatatggtgtatcctggggaa

SEQ ID NO: 29823 - DNA, 22 bp, Artificial Sequence
  chemically synthesized
gggaatgcgtcatgtgctgatg

SEQ ID NO: 29824 - DNA, 22 bp, Artificial Sequence
  chemically synthesized
atgagataaatatattctgtag

SEQ ID NO: 29825 - DNA, 22 bp, Artificial Sequence
  chemically synthesized
tgtagctgttggatgaaatatt

SEQ ID NO: 29826 - DNA, 22 bp, Artificial Sequence
  chemically synthesized
tagctgttggatgaaatattgt

SEQ ID NO: 29827 - DNA, 22 bp, Artificial Sequence
  chemically synthesized
ttggatgaaatattgtgtaaat

SEQ ID NO: 29828 - DNA, 22 bp, Artificial Sequence
  chemically synthesized
gatgaaatattgtgtaaatgtt

SEQ ID NO: 29829 - DNA, 22 bp, Artificial Sequence
  chemically synthesized
tgtaaatgttagatccatttgg

SEQ ID NO: 29830 - DNA, 22 bp, Artificial Sequence
  chemically synthesized
gatccatttggtctaaagtcaa

SEQ ID NO: 29831 - DNA, 22 bp, Artificial Sequence
  chemically synthesized
ggtctaaagtcaagtttaaatc

SEQ ID NO: 29832 - DNA, 22 bp, Artificial Sequence
  chemically synthesized
gtctaaagtcaagtttaaatcc

SEQ ID NO: 29833 - DNA, 22 bp, Artificial Sequence
  chemically synthesized
aagtcaagtttaaatccaatgt

SEQ ID NO: 29834 - DNA, 22 bp, Artificial Sequence
  chemically synthesized
aaatccaatgtttctttgttaa

SEQ ID NO: 29835 - DNA, 22 bp, Artificial Sequence
  chemically synthesized
aatccaatgtttctttgttaat

SEQ ID NO: 29836 - DNA, 22 bp, Artificial Sequence
  chemically synthesized
ctttgttaattttctgtctaga

SEQ ID NO: 29837 - DNA, 22 bp, Artificial Sequence
  chemically synthesized
tttgttaattttctgtctagat

SEQ ID NO: 29838 - DNA, 22 bp, Artificial Sequence
  chemically synthesized
tgttaattttctgtctagatga

SEQ ID NO: 29839 - DNA, 22 bp, Artificial Sequence
  chemically synthesized
gttaattttctgtctagatgat

SEQ ID NO: 29840 - DNA, 22 bp, Artificial Sequence
  chemically synthesized
ttaattttctgtctagatgatc

SEQ ID NO: 29841 - DNA, 22 bp, Artificial Sequence
  chemically synthesized
attttctgtctagatgatctat

SEQ ID NO: 29842 - DNA, 22 bp, Artificial Sequence
  chemically synthesized
tctgtctagatgatctatctga

SEQ ID NO: 29843 - DNA, 22 bp, Artificial Sequence
  chemically synthesized
ctgtctagatgatctatctgat

SEQ ID NO: 29844 - DNA, 22 bp, Artificial Sequence
  chemically synthesized
tgtctagatgatctatctgatg

SEQ ID NO: 29845 - DNA, 22 bp, Artificial Sequence
  chemically synthesized
tctagatgatctatctgatgct

SEQ ID NO: 29846 - DNA, 22 bp, Artificial Sequence
  chemically synthesized
gatgatctatctgatgctgaga

SEQ ID NO: 29847 - DNA, 22 bp, Artificial Sequence
  chemically synthesized
tctgatgctgagattagaatgt

SEQ ID NO: 29848 - DNA, 22 bp, Artificial Sequence
  chemically synthesized
atgctgagattagaatgttgaa

SEQ ID NO: 29849 - DNA, 22 bp, Artificial Sequence
  chemically synthesized
agattagaatgttgaaatcccc

SEQ ID NO: 29850 - DNA, 22 bp, Artificial Sequence
  chemically synthesized
gaatgttgaaatccccaactat

SEQ ID NO: 29851 - DNA, 22 bp, Artificial Sequence
  chemically synthesized
aaatccccaactattattgtat

SEQ ID NO: 29852 - DNA, 22 bp, Artificial Sequence
  chemically synthesized
ttattgtattggattctatttc

SEQ ID NO: 29853 - DNA, 22 bp, Artificial Sequence
  chemically synthesized
ttgtattggattctatttcacc

SEQ ID NO: 29854 - DNA, 22 bp, Artificial Sequence
  chemically synthesized
tattggattctatttcaccctt

SEQ ID NO: 29855 - DNA, 22 bp, Artificial Sequence
  chemically synthesized
gattctatttcaccctttatat

SEQ ID NO: 29856 - DNA, 22 bp, Artificial Sequence
  chemically synthesized
tatttcaccctttatatctaat

SEQ ID NO: 29857 - DNA, 22 bp, Artificial Sequence
  chemically synthesized
tttcaccctttatatctaataa

SEQ ID NO: 29858 - DNA, 22 bp, Artificial Sequence
  chemically synthesized
caccctttatatctaataacat

SEQ ID NO: 29859 - DNA, 22 bp, Artificial Sequence
  chemically synthesized
accctttatatctaataacatt

SEQ ID NO: 29860 - DNA, 22 bp, Artificial Sequence
  chemically synthesized
tatatctaataacatttgcttt

SEQ ID NO: 29861 - DNA, 22 bp, Artificial Sequence
  chemically synthesized
atatctaataacatttgcttta

SEQ ID NO: 29862 - DNA, 22 bp, Artificial Sequence
  chemically synthesized
tatctaataacatttgctttac

SEQ ID NO: 29863 - DNA, 22 bp, Artificial Sequence
  chemically synthesized
ataacatttgctttacatatct

SEQ ID NO: 29864 - DNA, 22 bp, Artificial Sequence
  chemically synthesized
gctttacatatctggatgctct

SEQ ID NO: 29865 - DNA, 22 bp, Artificial Sequence
  chemically synthesized
ctttacatatctggatgctctg

SEQ ID NO: 29866 - DNA, 22 bp, Artificial Sequence
  chemically synthesized
tacatatctggatgctctggtg

SEQ ID NO: 29867 - DNA, 22 bp, Artificial Sequence
  chemically synthesized
acatatctggatgctctggtgt

SEQ ID NO: 29868 - DNA, 22 bp, Artificial Sequence
  chemically synthesized
catatctggatgctctggtgtt

SEQ ID NO: 29869 - DNA, 22 bp, Artificial Sequence
  chemically synthesized
gatgctctggtgttgagtgtga

SEQ ID NO: 29870 - DNA, 22 bp, Artificial Sequence
  chemically synthesized
tggtgttgagtgtgaatgttta

SEQ ID NO: 29871 - DNA, 22 bp, Artificial Sequence
  chemically synthesized
gtgttgagtgtgaatgtttaga

SEQ ID NO: 29872 - DNA, 22 bp, Artificial Sequence
  chemically synthesized
agtgtgaatgtttagaattgtt

SEQ ID NO: 29873 - DNA, 22 bp, Artificial Sequence
  chemically synthesized
agaattgttatatactcttgct

SEQ ID NO: 29874 - DNA, 22 bp, Artificial Sequence
  chemically synthesized
gaattgttatatactcttgctg

SEQ ID NO: 29875 - DNA, 22 bp, Artificial Sequence
  chemically synthesized
ttatatactcttgctgaattgt

SEQ ID NO: 29876 - DNA, 22 bp, Artificial Sequence
  chemically synthesized
tatactcttgctgaattgttcc

SEQ ID NO: 29877 - DNA, 22 bp, Artificial Sequence
  chemically synthesized
ttgctgaattgttccttttatc

SEQ ID NO: 29878 - DNA, 22 bp, Artificial Sequence
  chemically synthesized
gctgaattgttccttttatcat

SEQ ID NO: 29879 - DNA, 22 bp, Artificial Sequence
  chemically synthesized
ctgaattgttccttttatcatt

SEQ ID NO: 29880 - DNA, 22 bp, Artificial Sequence
  chemically synthesized
aattgttccttttatcattatg

SEQ ID NO: 29881 - DNA, 22 bp, Artificial Sequence
  chemically synthesized
ttccttttatcattatgtaatg

SEQ ID NO: 29882 - DNA, 22 bp, Artificial Sequence
  chemically synthesized
cttttatcattatgtaatgact

SEQ ID NO: 29883 - DNA, 22 bp, Artificial Sequence
  chemically synthesized
ttatcattatgtaatgactttt

SEQ ID NO: 29884 - DNA, 22 bp, Artificial Sequence
  chemically synthesized
tatcattatgtaatgacttttg

SEQ ID NO: 29885 - DNA, 22 bp, Artificial Sequence
  chemically synthesized
atcattatgtaatgacttttgt

SEQ ID NO: 29886 - DNA, 22 bp, Artificial Sequence
  chemically synthesized
tcattatgtaatgacttttgtc

SEQ ID NO: 29887 - DNA, 22 bp, Artificial Sequence
  chemically synthesized
tgtaatgacttttgtctcttag

SEQ ID NO: 29888 - DNA, 22 bp, Artificial Sequence
  chemically synthesized
ttgtctcttagtgttttttatt

SEQ ID NO: 29889 - DNA, 22 bp, Artificial Sequence
  chemically synthesized
tgtctcttagtgttttttattt

SEQ ID NO: 29890 - DNA, 22 bp, Artificial Sequence
  chemically synthesized
gtctcttagtgttttttattta

SEQ ID NO: 29891 - DNA, 22 bp, Artificial Sequence
  chemically synthesized
tctcttagtgttttttatttaa

SEQ ID NO: 29892 - DNA, 22 bp, Artificial Sequence
  chemically synthesized
ttagtgttttttatttaaagtc

SEQ ID NO: 29893 - DNA, 22 bp, Artificial Sequence
  chemically synthesized
agtgttttttatttaaagtcaa

SEQ ID NO: 29894 - DNA, 22 bp, Artificial Sequence
  chemically synthesized
gtgttttttatttaaagtcaat

SEQ ID NO: 29895 - DNA, 22 bp, Artificial Sequence
  chemically synthesized
tttatttaaagtcaattttatc

SEQ ID NO: 29896 - DNA, 22 bp, Artificial Sequence
  chemically synthesized
ttatttaaagtcaattttatct

SEQ ID NO: 29897 - DNA, 22 bp, Artificial Sequence
  chemically synthesized
tatttaaagtcaattttatctg

SEQ ID NO: 29898 - DNA, 22 bp, Artificial Sequence
  chemically synthesized
atttaaagtcaattttatctgt

SEQ ID NO: 29899 - DNA, 22 bp, Artificial Sequence
  chemically synthesized
tttaaagtcaattttatctgtt

SEQ ID NO: 29900 - DNA, 22 bp, Artificial Sequence
  chemically synthesized
aaagtcaattttatctgttata

SEQ ID NO: 29901 - DNA, 22 bp, Artificial Sequence
  chemically synthesized
aagtcaattttatctgttatag

SEQ ID NO: 29902 - DNA, 22 bp, Artificial Sequence
  chemically synthesized
tatctgttataggtataactac

SEQ ID NO: 29903 - DNA, 22 bp, Artificial Sequence
  chemically synthesized
atctgttataggtataactact

SEQ ID NO: 29904 - DNA, 22 bp, Artificial Sequence
  chemically synthesized
tctgttataggtataactactt

SEQ ID NO: 29905 - DNA, 22 bp, Artificial Sequence
  chemically synthesized
ttataggtataactacttttgc

SEQ ID NO: 29906 - DNA, 22 bp, Artificial Sequence
  chemically synthesized
taggtataactacttttgctca

SEQ ID NO: 29907 - DNA, 22 bp, Artificial Sequence
  chemically synthesized
cttttgctcatttttggtttct

SEQ ID NO: 29908 - DNA, 22 bp, Artificial Sequence
  chemically synthesized
ttgctcatttttggtttctctt

SEQ ID NO: 29909 - DNA, 22 bp, Artificial Sequence
  chemically synthesized
tgctcatttttggtttctcttt

SEQ ID NO: 29910 - DNA, 22 bp, Artificial Sequence
  chemically synthesized
gctcatttttggtttctctttg

SEQ ID NO: 29911 - DNA, 22 bp, Artificial Sequence
  chemically synthesized
ctcatttttggtttctctttgt

SEQ ID NO: 29912 - DNA, 22 bp, Artificial Sequence
  chemically synthesized
atttttggtttctctttgtatg

SEQ ID NO: 29913 - DNA, 22 bp, Artificial Sequence
  chemically synthesized
ttggtttctctttgtatggaag

SEQ ID NO: 29914 - DNA, 22 bp, Artificial Sequence
  chemically synthesized
tggtttctctttgtatggaaga

SEQ ID NO: 29915 - DNA, 22 bp, Artificial Sequence
  chemically synthesized
ggtttctctttgtatggaagat

SEQ ID NO: 29916 - DNA, 22 bp, Artificial Sequence
  chemically synthesized
gtttctctttgtatggaagatc

SEQ ID NO: 29917 - DNA, 22 bp, Artificial Sequence
  chemically synthesized
ctctttgtatggaagatctttc

SEQ ID NO: 29918 - DNA, 22 bp, Artificial Sequence
  chemically synthesized
tctttgtatggaagatctttca

SEQ ID NO: 29919 - DNA, 22 bp, Artificial Sequence
  chemically synthesized
tttgtatggaagatctttcatc

SEQ ID NO: 29920 - DNA, 22 bp, Artificial Sequence
  chemically synthesized
tgtatggaagatctttcatctt

SEQ ID NO: 29921 - DNA, 22 bp, Artificial Sequence
  chemically synthesized
gtatggaagatctttcatcttt

SEQ ID NO: 29922 - DNA, 22 bp, Artificial Sequence
  chemically synthesized
tatggaagatctttcatctttt

SEQ ID NO: 29923 - DNA, 22 bp, Artificial Sequence
  chemically synthesized
tcatctttttactttcagtcta

SEQ ID NO: 29924 - DNA, 22 bp, Artificial Sequence
  chemically synthesized
catctttttactttcagtctat

SEQ ID NO: 29925 - DNA, 22 bp, Artificial Sequence
  chemically synthesized
atctttttactttcagtctata

SEQ ID NO: 29926 - DNA, 22 bp, Artificial Sequence
  chemically synthesized
tttactttcagtctatatttat

SEQ ID NO: 29927 - DNA, 22 bp, Artificial Sequence
  chemically synthesized
ttactttcagtctatatttatc

SEQ ID NO: 29928 - DNA, 22 bp, Artificial Sequence
  chemically synthesized
tactttcagtctatatttatct

SEQ ID NO: 29929 - DNA, 22 bp, Artificial Sequence
  chemically synthesized
actttcagtctatatttatctt

SEQ ID NO: 29930 - DNA, 22 bp, Artificial Sequence
  chemically synthesized
ctttcagtctatatttatcttt

SEQ ID NO: 29931 - DNA, 22 bp, Artificial Sequence
  chemically synthesized
tcagtctatatttatctttaca

SEQ ID NO: 29932 - DNA, 22 bp, Artificial Sequence
  chemically synthesized
cagtctatatttatctttacaa

SEQ ID NO: 29933 - DNA, 22 bp, Artificial Sequence
  chemically synthesized
agtctatatttatctttacaag

SEQ ID NO: 29934 - DNA, 22 bp, Artificial Sequence
  chemically synthesized
tatttatctttacaagtgagat

SEQ ID NO: 29935 - DNA, 22 bp, Artificial Sequence
  chemically synthesized
atctttacaagtgagataagtt

SEQ ID NO: 29936 - DNA, 22 bp, Artificial Sequence
  chemically synthesized
tctttacaagtgagataagttt

SEQ ID NO: 29937 - DNA, 22 bp, Artificial Sequence
  chemically synthesized
tacaagtgagataagtttctta

SEQ ID NO: 29938 - DNA, 22 bp, Artificial Sequence
  chemically synthesized
acaagtgagataagtttcttat

SEQ ID NO: 29939 - DNA, 22 bp, Artificial Sequence
  chemically synthesized
caagtgagataagtttcttata

SEQ ID NO: 29940 - DNA, 22 bp, Artificial Sequence
  chemically synthesized
cttataggcagcttacaactgg

SEQ ID NO: 29941 - DNA, 22 bp, Artificial Sequence
  chemically synthesized
ttataggcagcttacaactggg

SEQ ID NO: 29942 - DNA, 22 bp, Artificial Sequence
  chemically synthesized
ataggcagcttacaactgggtc

SEQ ID NO: 29943 - DNA, 22 bp, Artificial Sequence
  chemically synthesized
taggcagcttacaactgggtca

SEQ ID NO: 29944 - DNA, 22 bp, Artificial Sequence
  chemically synthesized
acaactgggtcatatttttgtt

SEQ ID NO: 29945 - DNA, 22 bp, Artificial Sequence
  chemically synthesized
caactgggtcatatttttgttt

SEQ ID NO: 29946 - DNA, 22 bp, Artificial Sequence
  chemically synthesized
ggtcatatttttgttttaaatc

SEQ ID NO: 29947 - DNA, 22 bp, Artificial Sequence
  chemically synthesized
ttgttttaaatctatttagcca

SEQ ID NO: 29948 - DNA, 22 bp, Artificial Sequence
  chemically synthesized
tgttttaaatctatttagccag

SEQ ID NO: 29949 - DNA, 22 bp, Artificial Sequence
  chemically synthesized
gttttaaatctatttagccagt

SEQ ID NO: 29950 - DNA, 22 bp, Artificial Sequence
  chemically synthesized
ttttaaatctatttagccagtc

SEQ ID NO: 29951 - DNA, 22 bp, Artificial Sequence
  chemically synthesized
taaatctatttagccagtctat

SEQ ID NO: 29952 - DNA, 22 bp, Artificial Sequence
  chemically synthesized
aaatctatttagccagtctata

SEQ ID NO: 29953 - DNA, 22 bp, Artificial Sequence
  chemically synthesized
aatctatttagccagtctatat

SEQ ID NO: 29954 - DNA, 22 bp, Artificial Sequence
  chemically synthesized
tttagccagtctatatctttca

SEQ ID NO: 29955 - DNA, 22 bp, Artificial Sequence
  chemically synthesized
agccagtctatatctttcaagt

SEQ ID NO: 29956 - DNA, 22 bp, Artificial Sequence
  chemically synthesized
gccagtctatatctttcaagta

SEQ ID NO: 29957 - DNA, 22 bp, Artificial Sequence
  chemically synthesized
tatctttcaagtaacaatttaa

SEQ ID NO: 29958 - DNA, 22 bp, Artificial Sequence
  chemically synthesized
tcaagtaacaatttaatccatt

SEQ ID NO: 29959 - DNA, 22 bp, Artificial Sequence
  chemically synthesized
caagtaacaatttaatccattt

SEQ ID NO: 29960 - DNA, 22 bp, Artificial Sequence
  chemically synthesized
aagtaacaatttaatccattta

SEQ ID NO: 29961 - DNA, 22 bp, Artificial Sequence
  chemically synthesized
aatccatttacatgcaaggcta

SEQ ID NO: 29962 - DNA, 22 bp, Artificial Sequence
  chemically synthesized
atccatttacatgcaaggctat

SEQ ID NO: 29963 - DNA, 22 bp, Artificial Sequence
  chemically synthesized
acatgcaaggctattattgaca

SEQ ID NO: 29964 - DNA, 22 bp, Artificial Sequence
  chemically synthesized
catgcaaggctattattgacat

SEQ ID NO: 29965 - DNA, 22 bp, Artificial Sequence
  chemically synthesized
ttattgacatgtgagagcttat

SEQ ID NO: 29966 - DNA, 22 bp, Artificial Sequence
  chemically synthesized
ttgacatgtgagagcttattcc

SEQ ID NO: 29967 - DNA, 22 bp, Artificial Sequence
  chemically synthesized
acatgtgagagcttattcctgc

SEQ ID NO: 29968 - DNA, 22 bp, Artificial Sequence
  chemically synthesized
attcctgccattttgttaattg

SEQ ID NO: 29969 - DNA, 22 bp, Artificial Sequence
  chemically synthesized
ttcctgccattttgttaattga

SEQ ID NO: 29970 - DNA, 22 bp, Artificial Sequence
  chemically synthesized
ctgccattttgttaattgattc

SEQ ID NO: 29971 - DNA, 22 bp, Artificial Sequence
  chemically synthesized
ccattttgttaattgattcctg

SEQ ID NO: 29972 - DNA, 22 bp, Artificial Sequence
  chemically synthesized
tgttaattgattcctggttgtt

SEQ ID NO: 29973 - DNA, 22 bp, Artificial Sequence
  chemically synthesized
gttaattgattcctggttgttt

SEQ ID NO: 29974 - DNA, 22 bp, Artificial Sequence
  chemically synthesized
ttaattgattcctggttgtttt

SEQ ID NO: 29975 - DNA, 22 bp, Artificial Sequence
  chemically synthesized
attgattcctggttgttttgtt

SEQ ID NO: 29976 - DNA, 22 bp, Artificial Sequence
  chemically synthesized
attcctggttgttttgtttttt

SEQ ID NO: 29977 - DNA, 22 bp, Artificial Sequence
  chemically synthesized
ctggttgttttgtttttttttt

SEQ ID NO: 29978 - DNA, 22 bp, Artificial Sequence
  chemically synthesized
gttgttttgttttttttttagt

SEQ ID NO: 29979 - DNA, 22 bp, Artificial Sequence
  chemically synthesized
ttttgttttttttttagtttgt

SEQ ID NO: 29980 - DNA, 22 bp, Artificial Sequence
  chemically synthesized
tgttttttttttagtttgtttg

SEQ ID NO: 29981 - DNA, 22 bp, Artificial Sequence
  chemically synthesized
gttttttttttagtttgtttgt

SEQ ID NO: 29982 - DNA, 22 bp, Artificial Sequence
  chemically synthesized
ttttttttttagtttgtttgtt

SEQ ID NO: 29983 - DNA, 22 bp, Artificial Sequence
  chemically synthesized
tttttttagtttgtttgttttg

SEQ ID NO: 29984 - DNA, 22 bp, Artificial Sequence
  chemically synthesized
ttttttagtttgtttgttttgt

SEQ ID NO: 29985 - DNA, 22 bp, Artificial Sequence
  chemically synthesized
tttttagtttgtttgttttgtg

SEQ ID NO: 29986 - DNA, 22 bp, Artificial Sequence
  chemically synthesized
ttttagtttgtttgttttgtgt

SEQ ID NO: 29987 - DNA, 22 bp, Artificial Sequence
  chemically synthesized
tttagtttgtttgttttgtgtt

SEQ ID NO: 29988 - DNA, 22 bp, Artificial Sequence
  chemically synthesized
ttagtttgtttgttttgtgttt

SEQ ID NO: 29989 - DNA, 22 bp, Artificial Sequence
  chemically synthesized
tagtttgtttgttttgtgtttt

SEQ ID NO: 29990 - DNA, 22 bp, Artificial Sequence
  chemically synthesized
agtttgtttgttttgtgttttt

SEQ ID NO: 29991 - DNA, 22 bp, Artificial Sequence
  chemically synthesized
gtttgtttgttttgtgtttttt

SEQ ID NO: 29992 - DNA, 22 bp, Artificial Sequence
  chemically synthesized
gtttgttttgtgtttttttctt

SEQ ID NO: 29993 - DNA, 22 bp, Artificial Sequence
  chemically synthesized
tttgttttgtgtttttttcttc

SEQ ID NO: 29994 - DNA, 22 bp, Artificial Sequence
  chemically synthesized
gttttgtgtttttttcttcctt

SEQ ID NO: 29995 - DNA, 22 bp, Artificial Sequence
  chemically synthesized
ttttgtgtttttttcttccttc

SEQ ID NO: 29996 - DNA, 22 bp, Artificial Sequence
  chemically synthesized
tgtgtttttttcttccttcctt

SEQ ID NO: 29997 - DNA, 22 bp, Artificial Sequence
  chemically synthesized
gtgtttttttcttccttccttc

SEQ ID NO: 29998 - DNA, 22 bp, Artificial Sequence
  chemically synthesized
tgtttttttcttccttccttcc

SEQ ID NO: 29999 - DNA, 22 bp, Artificial Sequence
  chemically synthesized
ttttcttccttccttccttttc

SEQ ID NO: 30000 - DNA, 22 bp, Artificial Sequence
  chemically synthesized
tttcttccttccttccttttct

SEQ ID NO: 30001 - DNA, 22 bp, Artificial Sequence
  chemically synthesized
ttcttccttccttccttttctt

SEQ ID NO: 30002 - DNA, 22 bp, Artificial Sequence
  chemically synthesized
tcttccttccttccttttcttt

SEQ ID NO: 30003 - DNA, 22 bp, Artificial Sequence
  chemically synthesized
cttccttccttccttttctttc

SEQ ID NO: 30004 - DNA, 22 bp, Artificial Sequence
  chemically synthesized
ttccttccttccttttctttct

SEQ ID NO: 30005 - DNA, 22 bp, Artificial Sequence
  chemically synthesized
ccttccttccttttctttcttt

SEQ ID NO: 30006 - DNA, 22 bp, Artificial Sequence
  chemically synthesized
cttccttccttttctttctttc

SEQ ID NO: 30007 - DNA, 22 bp, Artificial Sequence
  chemically synthesized
ccttccttttctttctttcatt

SEQ ID NO: 30008 - DNA, 22 bp, Artificial Sequence
  chemically synthesized
cttccttttctttctttcattc

SEQ ID NO: 30009 - DNA, 22 bp, Artificial Sequence
  chemically synthesized
ccttttctttctttcattctct

SEQ ID NO: 30010 - DNA, 22 bp, Artificial Sequence
  chemically synthesized
cttttctttctttcattctctc

SEQ ID NO: 30011 - DNA, 22 bp, Artificial Sequence
  chemically synthesized
ttctttctttcattctctctct

SEQ ID NO: 30012 - DNA, 22 bp, Artificial Sequence
  chemically synthesized
tctttctttcattctctctctc

SEQ ID NO: 30013 - DNA, 22 bp, Artificial Sequence
  chemically synthesized
ctttctttcattctctctctct

SEQ ID NO: 30014 - DNA, 22 bp, Artificial Sequence
  chemically synthesized
tttctttcattctctctctctc

SEQ ID NO: 30015 - DNA, 22 bp, Artificial Sequence
  chemically synthesized
tctttcattctctctctctctc

SEQ ID NO: 30016 - DNA, 22 bp, Artificial Sequence
  chemically synthesized
ctttcattctctctctctctct

SEQ ID NO: 30017 - DNA, 22 bp, Artificial Sequence
  chemically synthesized
tttcattctctctctctctctc

SEQ ID NO: 30018 - DNA, 22 bp, Artificial Sequence
  chemically synthesized
tcattctctctctctctctctt

SEQ ID NO: 30019 - DNA, 22 bp, Artificial Sequence
  chemically synthesized
cattctctctctctctctcttt

SEQ ID NO: 30020 - DNA, 22 bp, Artificial Sequence
  chemically synthesized
attctctctctctctctctttc

SEQ ID NO: 30021 - DNA, 22 bp, Artificial Sequence
  chemically synthesized
tctctctctctctctttctttc

SEQ ID NO: 30022 - DNA, 22 bp, Artificial Sequence
  chemically synthesized
tctctctctctctttctttctt

SEQ ID NO: 30023 - DNA, 22 bp, Artificial Sequence
  chemically synthesized
tctctctctctttctttctttc

SEQ ID NO: 30024 - DNA, 22 bp, Artificial Sequence
  chemically synthesized
tctctctctttctttctttctt

SEQ ID NO: 30025 - DNA, 22 bp, Artificial Sequence
  chemically synthesized
tctctctttctttctttctttc

SEQ ID NO: 30026 - DNA, 22 bp, Artificial Sequence
  chemically synthesized
tctctttctttctttctttctt

SEQ ID NO: 30027 - DNA, 22 bp, Artificial Sequence
  chemically synthesized
tctttctttctttctttctttc

SEQ ID NO: 30028 - DNA, 22 bp, Artificial Sequence
  chemically synthesized
tttctttctttctttctttctt

SEQ ID NO: 30029 - DNA, 22 bp, Artificial Sequence
  chemically synthesized
tctttctttctttctttcttat

SEQ ID NO: 30030 - DNA, 22 bp, Artificial Sequence
  chemically synthesized
ctttctttctttctttcttatt

SEQ ID NO: 30031 - DNA, 22 bp, Artificial Sequence
  chemically synthesized
tttctttctttctttcttatta

SEQ ID NO: 30032 - DNA, 22 bp, Artificial Sequence
  chemically synthesized
tctttctttctttcttattatt

SEQ ID NO: 30033 - DNA, 22 bp, Artificial Sequence
  chemically synthesized
ctttctttctttcttattattt

SEQ ID NO: 30034 - DNA, 22 bp, Artificial Sequence
  chemically synthesized
tttctttctttcttattattta

SEQ ID NO: 30035 - DNA, 22 bp, Artificial Sequence
  chemically synthesized
tctttctttcttattatttatg

SEQ ID NO: 30036 - DNA, 22 bp, Artificial Sequence
  chemically synthesized
ctttctttcttattatttatga

SEQ ID NO: 30037 - DNA, 22 bp, Artificial Sequence
  chemically synthesized
tttctttcttattatttatgat

SEQ ID NO: 30038 - DNA, 22 bp, Artificial Sequence
  chemically synthesized
tctttcttattatttatgattg

SEQ ID NO: 30039 - DNA, 22 bp, Artificial Sequence
  chemically synthesized
ctttcttattatttatgattgt

SEQ ID NO: 30040 - DNA, 22 bp, Artificial Sequence
  chemically synthesized
tttcttattatttatgattgtg

SEQ ID NO: 30041 - DNA, 22 bp, Artificial Sequence
  chemically synthesized
tcttattatttatgattgtggt

SEQ ID NO: 30042 - DNA, 22 bp, Artificial Sequence
  chemically synthesized
cttattatttatgattgtggtt

SEQ ID NO: 30043 - DNA, 22 bp, Artificial Sequence
  chemically synthesized
ttattatttatgattgtggttt

SEQ ID NO: 30044 - DNA, 22 bp, Artificial Sequence
  chemically synthesized
attatttatgattgtggtttgg

SEQ ID NO: 30045 - DNA, 22 bp, Artificial Sequence
  chemically synthesized
ttatttatgattgtggtttggt

SEQ ID NO: 30046 - DNA, 22 bp, Artificial Sequence
  chemically synthesized
tttatgattgtggtttggtgat

SEQ ID NO: 30047 - DNA, 22 bp, Artificial Sequence
  chemically synthesized
atgattgtggtttggtgatttt

SEQ ID NO: 30048 - DNA, 22 bp, Artificial Sequence
  chemically synthesized
tgattgtggtttggtgattttc

SEQ ID NO: 30049 - DNA, 22 bp, Artificial Sequence
  chemically synthesized
tggtttggtgattttctgtagt

SEQ ID NO: 30050 - DNA, 22 bp, Artificial Sequence
  chemically synthesized
ggtgattttctgtagtggtaac

SEQ ID NO: 30051 - DNA, 22 bp, Artificial Sequence
  chemically synthesized
gtgattttctgtagtggtaacg

SEQ ID NO: 30052 - DNA, 22 bp, Artificial Sequence
  chemically synthesized
tctgtagtggtaacgtttgagt

SEQ ID NO: 30053 - DNA, 22 bp, Artificial Sequence
  chemically synthesized
ctgtagtggtaacgtttgagtt

SEQ ID NO: 30054 - DNA, 22 bp, Artificial Sequence
  chemically synthesized
tgtagtggtaacgtttgagttc

SEQ ID NO: 30055 - DNA, 22 bp, Artificial Sequence
  chemically synthesized
tagtggtaacgtttgagttctt

SEQ ID NO: 30056 - DNA, 22 bp, Artificial Sequence
  chemically synthesized
gagttctttctcttctttattt

SEQ ID NO: 30057 - DNA, 22 bp, Artificial Sequence
  chemically synthesized
agttctttctcttctttatttg

SEQ ID NO: 30058 - DNA, 22 bp, Artificial Sequence
  chemically synthesized
tttctcttctttatttgtgttt

SEQ ID NO: 30059 - DNA, 22 bp, Artificial Sequence
  chemically synthesized
tctcttctttatttgtgttttg

SEQ ID NO: 30060 - DNA, 22 bp, Artificial Sequence
  chemically synthesized
ctcttctttatttgtgttttgc

SEQ ID NO: 30061 - DNA, 22 bp, Artificial Sequence
  chemically synthesized
tcttctttatttgtgttttgct

SEQ ID NO: 30062 - DNA, 22 bp, Artificial Sequence
  chemically synthesized
ttctttatttgtgttttgctct

SEQ ID NO: 30063 - DNA, 22 bp, Artificial Sequence
  chemically synthesized
ctttatttgtgttttgctctac

SEQ ID NO: 30064 - DNA, 22 bp, Artificial Sequence
  chemically synthesized
tttatttgtgttttgctctacc

SEQ ID NO: 30065 - DNA, 22 bp, Artificial Sequence
  chemically synthesized
tatttgtgttttgctctaccag

SEQ ID NO: 30066 - DNA, 22 bp, Artificial Sequence
  chemically synthesized
atttgtgttttgctctaccagt

SEQ ID NO: 30067 - DNA, 22 bp, Artificial Sequence
  chemically synthesized
tttgtgttttgctctaccagtt

SEQ ID NO: 30068 - DNA, 22 bp, Artificial Sequence
  chemically synthesized
gtgttttgctctaccagttagt

SEQ ID NO: 30069 - DNA, 22 bp, Artificial Sequence
  chemically synthesized
tgttttgctctaccagttagtt

SEQ ID NO: 30070 - DNA, 22 bp, Artificial Sequence
  chemically synthesized
tgctctaccagttagttgtata

SEQ ID NO: 30071 - DNA, 22 bp, Artificial Sequence
  chemically synthesized
gctctaccagttagttgtatac

SEQ ID NO: 30072 - DNA, 22 bp, Artificial Sequence
  chemically synthesized
ctctaccagttagttgtatacc

SEQ ID NO: 30073 - DNA, 22 bp, Artificial Sequence
  chemically synthesized
taccagttagttgtataccttt

SEQ ID NO: 30074 - DNA, 22 bp, Artificial Sequence
  chemically synthesized
ccagttagttgtatacctttgt

SEQ ID NO: 30075 - DNA, 22 bp, Artificial Sequence
  chemically synthesized
gttgtatacctttgtgtgtctt

SEQ ID NO: 30076 - DNA, 22 bp, Artificial Sequence
  chemically synthesized
tatacctttgtgtgtcttcata

SEQ ID NO: 30077 - DNA, 22 bp, Artificial Sequence
  chemically synthesized
tgtgtgtcttcataatggcagt

SEQ ID NO: 30078 - DNA, 22 bp, Artificial Sequence
  chemically synthesized
gtgtgtcttcataatggcagtg

SEQ ID NO: 30079 - DNA, 22 bp, Artificial Sequence
  chemically synthesized
tgtgtcttcataatggcagtgt

SEQ ID NO: 30080 - DNA, 22 bp, Artificial Sequence
  chemically synthesized
cataatggcagtgtcctgtcac

SEQ ID NO: 30081 - DNA, 22 bp, Artificial Sequence
  chemically synthesized
ataatggcagtgtcctgtcact

SEQ ID NO: 30082 - DNA, 22 bp, Artificial Sequence
  chemically synthesized
tcactttcatgtgtaggactcc

SEQ ID NO: 30083 - DNA, 22 bp, Artificial Sequence
  chemically synthesized
tcatgtgtaggactcccttaaa

SEQ ID NO: 30084 - DNA, 22 bp, Artificial Sequence
  chemically synthesized
catgtgtaggactcccttaaat

SEQ ID NO: 30085 - DNA, 22 bp, Artificial Sequence
  chemically synthesized
atgtgtaggactcccttaaata

SEQ ID NO: 30086 - DNA, 22 bp, Artificial Sequence
  chemically synthesized
ccttaaatatttcttgtaaagc

SEQ ID NO: 30087 - DNA, 22 bp, Artificial Sequence
  chemically synthesized
aaatatttcttgtaaagccagt

SEQ ID NO: 30088 - DNA, 22 bp, Artificial Sequence
  chemically synthesized
aatatttcttgtaaagccagtc

SEQ ID NO: 30089 - DNA, 22 bp, Artificial Sequence
  chemically synthesized
cttgtaaagccagtctagtgat

SEQ ID NO: 30090 - DNA, 22 bp, Artificial Sequence
  chemically synthesized
ttgtaaagccagtctagtgata

SEQ ID NO: 30091 - DNA, 22 bp, Artificial Sequence
  chemically synthesized
gtaaagccagtctagtgatagt

SEQ ID NO: 30092 - DNA, 22 bp, Artificial Sequence
  chemically synthesized
taaagccagtctagtgatagtg

SEQ ID NO: 30093 - DNA, 22 bp, Artificial Sequence
  chemically synthesized
gtgatagtgaattccttcaaat

SEQ ID NO: 30094 - DNA, 22 bp, Artificial Sequence
  chemically synthesized
cttcaaatttttcttgcccaga

SEQ ID NO: 30095 - DNA, 22 bp, Artificial Sequence
  chemically synthesized
caaatttttcttgcccagaaaa

SEQ ID NO: 30096 - DNA, 22 bp, Artificial Sequence
  chemically synthesized
aaatttttcttgcccagaaaag

SEQ ID NO: 30097 - DNA, 22 bp, Artificial Sequence
  chemically synthesized
ttcttgcccagaaaagatttta

SEQ ID NO: 30098 - DNA, 22 bp, Artificial Sequence
  chemically synthesized
tcttgcccagaaaagattttat

SEQ ID NO: 30099 - DNA, 22 bp, Artificial Sequence
  chemically synthesized
cttgcccagaaaagattttatt

SEQ ID NO: 30100 - DNA, 22 bp, Artificial Sequence
  chemically synthesized
ttgcccagaaaagattttattt

SEQ ID NO: 30101 - DNA, 22 bp, Artificial Sequence
  chemically synthesized
gcccagaaaagattttatttat

SEQ ID NO: 30102 - DNA, 22 bp, Artificial Sequence
  chemically synthesized
cccagaaaagattttatttatc

SEQ ID NO: 30103 - DNA, 22 bp, Artificial Sequence
  chemically synthesized
tatttatccttcatttttgaag

SEQ ID NO: 30104 - DNA, 22 bp, Artificial Sequence
  chemically synthesized
atttatccttcatttttgaaga

SEQ ID NO: 30105 - DNA, 22 bp, Artificial Sequence
  chemically synthesized
tttatccttcatttttgaagaa

SEQ ID NO: 30106 - DNA, 22 bp, Artificial Sequence
  chemically synthesized
atccttcatttttgaagaacaa

SEQ ID NO: 30107 - DNA, 22 bp, Artificial Sequence
  chemically synthesized
tccttcatttttgaagaacaat

SEQ ID NO: 30108 - DNA, 22 bp, Artificial Sequence
  chemically synthesized
catttttgaagaacaatgttgc

SEQ ID NO: 30109 - DNA, 22 bp, Artificial Sequence
  chemically synthesized
atttttgaagaacaatgttgct

SEQ ID NO: 30110 - DNA, 22 bp, Artificial Sequence
  chemically synthesized
ttgaagaacaatgttgctgggt

SEQ ID NO: 30111 - DNA, 22 bp, Artificial Sequence
  chemically synthesized
tgaagaacaatgttgctgggta

SEQ ID NO: 30112 - DNA, 22 bp, Artificial Sequence
  chemically synthesized
gaagaacaatgttgctgggtat

SEQ ID NO: 30113 - DNA, 22 bp, Artificial Sequence
  chemically synthesized
aagaacaatgttgctgggtata

SEQ ID NO: 30114 - DNA, 22 bp, Artificial Sequence
  chemically synthesized
ctgggtataacatccttggtgt

SEQ ID NO: 30115 - DNA, 22 bp, Artificial Sequence
  chemically synthesized
ggtataacatccttggtgtcat

SEQ ID NO: 30116 - DNA, 22 bp, Artificial Sequence
  chemically synthesized
ggtgtcatttttttctttcact

SEQ ID NO: 30117 - DNA, 22 bp, Artificial Sequence
  chemically synthesized
gtgtcatttttttctttcacta

SEQ ID NO: 30118 - DNA, 22 bp, Artificial Sequence
  chemically synthesized
ttttctttcactattttgaata

SEQ ID NO: 30119 - DNA, 22 bp, Artificial Sequence
  chemically synthesized
tttctttcactattttgaatat

SEQ ID NO: 30120 - DNA, 22 bp, Artificial Sequence
  chemically synthesized
ttctttcactattttgaatata

SEQ ID NO: 30121 - DNA, 22 bp, Artificial Sequence
  chemically synthesized
tctttcactattttgaatatat

SEQ ID NO: 30122 - DNA, 22 bp, Artificial Sequence
  chemically synthesized
ctttcactattttgaatatatc

SEQ ID NO: 30123 - DNA, 22 bp, Artificial Sequence
  chemically synthesized
tttcactattttgaatatatca

SEQ ID NO: 30124 - DNA, 22 bp, Artificial Sequence
  chemically synthesized
tcactattttgaatatatcatc

SEQ ID NO: 30125 - DNA, 22 bp, Artificial Sequence
  chemically synthesized
cactattttgaatatatcatcc

SEQ ID NO: 30126 - DNA, 22 bp, Artificial Sequence
  chemically synthesized
actattttgaatatatcatccc

SEQ ID NO: 30127 - DNA, 22 bp, Artificial Sequence
  chemically synthesized
ttttgaatatatcatcccatct

SEQ ID NO: 30128 - DNA, 22 bp, Artificial Sequence
  chemically synthesized
tgaatatatcatcccatcttct

SEQ ID NO: 30129 - DNA, 22 bp, Artificial Sequence
  chemically synthesized
gaatatatcatcccatcttctc

SEQ ID NO: 30130 - DNA, 22 bp, Artificial Sequence
  chemically synthesized
aatatatcatcccatcttctcc

SEQ ID NO: 30131 - DNA, 22 bp, Artificial Sequence
  chemically synthesized
ctcctggcctgtgaggtttctg

SEQ ID NO: 30132 - DNA, 22 bp, Artificial Sequence
  chemically synthesized
tcctggcctgtgaggtttctgc

SEQ ID NO: 30133 - DNA, 22 bp, Artificial Sequence
  chemically synthesized
ctggcctgtgaggtttctgctg

SEQ ID NO: 30134 - DNA, 22 bp, Artificial Sequence
  chemically synthesized
gcctgtgaggtttctgctgaga

SEQ ID NO: 30135 - DNA, 22 bp, Artificial Sequence
  chemically synthesized
tgaggtttctgctgagaaatct

SEQ ID NO: 30136 - DNA, 22 bp, Artificial Sequence
  chemically synthesized
ctgctgagaaatctgctgttaa

SEQ ID NO: 30137 - DNA, 22 bp, Artificial Sequence
  chemically synthesized
tgctgagaaatctgctgttaat

SEQ ID NO: 30138 - DNA, 22 bp, Artificial Sequence
  chemically synthesized
ctgagaaatctgctgttaatct

SEQ ID NO: 30139 - DNA, 22 bp, Artificial Sequence
  chemically synthesized
agaaatctgctgttaatctgtt

SEQ ID NO: 30140 - DNA, 22 bp, Artificial Sequence
  chemically synthesized
ctgttaatctgttaatcttgtg

SEQ ID NO: 30141 - DNA, 22 bp, Artificial Sequence
  chemically synthesized
ttaatctgttaatcttgtggaa

SEQ ID NO: 30142 - DNA, 22 bp, Artificial Sequence
  chemically synthesized
atctgttaatcttgtggaagtt

SEQ ID NO: 30143 - DNA, 22 bp, Artificial Sequence
  chemically synthesized
ttaatcttgtggaagttccctt

SEQ ID NO: 30144 - DNA, 22 bp, Artificial Sequence
  chemically synthesized
atcttgtggaagttcccttata

SEQ ID NO: 30145 - DNA, 22 bp, Artificial Sequence
  chemically synthesized
gtggaagttcccttataagtga

SEQ ID NO: 30146 - DNA, 22 bp, Artificial Sequence
  chemically synthesized
tggaagttcccttataagtgac

SEQ ID NO: 30147 - DNA, 22 bp, Artificial Sequence
  chemically synthesized
ccttataagtgactagacattt

SEQ ID NO: 30148 - DNA, 22 bp, Artificial Sequence
  chemically synthesized
ataagtgactagacattttgct

SEQ ID NO: 30149 - DNA, 22 bp, Artificial Sequence
  chemically synthesized
taagtgactagacattttgctt

SEQ ID NO: 30150 - DNA, 22 bp, Artificial Sequence
  chemically synthesized
gacattttgcttgctgttttag

SEQ ID NO: 30151 - DNA, 22 bp, Artificial Sequence
  chemically synthesized
tgcttgctgttttagagttctt

SEQ ID NO: 30152 - DNA, 22 bp, Artificial Sequence
  chemically synthesized
gcttgctgttttagagttctta

SEQ ID NO: 30153 - DNA, 22 bp, Artificial Sequence
  chemically synthesized
cttgctgttttagagttcttac

SEQ ID NO: 30154 - DNA, 22 bp, Artificial Sequence
  chemically synthesized
gctgttttagagttcttactct

SEQ ID NO: 30155 - DNA, 22 bp, Artificial Sequence
  chemically synthesized
ctgttttagagttcttactctt

SEQ ID NO: 30156 - DNA, 22 bp, Artificial Sequence
  chemically synthesized
ttttagagttcttactctttgg

SEQ ID NO: 30157 - DNA, 22 bp, Artificial Sequence
  chemically synthesized
tagagttcttactctttggctt

SEQ ID NO: 30158 - DNA, 22 bp, Artificial Sequence
  chemically synthesized
agagttcttactctttggcttt

SEQ ID NO: 30159 - DNA, 22 bp, Artificial Sequence
  chemically synthesized
gagttcttactctttggctttt

SEQ ID NO: 30160 - DNA, 22 bp, Artificial Sequence
  chemically synthesized
ttactctttggcttttgacagt

SEQ ID NO: 30161 - DNA, 22 bp, Artificial Sequence
  chemically synthesized
actctttggcttttgacagttt

SEQ ID NO: 30162 - DNA, 22 bp, Artificial Sequence
  chemically synthesized
ctctttggcttttgacagtttg

SEQ ID NO: 30163 - DNA, 22 bp, Artificial Sequence
  chemically synthesized
tttggcttttgacagtttgact

SEQ ID NO: 30164 - DNA, 22 bp, Artificial Sequence
  chemically synthesized
tggcttttgacagtttgactat

SEQ ID NO: 30165 - DNA, 22 bp, Artificial Sequence
  chemically synthesized
ggcttttgacagtttgactata

SEQ ID NO: 30166 - DNA, 22 bp, Artificial Sequence
  chemically synthesized
gcttttgacagtttgactataa

SEQ ID NO: 30167 - DNA, 22 bp, Artificial Sequence
  chemically synthesized
ttgacagtttgactataatgtg

SEQ ID NO: 30168 - DNA, 22 bp, Artificial Sequence
  chemically synthesized
tgacagtttgactataatgtgc

SEQ ID NO: 30169 - DNA, 22 bp, Artificial Sequence
  chemically synthesized
gacagtttgactataatgtgct

SEQ ID NO: 30170 - DNA, 22 bp, Artificial Sequence
  chemically synthesized
acagtttgactataatgtgctg

SEQ ID NO: 30171 - DNA, 22 bp, Artificial Sequence
  chemically synthesized
gactataatgtgctgtggagaa

SEQ ID NO: 30172 - DNA, 22 bp, Artificial Sequence
  chemically synthesized
actataatgtgctgtggagaag

SEQ ID NO: 30173 - DNA, 22 bp, Artificial Sequence
  chemically synthesized
taatgtgctgtggagaagagct

SEQ ID NO: 30174 - DNA, 22 bp, Artificial Sequence
  chemically synthesized
tggagaagagctttttgcatta

SEQ ID NO: 30175 - DNA, 22 bp, Artificial Sequence
  chemically synthesized
tttgcattatattatttgggaa

SEQ ID NO: 30176 - DNA, 22 bp, Artificial Sequence
  chemically synthesized
ttgcattatattatttgggaat

SEQ ID NO: 30177 - DNA, 22 bp, Artificial Sequence
  chemically synthesized
tgcattatattatttgggaatt

SEQ ID NO: 30178 - DNA, 22 bp, Artificial Sequence
  chemically synthesized
gcattatattatttgggaattt

SEQ ID NO: 30179 - DNA, 22 bp, Artificial Sequence
  chemically synthesized
cattatattatttgggaatttc

SEQ ID NO: 30180 - DNA, 22 bp, Artificial Sequence
  chemically synthesized
tattatttgggaatttctgatt

SEQ ID NO: 30181 - DNA, 22 bp, Artificial Sequence
  chemically synthesized
tttgggaatttctgattttcat

SEQ ID NO: 30182 - DNA, 22 bp, Artificial Sequence
  chemically synthesized
gggaatttctgattttcatttg

SEQ ID NO: 30183 - DNA, 22 bp, Artificial Sequence
  chemically synthesized
ggaatttctgattttcatttgt

SEQ ID NO: 30184 - DNA, 22 bp, Artificial Sequence
  chemically synthesized
ctgattttcatttgtctggatg

SEQ ID NO: 30185 - DNA, 22 bp, Artificial Sequence
  chemically synthesized
tgattttcatttgtctggatgt

SEQ ID NO: 30186 - DNA, 22 bp, Artificial Sequence
  chemically synthesized
attttcatttgtctggatgtct

SEQ ID NO: 30187 - DNA, 22 bp, Artificial Sequence
  chemically synthesized
tcatttgtctggatgtctacat

SEQ ID NO: 30188 - DNA, 22 bp, Artificial Sequence
  chemically synthesized
catttgtctggatgtctacatt

SEQ ID NO: 30189 - DNA, 22 bp, Artificial Sequence
  chemically synthesized
atttgtctggatgtctacattt

SEQ ID NO: 30190 - DNA, 22 bp, Artificial Sequence
  chemically synthesized
gtctggatgtctacatttcttg

SEQ ID NO: 30191 - DNA, 22 bp, Artificial Sequence
  chemically synthesized
tctggatgtctacatttcttgc

SEQ ID NO: 30192 - DNA, 22 bp, Artificial Sequence
  chemically synthesized
gatgtctacatttcttgctaga

SEQ ID NO: 30193 - DNA, 22 bp, Artificial Sequence
  chemically synthesized
catttcttgctagacttgacaa

SEQ ID NO: 30194 - DNA, 22 bp, Artificial Sequence
  chemically synthesized
cttgctagacttgacaagtttt

SEQ ID NO: 30195 - DNA, 22 bp, Artificial Sequence
  chemically synthesized
ttgctagacttgacaagttttc

SEQ ID NO: 30196 - DNA, 22 bp, Artificial Sequence
  chemically synthesized
gctagacttgacaagttttcag

SEQ ID NO: 30197 - DNA, 22 bp, Artificial Sequence
  chemically synthesized
ctagacttgacaagttttcagc

SEQ ID NO: 30198 - DNA, 22 bp, Artificial Sequence
  chemically synthesized
gacttgacaagttttcagctat

SEQ ID NO: 30199 - DNA, 22 bp, Artificial Sequence
  chemically synthesized
gacaagttttcagctattgtgt

SEQ ID NO: 30200 - DNA, 22 bp, Artificial Sequence
  chemically synthesized
acaagttttcagctattgtgtt

SEQ ID NO: 30201 - DNA, 22 bp, Artificial Sequence
  chemically synthesized
tcagctattgtgttgttacgta

SEQ ID NO: 30202 - DNA, 22 bp, Artificial Sequence
  chemically synthesized
cagctattgtgttgttacgtag

SEQ ID NO: 30203 - DNA, 22 bp, Artificial Sequence
  chemically synthesized
agctattgtgttgttacgtagg

SEQ ID NO: 30204 - DNA, 22 bp, Artificial Sequence
  chemically synthesized
ttgtgttgttacgtaggtttcc

SEQ ID NO: 30205 - DNA, 22 bp, Artificial Sequence
  chemically synthesized
tgttgttacgtaggtttcctac

SEQ ID NO: 30206 - DNA, 22 bp, Artificial Sequence
  chemically synthesized
ttacgtaggtttcctacacctt

SEQ ID NO: 30207 - DNA, 22 bp, Artificial Sequence
  chemically synthesized
cgtaggtttcctacacctttca

SEQ ID NO: 30208 - DNA, 22 bp, Artificial Sequence
  chemically synthesized
cctacacctttcatgttctctt

SEQ ID NO: 30209 - DNA, 22 bp, Artificial Sequence
  chemically synthesized
ctacacctttcatgttctcttt

SEQ ID NO: 30210 - DNA, 22 bp, Artificial Sequence
  chemically synthesized
cacctttcatgttctctttacc

SEQ ID NO: 30211 - DNA, 22 bp, Artificial Sequence
  chemically synthesized
tcatgttctctttaccttctgg

SEQ ID NO: 30212 - DNA, 22 bp, Artificial Sequence
  chemically synthesized
catgttctctttaccttctggg

SEQ ID NO: 30213 - DNA, 22 bp, Artificial Sequence
  chemically synthesized
atgttctctttaccttctggga

SEQ ID NO: 30214 - DNA, 22 bp, Artificial Sequence
  chemically synthesized
tctttaccttctgggaaactgc

SEQ ID NO: 30215 - DNA, 22 bp, Artificial Sequence
  chemically synthesized
tttaccttctgggaaactgcaa

SEQ ID NO: 30216 - DNA, 22 bp, Artificial Sequence
  chemically synthesized
taccttctgggaaactgcaaat

SEQ ID NO: 30217 - DNA, 22 bp, Artificial Sequence
  chemically synthesized
accttctgggaaactgcaaatt

SEQ ID NO: 30218 - DNA, 22 bp, Artificial Sequence
  chemically synthesized
ccttctgggaaactgcaaattt

SEQ ID NO: 30219 - DNA, 22 bp, Artificial Sequence
  chemically synthesized
ctgggaaactgcaaatttgaat

SEQ ID NO: 30220 - DNA, 22 bp, Artificial Sequence
  chemically synthesized
tgggaaactgcaaatttgaata

SEQ ID NO: 30221 - DNA, 22 bp, Artificial Sequence
  chemically synthesized
ggaaactgcaaatttgaatatt

SEQ ID NO: 30222 - DNA, 22 bp, Artificial Sequence
  chemically synthesized
caaatttgaatatttgttcact

SEQ ID NO: 30223 - DNA, 22 bp, Artificial Sequence
  chemically synthesized
gaatatttgttcactttatagt

SEQ ID NO: 30224 - DNA, 22 bp, Artificial Sequence
  chemically synthesized
aatatttgttcactttatagtg

SEQ ID NO: 30225 - DNA, 22 bp, Artificial Sequence
  chemically synthesized
gttcactttatagtgcctcata

SEQ ID NO: 30226 - DNA, 22 bp, Artificial Sequence
  chemically synthesized
ttcactttatagtgcctcatat

SEQ ID NO: 30227 - DNA, 22 bp, Artificial Sequence
  chemically synthesized
actttatagtgcctcatatgtc

SEQ ID NO: 30228 - DNA, 22 bp, Artificial Sequence
  chemically synthesized
tatagtgcctcatatgtcacat

SEQ ID NO: 30229 - DNA, 22 bp, Artificial Sequence
  chemically synthesized
atagtgcctcatatgtcacata

SEQ ID NO: 30230 - DNA, 22 bp, Artificial Sequence
  chemically synthesized
tagtgcctcatatgtcacatac

SEQ ID NO: 30231 - DNA, 22 bp, Artificial Sequence
  chemically synthesized
atatgtcacatacactttgttc

SEQ ID NO: 30232 - DNA, 22 bp, Artificial Sequence
  chemically synthesized
tgttcattctttttttttcctt

SEQ ID NO: 30233 - DNA, 22 bp, Artificial Sequence
  chemically synthesized
gttcattctttttttttccttt

SEQ ID NO: 30234 - DNA, 22 bp, Artificial Sequence
  chemically synthesized
ttcattctttttttttcctttc

SEQ ID NO: 30235 - DNA, 22 bp, Artificial Sequence
  chemically synthesized
attctttttttttcctttctat

SEQ ID NO: 30236 - DNA, 22 bp, Artificial Sequence
  chemically synthesized
tttttttttcctttctatcatt

SEQ ID NO: 30237 - DNA, 22 bp, Artificial Sequence
  chemically synthesized
tttttttcctttctatcatttg

SEQ ID NO: 30238 - DNA, 22 bp, Artificial Sequence
  chemically synthesized
ttttttcctttctatcatttga

SEQ ID NO: 30239 - DNA, 22 bp, Artificial Sequence
  chemically synthesized
tttttcctttctatcatttgac

SEQ ID NO: 30240 - DNA, 22 bp, Artificial Sequence
  chemically synthesized
ttttcctttctatcatttgacc

SEQ ID NO: 30241 - DNA, 22 bp, Artificial Sequence
  chemically synthesized
tttcctttctatcatttgacca

SEQ ID NO: 30242 - DNA, 22 bp, Artificial Sequence
  chemically synthesized
ttcctttctatcatttgaccag

SEQ ID NO: 30243 - DNA, 22 bp, Artificial Sequence
  chemically synthesized
tcctttctatcatttgaccagc

SEQ ID NO: 30244 - DNA, 22 bp, Artificial Sequence
  chemically synthesized
cctttctatcatttgaccagct

SEQ ID NO: 30245 - DNA, 22 bp, Artificial Sequence
  chemically synthesized
ctttctatcatttgaccagcta

SEQ ID NO: 30246 - DNA, 22 bp, Artificial Sequence
  chemically synthesized
tctatcatttgaccagctaatt

SEQ ID NO: 30247 - DNA, 22 bp, Artificial Sequence
  chemically synthesized
ctatcatttgaccagctaattt

SEQ ID NO: 30248 - DNA, 22 bp, Artificial Sequence
  chemically synthesized
tatcatttgaccagctaatttt

SEQ ID NO: 30249 - DNA, 22 bp, Artificial Sequence
  chemically synthesized
tcatttgaccagctaattttaa

SEQ ID NO: 30250 - DNA, 22 bp, Artificial Sequence
  chemically synthesized
gaccagctaattttaaaagacc

SEQ ID NO: 30251 - DNA, 22 bp, Artificial Sequence
  chemically synthesized
accagctaattttaaaagacct

SEQ ID NO: 30252 - DNA, 22 bp, Artificial Sequence
  chemically synthesized
attttaaaagacctgtcttcaa

SEQ ID NO: 30253 - DNA, 22 bp, Artificial Sequence
  chemically synthesized
taaaagacctgtcttcaagttc

SEQ ID NO: 30254 - DNA, 22 bp, Artificial Sequence
  chemically synthesized
aaaagacctgtcttcaagttct

SEQ ID NO: 30255 - DNA, 22 bp, Artificial Sequence
  chemically synthesized
aaagacctgtcttcaagttctg

SEQ ID NO: 30256 - DNA, 22 bp, Artificial Sequence
  chemically synthesized
tcttcaagttctgaaatttttc

SEQ ID NO: 30257 - DNA, 22 bp, Artificial Sequence
  chemically synthesized
caagttctgaaatttttcttct

SEQ ID NO: 30258 - DNA, 22 bp, Artificial Sequence
  chemically synthesized
aagttctgaaatttttcttctg

SEQ ID NO: 30259 - DNA, 22 bp, Artificial Sequence
  chemically synthesized
tgaaatttttcttctgcttgat

SEQ ID NO: 30260 - DNA, 22 bp, Artificial Sequence
  chemically synthesized
aaatttttcttctgcttgatct

SEQ ID NO: 30261 - DNA, 22 bp, Artificial Sequence
  chemically synthesized
ttcttctgcttgatctgatcta

SEQ ID NO: 30262 - DNA, 22 bp, Artificial Sequence
  chemically synthesized
tcttctgcttgatctgatctat

SEQ ID NO: 30263 - DNA, 22 bp, Artificial Sequence
  chemically synthesized
cttctgcttgatctgatctatt

SEQ ID NO: 30264 - DNA, 22 bp, Artificial Sequence
  chemically synthesized
ttctgcttgatctgatctattg

SEQ ID NO: 30265 - DNA, 22 bp, Artificial Sequence
  chemically synthesized
ctgcttgatctgatctattgtt

SEQ ID NO: 30266 - DNA, 22 bp, Artificial Sequence
  chemically synthesized
tgcttgatctgatctattgttg

SEQ ID NO: 30267 - DNA, 22 bp, Artificial Sequence
  chemically synthesized
cttgatctgatctattgttgaa

SEQ ID NO: 30268 - DNA, 22 bp, Artificial Sequence
  chemically synthesized
gatctgatctattgttgaagtt

SEQ ID NO: 30269 - DNA, 22 bp, Artificial Sequence
  chemically synthesized
atctgatctattgttgaagttt

SEQ ID NO: 30270 - DNA, 22 bp, Artificial Sequence
  chemically synthesized
atctattgttgaagtttttgaa

SEQ ID NO: 30271 - DNA, 22 bp, Artificial Sequence
  chemically synthesized
ttgttgaagtttttgaatgtat

SEQ ID NO: 30272 - DNA, 22 bp, Artificial Sequence
  chemically synthesized
ttgaagtttttgaatgtatttt

SEQ ID NO: 30273 - DNA, 22 bp, Artificial Sequence
  chemically synthesized
aagtttttgaatgtattttgta

SEQ ID NO: 30274 - DNA, 22 bp, Artificial Sequence
  chemically synthesized
ttgaatgtattttgtatttctt

SEQ ID NO: 30275 - DNA, 22 bp, Artificial Sequence
  chemically synthesized
tgaatgtattttgtatttcttt

SEQ ID NO: 30276 - DNA, 22 bp, Artificial Sequence
  chemically synthesized
gaatgtattttgtatttctttc

SEQ ID NO: 30277 - DNA, 22 bp, Artificial Sequence
  chemically synthesized
aatgtattttgtatttctttca

SEQ ID NO: 30278 - DNA, 22 bp, Artificial Sequence
  chemically synthesized
tgtatttctttcaataaactct

SEQ ID NO: 30279 - DNA, 22 bp, Artificial Sequence
  chemically synthesized
gtatttctttcaataaactctt

SEQ ID NO: 30280 - DNA, 22 bp, Artificial Sequence
  chemically synthesized
tatttctttcaataaactcttc

SEQ ID NO: 30281 - DNA, 22 bp, Artificial Sequence
  chemically synthesized
ctttcaataaactcttcagtta

SEQ ID NO: 30282 - DNA, 22 bp, Artificial Sequence
  chemically synthesized
tttcaataaactcttcagttac

SEQ ID NO: 30283 - DNA, 22 bp, Artificial Sequence
  chemically synthesized
tcaataaactcttcagttacag

SEQ ID NO: 30284 - DNA, 22 bp, Artificial Sequence
  chemically synthesized
caataaactcttcagttacaga

SEQ ID NO: 30285 - DNA, 22 bp, Artificial Sequence
  chemically synthesized
aataaactcttcagttacagaa

SEQ ID NO: 30286 - DNA, 22 bp, Artificial Sequence
  chemically synthesized
ttcagttacagaatttctgttt

SEQ ID NO: 30287 - DNA, 22 bp, Artificial Sequence
  chemically synthesized
cagttacagaatttctgtttgg

SEQ ID NO: 30288 - DNA, 22 bp, Artificial Sequence
  chemically synthesized
agttacagaatttctgtttggt

SEQ ID NO: 30289 - DNA, 22 bp, Artificial Sequence
  chemically synthesized
cagaatttctgtttggttcatt

SEQ ID NO: 30290 - DNA, 22 bp, Artificial Sequence
  chemically synthesized
ctgtttggttcattcttgttgt

SEQ ID NO: 30291 - DNA, 22 bp, Artificial Sequence
  chemically synthesized
tgtttggttcattcttgttgta

SEQ ID NO: 30292 - DNA, 22 bp, Artificial Sequence
  chemically synthesized
tttggttcattcttgttgtatc

SEQ ID NO: 30293 - DNA, 22 bp, Artificial Sequence
  chemically synthesized
ggttcattcttgttgtatctat

SEQ ID NO: 30294 - DNA, 22 bp, Artificial Sequence
  chemically synthesized
gttcattcttgttgtatctatc

SEQ ID NO: 30295 - DNA, 22 bp, Artificial Sequence
  chemically synthesized
attcttgttgtatctatctctt

SEQ ID NO: 30296 - DNA, 22 bp, Artificial Sequence
  chemically synthesized
ttgttgtatctatctcttgggt

SEQ ID NO: 30297 - DNA, 22 bp, Artificial Sequence
  chemically synthesized
gttgtatctatctcttgggtaa

SEQ ID NO: 30298 - DNA, 22 bp, Artificial Sequence
  chemically synthesized
ttgtatctatctcttgggtaaa

SEQ ID NO: 30299 - DNA, 22 bp, Artificial Sequence
  chemically synthesized
tatctatctcttgggtaaattt

SEQ ID NO: 30300 - DNA, 22 bp, Artificial Sequence
  chemically synthesized
tctcttgggtaaatttctcatt

SEQ ID NO: 30301 - DNA, 22 bp, Artificial Sequence
  chemically synthesized
ttgggtaaatttctcattcata

SEQ ID NO: 30302 - DNA, 22 bp, Artificial Sequence
  chemically synthesized
gggtaaatttctcattcatatc

SEQ ID NO: 30303 - DNA, 22 bp, Artificial Sequence
  chemically synthesized
ggtaaatttctcattcatatcc

SEQ ID NO: 30304 - DNA, 22 bp, Artificial Sequence
  chemically synthesized
ctcattcatatcctgaattgtt

SEQ ID NO: 30305 - DNA, 22 bp, Artificial Sequence
  chemically synthesized
tcattcatatcctgaattgttt

SEQ ID NO: 30306 - DNA, 22 bp, Artificial Sequence
  chemically synthesized
attcatatcctgaattgttttt

SEQ ID NO: 30307 - DNA, 22 bp, Artificial Sequence
  chemically synthesized
atatcctgaattgtttttctga

SEQ ID NO: 30308 - DNA, 22 bp, Artificial Sequence
  chemically synthesized
aattgtttttctgatttctttt

SEQ ID NO: 30309 - DNA, 22 bp, Artificial Sequence
  chemically synthesized
tttttctgatttctttttattg

SEQ ID NO: 30310 - DNA, 22 bp, Artificial Sequence
  chemically synthesized
ttctgatttctttttattgttt

SEQ ID NO: 30311 - DNA, 22 bp, Artificial Sequence
  chemically synthesized
tctgatttctttttattgttta

SEQ ID NO: 30312 - DNA, 22 bp, Artificial Sequence
  chemically synthesized
ctgatttctttttattgtttat

SEQ ID NO: 30313 - DNA, 22 bp, Artificial Sequence
  chemically synthesized
tgatttctttttattgtttatc

SEQ ID NO: 30314 - DNA, 22 bp, Artificial Sequence
  chemically synthesized
atttctttttattgtttatctg

SEQ ID NO: 30315 - DNA, 22 bp, Artificial Sequence
  chemically synthesized
ctttttattgtttatctgagtt

SEQ ID NO: 30316 - DNA, 22 bp, Artificial Sequence
  chemically synthesized
tttttattgtttatctgagttc

SEQ ID NO: 30317 - DNA, 22 bp, Artificial Sequence
  chemically synthesized
tttattgtttatctgagttctc

SEQ ID NO: 30318 - DNA, 22 bp, Artificial Sequence
  chemically synthesized
ttattgtttatctgagttctct

SEQ ID NO: 30319 - DNA, 22 bp, Artificial Sequence
  chemically synthesized
tattgtttatctgagttctctt

SEQ ID NO: 30320 - DNA, 22 bp, Artificial Sequence
  chemically synthesized
attgtttatctgagttctcttg

SEQ ID NO: 30321 - DNA, 22 bp, Artificial Sequence
  chemically synthesized
ttgtttatctgagttctcttgt

SEQ ID NO: 30322 - DNA, 22 bp, Artificial Sequence
  chemically synthesized
tttatctgagttctcttgtgtc

SEQ ID NO: 30323 - DNA, 22 bp, Artificial Sequence
  chemically synthesized
atctgagttctcttgtgtctca

SEQ ID NO: 30324 - DNA, 22 bp, Artificial Sequence
  chemically synthesized
tctgagttctcttgtgtctcac

SEQ ID NO: 30325 - DNA, 22 bp, Artificial Sequence
  chemically synthesized
agttctcttgtgtctcactgag

SEQ ID NO: 30326 - DNA, 22 bp, Artificial Sequence
  chemically synthesized
tcttgtgtctcactgagcttcc

SEQ ID NO: 30327 - DNA, 22 bp, Artificial Sequence
  chemically synthesized
ttgtgtctcactgagcttcctt

SEQ ID NO: 30328 - DNA, 22 bp, Artificial Sequence
  chemically synthesized
gtgtctcactgagcttccttaa

SEQ ID NO: 30329 - DNA, 22 bp, Artificial Sequence
  chemically synthesized
tgtctcactgagcttccttaat

SEQ ID NO: 30330 - DNA, 22 bp, Artificial Sequence
  chemically synthesized
actgagcttccttaatatcaac

SEQ ID NO: 30331 - DNA, 22 bp, Artificial Sequence
  chemically synthesized
agcttccttaatatcaacattt

SEQ ID NO: 30332 - DNA, 22 bp, Artificial Sequence
  chemically synthesized
ccttaatatcaacattttggat

SEQ ID NO: 30333 - DNA, 22 bp, Artificial Sequence
  chemically synthesized
cttaatatcaacattttggatt

SEQ ID NO: 30334 - DNA, 22 bp, Artificial Sequence
  chemically synthesized
aatatcaacattttggattctt

SEQ ID NO: 30335 - DNA, 22 bp, Artificial Sequence
  chemically synthesized
atatcaacattttggattcttt

SEQ ID NO: 30336 - DNA, 22 bp, Artificial Sequence
  chemically synthesized
tggattcttttttccagaattt

SEQ ID NO: 30337 - DNA, 22 bp, Artificial Sequence
  chemically synthesized
ggattcttttttccagaatttt

SEQ ID NO: 30338 - DNA, 22 bp, Artificial Sequence
  chemically synthesized
gattcttttttccagaatttta

SEQ ID NO: 30339 - DNA, 22 bp, Artificial Sequence
  chemically synthesized
ttttttccagaattttataaat

SEQ ID NO: 30340 - DNA, 22 bp, Artificial Sequence
  chemically synthesized
ttttccagaattttataaatgt

SEQ ID NO: 30341 - DNA, 22 bp, Artificial Sequence
  chemically synthesized
tttccagaattttataaatgtc

SEQ ID NO: 30342 - DNA, 22 bp, Artificial Sequence
  chemically synthesized
ttccagaattttataaatgtct

SEQ ID NO: 30343 - DNA, 22 bp, Artificial Sequence
  chemically synthesized
tccagaattttataaatgtctt

SEQ ID NO: 30344 - DNA, 22 bp, Artificial Sequence
  chemically synthesized
ccagaattttataaatgtcttt

SEQ ID NO: 30345 - DNA, 22 bp, Artificial Sequence
  chemically synthesized
cagaattttataaatgtctttt

SEQ ID NO: 30346 - DNA, 22 bp, Artificial Sequence
  chemically synthesized
tataaatgtcttttttttccac

SEQ ID NO: 30347 - DNA, 22 bp, Artificial Sequence
  chemically synthesized
ataaatgtcttttttttccact

SEQ ID NO: 30348 - DNA, 22 bp, Artificial Sequence
  chemically synthesized
taaatgtcttttttttccactg

SEQ ID NO: 30349 - DNA, 22 bp, Artificial Sequence
  chemically synthesized
ttttttccactggcttatgttg

SEQ ID NO: 30350 - DNA, 22 bp, Artificial Sequence
  chemically synthesized
tttttccactggcttatgttgc

SEQ ID NO: 30351 - DNA, 22 bp, Artificial Sequence
  chemically synthesized
ttttccactggcttatgttgct

SEQ ID NO: 30352 - DNA, 22 bp, Artificial Sequence
  chemically synthesized
tttccactggcttatgttgctg

SEQ ID NO: 30353 - DNA, 22 bp, Artificial Sequence
  chemically synthesized
ttccactggcttatgttgctga

SEQ ID NO: 30354 - DNA, 22 bp, Artificial Sequence
  chemically synthesized
tccactggcttatgttgctgaa

SEQ ID NO: 30355 - DNA, 22 bp, Artificial Sequence
  chemically synthesized
ccactggcttatgttgctgaag

SEQ ID NO: 30356 - DNA, 22 bp, Artificial Sequence
  chemically synthesized
cactggcttatgttgctgaaga

SEQ ID NO: 30357 - DNA, 22 bp, Artificial Sequence
  chemically synthesized
gcttatgttgctgaagaattat

SEQ ID NO: 30358 - DNA, 22 bp, Artificial Sequence
  chemically synthesized
atgttgctgaagaattattaaa

SEQ ID NO: 30359 - DNA, 22 bp, Artificial Sequence
  chemically synthesized
tgttgctgaagaattattaaat

SEQ ID NO: 30360 - DNA, 22 bp, Artificial Sequence
  chemically synthesized
ctgaagaattattaaattcctt

SEQ ID NO: 30361 - DNA, 22 bp, Artificial Sequence
  chemically synthesized
aagaattattaaattcctttgg

SEQ ID NO: 30362 - DNA, 22 bp, Artificial Sequence
  chemically synthesized
ttaaattcctttggaagtgtca

SEQ ID NO: 30363 - DNA, 22 bp, Artificial Sequence
  chemically synthesized
aattcctttggaagtgtcatat

SEQ ID NO: 30364 - DNA, 22 bp, Artificial Sequence
  chemically synthesized
ctttggaagtgtcatatttctt

SEQ ID NO: 30365 - DNA, 22 bp, Artificial Sequence
  chemically synthesized
tggaagtgtcatatttcttcac

SEQ ID NO: 30366 - DNA, 22 bp, Artificial Sequence
  chemically synthesized
ggaagtgtcatatttcttcacc

SEQ ID NO: 30367 - DNA, 22 bp, Artificial Sequence
  chemically synthesized
gaagtgtcatatttcttcacct

SEQ ID NO: 30368 - DNA, 22 bp, Artificial Sequence
  chemically synthesized
cttcacctttttatgtttattt

SEQ ID NO: 30369 - DNA, 22 bp, Artificial Sequence
  chemically synthesized
ttcacctttttatgtttatttt

SEQ ID NO: 30370 - DNA, 22 bp, Artificial Sequence
  chemically synthesized
cacctttttatgtttattttgt

SEQ ID NO: 30371 - DNA, 22 bp, Artificial Sequence
  chemically synthesized
acctttttatgtttattttgtt

SEQ ID NO: 30372 - DNA, 22 bp, Artificial Sequence
  chemically synthesized
tttatgtttattttgttcttgc

SEQ ID NO: 30373 - DNA, 22 bp, Artificial Sequence
  chemically synthesized
ttatgtttattttgttcttgca

SEQ ID NO: 30374 - DNA, 22 bp, Artificial Sequence
  chemically synthesized
tatgtttattttgttcttgcat

SEQ ID NO: 30375 - DNA, 22 bp, Artificial Sequence
  chemically synthesized
atgtttattttgttcttgcatt

SEQ ID NO: 30376 - DNA, 22 bp, Artificial Sequence
  chemically synthesized
tgtttattttgttcttgcattg

SEQ ID NO: 30377 - DNA, 22 bp, Artificial Sequence
  chemically synthesized
attttgttcttgcattgatatc

SEQ ID NO: 30378 - DNA, 22 bp, Artificial Sequence
  chemically synthesized
ttttgttcttgcattgatatct

SEQ ID NO: 30379 - DNA, 22 bp, Artificial Sequence
  chemically synthesized
tgttcttgcattgatatctctg

SEQ ID NO: 30380 - DNA, 22 bp, Artificial Sequence
  chemically synthesized
gttcttgcattgatatctctgc

SEQ ID NO: 30381 - DNA, 22 bp, Artificial Sequence
  chemically synthesized
ttcttgcattgatatctctgca

SEQ ID NO: 30382 - DNA, 22 bp, Artificial Sequence
  chemically synthesized
ttgcattgatatctctgcatct

SEQ ID NO: 30383 - DNA, 22 bp, Artificial Sequence
  chemically synthesized
gcattgatatctctgcatctgg

SEQ ID NO: 30384 - DNA, 22 bp, Artificial Sequence
  chemically synthesized
cattgatatctctgcatctggt

SEQ ID NO: 30385 - DNA, 22 bp, Artificial Sequence
  chemically synthesized
atatctctgcatctggtgtaat

SEQ ID NO: 30386 - DNA, 22 bp, Artificial Sequence
  chemically synthesized
tgcatctggtgtaatgattgct

SEQ ID NO: 30387 - DNA, 22 bp, Artificial Sequence
  chemically synthesized
catctggtgtaatgattgctgc

SEQ ID NO: 30388 - DNA, 22 bp, Artificial Sequence
  chemically synthesized
gtgtaatgattgctgcttccag

SEQ ID NO: 30389 - DNA, 22 bp, Artificial Sequence
  chemically synthesized
ctgcttccagttttgtaaattt

SEQ ID NO: 30390 - DNA, 22 bp, Artificial Sequence
  chemically synthesized
cttccagttttgtaaatttgtt

SEQ ID NO: 30391 - DNA, 22 bp, Artificial Sequence
  chemically synthesized
ccagttttgtaaatttgttttt

SEQ ID NO: 30392 - DNA, 22 bp, Artificial Sequence
  chemically synthesized
cagttttgtaaatttgtttttg

SEQ ID NO: 30393 - DNA, 22 bp, Artificial Sequence
  chemically synthesized
tgtaaatttgtttttgtagggg

SEQ ID NO: 30394 - DNA, 22 bp, Artificial Sequence
  chemically synthesized
gtaaatttgtttttgtagggga

SEQ ID NO: 30395 - DNA, 22 bp, Artificial Sequence
  chemically synthesized
taaatttgtttttgtaggggaa

SEQ ID NO: 30396 - DNA, 22 bp, Artificial Sequence
  chemically synthesized
gtttttgtaggggaagactttt

SEQ ID NO: 30397 - DNA, 22 bp, Artificial Sequence
  chemically synthesized
tttttgtaggggaagacttttt

SEQ ID NO: 30398 - DNA, 22 bp, Artificial Sequence
  chemically synthesized
ttgtaggggaagacttttttct

SEQ ID NO: 30399 - DNA, 22 bp, Artificial Sequence
  chemically synthesized
tgtaggggaagacttttttctg

SEQ ID NO: 30400 - DNA, 22 bp, Artificial Sequence
  chemically synthesized
gtaggggaagacttttttctga

SEQ ID NO: 30401 - DNA, 22 bp, Artificial Sequence
  chemically synthesized
taggggaagacttttttctgaa

SEQ ID NO: 30402 - DNA, 22 bp, Artificial Sequence
  chemically synthesized
ttttctgaagatgtatcttggt

SEQ ID NO: 30403 - DNA, 22 bp, Artificial Sequence
  chemically synthesized
tttctgaagatgtatcttggtg

SEQ ID NO: 30404 - DNA, 22 bp, Artificial Sequence
  chemically synthesized
ttctgaagatgtatcttggtgt

SEQ ID NO: 30405 - DNA, 22 bp, Artificial Sequence
  chemically synthesized
tctgaagatgtatcttggtgtt

SEQ ID NO: 30406 - DNA, 22 bp, Artificial Sequence
  chemically synthesized
ctgaagatgtatcttggtgttg

SEQ ID NO: 30407 - DNA, 22 bp, Artificial Sequence
  chemically synthesized
tgaagatgtatcttggtgttga

SEQ ID NO: 30408 - DNA, 22 bp, Artificial Sequence
  chemically synthesized
aagatgtatcttggtgttgatt

SEQ ID NO: 30409 - DNA, 22 bp, Artificial Sequence
  chemically synthesized
ggtgttgattgagtagggcact

SEQ ID NO: 30410 - DNA, 22 bp, Artificial Sequence
  chemically synthesized
gtgttgattgagtagggcactt

SEQ ID NO: 30411 - DNA, 22 bp, Artificial Sequence
  chemically synthesized
attgagtagggcactttgattt

SEQ ID NO: 30412 - DNA, 22 bp, Artificial Sequence
  chemically synthesized
agtagggcactttgattttgat

SEQ ID NO: 30413 - DNA, 22 bp, Artificial Sequence
  chemically synthesized
tgattttgatttctaggtgcat

SEQ ID NO: 30414 - DNA, 22 bp, Artificial Sequence
  chemically synthesized
gattttgatttctaggtgcata

SEQ ID NO: 30415 - DNA, 22 bp, Artificial Sequence
  chemically synthesized
attttgatttctaggtgcatac

SEQ ID NO: 30416 - DNA, 22 bp, Artificial Sequence
  chemically synthesized
tgatttctaggtgcatacagca

SEQ ID NO: 30417 - DNA, 22 bp, Artificial Sequence
  chemically synthesized
gatttctaggtgcatacagcag

SEQ ID NO: 30418 - DNA, 22 bp, Artificial Sequence
  chemically synthesized
atttctaggtgcatacagcagc

SEQ ID NO: 30419 - DNA, 22 bp, Artificial Sequence
  chemically synthesized
ctaggtgcatacagcagcatag

SEQ ID NO: 30420 - DNA, 22 bp, Artificial Sequence
  chemically synthesized
taggtgcatacagcagcatagt

SEQ ID NO: 30421 - DNA, 22 bp, Artificial Sequence
  chemically synthesized
ggtgcatacagcagcatagtct

SEQ ID NO: 30422 - DNA, 22 bp, Artificial Sequence
  chemically synthesized
catattattttttttcagctgc

SEQ ID NO: 30423 - DNA, 22 bp, Artificial Sequence
  chemically synthesized
atattattttttttcagctgcc

SEQ ID NO: 30424 - DNA, 22 bp, Artificial Sequence
  chemically synthesized
ttttttttcagctgccaacagt

SEQ ID NO: 30425 - DNA, 22 bp, Artificial Sequence
  chemically synthesized
tttttcagctgccaacagtatc

SEQ ID NO: 30426 - DNA, 22 bp, Artificial Sequence
  chemically synthesized
ttttcagctgccaacagtatca

SEQ ID NO: 30427 - DNA, 22 bp, Artificial Sequence
  chemically synthesized
tttcagctgccaacagtatcat

SEQ ID NO: 30428 - DNA, 22 bp, Artificial Sequence
  chemically synthesized
ttcagctgccaacagtatcatc

SEQ ID NO: 30429 - DNA, 22 bp, Artificial Sequence
  chemically synthesized
tcagctgccaacagtatcatca

SEQ ID NO: 30430 - DNA, 22 bp, Artificial Sequence
  chemically synthesized
cagctgccaacagtatcatcag

SEQ ID NO: 30431 - DNA, 22 bp, Artificial Sequence
  chemically synthesized
agctgccaacagtatcatcagt

SEQ ID NO: 30432 - DNA, 22 bp, Artificial Sequence
  chemically synthesized
ccaacagtatcatcagtgtctg

SEQ ID NO: 30433 - DNA, 22 bp, Artificial Sequence
  chemically synthesized
tgattttttcagtggcttaggg

SEQ ID NO: 30434 - DNA, 22 bp, Artificial Sequence
  chemically synthesized
tttcagtggcttagggtgcatt

SEQ ID NO: 30435 - DNA, 22 bp, Artificial Sequence
  chemically synthesized
ttcagtggcttagggtgcattt

SEQ ID NO: 30436 - DNA, 22 bp, Artificial Sequence
  chemically synthesized
tcagtggcttagggtgcatttg

SEQ ID NO: 30437 - DNA, 22 bp, Artificial Sequence
  chemically synthesized
cagtggcttagggtgcatttgt

SEQ ID NO: 30438 - DNA, 22 bp, Artificial Sequence
  chemically synthesized
agtggcttagggtgcatttgtt

SEQ ID NO: 30439 - DNA, 22 bp, Artificial Sequence
  chemically synthesized
agggtgcatttgttagtgaagg

SEQ ID NO: 30440 - DNA, 22 bp, Artificial Sequence
  chemically synthesized
gggtgcatttgttagtgaaggt

SEQ ID NO: 30441 - DNA, 22 bp, Artificial Sequence
  chemically synthesized
gttagtgaaggtggtgatgagg

SEQ ID NO: 30442 - DNA, 22 bp, Artificial Sequence
  chemically synthesized
ttagtgaaggtggtgatgaggt

SEQ ID NO: 30443 - DNA, 22 bp, Artificial Sequence
  chemically synthesized
gtgaaggtggtgatgaggttgt

SEQ ID NO: 30444 - DNA, 22 bp, Artificial Sequence
  chemically synthesized
tgctggagacaagaatatcaag

SEQ ID NO: 30445 - DNA, 22 bp, Artificial Sequence
  chemically synthesized
gagacaagaatatcaagtgggc

SEQ ID NO: 30446 - DNA, 22 bp, Artificial Sequence
  chemically synthesized
ggccccagtggtggtggtgggc

SEQ ID NO: 30447 - DNA, 22 bp, Artificial Sequence
  chemically synthesized
gccccagtggtggtggtgggcc

SEQ ID NO: 30448 - DNA, 22 bp, Artificial Sequence
  chemically synthesized
gcattcctgtccttgggcccca

SEQ ID NO: 30449 - DNA, 22 bp, Artificial Sequence
  chemically synthesized
ctgtccttgggccccatggctg

SEQ ID NO: 30450 - DNA, 22 bp, Artificial Sequence
  chemically synthesized
tccttgggccccatggctgtgt

SEQ ID NO: 30451 - DNA, 22 bp, Artificial Sequence
  chemically synthesized
gggccccatggctgtgtacatt

SEQ ID NO: 30452 - DNA, 22 bp, Artificial Sequence
  chemically synthesized
ggccccatggctgtgtacattg

SEQ ID NO: 30453 - DNA, 22 bp, Artificial Sequence
  chemically synthesized
tgtacattggcactgatggtaa

SEQ ID NO: 30454 - DNA, 22 bp, Artificial Sequence
  chemically synthesized
gcactgatggtaatgagtctag

SEQ ID NO: 30455 - DNA, 22 bp, Artificial Sequence
  chemically synthesized
atggtaatgagtctagttgggt

SEQ ID NO: 30456 - DNA, 22 bp, Artificial Sequence
  chemically synthesized
gttgggttgattctttggcctt

SEQ ID NO: 30457 - DNA, 22 bp, Artificial Sequence
  chemically synthesized
ggttgattctttggccttcagg

SEQ ID NO: 30458 - DNA, 22 bp, Artificial Sequence
  chemically synthesized
attctttggccttcaggcagtt

SEQ ID NO: 30459 - DNA, 22 bp, Artificial Sequence
  chemically synthesized
tttggccttcaggcagtttgct

SEQ ID NO: 30460 - DNA, 22 bp, Artificial Sequence
  chemically synthesized
tggccttcaggcagtttgcttg

SEQ ID NO: 30461 - DNA, 22 bp, Artificial Sequence
  chemically synthesized
ggccttcaggcagtttgcttgg

SEQ ID NO: 30462 - DNA, 22 bp, Artificial Sequence
  chemically synthesized
gccttcaggcagtttgcttggg

SEQ ID NO: 30463 - DNA, 22 bp, Artificial Sequence
  chemically synthesized
caggcagtttgcttgggtgtca

SEQ ID NO: 30464 - DNA, 22 bp, Artificial Sequence
  chemically synthesized
aggcagtttgcttgggtgtcag

SEQ ID NO: 30465 - DNA, 22 bp, Artificial Sequence
  chemically synthesized
gcttgggtgtcagtagtggcca

SEQ ID NO: 30466 - DNA, 22 bp, Artificial Sequence
  chemically synthesized
cttgggtgtcagtagtggccat

SEQ ID NO: 30467 - DNA, 22 bp, Artificial Sequence
  chemically synthesized
gggtgtcagtagtggccatagt

SEQ ID NO: 30468 - DNA, 22 bp, Artificial Sequence
  chemically synthesized
ggtgtcagtagtggccatagta

SEQ ID NO: 30469 - DNA, 22 bp, Artificial Sequence
  chemically synthesized
ggctggtgtgtgggtcctcagg

SEQ ID NO: 30470 - DNA, 22 bp, Artificial Sequence
  chemically synthesized
gtgtgtgggtcctcaggcttct

SEQ ID NO: 30471 - DNA, 22 bp, Artificial Sequence
  chemically synthesized
aggcttctggacagtgggtgtg

SEQ ID NO: 30472 - DNA, 22 bp, Artificial Sequence
  chemically synthesized
ctggacagtgggtgtggtgtgg

SEQ ID NO: 30473 - DNA, 22 bp, Artificial Sequence
  chemically synthesized
tggacagtgggtgtggtgtggg

SEQ ID NO: 30474 - DNA, 22 bp, Artificial Sequence
  chemically synthesized
gacagtgggtgtggtgtgggtg

SEQ ID NO: 30475 - DNA, 22 bp, Artificial Sequence
  chemically synthesized
tagcaactgcaggacaaccctc

SEQ ID NO: 30476 - DNA, 22 bp, Artificial Sequence
  chemically synthesized
caggacaaccctctggctccca

SEQ ID NO: 30477 - DNA, 22 bp, Artificial Sequence
  chemically synthesized
tggctcccaagcagtctgcact

SEQ ID NO: 30478 - DNA, 22 bp, Artificial Sequence
  chemically synthesized
gctcccaagcagtctgcactgg

SEQ ID NO: 30479 - DNA, 22 bp, Artificial Sequence
  chemically synthesized
ccaagcagtctgcactggtgtt

SEQ ID NO: 30480 - DNA, 22 bp, Artificial Sequence
  chemically synthesized
cactggtgttggtggtggctgc

SEQ ID NO: 30481 - DNA, 22 bp, Artificial Sequence
  chemically synthesized
gtgttggtggtggctgcaaggg

SEQ ID NO: 30482 - DNA, 22 bp, Artificial Sequence
  chemically synthesized
gtggtggctgcaagggctgaat

SEQ ID NO: 30483 - DNA, 22 bp, Artificial Sequence
  chemically synthesized
caagggctgaatgagccagtct

SEQ ID NO: 30484 - DNA, 22 bp, Artificial Sequence
  chemically synthesized
aatgagccagtcttcagaccca

SEQ ID NO: 30485 - DNA, 22 bp, Artificial Sequence
  chemically synthesized
cagacccacaggtggcacatgc

SEQ ID NO: 30486 - DNA, 22 bp, Artificial Sequence
  chemically synthesized
agacccacaggtggcacatgca

SEQ ID NO: 30487 - DNA, 22 bp, Artificial Sequence
  chemically synthesized
tgatggcagtggcagattgggt

SEQ ID NO: 30488 - DNA, 22 bp, Artificial Sequence
  chemically synthesized
ggtaggcccatcatcaggcttc

SEQ ID NO: 30489 - DNA, 22 bp, Artificial Sequence
  chemically synthesized
ctgggagggttgcttaggtacc

SEQ ID NO: 30490 - DNA, 22 bp, Artificial Sequence
  chemically synthesized
tgggagggttgcttaggtacca

SEQ ID NO: 30491 - DNA, 22 bp, Artificial Sequence
  chemically synthesized
ggagggttgcttaggtaccagt

SEQ ID NO: 30492 - DNA, 22 bp, Artificial Sequence
  chemically synthesized
cttaggtaccagtcatggtgga

SEQ ID NO: 30493 - DNA, 22 bp, Artificial Sequence
  chemically synthesized
aggtaccagtcatggtggatgg

SEQ ID NO: 30494 - DNA, 22 bp, Artificial Sequence
  chemically synthesized
ggtaccagtcatggtggatggc

SEQ ID NO: 30495 - DNA, 22 bp, Artificial Sequence
  chemically synthesized
tctctgggttcccagacaactt

SEQ ID NO: 30496 - DNA, 22 bp, Artificial Sequence
  chemically synthesized
tgggttcccagacaacttgctt

SEQ ID NO: 30497 - DNA, 22 bp, Artificial Sequence
  chemically synthesized
ggttcccagacaacttgcttag

SEQ ID NO: 30498 - DNA, 22 bp, Artificial Sequence
  chemically synthesized
ccagacaacttgcttaggcatt

SEQ ID NO: 30499 - DNA, 22 bp, Artificial Sequence
  chemically synthesized
gcttaggcattgaggaaggcaa

SEQ ID NO: 30500 - DNA, 22 bp, Artificial Sequence
  chemically synthesized
cttaggcattgaggaaggcaaa

SEQ ID NO: 30501 - DNA, 22 bp, Artificial Sequence
  chemically synthesized
aggcattgaggaaggcaaagcc

SEQ ID NO: 30502 - DNA, 22 bp, Artificial Sequence
  chemically synthesized
ggcattgaggaaggcaaagcca

SEQ ID NO: 30503 - DNA, 22 bp, Artificial Sequence
  chemically synthesized
aggaaggcaaagccaggctggg

SEQ ID NO: 30504 - DNA, 22 bp, Artificial Sequence
  chemically synthesized
ggtgttcctgacctcaggccac

SEQ ID NO: 30505 - DNA, 22 bp, Artificial Sequence
  chemically synthesized
ctgacctcaggccactcagtgg

SEQ ID NO: 30506 - DNA, 22 bp, Artificial Sequence
  chemically synthesized
acctcaggccactcagtggtgt

SEQ ID NO: 30507 - DNA, 22 bp, Artificial Sequence
  chemically synthesized
aggccactcagtggtgtgtgtg

SEQ ID NO: 30508 - DNA, 22 bp, Artificial Sequence
  chemically synthesized
agtggtgtgtgtggacaccggc

SEQ ID NO: 30509 - DNA, 22 bp, Artificial Sequence
  chemically synthesized
tcataggctggagtggagtgat

SEQ ID NO: 30510 - DNA, 22 bp, Artificial Sequence
  chemically synthesized
gagtggagtgatcctcaggccc

SEQ ID NO: 30511 - DNA, 22 bp, Artificial Sequence
  chemically synthesized
aggcccccagcagaatgcctga

SEQ ID NO: 30512 - DNA, 22 bp, Artificial Sequence
  chemically synthesized
agtgaattagcagctactgcat

SEQ ID NO: 30513 - DNA, 22 bp, Artificial Sequence
  chemically synthesized
gcagctactgcattgttgccct

SEQ ID NO: 30514 - DNA, 22 bp, Artificial Sequence
  chemically synthesized
ctgcattgttgccctgctcttg

SEQ ID NO: 30515 - DNA, 22 bp, Artificial Sequence
  chemically synthesized
cattgttgccctgctcttgaag

SEQ ID NO: 30516 - DNA, 22 bp, Artificial Sequence
  chemically synthesized
ttgccctgctcttgaaggggtg

SEQ ID NO: 30517 - DNA, 22 bp, Artificial Sequence
  chemically synthesized
ccctgctcttgaaggggtgcgg

SEQ ID NO: 30518 - DNA, 22 bp, Artificial Sequence
  chemically synthesized
ctcttgaaggggtgcggggtgt

SEQ ID NO: 30519 - DNA, 22 bp, Artificial Sequence
  chemically synthesized
ttgaaggggtgcggggtgtgtt

SEQ ID NO: 30520 - DNA, 22 bp, Artificial Sequence
  chemically synthesized
gaaggggtgcggggtgtgttgc

SEQ ID NO: 30521 - DNA, 22 bp, Artificial Sequence
  chemically synthesized
aaggggtgcggggtgtgttgct

SEQ ID NO: 30522 - DNA, 22 bp, Artificial Sequence
  chemically synthesized
ctttcagtggcagcagctataa

SEQ ID NO: 30523 - DNA, 22 bp, Artificial Sequence
  chemically synthesized
tcagtggcagcagctataaatg

SEQ ID NO: 30524 - DNA, 22 bp, Artificial Sequence
  chemically synthesized
cagtggcagcagctataaatgg

SEQ ID NO: 30525 - DNA, 22 bp, Artificial Sequence
  chemically synthesized
agtggcagcagctataaatggg

SEQ ID NO: 30526 - DNA, 22 bp, Artificial Sequence
  chemically synthesized
taaatgggttgctggtgggcat

SEQ ID NO: 30527 - DNA, 22 bp, Artificial Sequence
  chemically synthesized
ctggtgggcatgtgtttcagcc

SEQ ID NO: 30528 - DNA, 22 bp, Artificial Sequence
  chemically synthesized
gtgggcatgtgtttcagcccca

SEQ ID NO: 30529 - DNA, 22 bp, Artificial Sequence
  chemically synthesized
cagccccagatggtggctgcaa

SEQ ID NO: 30530 - DNA, 22 bp, Artificial Sequence
  chemically synthesized
agccccagatggtggctgcaag

SEQ ID NO: 30531 - DNA, 22 bp, Artificial Sequence
  chemically synthesized
caagtggggtagcattttctta

SEQ ID NO: 30532 - DNA, 22 bp, Artificial Sequence
  chemically synthesized
tcttagggagcttataaatgtg

SEQ ID NO: 30533 - DNA, 22 bp, Artificial Sequence
  chemically synthesized
cttagggagcttataaatgtgt

SEQ ID NO: 30534 - DNA, 22 bp, Artificial Sequence
  chemically synthesized
ttagggagcttataaatgtgta

SEQ ID NO: 30535 - DNA, 22 bp, Artificial Sequence
  chemically synthesized
agggagcttataaatgtgtagc

SEQ ID NO: 30536 - DNA, 22 bp, Artificial Sequence
  chemically synthesized
gggagcttataaatgtgtagca

SEQ ID NO: 30537 - DNA, 22 bp, Artificial Sequence
  chemically synthesized
ataaatgtgtagcagccctgct

SEQ ID NO: 30538 - DNA, 22 bp, Artificial Sequence
  chemically synthesized
taaatgtgtagcagccctgcta

SEQ ID NO: 30539 - DNA, 22 bp, Artificial Sequence
  chemically synthesized
ctactgggggtgggggagtcca

SEQ ID NO: 30540 - DNA, 22 bp, Artificial Sequence
  chemically synthesized
ctgggggtgggggagtccactt

SEQ ID NO: 30541 - DNA, 22 bp, Artificial Sequence
  chemically synthesized
ggggtgggggagtccacttcta

SEQ ID NO: 30542 - DNA, 22 bp, Artificial Sequence
  chemically synthesized
ctaatgacacactttatccctg

SEQ ID NO: 30543 - DNA, 22 bp, Artificial Sequence
  chemically synthesized
taatgacacactttatccctgg

SEQ ID NO: 30544 - DNA, 22 bp, Artificial Sequence
  chemically synthesized
atgacacactttatccctggtg

SEQ ID NO: 30545 - DNA, 22 bp, Artificial Sequence
  chemically synthesized
tatccctggtgacagcagccag

SEQ ID NO: 30546 - DNA, 22 bp, Artificial Sequence
  chemically synthesized
atccctggtgacagcagccagc

SEQ ID NO: 30547 - DNA, 22 bp, Artificial Sequence
  chemically synthesized
tccctggtgacagcagccagca

SEQ ID NO: 30548 - DNA, 22 bp, Artificial Sequence
  chemically synthesized
gtgacagcagccagcagtagca

SEQ ID NO: 30549 - DNA, 22 bp, Artificial Sequence
  chemically synthesized
agctgtgggtgggggatgtcag

SEQ ID NO: 30550 - DNA, 22 bp, Artificial Sequence
  chemically synthesized
tgggtgggggatgtcagcagag

SEQ ID NO: 30551 - DNA, 22 bp, Artificial Sequence
  chemically synthesized
cagggatgtagagatgcagatg

SEQ ID NO: 30552 - DNA, 22 bp, Artificial Sequence
  chemically synthesized
agggatgtagagatgcagatga

SEQ ID NO: 30553 - DNA, 22 bp, Artificial Sequence
  chemically synthesized
gggtctgaggaacgatgtcatc

SEQ ID NO: 30554 - DNA, 22 bp, Artificial Sequence
  chemically synthesized
aggaacgatgtcatctggtggg

SEQ ID NO: 30555 - DNA, 22 bp, Artificial Sequence
  chemically synthesized
gtgggtgttgggctctcaaaat

SEQ ID NO: 30556 - DNA, 22 bp, Artificial Sequence
  chemically synthesized
ggctctcaaaatggcaccttgc

SEQ ID NO: 30557 - DNA, 22 bp, Artificial Sequence
  chemically synthesized
tcaaaatggcaccttgctgctc

SEQ ID NO: 30558 - DNA, 22 bp, Artificial Sequence
  chemically synthesized
aaaatggcaccttgctgctcag

SEQ ID NO: 30559 - DNA, 22 bp, Artificial Sequence
  chemically synthesized
gctgctcagtaatggggatggc

SEQ ID NO: 30560 - DNA, 22 bp, Artificial Sequence
  chemically synthesized
ctgctcagtaatggggatggca

SEQ ID NO: 30561 - DNA, 22 bp, Artificial Sequence
  chemically synthesized
ctcagtaatggggatggcaggg

SEQ ID NO: 30562 - DNA, 22 bp, Artificial Sequence
  chemically synthesized
agtaatggggatggcaggggtg

SEQ ID NO: 30563 - DNA, 22 bp, Artificial Sequence
  chemically synthesized
cttctctggagcaatgcctttg

SEQ ID NO: 30564 - DNA, 22 bp, Artificial Sequence
  chemically synthesized
ctctggagcaatgcctttgtgc

SEQ ID NO: 30565 - DNA, 22 bp, Artificial Sequence
  chemically synthesized
tctggagcaatgcctttgtgcg

SEQ ID NO: 30566 - DNA, 22 bp, Artificial Sequence
  chemically synthesized
tggagcaatgcctttgtgcgat

SEQ ID NO: 30567 - DNA, 22 bp, Artificial Sequence
  chemically synthesized
gagcaatgcctttgtgcgattg

SEQ ID NO: 30568 - DNA, 22 bp, Artificial Sequence
  chemically synthesized
tgtgcgattgctgggcagttcc

SEQ ID NO: 30569 - DNA, 22 bp, Artificial Sequence
  chemically synthesized
gtgcgattgctgggcagttcct

SEQ ID NO: 30570 - DNA, 22 bp, Artificial Sequence
  chemically synthesized
tgcgattgctgggcagttcctt

SEQ ID NO: 30571 - DNA, 22 bp, Artificial Sequence
  chemically synthesized
ctgggcagttccttatgatagt

SEQ ID NO: 30572 - DNA, 22 bp, Artificial Sequence
  chemically synthesized
ggcagttccttatgatagtctc

SEQ ID NO: 30573 - DNA, 22 bp, Artificial Sequence
  chemically synthesized
cttatgatagtctcaaggcctg

SEQ ID NO: 30574 - DNA, 22 bp, Artificial Sequence
  chemically synthesized
atgatagtctcaaggcctgcat

SEQ ID NO: 30575 - DNA, 22 bp, Artificial Sequence
  chemically synthesized
tgatagtctcaaggcctgcatg

SEQ ID NO: 30576 - DNA, 22 bp, Artificial Sequence
  chemically synthesized
aaggcctgcatggtcaagggac

SEQ ID NO: 30577 - DNA, 22 bp, Artificial Sequence
  chemically synthesized
catggtcaagggactctcctgt

SEQ ID NO: 30578 - DNA, 22 bp, Artificial Sequence
  chemically synthesized
tcctgtggctaggattcctgga

SEQ ID NO: 30579 - DNA, 22 bp, Artificial Sequence
  chemically synthesized
ctgtggctaggattcctggagt

SEQ ID NO: 30580 - DNA, 22 bp, Artificial Sequence
  chemically synthesized
tggctaggattcctggagtcca

SEQ ID NO: 30581 - DNA, 22 bp, Artificial Sequence
  chemically synthesized
ggattcctggagtccataatgc

SEQ ID NO: 30582 - DNA, 22 bp, Artificial Sequence
  chemically synthesized
ctggagtccataatgcagatgt

SEQ ID NO: 30583 - DNA, 22 bp, Artificial Sequence
  chemically synthesized
gagtccataatgcagatgtgga

SEQ ID NO: 30584 - DNA, 22 bp, Artificial Sequence
  chemically synthesized
ggagtcagtcacttaactttcg

SEQ ID NO: 30585 - DNA, 22 bp, Artificial Sequence
  chemically synthesized
aactttcgatgcactggggagc

SEQ ID NO: 30586 - DNA, 22 bp, Artificial Sequence
  chemically synthesized
actttcgatgcactggggagcc

SEQ ID NO: 30587 - DNA, 22 bp, Artificial Sequence
  chemically synthesized
tcgatgcactggggagcctctc

SEQ ID NO: 30588 - DNA, 22 bp, Artificial Sequence
  chemically synthesized
cgatgcactggggagcctctct

SEQ ID NO: 30589 - DNA, 22 bp, Artificial Sequence
  chemically synthesized
gatgcactggggagcctctctg

SEQ ID NO: 30590 - DNA, 22 bp, Artificial Sequence
  chemically synthesized
gggagcctctctggcctcacag

SEQ ID NO: 30591 - DNA, 22 bp, Artificial Sequence
  chemically synthesized
tctggcctcacagaggatccct

SEQ ID NO: 30592 - DNA, 22 bp, Artificial Sequence
  chemically synthesized
tggcctcacagaggatccctac

SEQ ID NO: 30593 - DNA, 22 bp, Artificial Sequence
  chemically synthesized
gcctcacagaggatccctactg

SEQ ID NO: 30594 - DNA, 22 bp, Artificial Sequence
  chemically synthesized
acagaggatccctactgggtag

SEQ ID NO: 30595 - DNA, 22 bp, Artificial Sequence
  chemically synthesized
ctgggtaggcttccttgcttcc

SEQ ID NO: 30596 - DNA, 22 bp, Artificial Sequence
  chemically synthesized
ggtaggcttccttgcttccctc

SEQ ID NO: 30597 - DNA, 22 bp, Artificial Sequence
  chemically synthesized
ccttgcttccctccccttcatt

SEQ ID NO: 30598 - DNA, 22 bp, Artificial Sequence
  chemically synthesized
cttgcttccctccccttcattg

SEQ ID NO: 30599 - DNA, 22 bp, Artificial Sequence
  chemically synthesized
gcttccctccccttcattgcct

SEQ ID NO: 30600 - DNA, 22 bp, Artificial Sequence
  chemically synthesized
cttccctccccttcattgcctt

SEQ ID NO: 30601 - DNA, 22 bp, Artificial Sequence
  chemically synthesized
ccctccccttcattgccttaga

SEQ ID NO: 30602 - DNA, 22 bp, Artificial Sequence
  chemically synthesized
cctccccttcattgccttagat

SEQ ID NO: 30603 - DNA, 22 bp, Artificial Sequence
  chemically synthesized
cccttcattgccttagatgctt

SEQ ID NO: 30604 - DNA, 22 bp, Artificial Sequence
  chemically synthesized
cattgccttagatgcttcctgt

SEQ ID NO: 30605 - DNA, 22 bp, Artificial Sequence
  chemically synthesized
attgccttagatgcttcctgtc

SEQ ID NO: 30606 - DNA, 22 bp, Artificial Sequence
  chemically synthesized
ccttagatgcttcctgtcactt

SEQ ID NO: 30607 - DNA, 22 bp, Artificial Sequence
  chemically synthesized
agatgcttcctgtcacttctct

SEQ ID NO: 30608 - DNA, 22 bp, Artificial Sequence
  chemically synthesized
gatgcttcctgtcacttctctg

SEQ ID NO: 30609 - DNA, 22 bp, Artificial Sequence
  chemically synthesized
cctgtcacttctctgttgaatt

SEQ ID NO: 30610 - DNA, 22 bp, Artificial Sequence
  chemically synthesized
ctgtcacttctctgttgaattc

SEQ ID NO: 30611 - DNA, 22 bp, Artificial Sequence
  chemically synthesized
tcacttctctgttgaattccag

SEQ ID NO: 30612 - DNA, 22 bp, Artificial Sequence
  chemically synthesized
ctctgttgaattccagaattct

SEQ ID NO: 30613 - DNA, 22 bp, Artificial Sequence
  chemically synthesized
tctgttgaattccagaattctc

SEQ ID NO: 30614 - DNA, 22 bp, Artificial Sequence
  chemically synthesized
tgttgaattccagaattctctc

SEQ ID NO: 30615 - DNA, 22 bp, Artificial Sequence
  chemically synthesized
ttgaattccagaattctctctt

SEQ ID NO: 30616 - DNA, 22 bp, Artificial Sequence
  chemically synthesized
aattccagaattctctcttatg

SEQ ID NO: 30617 - DNA, 22 bp, Artificial Sequence
  chemically synthesized
cagaattctctcttatgtggga

SEQ ID NO: 30618 - DNA, 22 bp, Artificial Sequence
  chemically synthesized
tctcttatgtgggattttctac

SEQ ID NO: 30619 - DNA, 22 bp, Artificial Sequence
  chemically synthesized
tcttatgtgggattttctactt

SEQ ID NO: 30620 - DNA, 22 bp, Artificial Sequence
  chemically synthesized
ttatgtgggattttctacttac

SEQ ID NO: 30621 - DNA, 22 bp, Artificial Sequence
  chemically synthesized
atgtgggattttctacttacta

SEQ ID NO: 30622 - DNA, 22 bp, Artificial Sequence
  chemically synthesized
tgtgggattttctacttactat

SEQ ID NO: 30623 - DNA, 22 bp, Artificial Sequence
  chemically synthesized
tctacttactattttggttctt

SEQ ID NO: 30624 - DNA, 22 bp, Artificial Sequence
  chemically synthesized
ctacttactattttggttcttt

SEQ ID NO: 30625 - DNA, 22 bp, Artificial Sequence
  chemically synthesized
tacttactattttggttctttg

SEQ ID NO: 30626 - DNA, 22 bp, Artificial Sequence
  chemically synthesized
cttactattttggttctttgtg

SEQ ID NO: 30627 - DNA, 22 bp, Artificial Sequence
  chemically synthesized
actattttggttctttgtggag

SEQ ID NO: 30628 - DNA, 22 bp, Artificial Sequence
  chemically synthesized
ctattttggttctttgtggagg

SEQ ID NO: 30629 - DNA, 22 bp, Artificial Sequence
  chemically synthesized
ttttggttctttgtggaggagg

SEQ ID NO: 30630 - DNA, 22 bp, Artificial Sequence
  chemically synthesized
tggttctttgtggaggaggtga

SEQ ID NO: 30631 - DNA, 22 bp, Artificial Sequence
  chemically synthesized
ggttctttgtggaggaggtgag

SEQ ID NO: 30632 - DNA, 22 bp, Artificial Sequence
  chemically synthesized
gttctttgtggaggaggtgagt

SEQ ID NO: 30633 - DNA, 22 bp, Artificial Sequence
  chemically synthesized
tttgtggaggaggtgagtgtca

SEQ ID NO: 30634 - DNA, 22 bp, Artificial Sequence
  chemically synthesized
tgtggaggaggtgagtgtcagc

SEQ ID NO: 30635 - DNA, 22 bp, Artificial Sequence
  chemically synthesized
gtggaggaggtgagtgtcagct

SEQ ID NO: 30636 - DNA, 22 bp, Artificial Sequence
  chemically synthesized
tggaggaggtgagtgtcagctg

SEQ ID NO: 30637 - DNA, 22 bp, Artificial Sequence
  chemically synthesized
cccttagtcagtaatcttcaag

SEQ ID NO: 30638 - DNA, 22 bp, Artificial Sequence
  chemically synthesized
agtcagtaatcttcaagcccct

SEQ ID NO: 30639 - DNA, 22 bp, Artificial Sequence
  chemically synthesized
gtcagtaatcttcaagcccctt

SEQ ID NO: 30640 - DNA, 22 bp, Artificial Sequence
  chemically synthesized
caagccccttcccttgaaattt

SEQ ID NO: 30641 - DNA, 22 bp, Artificial Sequence
  chemically synthesized
aagccccttcccttgaaatttt

SEQ ID NO: 30642 - DNA, 22 bp, Artificial Sequence
  chemically synthesized
cccttgaaattttttaagcttt

SEQ ID NO: 30643 - DNA, 22 bp, Artificial Sequence
  chemically synthesized
ccttgaaattttttaagcttta

SEQ ID NO: 30644 - DNA, 22 bp, Artificial Sequence
  chemically synthesized
gaaattttttaagctttatgtt

SEQ ID NO: 30645 - DNA, 22 bp, Artificial Sequence
  chemically synthesized
aaattttttaagctttatgttt

SEQ ID NO: 30646 - DNA, 22 bp, Artificial Sequence
  chemically synthesized
tttaagctttatgtttttattt

SEQ ID NO: 30647 - DNA, 22 bp, Artificial Sequence
  chemically synthesized
ttaagctttatgtttttatttc

SEQ ID NO: 30648 - DNA, 22 bp, Artificial Sequence
  chemically synthesized
taagctttatgtttttatttct

SEQ ID NO: 30649 - DNA, 22 bp, Artificial Sequence
  chemically synthesized
aagctttatgtttttatttcta

SEQ ID NO: 30650 - DNA, 22 bp, Artificial Sequence
  chemically synthesized
agctttatgtttttatttctaa

SEQ ID NO: 30651 - DNA, 22 bp, Artificial Sequence
  chemically synthesized
tatgtttttatttctaatagac

SEQ ID NO: 30652 - DNA, 22 bp, Artificial Sequence
  chemically synthesized
atgtttttatttctaatagact

SEQ ID NO: 30653 - DNA, 22 bp, Artificial Sequence
  chemically synthesized
tgtttttatttctaatagactg

SEQ ID NO: 30654 - DNA, 22 bp, Artificial Sequence
  chemically synthesized
ttatttctaatagactgaaaga

SEQ ID NO: 30655 - DNA, 22 bp, Artificial Sequence
  chemically synthesized
tatttctaatagactgaaagag

SEQ ID NO: 30656 - DNA, 22 bp, Artificial Sequence
  chemically synthesized
atttctaatagactgaaagagc

SEQ ID NO: 30657 - DNA, 22 bp, Artificial Sequence
  chemically synthesized
tttctaatagactgaaagagca

SEQ ID NO: 30658 - DNA, 22 bp, Artificial Sequence
  chemically synthesized
ctaatagactgaaagagcataa

SEQ ID NO: 30659 - DNA, 22 bp, Artificial Sequence
  chemically synthesized
taatagactgaaagagcataat

SEQ ID NO: 30660 - DNA, 22 bp, Artificial Sequence
  chemically synthesized
atagactgaaagagcataatca

SEQ ID NO: 30661 - DNA, 22 bp, Artificial Sequence
  chemically synthesized
aaagagcataatcatattttaa

SEQ ID NO: 30662 - DNA, 22 bp, Artificial Sequence
  chemically synthesized
taaacactctaaggctatatgg

SEQ ID NO: 30663 - DNA, 22 bp, Artificial Sequence
  chemically synthesized
aaacactctaaggctatatggg

SEQ ID NO: 30664 - DNA, 22 bp, Artificial Sequence
  chemically synthesized
aacactctaaggctatatgggg

SEQ ID NO: 30665 - DNA, 22 bp, Artificial Sequence
  chemically synthesized
taaggctatatgggggactatc

SEQ ID NO: 30666 - DNA, 22 bp, Artificial Sequence
  chemically synthesized
aggctatatgggggactatctg

SEQ ID NO: 30667 - DNA, 22 bp, Artificial Sequence
  chemically synthesized
tatgggggactatctgaaggcc

SEQ ID NO: 30668 - DNA, 22 bp, Artificial Sequence
  chemically synthesized
tctgaaggcctcagatgagtaa

SEQ ID NO: 30669 - DNA, 22 bp, Artificial Sequence
  chemically synthesized
aaggcctcagatgagtaaaaga

SEQ ID NO: 30670 - DNA, 22 bp, Artificial Sequence
  chemically synthesized
agatgagtaaaagaagtagcga

SEQ ID NO: 30671 - DNA, 22 bp, Artificial Sequence
  chemically synthesized
gttaactatgtttttcttttca

SEQ ID NO: 30672 - DNA, 22 bp, Artificial Sequence
  chemically synthesized
actatgtttttcttttcatttc

SEQ ID NO: 30673 - DNA, 22 bp, Artificial Sequence
  chemically synthesized
tgtttttcttttcatttcattt

SEQ ID NO: 30674 - DNA, 22 bp, Artificial Sequence
  chemically synthesized
ttcttttcatttcatttcccaa

SEQ ID NO: 30675 - DNA, 22 bp, Artificial Sequence
  chemically synthesized
tcttttcatttcatttcccaaa

SEQ ID NO: 30676 - DNA, 22 bp, Artificial Sequence
  chemically synthesized
cttttcatttcatttcccaaat

SEQ ID NO: 30677 - DNA, 22 bp, Artificial Sequence
  chemically synthesized
ttttcatttcatttcccaaatc

SEQ ID NO: 30678 - DNA, 22 bp, Artificial Sequence
  chemically synthesized
ttcatttcatttcccaaatcaa

SEQ ID NO: 30679 - DNA, 22 bp, Artificial Sequence
  chemically synthesized
tcatttcatttcccaaatcaaa

SEQ ID NO: 30680 - DNA, 22 bp, Artificial Sequence
  chemically synthesized
catttcatttcccaaatcaaat

SEQ ID NO: 30681 - DNA, 22 bp, Artificial Sequence
  chemically synthesized
atttcatttcccaaatcaaatc

SEQ ID NO: 30682 - DNA, 22 bp, Artificial Sequence
  chemically synthesized
catttcccaaatcaaatcattt

SEQ ID NO: 30683 - DNA, 22 bp, Artificial Sequence
  chemically synthesized
atttcccaaatcaaatcatttg

SEQ ID NO: 30684 - DNA, 22 bp, Artificial Sequence
  chemically synthesized
cccaaatcaaatcatttgtttc

SEQ ID NO: 30685 - DNA, 22 bp, Artificial Sequence
  chemically synthesized
ccaaatcaaatcatttgtttct

SEQ ID NO: 30686 - DNA, 22 bp, Artificial Sequence
  chemically synthesized
gtttcttcaaataaagaatctc

SEQ ID NO: 30687 - DNA, 22 bp, Artificial Sequence
  chemically synthesized
tttcttcaaataaagaatctct

SEQ ID NO: 30688 - DNA, 22 bp, Artificial Sequence
  chemically synthesized
cttcaaataaagaatctctatt

SEQ ID NO: 30689 - DNA, 22 bp, Artificial Sequence
  chemically synthesized
ttcaaataaagaatctctattt

SEQ ID NO: 30690 - DNA, 22 bp, Artificial Sequence
  chemically synthesized
caaataaagaatctctatttcc

SEQ ID NO: 30691 - DNA, 22 bp, Artificial Sequence
  chemically synthesized
aaataaagaatctctatttccc

SEQ ID NO: 30692 - DNA, 22 bp, Artificial Sequence
  chemically synthesized
tatttcccccttatgttcttca

SEQ ID NO: 30693 - DNA, 22 bp, Artificial Sequence
  chemically synthesized
tttcccccttatgttcttcagc

SEQ ID NO: 30694 - DNA, 22 bp, Artificial Sequence
  chemically synthesized
cccccttatgttcttcagcaaa

SEQ ID NO: 30695 - DNA, 22 bp, Artificial Sequence
  chemically synthesized
ccccttatgttcttcagcaaat

SEQ ID NO: 30696 - DNA, 22 bp, Artificial Sequence
  chemically synthesized
atgttcttcagcaaataaaaat

SEQ ID NO: 30697 - DNA, 22 bp, Artificial Sequence
  chemically synthesized
tgttcttcagcaaataaaaatg

SEQ ID NO: 30698 - DNA, 22 bp, Artificial Sequence
  chemically synthesized
ttcagcaaataaaaatgtttgc

SEQ ID NO: 30699 - DNA, 22 bp, Artificial Sequence
  chemically synthesized
cagcaaataaaaatgtttgcat

SEQ ID NO: 30700 - DNA, 22 bp, Artificial Sequence
  chemically synthesized
agcaaataaaaatgtttgcatc

SEQ ID NO: 30701 - DNA, 22 bp, Artificial Sequence
  chemically synthesized
gcatctaccaaagtgtatatga

SEQ ID NO: 30702 - DNA, 22 bp, Artificial Sequence
  chemically synthesized
catctaccaaagtgtatatgaa

SEQ ID NO: 30703 - DNA, 22 bp, Artificial Sequence
  chemically synthesized
ccaaagtgtatatgaatttgaa

SEQ ID NO: 30704 - DNA, 22 bp, Artificial Sequence
  chemically synthesized
gaaatacgtaatctaacaaaca

SEQ ID NO: 30705 - DNA, 22 bp, Artificial Sequence
  chemically synthesized
aaatacgtaatctaacaaacaa

SEQ ID NO: 30706 - DNA, 22 bp, Artificial Sequence
  chemically synthesized
acaaacaaggatgttttaagat

SEQ ID NO: 30707 - DNA, 22 bp, Artificial Sequence
  chemically synthesized
taagatctctgagtaagatgca

SEQ ID NO: 30708 - DNA, 22 bp, Artificial Sequence
  chemically synthesized
aagatctctgagtaagatgcat

SEQ ID NO: 30709 - DNA, 22 bp, Artificial Sequence
  chemically synthesized
agatctctgagtaagatgcata

SEQ ID NO: 30710 - DNA, 22 bp, Artificial Sequence
  chemically synthesized
tgagtaagatgcatagttgcaa

SEQ ID NO: 30711 - DNA, 22 bp, Artificial Sequence
  chemically synthesized
agtaagatgcatagttgcaaat

SEQ ID NO: 30712 - DNA, 22 bp, Artificial Sequence
  chemically synthesized
caaataaaaggagttttcaagg

SEQ ID NO: 30713 - DNA, 22 bp, Artificial Sequence
  chemically synthesized
tcaaggataaaaaatgtaaata

SEQ ID NO: 30714 - DNA, 22 bp, Artificial Sequence
  chemically synthesized
caaggataaaaaatgtaaataa

SEQ ID NO: 30715 - DNA, 22 bp, Artificial Sequence
  chemically synthesized
aaggataaaaaatgtaaataaa

SEQ ID NO: 30716 - DNA, 22 bp, Artificial Sequence
  chemically synthesized
ataaatgtgtaccatcagaaac

SEQ ID NO: 30717 - DNA, 22 bp, Artificial Sequence
  chemically synthesized
atggtatattctcctggaaaag

SEQ ID NO: 30718 - DNA, 22 bp, Artificial Sequence
  chemically synthesized
tggtatattctcctggaaaaga

SEQ ID NO: 30719 - DNA, 22 bp, Artificial Sequence
  chemically synthesized
tcctggaaaagatgaagatgaa

SEQ ID NO: 30720 - DNA, 22 bp, Artificial Sequence
  chemically synthesized
ctggaaaagatgaagatgaaga

SEQ ID NO: 30721 - DNA, 22 bp, Artificial Sequence
  chemically synthesized
gaaaagatgaagatgaagaaaa

SEQ ID NO: 30722 - DNA, 22 bp, Artificial Sequence
  chemically synthesized
cagaagaggagaaattctttgg

SEQ ID NO: 30723 - DNA, 22 bp, Artificial Sequence
  chemically synthesized
tttggaaattttgcatttttgt

SEQ ID NO: 30724 - DNA, 22 bp, Artificial Sequence
  chemically synthesized
tggaaattttgcatttttgtgg

SEQ ID NO: 30725 - DNA, 22 bp, Artificial Sequence
  chemically synthesized
ggaaattttgcatttttgtgga

SEQ ID NO: 30726 - DNA, 22 bp, Artificial Sequence
  chemically synthesized
gaaattttgcatttttgtggat

SEQ ID NO: 30727 - DNA, 22 bp, Artificial Sequence
  chemically synthesized
tgcatttttgtggatagtggtt

SEQ ID NO: 30728 - DNA, 22 bp, Artificial Sequence
  chemically synthesized
gcatttttgtggatagtggttt

SEQ ID NO: 30729 - DNA, 22 bp, Artificial Sequence
  chemically synthesized
catttttgtggatagtggtttt

SEQ ID NO: 30730 - DNA, 22 bp, Artificial Sequence
  chemically synthesized
ttgtggatagtggttttgaaga

SEQ ID NO: 30731 - DNA, 22 bp, Artificial Sequence
  chemically synthesized
tgtggatagtggttttgaagaa

SEQ ID NO: 30732 - DNA, 22 bp, Artificial Sequence
  chemically synthesized
gtggatagtggttttgaagaaa

SEQ ID NO: 30733 - DNA, 22 bp, Artificial Sequence
  chemically synthesized
tggatagtggttttgaagaaag

SEQ ID NO: 30734 - DNA, 22 bp, Artificial Sequence
  chemically synthesized
tgaagaaagcttagatatattt

SEQ ID NO: 30735 - DNA, 22 bp, Artificial Sequence
  chemically synthesized
gaagaaagcttagatatattta

SEQ ID NO: 30736 - DNA, 22 bp, Artificial Sequence
  chemically synthesized
aagaaagcttagatatatttaa

SEQ ID NO: 30737 - DNA, 22 bp, Artificial Sequence
  chemically synthesized
agatatatttaaatatgttgct

SEQ ID NO: 30738 - DNA, 22 bp, Artificial Sequence
  chemically synthesized
gatatatttaaatatgttgcta

SEQ ID NO: 30739 - DNA, 22 bp, Artificial Sequence
  chemically synthesized
aaatatgttgctaagatgtgac

SEQ ID NO: 30740 - DNA, 22 bp, Artificial Sequence
  chemically synthesized
aatatgttgctaagatgtgact

SEQ ID NO: 30741 - DNA, 22 bp, Artificial Sequence
  chemically synthesized
ctaagatgtgactcccacactt

SEQ ID NO: 30742 - DNA, 22 bp, Artificial Sequence
  chemically synthesized
agatgtgactcccacactttaa

SEQ ID NO: 30743 - DNA, 22 bp, Artificial Sequence
  chemically synthesized
ccacactttaaagaaaagttct

SEQ ID NO: 30744 - DNA, 22 bp, Artificial Sequence
  chemically synthesized
taaagaaaagttcttcatttta

SEQ ID NO: 30745 - DNA, 22 bp, Artificial Sequence
  chemically synthesized
aaagaaaagttcttcattttag

SEQ ID NO: 30746 - DNA, 22 bp, Artificial Sequence
  chemically synthesized
aagaaaagttcttcattttagt

SEQ ID NO: 30747 - DNA, 22 bp, Artificial Sequence
  chemically synthesized
ttcattttagttgcccttgcaa

SEQ ID NO: 30748 - DNA, 22 bp, Artificial Sequence
  chemically synthesized
cattttagttgcccttgcaaat

SEQ ID NO: 30749 - DNA, 22 bp, Artificial Sequence
  chemically synthesized
attttagttgcccttgcaaatt

SEQ ID NO: 30750 - DNA, 22 bp, Artificial Sequence
  chemically synthesized
tagttgcccttgcaaattggct

SEQ ID NO: 30751 - DNA, 22 bp, Artificial Sequence
  chemically synthesized
agttgcccttgcaaattggcta

SEQ ID NO: 30752 - DNA, 22 bp, Artificial Sequence
  chemically synthesized
gttgcccttgcaaattggctaa

SEQ ID NO: 30753 - DNA, 22 bp, Artificial Sequence
  chemically synthesized
cccttgcaaattggctaagttt

SEQ ID NO: 30754 - DNA, 22 bp, Artificial Sequence
  chemically synthesized
gcaaattggctaagtttatttt

SEQ ID NO: 30755 - DNA, 22 bp, Artificial Sequence
  chemically synthesized
caaattggctaagtttattttt

SEQ ID NO: 30756 - DNA, 22 bp, Artificial Sequence
  chemically synthesized
gctaagtttatttttcctcaac

SEQ ID NO: 30757 - DNA, 22 bp, Artificial Sequence
  chemically synthesized
agtttatttttcctcaacaaat

SEQ ID NO: 30758 - DNA, 22 bp, Artificial Sequence
  chemically synthesized
atttttcctcaacaaataattt

SEQ ID NO: 30759 - DNA, 22 bp, Artificial Sequence
  chemically synthesized
tttttcctcaacaaataatttt

SEQ ID NO: 30760 - DNA, 22 bp, Artificial Sequence
  chemically synthesized
ttcctcaacaaataattttgat

SEQ ID NO: 30761 - DNA, 22 bp, Artificial Sequence
  chemically synthesized
tcctcaacaaataattttgatg

SEQ ID NO: 30762 - DNA, 22 bp, Artificial Sequence
  chemically synthesized
cctcaacaaataattttgatgg

SEQ ID NO: 30763 - DNA, 22 bp, Artificial Sequence
  chemically synthesized
ctcaacaaataattttgatggt

SEQ ID NO: 30764 - DNA, 22 bp, Artificial Sequence
  chemically synthesized
aacaaataattttgatggtttc

SEQ ID NO: 30765 - DNA, 22 bp, Artificial Sequence
  chemically synthesized
tgatggtttctaaaattgtcca

SEQ ID NO: 30766 - DNA, 22 bp, Artificial Sequence
  chemically synthesized
gatggtttctaaaattgtccag

SEQ ID NO: 30767 - DNA, 22 bp, Artificial Sequence
  chemically synthesized
atggtttctaaaattgtccaga

SEQ ID NO: 30768 - DNA, 22 bp, Artificial Sequence
  chemically synthesized
ctaaaattgtccagaatttgag

SEQ ID NO: 30769 - DNA, 22 bp, Artificial Sequence
  chemically synthesized
taaaattgtccagaatttgagg

SEQ ID NO: 30770 - DNA, 22 bp, Artificial Sequence
  chemically synthesized
aaattgtccagaatttgaggaa

SEQ ID NO: 30771 - DNA, 22 bp, Artificial Sequence
  chemically synthesized
tccagaatttgaggaaatactt

SEQ ID NO: 30772 - DNA, 22 bp, Artificial Sequence
  chemically synthesized
gaggaaatacttagatgtagta

SEQ ID NO: 30773 - DNA, 22 bp, Artificial Sequence
  chemically synthesized
aggaaatacttagatgtagtag

SEQ ID NO: 30774 - DNA, 22 bp, Artificial Sequence
  chemically synthesized
agatgtagtagatgacatcaat

SEQ ID NO: 30775 - DNA, 22 bp, Artificial Sequence
  chemically synthesized
gatgtagtagatgacatcaatt

SEQ ID NO: 30776 - DNA, 22 bp, Artificial Sequence
  chemically synthesized
atgttaacttagatttattgtt

SEQ ID NO: 30777 - DNA, 22 bp, Artificial Sequence
  chemically synthesized
tgttaacttagatttattgttg

SEQ ID NO: 30778 - DNA, 22 bp, Artificial Sequence
  chemically synthesized
acttagatttattgttggatgg

SEQ ID NO: 30779 - DNA, 22 bp, Artificial Sequence
  chemically synthesized
agatttattgttggatggttaa

SEQ ID NO: 30780 - DNA, 22 bp, Artificial Sequence
  chemically synthesized
gatttattgttggatggttaag

SEQ ID NO: 30781 - DNA, 22 bp, Artificial Sequence
  chemically synthesized
attgttggatggttaagttaat

SEQ ID NO: 30782 - DNA, 22 bp, Artificial Sequence
  chemically synthesized
ttgttggatggttaagttaatc

SEQ ID NO: 30783 - DNA, 22 bp, Artificial Sequence
  chemically synthesized
ttggatggttaagttaatcatg

SEQ ID NO: 30784 - DNA, 22 bp, Artificial Sequence
  chemically synthesized
gatggttaagttaatcatgtct

SEQ ID NO: 30785 - DNA, 22 bp, Artificial Sequence
  chemically synthesized
agttaatcatgtctgttcttgt

SEQ ID NO: 30786 - DNA, 22 bp, Artificial Sequence
  chemically synthesized
atcatgtctgttcttgtccagt

SEQ ID NO: 30787 - DNA, 22 bp, Artificial Sequence
  chemically synthesized
ttcttgtccagtctagaagttt

SEQ ID NO: 30788 - DNA, 22 bp, Artificial Sequence
  chemically synthesized
ttgtccagtctagaagtttctg

SEQ ID NO: 30789 - DNA, 22 bp, Artificial Sequence
  chemically synthesized
gtccagtctagaagtttctgct

SEQ ID NO: 30790 - DNA, 22 bp, Artificial Sequence
  chemically synthesized
tccagtctagaagtttctgctt

SEQ ID NO: 30791 - DNA, 22 bp, Artificial Sequence
  chemically synthesized
gaagtttctgcttcctcctcat

SEQ ID NO: 30792 - DNA, 22 bp, Artificial Sequence
  chemically synthesized
ctgcttcctcctcatgtgttct

SEQ ID NO: 30793 - DNA, 22 bp, Artificial Sequence
  chemically synthesized
tgcttcctcctcatgtgttcta

SEQ ID NO: 30794 - DNA, 22 bp, Artificial Sequence
  chemically synthesized
cttcctcctcatgtgttctatt

SEQ ID NO: 30795 - DNA, 22 bp, Artificial Sequence
  chemically synthesized
cctcctcatgtgttctattctg

SEQ ID NO: 30796 - DNA, 22 bp, Artificial Sequence
  chemically synthesized
ctcctcatgtgttctattctgt

SEQ ID NO: 30797 - DNA, 22 bp, Artificial Sequence
  chemically synthesized
ctcatgtgttctattctgtcct

SEQ ID NO: 30798 - DNA, 22 bp, Artificial Sequence
  chemically synthesized
atgtgttctattctgtcctcat

SEQ ID NO: 30799 - DNA, 22 bp, Artificial Sequence
  chemically synthesized
tattctgtcctcatcacataac

SEQ ID NO: 30800 - DNA, 22 bp, Artificial Sequence
  chemically synthesized
ttctgtcctcatcacataacat

SEQ ID NO: 30801 - DNA, 22 bp, Artificial Sequence
  chemically synthesized
tgtcctcatcacataacatctg

SEQ ID NO: 30802 - DNA, 22 bp, Artificial Sequence
  chemically synthesized
tcctcatcacataacatctgaa

SEQ ID NO: 30803 - DNA, 22 bp, Artificial Sequence
  chemically synthesized
atcacataacatctgaactgtg

SEQ ID NO: 30804 - DNA, 22 bp, Artificial Sequence
  chemically synthesized
aactgtgatttgacagtgtcct

SEQ ID NO: 30805 - DNA, 22 bp, Artificial Sequence
  chemically synthesized
tgatttgacagtgtccttatta

SEQ ID NO: 30806 - DNA, 22 bp, Artificial Sequence
  chemically synthesized
gacagtgtccttattatcagac

SEQ ID NO: 30807 - DNA, 22 bp, Artificial Sequence
  chemically synthesized
acagtgtccttattatcagact

SEQ ID NO: 30808 - DNA, 22 bp, Artificial Sequence
  chemically synthesized
attatcagactctgctcaatga

SEQ ID NO: 30809 - DNA, 22 bp, Artificial Sequence
  chemically synthesized
ttatcagactctgctcaatgac

SEQ ID NO: 30810 - DNA, 22 bp, Artificial Sequence
  chemically synthesized
tcagactctgctcaatgacagt

SEQ ID NO: 30811 - DNA, 22 bp, Artificial Sequence
  chemically synthesized
tgctcaatgacagtttaaactt

SEQ ID NO: 30812 - DNA, 22 bp, Artificial Sequence
  chemically synthesized
ctcaatgacagtttaaacttct

SEQ ID NO: 30813 - DNA, 22 bp, Artificial Sequence
  chemically synthesized
aatgacagtttaaacttctttt

SEQ ID NO: 30814 - DNA, 22 bp, Artificial Sequence
  chemically synthesized
aaacttctttttgatacagtaa

SEQ ID NO: 30815 - DNA, 22 bp, Artificial Sequence
  chemically synthesized
aacttctttttgatacagtaaa

SEQ ID NO: 30816 - DNA, 22 bp, Artificial Sequence
  chemically synthesized
ctttttgatacagtaaaaaact

SEQ ID NO: 30817 - DNA, 22 bp, Artificial Sequence
  chemically synthesized
tttttgatacagtaaaaaactt

SEQ ID NO: 30818 - DNA, 22 bp, Artificial Sequence
  chemically synthesized
tttgatacagtaaaaaactttt

SEQ ID NO: 30819 - DNA, 22 bp, Artificial Sequence
  chemically synthesized
ttgatacagtaaaaaacttttc

SEQ ID NO: 30820 - DNA, 22 bp, Artificial Sequence
  chemically synthesized
tgatacagtaaaaaacttttcc

SEQ ID NO: 30821 - DNA, 22 bp, Artificial Sequence
  chemically synthesized
gatacagtaaaaaacttttcct

SEQ ID NO: 30822 - DNA, 22 bp, Artificial Sequence
  chemically synthesized
atacagtaaaaaacttttcctt

SEQ ID NO: 30823 - DNA, 22 bp, Artificial Sequence
  chemically synthesized
ttccttaaagatgaaattctta

SEQ ID NO: 30824 - DNA, 22 bp, Artificial Sequence
  chemically synthesized
tccttaaagatgaaattcttaa

SEQ ID NO: 30825 - DNA, 22 bp, Artificial Sequence
  chemically synthesized
ccttaaagatgaaattcttaag

SEQ ID NO: 30826 - DNA, 22 bp, Artificial Sequence
  chemically synthesized
cttaaagatgaaattcttaagg

SEQ ID NO: 30827 - DNA, 22 bp, Artificial Sequence
  chemically synthesized
aaagatgaaattcttaaggaca

SEQ ID NO: 30828 - DNA, 22 bp, Artificial Sequence
  chemically synthesized
aagatgaaattcttaaggacaa

SEQ ID NO: 30829 - DNA, 22 bp, Artificial Sequence
  chemically synthesized
ttaaggacaattagcttgtgta

SEQ ID NO: 30830 - DNA, 22 bp, Artificial Sequence
  chemically synthesized
aaggacaattagcttgtgtaga

SEQ ID NO: 30831 - DNA, 22 bp, Artificial Sequence
  chemically synthesized
aggacaattagcttgtgtagac

SEQ ID NO: 30832 - DNA, 22 bp, Artificial Sequence
  chemically synthesized
gcttgtgtagactcatatgaaa

SEQ ID NO: 30833 - DNA, 22 bp, Artificial Sequence
  chemically synthesized
gtgtagactcatatgaaaattg

SEQ ID NO: 30834 - DNA, 22 bp, Artificial Sequence
  chemically synthesized
tgtagactcatatgaaaattgc

SEQ ID NO: 30835 - DNA, 22 bp, Artificial Sequence
  chemically synthesized
atatgaaaattgcttgcatttt

SEQ ID NO: 30836 - DNA, 22 bp, Artificial Sequence
  chemically synthesized
cttgcattttggagttacatta

SEQ ID NO: 30837 - DNA, 22 bp, Artificial Sequence
  chemically synthesized
gcattttggagttacattagct

SEQ ID NO: 30838 - DNA, 22 bp, Artificial Sequence
  chemically synthesized
cattttggagttacattagctc

SEQ ID NO: 30839 - DNA, 22 bp, Artificial Sequence
  chemically synthesized
tggagttacattagctcttctc

SEQ ID NO: 30840 - DNA, 22 bp, Artificial Sequence
  chemically synthesized
ggagttacattagctcttctcc

SEQ ID NO: 30841 - DNA, 22 bp, Artificial Sequence
  chemically synthesized
gagttacattagctcttctcct

SEQ ID NO: 30842 - DNA, 22 bp, Artificial Sequence
  chemically synthesized
cattagctcttctcctttataa

SEQ ID NO: 30843 - DNA, 22 bp, Artificial Sequence
  chemically synthesized
gctcttctcctttataaattaa

SEQ ID NO: 30844 - DNA, 22 bp, Artificial Sequence
  chemically synthesized
ttctcctttataaattaatgaa

SEQ ID NO: 30845 - DNA, 22 bp, Artificial Sequence
  chemically synthesized
ctcctttataaattaatgaatc

SEQ ID NO: 30846 - DNA, 22 bp, Artificial Sequence
  chemically synthesized
tcctttataaattaatgaatcc

SEQ ID NO: 30847 - DNA, 22 bp, Artificial Sequence
  chemically synthesized
ctttataaattaatgaatccta

SEQ ID NO: 30848 - DNA, 22 bp, Artificial Sequence
  chemically synthesized
tataaattaatgaatcctattg

SEQ ID NO: 30849 - DNA, 22 bp, Artificial Sequence
  chemically synthesized
ataaattaatgaatcctattgg

SEQ ID NO: 30850 - DNA, 22 bp, Artificial Sequence
  chemically synthesized
taaattaatgaatcctattggt

SEQ ID NO: 30851 - DNA, 22 bp, Artificial Sequence
  chemically synthesized
atgaatcctattggtaccatat

SEQ ID NO: 30852 - DNA, 22 bp, Artificial Sequence
  chemically synthesized
ttggtaccatataatagcatca

SEQ ID NO: 30853 - DNA, 22 bp, Artificial Sequence
  chemically synthesized
gtaccatataatagcatcaaca

SEQ ID NO: 30854 - DNA, 22 bp, Artificial Sequence
  chemically synthesized
gccttttgtgtctcgcctttca

SEQ ID NO: 30855 - DNA, 22 bp, Artificial Sequence
  chemically synthesized
ccttttgtgtctcgcctttcaa

SEQ ID NO: 30856 - DNA, 22 bp, Artificial Sequence
  chemically synthesized
ttgtgtctcgcctttcaaaggg

SEQ ID NO: 30857 - DNA, 22 bp, Artificial Sequence
  chemically synthesized
tgtgtctcgcctttcaaagggc

SEQ ID NO: 30858 - DNA, 22 bp, Artificial Sequence
  chemically synthesized
gtgtctcgcctttcaaagggca

SEQ ID NO: 30859 - DNA, 22 bp, Artificial Sequence
  chemically synthesized
tgtctcgcctttcaaagggcaa

SEQ ID NO: 30860 - DNA, 22 bp, Artificial Sequence
  chemically synthesized
gcctttcaaagggcaattttcc

SEQ ID NO: 30861 - DNA, 22 bp, Artificial Sequence
  chemically synthesized
tcaaagggcaattttccaaaaa

SEQ ID NO: 30862 - DNA, 22 bp, Artificial Sequence
  chemically synthesized
caaagggcaattttccaaaaag

SEQ ID NO: 30863 - DNA, 22 bp, Artificial Sequence
  chemically synthesized
aaagggcaattttccaaaaagt

SEQ ID NO: 30864 - DNA, 22 bp, Artificial Sequence
  chemically synthesized
tccaaaaagtatattttgcatg

SEQ ID NO: 30865 - DNA, 22 bp, Artificial Sequence
  chemically synthesized
ccaaaaagtatattttgcatgg

SEQ ID NO: 30866 - DNA, 22 bp, Artificial Sequence
  chemically synthesized
caaaaagtatattttgcatggc

SEQ ID NO: 30867 - DNA, 22 bp, Artificial Sequence
  chemically synthesized
tgcatggctcaggctaaaagta

SEQ ID NO: 30868 - DNA, 22 bp, Artificial Sequence
  chemically synthesized
gcatggctcaggctaaaagtaa

SEQ ID NO: 30869 - DNA, 22 bp, Artificial Sequence
  chemically synthesized
catggctcaggctaaaagtaat

SEQ ID NO: 30870 - DNA, 22 bp, Artificial Sequence
  chemically synthesized
aggctaaaagtaatgtctccag

SEQ ID NO: 30871 - DNA, 22 bp, Artificial Sequence
  chemically synthesized
aaagtaatgtctccagatgaag

SEQ ID NO: 30872 - DNA, 22 bp, Artificial Sequence
  chemically synthesized
cagatgaagttctactttgtga

SEQ ID NO: 30873 - DNA, 22 bp, Artificial Sequence
  chemically synthesized
tactttgtgaccattgattgtg

SEQ ID NO: 30874 - DNA, 22 bp, Artificial Sequence
  chemically synthesized
ctttgtgaccattgattgtgac

SEQ ID NO: 30875 - DNA, 22 bp, Artificial Sequence
  chemically synthesized
tgtgaccattgattgtgactat

SEQ ID NO: 30876 - DNA, 22 bp, Artificial Sequence
  chemically synthesized
gtgaccattgattgtgactatt

SEQ ID NO: 30877 - DNA, 22 bp, Artificial Sequence
  chemically synthesized
tgaccattgattgtgactattg

SEQ ID NO: 30878 - DNA, 22 bp, Artificial Sequence
  chemically synthesized
attgtgactattgataagattt

SEQ ID NO: 30879 - DNA, 22 bp, Artificial Sequence
  chemically synthesized
tgactattgataagatttacta

SEQ ID NO: 30880 - DNA, 22 bp, Artificial Sequence
  chemically synthesized
ttgataagatttactatgtaaa

SEQ ID NO: 30881 - DNA, 22 bp, Artificial Sequence
  chemically synthesized
ataagatttactatgtaaagta

SEQ ID NO: 30882 - DNA, 22 bp, Artificial Sequence
  chemically synthesized
actatgtaaagtataagttact

SEQ ID NO: 30883 - DNA, 22 bp, Artificial Sequence
  chemically synthesized
ctatgtaaagtataagttactg

SEQ ID NO: 30884 - DNA, 22 bp, Artificial Sequence
  chemically synthesized
tgtaaagtataagttactggaa

SEQ ID NO: 30885 - DNA, 22 bp, Artificial Sequence
  chemically synthesized
ctggaataatacatttaagaaa

SEQ ID NO: 30886 - DNA, 22 bp, Artificial Sequence
  chemically synthesized
gaataatacatttaagaaatat

SEQ ID NO: 30887 - DNA, 22 bp, Artificial Sequence
  chemically synthesized
aagaaatatagtagctattaaa

SEQ ID NO: 30888 - DNA, 22 bp, Artificial Sequence
  chemically synthesized
agaaatatagtagctattaaaa

SEQ ID NO: 30889 - DNA, 22 bp, Artificial Sequence
  chemically synthesized
ttaaaacctgtagtctgatgaa

SEQ ID NO: 30890 - DNA, 22 bp, Artificial Sequence
  chemically synthesized
aaacctgtagtctgatgaaatg

SEQ ID NO: 30891 - DNA, 22 bp, Artificial Sequence
  chemically synthesized
tagtctgatgaaatggaatatg

SEQ ID NO: 30892 - DNA, 22 bp, Artificial Sequence
  chemically synthesized
atgaaatggaatatgttttgaa

SEQ ID NO: 30893 - DNA, 22 bp, Artificial Sequence
  chemically synthesized
tgaaagacagcagtgaaaaatg

SEQ ID NO: 30894 - DNA, 22 bp, Artificial Sequence
  chemically synthesized
gaaagacagcagtgaaaaatga

SEQ ID NO: 30895 - DNA, 22 bp, Artificial Sequence
  chemically synthesized
aaagacagcagtgaaaaatgag

SEQ ID NO: 30896 - DNA, 22 bp, Artificial Sequence
  chemically synthesized
ctttttgcaattgagttgaaga

SEQ ID NO: 30897 - DNA, 22 bp, Artificial Sequence
  chemically synthesized
tttgcaattgagttgaagattg

SEQ ID NO: 30898 - DNA, 22 bp, Artificial Sequence
  chemically synthesized
ttgcaattgagttgaagattga

SEQ ID NO: 30899 - DNA, 22 bp, Artificial Sequence
  chemically synthesized
tgcaattgagttgaagattgat

SEQ ID NO: 30900 - DNA, 22 bp, Artificial Sequence
  chemically synthesized
gcaattgagttgaagattgatg

SEQ ID NO: 30901 - DNA, 22 bp, Artificial Sequence
  chemically synthesized
caattgagttgaagattgatgc

SEQ ID NO: 30902 - DNA, 22 bp, Artificial Sequence
  chemically synthesized
agttgaagattgatgccaggat

SEQ ID NO: 30903 - DNA, 22 bp, Artificial Sequence
  chemically synthesized
aagattgatgccaggatcttat

SEQ ID NO: 30904 - DNA, 22 bp, Artificial Sequence
  chemically synthesized
atgccaggatcttattacctcc

SEQ ID NO: 30905 - DNA, 22 bp, Artificial Sequence
  chemically synthesized
attacctccaggatttcacaaa

SEQ ID NO: 30906 - DNA, 22 bp, Artificial Sequence
  chemically synthesized
ttacctccaggatttcacaaag

SEQ ID NO: 30907 - DNA, 22 bp, Artificial Sequence
  chemically synthesized
cctccaggatttcacaaaggat

SEQ ID NO: 30908 - DNA, 22 bp, Artificial Sequence
  chemically synthesized
caggatttcacaaaggatttct

SEQ ID NO: 30909 - DNA, 22 bp, Artificial Sequence
  chemically synthesized
cacaaaggatttcttgagtcat

SEQ ID NO: 30910 - DNA, 22 bp, Artificial Sequence
  chemically synthesized
acaaaggatttcttgagtcatc

SEQ ID NO: 30911 - DNA, 22 bp, Artificial Sequence
  chemically synthesized
cttgagtcatccccttgctcta

SEQ ID NO: 30912 - DNA, 22 bp, Artificial Sequence
  chemically synthesized
ttgagtcatccccttgctctag

SEQ ID NO: 30913 - DNA, 22 bp, Artificial Sequence
  chemically synthesized
gagtcatccccttgctctagct

SEQ ID NO: 30914 - DNA, 22 bp, Artificial Sequence
  chemically synthesized
agtcatccccttgctctagctc

SEQ ID NO: 30915 - DNA, 22 bp, Artificial Sequence
  chemically synthesized
gctctagctcatgaacaaagta

SEQ ID NO: 30916 - DNA, 22 bp, Artificial Sequence
  chemically synthesized
ctctagctcatgaacaaagtat

SEQ ID NO: 30917 - DNA, 22 bp, Artificial Sequence
  chemically synthesized
tagctcatgaacaaagtattgc

SEQ ID NO: 30918 - DNA, 22 bp, Artificial Sequence
  chemically synthesized
gctcatgaacaaagtattgctc

SEQ ID NO: 30919 - DNA, 22 bp, Artificial Sequence
  chemically synthesized
atgaacaaagtattgctcaagt

SEQ ID NO: 30920 - DNA, 22 bp, Artificial Sequence
  chemically synthesized
ctcaagtaatcgacagattatt

SEQ ID NO: 30921 - DNA, 22 bp, Artificial Sequence
  chemically synthesized
aagtaatcgacagattatttgt

SEQ ID NO: 30922 - DNA, 22 bp, Artificial Sequence
  chemically synthesized
tttgtgtattctcacatgtgat

SEQ ID NO: 30923 - DNA, 22 bp, Artificial Sequence
  chemically synthesized
gtgtattctcacatgtgattat

SEQ ID NO: 30924 - DNA, 22 bp, Artificial Sequence
  chemically synthesized
tgtattctcacatgtgattatt

SEQ ID NO: 30925 - DNA, 22 bp, Artificial Sequence
  chemically synthesized
tcacatgtgattattatttagt

SEQ ID NO: 30926 - DNA, 22 bp, Artificial Sequence
  chemically synthesized
acatgtgattattatttagtgc

SEQ ID NO: 30927 - DNA, 22 bp, Artificial Sequence
  chemically synthesized
ttatttagtgctgtcacgggaa

SEQ ID NO: 30928 - DNA, 22 bp, Artificial Sequence
  chemically synthesized
tttagtgctgtcacgggaaata

SEQ ID NO: 30929 - DNA, 22 bp, Artificial Sequence
  chemically synthesized
agtgctgtcacgggaaatatcc

SEQ ID NO: 30930 - DNA, 22 bp, Artificial Sequence
  chemically synthesized
gtgctgtcacgggaaatatcct

SEQ ID NO: 30931 - DNA, 22 bp, Artificial Sequence
  chemically synthesized
tcacgggaaatatcctgcctaa

SEQ ID NO: 30932 - DNA, 22 bp, Artificial Sequence
  chemically synthesized
cctaagtttactggaggtcttc

SEQ ID NO: 30933 - DNA, 22 bp, Artificial Sequence
  chemically synthesized
agtttactggaggtcttcctcc

SEQ ID NO: 30934 - DNA, 22 bp, Artificial Sequence
  chemically synthesized
actggaggtcttcctcccctta

SEQ ID NO: 30935 - DNA, 22 bp, Artificial Sequence
  chemically synthesized
ctggaggtcttcctccccttac

SEQ ID NO: 30936 - DNA, 22 bp, Artificial Sequence
  chemically synthesized
gaggtcttcctccccttacccc

SEQ ID NO: 30937 - DNA, 22 bp, Artificial Sequence
  chemically synthesized
cctccccttacccctccctatg

SEQ ID NO: 30938 - DNA, 22 bp, Artificial Sequence
  chemically synthesized
ctccccttacccctccctatgt

SEQ ID NO: 30939 - DNA, 22 bp, Artificial Sequence
  chemically synthesized
cccttacccctccctatgtcct

SEQ ID NO: 30940 - DNA, 22 bp, Artificial Sequence
  chemically synthesized
acccctccctatgtcctcctac

SEQ ID NO: 30941 - DNA, 22 bp, Artificial Sequence
  chemically synthesized
cccctccctatgtcctcctacc

SEQ ID NO: 30942 - DNA, 22 bp, Artificial Sequence
  chemically synthesized
cctatgtcctcctacctggtta

SEQ ID NO: 30943 - DNA, 22 bp, Artificial Sequence
  chemically synthesized
tgtcctcctacctggttatcct

SEQ ID NO: 30944 - DNA, 22 bp, Artificial Sequence
  chemically synthesized
ctacctggttatccttttcaat

SEQ ID NO: 30945 - DNA, 22 bp, Artificial Sequence
  chemically synthesized
cctggttatccttttcaatcct

SEQ ID NO: 30946 - DNA, 22 bp, Artificial Sequence
  chemically synthesized
gttatccttttcaatcctatta

SEQ ID NO: 30947 - DNA, 22 bp, Artificial Sequence
  chemically synthesized
tccttttcaatcctattactct

SEQ ID NO: 30948 - DNA, 22 bp, Artificial Sequence
  chemically synthesized
ttcaatcctattactctttcct

SEQ ID NO: 30949 - DNA, 22 bp, Artificial Sequence
  chemically synthesized
tcaatcctattactctttcctt

SEQ ID NO: 30950 - DNA, 22 bp, Artificial Sequence
  chemically synthesized
caatcctattactctttccttg

SEQ ID NO: 30951 - DNA, 22 bp, Artificial Sequence
  chemically synthesized
aatcctattactctttccttgc

SEQ ID NO: 30952 - DNA, 22 bp, Artificial Sequence
  chemically synthesized
ttactctttccttgcacactct

SEQ ID NO: 30953 - DNA, 22 bp, Artificial Sequence
  chemically synthesized
ctctttccttgcacactctact

SEQ ID NO: 30954 - DNA, 22 bp, Artificial Sequence
  chemically synthesized
tttccttgcacactctactcca

SEQ ID NO: 30955 - DNA, 22 bp, Artificial Sequence
  chemically synthesized
tccttgcacactctactccagc

SEQ ID NO: 30956 - DNA, 22 bp, Artificial Sequence
  chemically synthesized
ccttgcacactctactccagct

SEQ ID NO: 30957 - DNA, 22 bp, Artificial Sequence
  chemically synthesized
cttgcacactctactccagctt

SEQ ID NO: 30958 - DNA, 22 bp, Artificial Sequence
  chemically synthesized
gcacactctactccagcttagg

SEQ ID NO: 30959 - DNA, 22 bp, Artificial Sequence
  chemically synthesized
cacactctactccagcttaggg

SEQ ID NO: 30960 - DNA, 22 bp, Artificial Sequence
  chemically synthesized
tactccagcttagggcctgggc

SEQ ID NO: 30961 - DNA, 22 bp, Artificial Sequence
  chemically synthesized
ctccagcttagggcctgggctc

SEQ ID NO: 30962 - DNA, 22 bp, Artificial Sequence
  chemically synthesized
cagcttagggcctgggctctga

SEQ ID NO: 30963 - DNA, 22 bp, Artificial Sequence
  chemically synthesized
agggcctgggctctgaccatta

SEQ ID NO: 30964 - DNA, 22 bp, Artificial Sequence
  chemically synthesized
gggcctgggctctgaccattac

SEQ ID NO: 30965 - DNA, 22 bp, Artificial Sequence
  chemically synthesized
ggctctgaccattacctctgcc

SEQ ID NO: 30966 - DNA, 22 bp, Artificial Sequence
  chemically synthesized
tgaccattacctctgcctaaaa

SEQ ID NO: 30967 - DNA, 22 bp, Artificial Sequence
  chemically synthesized
accattacctctgcctaaaaat

SEQ ID NO: 30968 - DNA, 22 bp, Artificial Sequence
  chemically synthesized
cctctgcctaaaaattcctcct

SEQ ID NO: 30969 - DNA, 22 bp, Artificial Sequence
  chemically synthesized
tgcctaaaaattcctcctcatg

SEQ ID NO: 30970 - DNA, 22 bp, Artificial Sequence
  chemically synthesized
cctaaaaattcctcctcatgac

SEQ ID NO: 30971 - DNA, 22 bp, Artificial Sequence
  chemically synthesized
aaaattcctcctcatgacatcc

SEQ ID NO: 30972 - DNA, 22 bp, Artificial Sequence
  chemically synthesized
ctcctcatgacatccatttgcc

SEQ ID NO: 30973 - DNA, 22 bp, Artificial Sequence
  chemically synthesized
ctcatgacatccatttgcccaa

SEQ ID NO: 30974 - DNA, 22 bp, Artificial Sequence
  chemically synthesized
atgacatccatttgcccaattt

SEQ ID NO: 30975 - DNA, 22 bp, Artificial Sequence
  chemically synthesized
gcccaatttcttcaccctttta

SEQ ID NO: 30976 - DNA, 22 bp, Artificial Sequence
  chemically synthesized
cccaatttcttcacccttttaa

SEQ ID NO: 30977 - DNA, 22 bp, Artificial Sequence
  chemically synthesized
cttcacccttttaattacccca

SEQ ID NO: 30978 - DNA, 22 bp, Artificial Sequence
  chemically synthesized
ttcacccttttaattaccccat

SEQ ID NO: 30979 - DNA, 22 bp, Artificial Sequence
  chemically synthesized
cacccttttaattaccccatta

SEQ ID NO: 30980 - DNA, 22 bp, Artificial Sequence
  chemically synthesized
acccttttaattaccccattaa

SEQ ID NO: 30981 - DNA, 22 bp, Artificial Sequence
  chemically synthesized
ttaattaccccattaagtgata

SEQ ID NO: 30982 - DNA, 22 bp, Artificial Sequence
  chemically synthesized
taattaccccattaagtgatat

SEQ ID NO: 30983 - DNA, 22 bp, Artificial Sequence
  chemically synthesized
aattaccccattaagtgatatt

SEQ ID NO: 30984 - DNA, 22 bp, Artificial Sequence
  chemically synthesized
attaccccattaagtgatattt

SEQ ID NO: 30985 - DNA, 22 bp, Artificial Sequence
  chemically synthesized
ccccattaagtgatattttgct

SEQ ID NO: 30986 - DNA, 22 bp, Artificial Sequence
  chemically synthesized
agtgatattttgcttgctcaat

SEQ ID NO: 30987 - DNA, 22 bp, Artificial Sequence
  chemically synthesized
tgcttgctcaatttttgccttt

SEQ ID NO: 30988 - DNA, 22 bp, Artificial Sequence
  chemically synthesized
gcttgctcaatttttgcctttt

SEQ ID NO: 30989 - DNA, 22 bp, Artificial Sequence
  chemically synthesized
cttgctcaatttttgccttttc

SEQ ID NO: 30990 - DNA, 22 bp, Artificial Sequence
  chemically synthesized
gctcaatttttgccttttcaat

SEQ ID NO: 30991 - DNA, 22 bp, Artificial Sequence
  chemically synthesized
ctcaatttttgccttttcaatc

SEQ ID NO: 30992 - DNA, 22 bp, Artificial Sequence
  chemically synthesized
aatttttgccttttcaatcaga

SEQ ID NO: 30993 - DNA, 22 bp, Artificial Sequence
  chemically synthesized
ttgccttttcaatcagatctaa

SEQ ID NO: 30994 - DNA, 22 bp, Artificial Sequence
  chemically synthesized
tgccttttcaatcagatctaat

SEQ ID NO: 30995 - DNA, 22 bp, Artificial Sequence
  chemically synthesized
gccttttcaatcagatctaatt

SEQ ID NO: 30996 - DNA, 22 bp, Artificial Sequence
  chemically synthesized
ccttttcaatcagatctaattt

SEQ ID NO: 30997 - DNA, 22 bp, Artificial Sequence
  chemically synthesized
ttcaatcagatctaatttattt

SEQ ID NO: 30998 - DNA, 22 bp, Artificial Sequence
  chemically synthesized
tcaatcagatctaatttatttt

SEQ ID NO: 30999 - DNA, 22 bp, Artificial Sequence
  chemically synthesized
caatcagatctaatttatttta

SEQ ID NO: 31000 - DNA, 22 bp, Artificial Sequence
  chemically synthesized
aatcagatctaatttattttat

SEQ ID NO: 31001 - DNA, 22 bp, Artificial Sequence
  chemically synthesized
atttattttatatttttaaaat

SEQ ID NO: 31002 - DNA, 22 bp, Artificial Sequence
  chemically synthesized
attttatatttttaaaatttat

SEQ ID NO: 31003 - DNA, 22 bp, Artificial Sequence
  chemically synthesized
ttttatatttttaaaatttatt

SEQ ID NO: 31004 - DNA, 22 bp, Artificial Sequence
  chemically synthesized
tatatttttaaaatttatttat

SEQ ID NO: 31005 - DNA, 22 bp, Artificial Sequence
  chemically synthesized
atatttttaaaatttatttata

SEQ ID NO: 31006 - DNA, 22 bp, Artificial Sequence
  chemically synthesized
tatttttaaaatttatttatat

SEQ ID NO: 31007 - DNA, 22 bp, Artificial Sequence
  chemically synthesized
ttaaaatttatttatatatatt

SEQ ID NO: 31008 - DNA, 22 bp, Artificial Sequence
  chemically synthesized
taaaatttatttatatatattt

SEQ ID NO: 31009 - DNA, 22 bp, Artificial Sequence
  chemically synthesized
aaaatttatttatatatattta

SEQ ID NO: 31010 - DNA, 22 bp, Artificial Sequence
  chemically synthesized
aaatttatttatatatatttag

SEQ ID NO: 31011 - DNA, 22 bp, Artificial Sequence
  chemically synthesized
atttatatatatttagaaggta

SEQ ID NO: 31012 - DNA, 22 bp, Artificial Sequence
  chemically synthesized
tttatatatatttagaaggtat

SEQ ID NO: 31013 - DNA, 22 bp, Artificial Sequence
  chemically synthesized
atatatatttagaaggtatgta

SEQ ID NO: 31014 - DNA, 22 bp, Artificial Sequence
  chemically synthesized
tatatatttagaaggtatgtac

SEQ ID NO: 31015 - DNA, 22 bp, Artificial Sequence
  chemically synthesized
agaaggtatgtactagttcgtt

SEQ ID NO: 31016 - DNA, 22 bp, Artificial Sequence
  chemically synthesized
gaaggtatgtactagttcgtta

SEQ ID NO: 31017 - DNA, 22 bp, Artificial Sequence
  chemically synthesized
gttcgttatcatgctgcttata

SEQ ID NO: 31018 - DNA, 22 bp, Artificial Sequence
  chemically synthesized
gttatcatgctgcttataaaga

SEQ ID NO: 31019 - DNA, 22 bp, Artificial Sequence
  chemically synthesized
tcatgctgcttataaagacata

SEQ ID NO: 31020 - DNA, 22 bp, Artificial Sequence
  chemically synthesized
cttataaagacatacctgagac

SEQ ID NO: 31021 - DNA, 22 bp, Artificial Sequence
  chemically synthesized
ataaagacatacctgagactgg

SEQ ID NO: 31022 - DNA, 22 bp, Artificial Sequence
  chemically synthesized
taaagacatacctgagactggg

SEQ ID NO: 31023 - DNA, 22 bp, Artificial Sequence
  chemically synthesized
agactgggtaatttataaggaa

SEQ ID NO: 31024 - DNA, 22 bp, Artificial Sequence
  chemically synthesized
ggtaatttataaggaaaaaacg

SEQ ID NO: 31025 - DNA, 22 bp, Artificial Sequence
  chemically synthesized
ataaggaaaaaacgtttaattg

SEQ ID NO: 31026 - DNA, 22 bp, Artificial Sequence
  chemically synthesized
taaggaaaaaacgtttaattgt

SEQ ID NO: 31027 - DNA, 22 bp, Artificial Sequence
  chemically synthesized
aattgtctcacagttccacagg

SEQ ID NO: 31028 - DNA, 22 bp, Artificial Sequence
  chemically synthesized
attgtctcacagttccacaggg

SEQ ID NO: 31029 - DNA, 22 bp, Artificial Sequence
  chemically synthesized
tctcacagttccacagggctgg

SEQ ID NO: 31030 - DNA, 22 bp, Artificial Sequence
  chemically synthesized
acagttccacagggctggggag

SEQ ID NO: 31031 - DNA, 22 bp, Artificial Sequence
  chemically synthesized
cacagggctggggaggcctcgg

SEQ ID NO: 31032 - DNA, 22 bp, Artificial Sequence
  chemically synthesized
gggaggcctcgggaaacttaca

SEQ ID NO: 31033 - DNA, 22 bp, Artificial Sequence
  chemically synthesized
gggaaacttacaatcatggcag

SEQ ID NO: 31034 - DNA, 22 bp, Artificial Sequence
  chemically synthesized
acaatcatggcagaagaagaaa

SEQ ID NO: 31035 - DNA, 22 bp, Artificial Sequence
  chemically synthesized
caatcatggcagaagaagaaac

SEQ ID NO: 31036 - DNA, 22 bp, Artificial Sequence
  chemically synthesized
cttcacatggcagcagcaagta

SEQ ID NO: 31037 - DNA, 22 bp, Artificial Sequence
  chemically synthesized
ttcacatggcagcagcaagtag

SEQ ID NO: 31038 - DNA, 22 bp, Artificial Sequence
  chemically synthesized
cacatggcagcagcaagtagaa

SEQ ID NO: 31039 - DNA, 22 bp, Artificial Sequence
  chemically synthesized
acatggcagcagcaagtagaag

SEQ ID NO: 31040 - DNA, 22 bp, Artificial Sequence
  chemically synthesized
ataaaaccatcagatcttgtaa

SEQ ID NO: 31041 - DNA, 22 bp, Artificial Sequence
  chemically synthesized
taaaaccatcagatcttgtaag

SEQ ID NO: 31042 - DNA, 22 bp, Artificial Sequence
  chemically synthesized
gtaagaactcactatcacgaga

SEQ ID NO: 31043 - DNA, 22 bp, Artificial Sequence
  chemically synthesized
taagaactcactatcacgagaa

SEQ ID NO: 31044 - DNA, 22 bp, Artificial Sequence
  chemically synthesized
actatcacgagaagagcatgag

SEQ ID NO: 31045 - DNA, 22 bp, Artificial Sequence
  chemically synthesized
tcacgagaagagcatgagagta

SEQ ID NO: 31046 - DNA, 22 bp, Artificial Sequence
  chemically synthesized
ctctatgattcaattacctccc

SEQ ID NO: 31047 - DNA, 22 bp, Artificial Sequence
  chemically synthesized
tatgattcaattacctccctcc

SEQ ID NO: 31048 - DNA, 22 bp, Artificial Sequence
  chemically synthesized
tgattcaattacctccctccaa

SEQ ID NO: 31049 - DNA, 22 bp, Artificial Sequence
  chemically synthesized
aattacctccctccaaatccct

SEQ ID NO: 31050 - DNA, 22 bp, Artificial Sequence
  chemically synthesized
cctccctccaaatccctcccac

SEQ ID NO: 31051 - DNA, 22 bp, Artificial Sequence
  chemically synthesized
cctccaaatccctcccacaaca

SEQ ID NO: 31052 - DNA, 22 bp, Artificial Sequence
  chemically synthesized
caaatccctcccacaacacgtg

SEQ ID NO: 31053 - DNA, 22 bp, Artificial Sequence
  chemically synthesized
ccacaacacgtgaggattatgg

SEQ ID NO: 31054 - DNA, 22 bp, Artificial Sequence
  chemically synthesized
tgggaactacaattcaagatga

SEQ ID NO: 31055 - DNA, 22 bp, Artificial Sequence
  chemically synthesized
caattcaagatgagatttgggt

SEQ ID NO: 31056 - DNA, 22 bp, Artificial Sequence
  chemically synthesized
aagatgagatttgggtggggac

SEQ ID NO: 31057 - DNA, 22 bp, Artificial Sequence
  chemically synthesized
gggtggggacacagtcaagctg

SEQ ID NO: 31058 - DNA, 22 bp, Artificial Sequence
  chemically synthesized
ggtggggacacagtcaagctgt

SEQ ID NO: 31059 - DNA, 22 bp, Artificial Sequence
  chemically synthesized
tatcagggtacaagctcgggtt

SEQ ID NO: 31060 - DNA, 22 bp, Artificial Sequence
  chemically synthesized
gggttccttacatatgtatgtt

SEQ ID NO: 31061 - DNA, 22 bp, Artificial Sequence
  chemically synthesized
cttacatatgtatgttgcatag

SEQ ID NO: 31062 - DNA, 22 bp, Artificial Sequence
  chemically synthesized
acatatgtatgttgcatagtgg

SEQ ID NO: 31063 - DNA, 22 bp, Artificial Sequence
  chemically synthesized
catatgtatgttgcatagtggt

SEQ ID NO: 31064 - DNA, 22 bp, Artificial Sequence
  chemically synthesized
catagtggtgaagtctgagctt

SEQ ID NO: 31065 - DNA, 22 bp, Artificial Sequence
  chemically synthesized
agcttttagtggaccatcacct

SEQ ID NO: 31066 - DNA, 22 bp, Artificial Sequence
  chemically synthesized
ttagtggaccatcacctgaaaa

SEQ ID NO: 31067 - DNA, 22 bp, Artificial Sequence
  chemically synthesized
tagtggaccatcacctgaaaag

SEQ ID NO: 31068 - DNA, 22 bp, Artificial Sequence
  chemically synthesized
agtggaccatcacctgaaaagt

SEQ ID NO: 31069 - DNA, 22 bp, Artificial Sequence
  chemically synthesized
gtggaccatcacctgaaaagtg

SEQ ID NO: 31070 - DNA, 22 bp, Artificial Sequence
  chemically synthesized
aaaagtgaatgttgtatccaat

SEQ ID NO: 31071 - DNA, 22 bp, Artificial Sequence
  chemically synthesized
tatccaatccgtagtttttcag

SEQ ID NO: 31072 - DNA, 22 bp, Artificial Sequence
  chemically synthesized
ttcagtcctcaccatactccta

SEQ ID NO: 31073 - DNA, 22 bp, Artificial Sequence
  chemically synthesized
tcagtcctcaccatactcctat

SEQ ID NO: 31074 - DNA, 22 bp, Artificial Sequence
  chemically synthesized
cagtcctcaccatactcctatc

SEQ ID NO: 31075 - DNA, 22 bp, Artificial Sequence
  chemically synthesized
agtcctcaccatactcctatcc

SEQ ID NO: 31076 - DNA, 22 bp, Artificial Sequence
  chemically synthesized
accatactcctatcctcccacc

SEQ ID NO: 31077 - DNA, 22 bp, Artificial Sequence
  chemically synthesized
ctatcctcccacctttctctag

SEQ ID NO: 31078 - DNA, 22 bp, Artificial Sequence
  chemically synthesized
tcctcccacctttctctagtct

SEQ ID NO: 31079 - DNA, 22 bp, Artificial Sequence
  chemically synthesized
ccacctttctctagtctcaagt

SEQ ID NO: 31080 - DNA, 22 bp, Artificial Sequence
  chemically synthesized
tctctagtctcaagtgtctatt

SEQ ID NO: 31081 - DNA, 22 bp, Artificial Sequence
  chemically synthesized
ctctagtctcaagtgtctatta

SEQ ID NO: 31082 - DNA, 22 bp, Artificial Sequence
  chemically synthesized
tctagtctcaagtgtctattat

SEQ ID NO: 31083 - DNA, 22 bp, Artificial Sequence
  chemically synthesized
tagtctcaagtgtctattattt

SEQ ID NO: 31084 - DNA, 22 bp, Artificial Sequence
  chemically synthesized
gtctcaagtgtctattatttca

SEQ ID NO: 31085 - DNA, 22 bp, Artificial Sequence
  chemically synthesized
aagtgtctattatttcattcta

SEQ ID NO: 31086 - DNA, 22 bp, Artificial Sequence
  chemically synthesized
ttatttcattctatatgtctat

SEQ ID NO: 31087 - DNA, 22 bp, Artificial Sequence
  chemically synthesized
tttcattctatatgtctatgct

SEQ ID NO: 31088 - DNA, 22 bp, Artificial Sequence
  chemically synthesized
cattctatatgtctatgcttac

SEQ ID NO: 31089 - DNA, 22 bp, Artificial Sequence
  chemically synthesized
attctatatgtctatgcttact

SEQ ID NO: 31090 - DNA, 22 bp, Artificial Sequence
  chemically synthesized
tatatgtctatgcttactcatc

SEQ ID NO: 31091 - DNA, 22 bp, Artificial Sequence
  chemically synthesized
tatgtctatgcttactcatcgt

SEQ ID NO: 31092 - DNA, 22 bp, Artificial Sequence
  chemically synthesized
tgcttactcatcgtttagctcc

SEQ ID NO: 31093 - DNA, 22 bp, Artificial Sequence
  chemically synthesized
actcatcgtttagctcccactt

SEQ ID NO: 31094 - DNA, 22 bp, Artificial Sequence
  chemically synthesized
ctcatcgtttagctcccacttg

SEQ ID NO: 31095 - DNA, 22 bp, Artificial Sequence
  chemically synthesized
atcgtttagctcccacttggct

SEQ ID NO: 31096 - DNA, 22 bp, Artificial Sequence
  chemically synthesized
agctcccacttggctctcacta

SEQ ID NO: 31097 - DNA, 22 bp, Artificial Sequence
  chemically synthesized
gctcccacttggctctcactaa

SEQ ID NO: 31098 - DNA, 22 bp, Artificial Sequence
  chemically synthesized
ccacttggctctcactaaatga

SEQ ID NO: 31099 - DNA, 22 bp, Artificial Sequence
  chemically synthesized
ggctctcactaaatgagaacat

SEQ ID NO: 31100 - DNA, 22 bp, Artificial Sequence
  chemically synthesized
gctctcactaaatgagaacata

SEQ ID NO: 31101 - DNA, 22 bp, Artificial Sequence
  chemically synthesized
tcactaaatgagaacatactgt

SEQ ID NO: 31102 - DNA, 22 bp, Artificial Sequence
  chemically synthesized
actaaatgagaacatactgtgt

SEQ ID NO: 31103 - DNA, 22 bp, Artificial Sequence
  chemically synthesized
aatgagaacatactgtgtttga

SEQ ID NO: 31104 - DNA, 22 bp, Artificial Sequence
  chemically synthesized
tgtttgactttctgtttctgag

SEQ ID NO: 31105 - DNA, 22 bp, Artificial Sequence
  chemically synthesized
gactttctgtttctgagttatt

SEQ ID NO: 31106 - DNA, 22 bp, Artificial Sequence
  chemically synthesized
actttctgtttctgagttattt

SEQ ID NO: 31107 - DNA, 22 bp, Artificial Sequence
  chemically synthesized
tctgtttctgagttatttcact

SEQ ID NO: 31108 - DNA, 22 bp, Artificial Sequence
  chemically synthesized
ctgtttctgagttatttcactg

SEQ ID NO: 31109 - DNA, 22 bp, Artificial Sequence
  chemically synthesized
tgtttctgagttatttcactga

SEQ ID NO: 31110 - DNA, 22 bp, Artificial Sequence
  chemically synthesized
tttctgagttatttcactgagg

SEQ ID NO: 31111 - DNA, 22 bp, Artificial Sequence
  chemically synthesized
ctgagttatttcactgaggata

SEQ ID NO: 31112 - DNA, 22 bp, Artificial Sequence
  chemically synthesized
tgagttatttcactgaggataa

SEQ ID NO: 31113 - DNA, 22 bp, Artificial Sequence
  chemically synthesized
agttatttcactgaggataatg

SEQ ID NO: 31114 - DNA, 22 bp, Artificial Sequence
  chemically synthesized
tttcactgaggataatgtcctc

SEQ ID NO: 31115 - DNA, 22 bp, Artificial Sequence
  chemically synthesized
cactgaggataatgtcctccag

SEQ ID NO: 31116 - DNA, 22 bp, Artificial Sequence
  chemically synthesized
actgaggataatgtcctccagt

SEQ ID NO: 31117 - DNA, 22 bp, Artificial Sequence
  chemically synthesized
aggataatgtcctccagttcta

SEQ ID NO: 31118 - DNA, 22 bp, Artificial Sequence
  chemically synthesized
cagttctaaccatgtttctaga

SEQ ID NO: 31119 - DNA, 22 bp, Artificial Sequence
  chemically synthesized
taaccatgtttctagagaagac

SEQ ID NO: 31120 - DNA, 22 bp, Artificial Sequence
  chemically synthesized
accatgtttctagagaagacat

SEQ ID NO: 31121 - DNA, 22 bp, Artificial Sequence
  chemically synthesized
ctagagaagacatgatttcatt

SEQ ID NO: 31122 - DNA, 22 bp, Artificial Sequence
  chemically synthesized
tagagaagacatgatttcattc

SEQ ID NO: 31123 - DNA, 22 bp, Artificial Sequence
  chemically synthesized
gagaagacatgatttcattctt

SEQ ID NO: 31124 - DNA, 22 bp, Artificial Sequence
  chemically synthesized
cattcttttttatggctgagta

SEQ ID NO: 31125 - DNA, 22 bp, Artificial Sequence
  chemically synthesized
attcttttttatggctgagtaa

SEQ ID NO: 31126 - DNA, 22 bp, Artificial Sequence
  chemically synthesized
ttttttatggctgagtaatata

SEQ ID NO: 31127 - DNA, 22 bp, Artificial Sequence
  chemically synthesized
ttttatggctgagtaatatata

SEQ ID NO: 31128 - DNA, 22 bp, Artificial Sequence
  chemically synthesized
tttatggctgagtaatatatat

SEQ ID NO: 31129 - DNA, 22 bp, Artificial Sequence
  chemically synthesized
ttatggctgagtaatatatatg

SEQ ID NO: 31130 - DNA, 22 bp, Artificial Sequence
  chemically synthesized
tatggctgagtaatatatatgt

SEQ ID NO: 31131 - DNA, 22 bp, Artificial Sequence
  chemically synthesized
atggctgagtaatatatatgta

SEQ ID NO: 31132 - DNA, 22 bp, Artificial Sequence
  chemically synthesized
tggctgagtaatatatatgtat

SEQ ID NO: 31133 - DNA, 22 bp, Artificial Sequence
  chemically synthesized
agtaatatatatgtatataaat

SEQ ID NO: 31134 - DNA, 22 bp, Artificial Sequence
  chemically synthesized
tctttatccaatcgtccattgg

SEQ ID NO: 31135 - DNA, 22 bp, Artificial Sequence
  chemically synthesized
ctttatccaatcgtccattggt

SEQ ID NO: 31136 - DNA, 22 bp, Artificial Sequence
  chemically synthesized
tttatccaatcgtccattggta

SEQ ID NO: 31137 - DNA, 22 bp, Artificial Sequence
  chemically synthesized
tatccaatcgtccattggtaga

SEQ ID NO: 31138 - DNA, 22 bp, Artificial Sequence
  chemically synthesized
atccaatcgtccattggtagac

SEQ ID NO: 31139 - DNA, 22 bp, Artificial Sequence
  chemically synthesized
tccaatcgtccattggtagaca

SEQ ID NO: 31140 - DNA, 22 bp, Artificial Sequence
  chemically synthesized
gtagacatttaggttgattcca

SEQ ID NO: 31141 - DNA, 22 bp, Artificial Sequence
  chemically synthesized
aggttgattccatatctttgct

SEQ ID NO: 31142 - DNA, 22 bp, Artificial Sequence
  chemically synthesized
ggttgattccatatctttgcta

SEQ ID NO: 31143 - DNA, 22 bp, Artificial Sequence
  chemically synthesized
attccatatctttgctattggg

SEQ ID NO: 31144 - DNA, 22 bp, Artificial Sequence
  chemically synthesized
catatctttgctattgggaaca

SEQ ID NO: 31145 - DNA, 22 bp, Artificial Sequence
  chemically synthesized
tgctattgggaacagtgctact

SEQ ID NO: 31146 - DNA, 22 bp, Artificial Sequence
  chemically synthesized
gctattgggaacagtgctactt

SEQ ID NO: 31147 - DNA, 22 bp, Artificial Sequence
  chemically synthesized
ctattgggaacagtgctacttt

SEQ ID NO: 31148 - DNA, 22 bp, Artificial Sequence
  chemically synthesized
ttgggaacagtgctactttgaa

SEQ ID NO: 31149 - DNA, 22 bp, Artificial Sequence
  chemically synthesized
ggaacagtgctactttgaacat

SEQ ID NO: 31150 - DNA, 22 bp, Artificial Sequence
  chemically synthesized
ctttgaacatactaatgcagat

SEQ ID NO: 31151 - DNA, 22 bp, Artificial Sequence
  chemically synthesized
tgaacatactaatgcagatatc

SEQ ID NO: 31152 - DNA, 22 bp, Artificial Sequence
  chemically synthesized
gaacatactaatgcagatatct

SEQ ID NO: 31153 - DNA, 22 bp, Artificial Sequence
  chemically synthesized
aacatactaatgcagatatctt

SEQ ID NO: 31154 - DNA, 22 bp, Artificial Sequence
  chemically synthesized
atgcagatatcttttttaatat

SEQ ID NO: 31155 - DNA, 22 bp, Artificial Sequence
  chemically synthesized
ttttaatatgatctctttcact

SEQ ID NO: 31156 - DNA, 22 bp, Artificial Sequence
  chemically synthesized
tttaatatgatctctttcactt

SEQ ID NO: 31157 - DNA, 22 bp, Artificial Sequence
  chemically synthesized
ttaatatgatctctttcacttt

SEQ ID NO: 31158 - DNA, 22 bp, Artificial Sequence
  chemically synthesized
taatatgatctctttcactttg

SEQ ID NO: 31159 - DNA, 22 bp, Artificial Sequence
  chemically synthesized
aatatgatctctttcactttgg

SEQ ID NO: 31160 - DNA, 22 bp, Artificial Sequence
  chemically synthesized
atatgatctctttcactttggg

SEQ ID NO: 31161 - DNA, 22 bp, Artificial Sequence
  chemically synthesized
tttcactttgggtccataccca

SEQ ID NO: 31162 - DNA, 22 bp, Artificial Sequence
  chemically synthesized
tcactttgggtccatacccagt

SEQ ID NO: 31163 - DNA, 22 bp, Artificial Sequence
  chemically synthesized
cactttgggtccatacccagta

SEQ ID NO: 31164 - DNA, 22 bp, Artificial Sequence
  chemically synthesized
actttgggtccatacccagtag

SEQ ID NO: 31165 - DNA, 22 bp, Artificial Sequence
  chemically synthesized
tgggtccatacccagtagtggg

SEQ ID NO: 31166 - DNA, 22 bp, Artificial Sequence
  chemically synthesized
gggtccatacccagtagtggga

SEQ ID NO: 31167 - DNA, 22 bp, Artificial Sequence
  chemically synthesized
ggtccatacccagtagtgggat

SEQ ID NO: 31168 - DNA, 22 bp, Artificial Sequence
  chemically synthesized
caggattgaatggtagttctgt

SEQ ID NO: 31169 - DNA, 22 bp, Artificial Sequence
  chemically synthesized
aatggtagttctgtttctagtt

SEQ ID NO: 31170 - DNA, 22 bp, Artificial Sequence
  chemically synthesized
tgtttctagttctttaagaaat

SEQ ID NO: 31171 - DNA, 22 bp, Artificial Sequence
  chemically synthesized
tttctagttctttaagaaatct

SEQ ID NO: 31172 - DNA, 22 bp, Artificial Sequence
  chemically synthesized
ctagttctttaagaaatcttca

SEQ ID NO: 31173 - DNA, 22 bp, Artificial Sequence
  chemically synthesized
tagttctttaagaaatcttcat

SEQ ID NO: 31174 - DNA, 22 bp, Artificial Sequence
  chemically synthesized
gttctttaagaaatcttcatgc

SEQ ID NO: 31175 - DNA, 22 bp, Artificial Sequence
  chemically synthesized
tttaagaaatcttcatgctgtc

SEQ ID NO: 31176 - DNA, 22 bp, Artificial Sequence
  chemically synthesized
taagaaatcttcatgctgtctt

SEQ ID NO: 31177 - DNA, 22 bp, Artificial Sequence
  chemically synthesized
aagaaatcttcatgctgtcttc

SEQ ID NO: 31178 - DNA, 22 bp, Artificial Sequence
  chemically synthesized
agaaatcttcatgctgtcttcc

SEQ ID NO: 31179 - DNA, 22 bp, Artificial Sequence
  chemically synthesized
catgctgtcttccataaagttt

SEQ ID NO: 31180 - DNA, 22 bp, Artificial Sequence
  chemically synthesized
atgctgtcttccataaagtttg

SEQ ID NO: 31181 - DNA, 22 bp, Artificial Sequence
  chemically synthesized
tcttccataaagtttgtactaa

SEQ ID NO: 31182 - DNA, 22 bp, Artificial Sequence
  chemically synthesized
ccataaagtttgtactaattta

SEQ ID NO: 31183 - DNA, 22 bp, Artificial Sequence
  chemically synthesized
cataaagtttgtactaatttac

SEQ ID NO: 31184 - DNA, 22 bp, Artificial Sequence
  chemically synthesized
gtactaatttacattcttacca

SEQ ID NO: 31185 - DNA, 22 bp, Artificial Sequence
  chemically synthesized
tactaatttacattcttaccaa

SEQ ID NO: 31186 - DNA, 22 bp, Artificial Sequence
  chemically synthesized
atttacattcttaccaacagtg

SEQ ID NO: 31187 - DNA, 22 bp, Artificial Sequence
  chemically synthesized
acattcttaccaacagtgtata

SEQ ID NO: 31188 - DNA, 22 bp, Artificial Sequence
  chemically synthesized
cattcttaccaacagtgtataa

SEQ ID NO: 31189 - DNA, 22 bp, Artificial Sequence
  chemically synthesized
ttaccaacagtgtataagcatt

SEQ ID NO: 31190 - DNA, 22 bp, Artificial Sequence
  chemically synthesized
accaacagtgtataagcatttt

SEQ ID NO: 31191 - DNA, 22 bp, Artificial Sequence
  chemically synthesized
ccaacagtgtataagcattttc

SEQ ID NO: 31192 - DNA, 22 bp, Artificial Sequence
  chemically synthesized
tcttgtctccacatcctcacca

SEQ ID NO: 31193 - DNA, 22 bp, Artificial Sequence
  chemically synthesized
cttgtctccacatcctcaccaa

SEQ ID NO: 31194 - DNA, 22 bp, Artificial Sequence
  chemically synthesized
ttgtctccacatcctcaccaac

SEQ ID NO: 31195 - DNA, 22 bp, Artificial Sequence
  chemically synthesized
gtctccacatcctcaccaacat

SEQ ID NO: 31196 - DNA, 22 bp, Artificial Sequence
  chemically synthesized
tctccacatcctcaccaacatc

SEQ ID NO: 31197 - DNA, 22 bp, Artificial Sequence
  chemically synthesized
cacatcctcaccaacatctgct

SEQ ID NO: 31198 - DNA, 22 bp, Artificial Sequence
  chemically synthesized
accaacatctgctgtttttgaa

SEQ ID NO: 31199 - DNA, 22 bp, Artificial Sequence
  chemically synthesized
ctgtttttgaactttataatga

SEQ ID NO: 31200 - DNA, 22 bp, Artificial Sequence
  chemically synthesized
tttttgaactttataatgatag

SEQ ID NO: 31201 - DNA, 22 bp, Artificial Sequence
  chemically synthesized
ttgaactttataatgatagcca

SEQ ID NO: 31202 - DNA, 22 bp, Artificial Sequence
  chemically synthesized
tgaactttataatgatagccat

SEQ ID NO: 31203 - DNA, 22 bp, Artificial Sequence
  chemically synthesized
gaactttataatgatagccatt

SEQ ID NO: 31204 - DNA, 22 bp, Artificial Sequence
  chemically synthesized
aactttataatgatagccattc

SEQ ID NO: 31205 - DNA, 22 bp, Artificial Sequence
  chemically synthesized
tataatgatagccattctgact

SEQ ID NO: 31206 - DNA, 22 bp, Artificial Sequence
  chemically synthesized
ataatgatagccattctgactg

SEQ ID NO: 31207 - DNA, 22 bp, Artificial Sequence
  chemically synthesized
taatgatagccattctgactgg

SEQ ID NO: 31208 - DNA, 22 bp, Artificial Sequence
  chemically synthesized
tgactggcataaggaggtatca

SEQ ID NO: 31209 - DNA, 22 bp, Artificial Sequence
  chemically synthesized
actggcataaggaggtatcata

SEQ ID NO: 31210 - DNA, 22 bp, Artificial Sequence
  chemically synthesized
gcataaggaggtatcatatggt

SEQ ID NO: 31211 - DNA, 22 bp, Artificial Sequence
  chemically synthesized
taatttgcattctctgattatt

SEQ ID NO: 31212 - DNA, 22 bp, Artificial Sequence
  chemically synthesized
aatttgcattctctgattatta

SEQ ID NO: 31213 - DNA, 22 bp, Artificial Sequence
  chemically synthesized
atttgcattctctgattattag

SEQ ID NO: 31214 - DNA, 22 bp, Artificial Sequence
  chemically synthesized
gcattctctgattattagtgat

SEQ ID NO: 31215 - DNA, 22 bp, Artificial Sequence
  chemically synthesized
cattctctgattattagtgatg

SEQ ID NO: 31216 - DNA, 22 bp, Artificial Sequence
  chemically synthesized
tctgattattagtgatgttgaa

SEQ ID NO: 31217 - DNA, 22 bp, Artificial Sequence
  chemically synthesized
tgattattagtgatgttgaact

SEQ ID NO: 31218 - DNA, 22 bp, Artificial Sequence
  chemically synthesized
attattagtgatgttgaacttt

SEQ ID NO: 31219 - DNA, 22 bp, Artificial Sequence
  chemically synthesized
ttagtgatgttgaacttttttt

SEQ ID NO: 31220 - DNA, 22 bp, Artificial Sequence
  chemically synthesized
gtgatgttgaacttttttttga

SEQ ID NO: 31221 - DNA, 22 bp, Artificial Sequence
  chemically synthesized
aacttttttttgacgtttattg

SEQ ID NO: 31222 - DNA, 22 bp, Artificial Sequence
  chemically synthesized
ttttttgacgtttattggccac

SEQ ID NO: 31223 - DNA, 22 bp, Artificial Sequence
  chemically synthesized
tttttgacgtttattggccact

SEQ ID NO: 31224 - DNA, 22 bp, Artificial Sequence
  chemically synthesized
ttttgacgtttattggccactt

SEQ ID NO: 31225 - DNA, 22 bp, Artificial Sequence
  chemically synthesized
tttgacgtttattggccacttg

SEQ ID NO: 31226 - DNA, 22 bp, Artificial Sequence
  chemically synthesized
ttgacgtttattggccacttgt

SEQ ID NO: 31227 - DNA, 22 bp, Artificial Sequence
  chemically synthesized
tgacgtttattggccacttgta

SEQ ID NO: 31228 - DNA, 22 bp, Artificial Sequence
  chemically synthesized
gacgtttattggccacttgtat

SEQ ID NO: 31229 - DNA, 22 bp, Artificial Sequence
  chemically synthesized
acgtttattggccacttgtatg

SEQ ID NO: 31230 - DNA, 22 bp, Artificial Sequence
  chemically synthesized
attggccacttgtatgtcttct

SEQ ID NO: 31231 - DNA, 22 bp, Artificial Sequence
  chemically synthesized
ttggccacttgtatgtcttctt

SEQ ID NO: 31232 - DNA, 22 bp, Artificial Sequence
  chemically synthesized
gccacttgtatgtcttcttttg

SEQ ID NO: 31233 - DNA, 22 bp, Artificial Sequence
  chemically synthesized
gtatgtcttcttttggaaaatg

SEQ ID NO: 31234 - DNA, 22 bp, Artificial Sequence
  chemically synthesized
tatgtcttcttttggaaaatgt

SEQ ID NO: 31235 - DNA, 22 bp, Artificial Sequence
  chemically synthesized
cttttggaaaatgtctgctcag

SEQ ID NO: 31236 - DNA, 22 bp, Artificial Sequence
  chemically synthesized
ttttggaaaatgtctgctcagg

SEQ ID NO: 31237 - DNA, 22 bp, Artificial Sequence
  chemically synthesized
ttggaaaatgtctgctcaggac

SEQ ID NO: 31238 - DNA, 22 bp, Artificial Sequence
  chemically synthesized
tggaaaatgtctgctcaggacc

SEQ ID NO: 31239 - DNA, 22 bp, Artificial Sequence
  chemically synthesized
ggaaaatgtctgctcaggacct

SEQ ID NO: 31240 - DNA, 22 bp, Artificial Sequence
  chemically synthesized
gaaaatgtctgctcaggacctg

SEQ ID NO: 31241 - DNA, 22 bp, Artificial Sequence
  chemically synthesized
ctcaggacctgagctcactgta

SEQ ID NO: 31242 - DNA, 22 bp, Artificial Sequence
  chemically synthesized
aggacctgagctcactgtattt

SEQ ID NO: 31243 - DNA, 22 bp, Artificial Sequence
  chemically synthesized
agctcactgtatttgtcagggt

SEQ ID NO: 31244 - DNA, 22 bp, Artificial Sequence
  chemically synthesized
actgtatttgtcagggttccct

SEQ ID NO: 31245 - DNA, 22 bp, Artificial Sequence
  chemically synthesized
tatttgtcagggttccctagag

SEQ ID NO: 31246 - DNA, 22 bp, Artificial Sequence
  chemically synthesized
gtcagggttccctagagagaca

SEQ ID NO: 31247 - DNA, 22 bp, Artificial Sequence
  chemically synthesized
tcagggttccctagagagacag

SEQ ID NO: 31248 - DNA, 22 bp, Artificial Sequence
  chemically synthesized
cctagagagacagaactaatag

SEQ ID NO: 31249 - DNA, 22 bp, Artificial Sequence
  chemically synthesized
gagagacagaactaataggaga

SEQ ID NO: 31250 - DNA, 22 bp, Artificial Sequence
  chemically synthesized
ataggagatagatagatagata

SEQ ID NO: 31251 - DNA, 22 bp, Artificial Sequence
  chemically synthesized
agatataaaagggagtttatta

SEQ ID NO: 31252 - DNA, 22 bp, Artificial Sequence
  chemically synthesized
gatataaaagggagtttattaa

SEQ ID NO: 31253 - DNA, 22 bp, Artificial Sequence
  chemically synthesized
attaagtagtgttaacttacac

SEQ ID NO: 31254 - DNA, 22 bp, Artificial Sequence
  chemically synthesized
ttaagtagtgttaacttacaca

SEQ ID NO: 31255 - DNA, 22 bp, Artificial Sequence
  chemically synthesized
agtagtgttaacttacacaatc

SEQ ID NO: 31256 - DNA, 22 bp, Artificial Sequence
  chemically synthesized
acttacacaatcacaaggtccc

SEQ ID NO: 31257 - DNA, 22 bp, Artificial Sequence
  chemically synthesized
acacaatcacaaggtcccacaa

SEQ ID NO: 31258 - DNA, 22 bp, Artificial Sequence
  chemically synthesized
cacaatcacaaggtcccacaat

SEQ ID NO: 31259 - DNA, 22 bp, Artificial Sequence
  chemically synthesized
caagcagaggagcaaggaagcc

SEQ ID NO: 31260 - DNA, 22 bp, Artificial Sequence
  chemically synthesized
aaggacttggagtccaatgttt

SEQ ID NO: 31261 - DNA, 22 bp, Artificial Sequence
  chemically synthesized
ggagtccaatgtttgagggcag

SEQ ID NO: 31262 - DNA, 22 bp, Artificial Sequence
  chemically synthesized
gagtccaatgtttgagggcagg

SEQ ID NO: 31263 - DNA, 22 bp, Artificial Sequence
  chemically synthesized
gagggcaggaagcatccagcat

SEQ ID NO: 31264 - DNA, 22 bp, Artificial Sequence
  chemically synthesized
agggcaggaagcatccagcatg

SEQ ID NO: 31265 - DNA, 22 bp, Artificial Sequence
  chemically synthesized
ggaggctaagccagtccaggat

SEQ ID NO: 31266 - DNA, 22 bp, Artificial Sequence
  chemically synthesized
gaggctaagccagtccaggatt

SEQ ID NO: 31267 - DNA, 22 bp, Artificial Sequence
  chemically synthesized
agccagtccaggattttcacat

SEQ ID NO: 31268 - DNA, 22 bp, Artificial Sequence
  chemically synthesized
tcacatgttttttttctgcctg

SEQ ID NO: 31269 - DNA, 22 bp, Artificial Sequence
  chemically synthesized
cacatgttttttttctgcctgc

SEQ ID NO: 31270 - DNA, 22 bp, Artificial Sequence
  chemically synthesized
acatgttttttttctgcctgct

SEQ ID NO: 31271 - DNA, 22 bp, Artificial Sequence
  chemically synthesized
tttttctgcctgctttatatcc

SEQ ID NO: 31272 - DNA, 22 bp, Artificial Sequence
  chemically synthesized
ttttctgcctgctttatatcct

SEQ ID NO: 31273 - DNA, 22 bp, Artificial Sequence
  chemically synthesized
tttctgcctgctttatatcctg

SEQ ID NO: 31274 - DNA, 22 bp, Artificial Sequence
  chemically synthesized
ttctgcctgctttatatcctgg

SEQ ID NO: 31275 - DNA, 22 bp, Artificial Sequence
  chemically synthesized
tctgcctgctttatatcctggc

SEQ ID NO: 31276 - DNA, 22 bp, Artificial Sequence
  chemically synthesized
ctgcctgctttatatcctggcc

SEQ ID NO: 31277 - DNA, 22 bp, Artificial Sequence
  chemically synthesized
tgcctgctttatatcctggcca

SEQ ID NO: 31278 - DNA, 22 bp, Artificial Sequence
  chemically synthesized
cctgctttatatcctggccaca

SEQ ID NO: 31279 - DNA, 22 bp, Artificial Sequence
  chemically synthesized
ctttatatcctggccacactgg

SEQ ID NO: 31280 - DNA, 22 bp, Artificial Sequence
  chemically synthesized
tatatcctggccacactggcaa

SEQ ID NO: 31281 - DNA, 22 bp, Artificial Sequence
  chemically synthesized
atatcctggccacactggcaac

SEQ ID NO: 31282 - DNA, 22 bp, Artificial Sequence
  chemically synthesized
tatcctggccacactggcaact

SEQ ID NO: 31283 - DNA, 22 bp, Artificial Sequence
  chemically synthesized
gccacactggcaactgattaga

SEQ ID NO: 31284 - DNA, 22 bp, Artificial Sequence
  chemically synthesized
gcaactgattagatggtgccca

SEQ ID NO: 31285 - DNA, 22 bp, Artificial Sequence
  chemically synthesized
attagatggtgcccacccagat

SEQ ID NO: 31286 - DNA, 22 bp, Artificial Sequence
  chemically synthesized
gatggtgcccacccagattaag

SEQ ID NO: 31287 - DNA, 22 bp, Artificial Sequence
  chemically synthesized
agggtgggtctgcctttcccag

SEQ ID NO: 31288 - DNA, 22 bp, Artificial Sequence
  chemically synthesized
cctttcccagcccactgactaa

SEQ ID NO: 31289 - DNA, 22 bp, Artificial Sequence
  chemically synthesized
tcccagcccactgactaaaatg

SEQ ID NO: 31290 - DNA, 22 bp, Artificial Sequence
  chemically synthesized
cccagcccactgactaaaatgt

SEQ ID NO: 31291 - DNA, 22 bp, Artificial Sequence
  chemically synthesized
ccagcccactgactaaaatgtt

SEQ ID NO: 31292 - DNA, 22 bp, Artificial Sequence
  chemically synthesized
actaaaatgttaatctcctttg

SEQ ID NO: 31293 - DNA, 22 bp, Artificial Sequence
  chemically synthesized
aaatgttaatctcctttggcaa

SEQ ID NO: 31294 - DNA, 22 bp, Artificial Sequence
  chemically synthesized
atctcctttggcaataccctca

SEQ ID NO: 31295 - DNA, 22 bp, Artificial Sequence
  chemically synthesized
ctttggcaataccctcacagac

SEQ ID NO: 31296 - DNA, 22 bp, Artificial Sequence
  chemically synthesized
tggcaataccctcacagacaca

SEQ ID NO: 31297 - DNA, 22 bp, Artificial Sequence
  chemically synthesized
ggcaataccctcacagacacac

SEQ ID NO: 31298 - DNA, 22 bp, Artificial Sequence
  chemically synthesized
gcaataccctcacagacacact

SEQ ID NO: 31299 - DNA, 22 bp, Artificial Sequence
  chemically synthesized
acagacacactcaggatcaata

SEQ ID NO: 31300 - DNA, 22 bp, Artificial Sequence
  chemically synthesized
aggatcaatactttgcacactt

SEQ ID NO: 31301 - DNA, 22 bp, Artificial Sequence
  chemically synthesized
tgcacacttcaatccaatcaag

SEQ ID NO: 31302 - DNA, 22 bp, Artificial Sequence
  chemically synthesized
gcacacttcaatccaatcaagt

SEQ ID NO: 31303 - DNA, 22 bp, Artificial Sequence
  chemically synthesized
cacacttcaatccaatcaagtt

SEQ ID NO: 31304 - DNA, 22 bp, Artificial Sequence
  chemically synthesized
caatccaatcaagttgacactc

SEQ ID NO: 31305 - DNA, 22 bp, Artificial Sequence
  chemically synthesized
aatccaatcaagttgacactca

SEQ ID NO: 31306 - DNA, 22 bp, Artificial Sequence
  chemically synthesized
acactcagtattaaccatcaca

SEQ ID NO: 31307 - DNA, 22 bp, Artificial Sequence
  chemically synthesized
agtattaaccatcacaagtcca

SEQ ID NO: 31308 - DNA, 22 bp, Artificial Sequence
  chemically synthesized
accatcacaagtccatcgcttg

SEQ ID NO: 31309 - DNA, 22 bp, Artificial Sequence
  chemically synthesized
gtcaacttgagcctatacacat

SEQ ID NO: 31310 - DNA, 22 bp, Artificial Sequence
  chemically synthesized
tcaacttgagcctatacacatc

SEQ ID NO: 31311 - DNA, 22 bp, Artificial Sequence
  chemically synthesized
gagcctatacacatcccctgag

SEQ ID NO: 31312 - DNA, 22 bp, Artificial Sequence
  chemically synthesized
agcctatacacatcccctgagg

SEQ ID NO: 31313 - DNA, 22 bp, Artificial Sequence
  chemically synthesized
tacacatcccctgaggtcatac

SEQ ID NO: 31314 - DNA, 22 bp, Artificial Sequence
  chemically synthesized
aggtcatacattatcttcaaat

SEQ ID NO: 31315 - DNA, 22 bp, Artificial Sequence
  chemically synthesized
tcttcaaataaagacaacaata

SEQ ID NO: 31316 - DNA, 22 bp, Artificial Sequence
  chemically synthesized
caaataaagacaacaataagtc

SEQ ID NO: 31317 - DNA, 22 bp, Artificial Sequence
  chemically synthesized
aaataaagacaacaataagtca

SEQ ID NO: 31318 - DNA, 22 bp, Artificial Sequence
  chemically synthesized
tgcctaacatactaaaactatc

SEQ ID NO: 31319 - DNA, 22 bp, Artificial Sequence
  chemically synthesized
acatactaaaactatccttcgt

SEQ ID NO: 31320 - DNA, 22 bp, Artificial Sequence
  chemically synthesized
aaactatccttcgtgcaattga

SEQ ID NO: 31321 - DNA, 22 bp, Artificial Sequence
  chemically synthesized
tccttcgtgcaattgaaaatgc

SEQ ID NO: 31322 - DNA, 22 bp, Artificial Sequence
  chemically synthesized
cgtgcaattgaaaatgcaccaa

SEQ ID NO: 31323 - DNA, 22 bp, Artificial Sequence
  chemically synthesized
gtgcaattgaaaatgcaccaat

SEQ ID NO: 31324 - DNA, 22 bp, Artificial Sequence
  chemically synthesized
aaaatgcaccaatccccattgc

SEQ ID NO: 31325 - DNA, 22 bp, Artificial Sequence
  chemically synthesized
caaatgctattacataaactta

SEQ ID NO: 31326 - DNA, 22 bp, Artificial Sequence
  chemically synthesized
ttacataaacttaacaatactt

SEQ ID NO: 31327 - DNA, 22 bp, Artificial Sequence
  chemically synthesized
cataaacttaacaatacttaaa

SEQ ID NO: 31328 - DNA, 22 bp, Artificial Sequence
  chemically synthesized
aacaatacttaaatgctgatat

SEQ ID NO: 31329 - DNA, 22 bp, Artificial Sequence
  chemically synthesized
acaatacttaaatgctgatatg

SEQ ID NO: 31330 - DNA, 22 bp, Artificial Sequence
  chemically synthesized
aaatgctgatatgaagtcaata

SEQ ID NO: 31331 - DNA, 22 bp, Artificial Sequence
  chemically synthesized
aatgctgatatgaagtcaataa

SEQ ID NO: 31332 - DNA, 22 bp, Artificial Sequence
  chemically synthesized
atatgaagtcaataaatcttat

SEQ ID NO: 31333 - DNA, 22 bp, Artificial Sequence
  chemically synthesized
atgtcacatgataaaggaaaaa

SEQ ID NO: 31334 - DNA, 22 bp, Artificial Sequence
  chemically synthesized
tgtcacatgataaaggaaaaag

SEQ ID NO: 31335 - DNA, 22 bp, Artificial Sequence
  chemically synthesized
tcttagtacaagtgtatacaga

SEQ ID NO: 31336 - DNA, 22 bp, Artificial Sequence
  chemically synthesized
cttagtacaagtgtatacagac

SEQ ID NO: 31337 - DNA, 22 bp, Artificial Sequence
  chemically synthesized
ttagtacaagtgtatacagaca

SEQ ID NO: 31338 - DNA, 22 bp, Artificial Sequence
  chemically synthesized
agtacaagtgtatacagacacg

SEQ ID NO: 31339 - DNA, 22 bp, Artificial Sequence
  chemically synthesized
gtacaagtgtatacagacacga

SEQ ID NO: 31340 - DNA, 22 bp, Artificial Sequence
  chemically synthesized
ttaacaaaagaaggaggaaata

SEQ ID NO: 31341 - DNA, 22 bp, Artificial Sequence
  chemically synthesized
taacaaaagaaggaggaaatac

SEQ ID NO: 31342 - DNA, 22 bp, Artificial Sequence
  chemically synthesized
aacaaaagaaggaggaaatact

SEQ ID NO: 31343 - DNA, 22 bp, Artificial Sequence
  chemically synthesized
acaaaagaaggaggaaatactc

SEQ ID NO: 31344 - DNA, 22 bp, Artificial Sequence
  chemically synthesized
atgacaattacagtccttgtat

SEQ ID NO: 31345 - DNA, 22 bp, Artificial Sequence
  chemically synthesized
cagtccttgtatctgcaattgg

SEQ ID NO: 31346 - DNA, 22 bp, Artificial Sequence
  chemically synthesized
gtatctgcaattggtcacgtga

SEQ ID NO: 31347 - DNA, 22 bp, Artificial Sequence
  chemically synthesized
tatctgcaattggtcacgtgat

SEQ ID NO: 31348 - DNA, 22 bp, Artificial Sequence
  chemically synthesized
caattggtcacgtgatcgtagc

SEQ ID NO: 31349 - DNA, 22 bp, Artificial Sequence
  chemically synthesized
gtcacgtgatcgtagctggtat

SEQ ID NO: 31350 - DNA, 22 bp, Artificial Sequence
  chemically synthesized
gtattgatgactaccttcttct

SEQ ID NO: 31351 - DNA, 22 bp, Artificial Sequence
  chemically synthesized
atgactaccttcttctgctaca

SEQ ID NO: 31352 - DNA, 22 bp, Artificial Sequence
  chemically synthesized
ccttcttctgctacatattctg

SEQ ID NO: 31353 - DNA, 22 bp, Artificial Sequence
  chemically synthesized
cttctgctacatattctgtatt

SEQ ID NO: 31354 - DNA, 22 bp, Artificial Sequence
  chemically synthesized
ttctgctacatattctgtattc

SEQ ID NO: 31355 - DNA, 22 bp, Artificial Sequence
  chemically synthesized
ctgctacatattctgtattccc

SEQ ID NO: 31356 - DNA, 22 bp, Artificial Sequence
  chemically synthesized
tgctacatattctgtattccct

SEQ ID NO: 31357 - DNA, 22 bp, Artificial Sequence
  chemically synthesized
ctacatattctgtattcccttt

SEQ ID NO: 31358 - DNA, 22 bp, Artificial Sequence
  chemically synthesized
catattctgtattccctttgcc

SEQ ID NO: 31359 - DNA, 22 bp, Artificial Sequence
  chemically synthesized
tgtattccctttgccctcagca

SEQ ID NO: 31360 - DNA, 22 bp, Artificial Sequence
  chemically synthesized
tattccctttgccctcagcaag

SEQ ID NO: 31361 - DNA, 22 bp, Artificial Sequence
  chemically synthesized
cctttgccctcagcaagcacct

SEQ ID NO: 31362 - DNA, 22 bp, Artificial Sequence
  chemically synthesized
tgccctcagcaagcacctcagc

SEQ ID NO: 31363 - DNA, 22 bp, Artificial Sequence
  chemically synthesized
gccctcagcaagcacctcagca

SEQ ID NO: 31364 - DNA, 22 bp, Artificial Sequence
  chemically synthesized
ccctcagcaagcacctcagcag

SEQ ID NO: 31365 - DNA, 22 bp, Artificial Sequence
  chemically synthesized
agcaagcacctcagcaggtctt

SEQ ID NO: 31366 - DNA, 22 bp, Artificial Sequence
  chemically synthesized
agcaggtcttgtcttttttttt

SEQ ID NO: 31367 - DNA, 22 bp, Artificial Sequence
  chemically synthesized
gtcttttttttttttttttttc

SEQ ID NO: 31368 - DNA, 22 bp, Artificial Sequence
  chemically synthesized
tcttttttttttttttttttcc

SEQ ID NO: 31369 - DNA, 22 bp, Artificial Sequence
  chemically synthesized
ttttttttttttttttcctggt

SEQ ID NO: 31370 - DNA, 22 bp, Artificial Sequence
  chemically synthesized
tttttttttttttttcctggtg

SEQ ID NO: 31371 - DNA, 22 bp, Artificial Sequence
  chemically synthesized
ttttttttttttttcctggtgg

SEQ ID NO: 31372 - DNA, 22 bp, Artificial Sequence
  chemically synthesized
tttttttttttttcctggtgga

SEQ ID NO: 31373 - DNA, 22 bp, Artificial Sequence
  chemically synthesized
ttttttttttttcctggtggag

SEQ ID NO: 31374 - DNA, 22 bp, Artificial Sequence
  chemically synthesized
tttttttttttcctggtggagt

SEQ ID NO: 31375 - DNA, 22 bp, Artificial Sequence
  chemically synthesized
ttttttttttcctggtggagtg

SEQ ID NO: 31376 - DNA, 22 bp, Artificial Sequence
  chemically synthesized
tttttttttcctggtggagtga

SEQ ID NO: 31377 - DNA, 22 bp, Artificial Sequence
  chemically synthesized
ttttttttcctggtggagtgac

SEQ ID NO: 31378 - DNA, 22 bp, Artificial Sequence
  chemically synthesized
tttttttcctggtggagtgacc

SEQ ID NO: 31379 - DNA, 22 bp, Artificial Sequence
  chemically synthesized
ttttttcctggtggagtgaccc

SEQ ID NO: 31380 - DNA, 22 bp, Artificial Sequence
  chemically synthesized
tttttcctggtggagtgaccca

SEQ ID NO: 31381 - DNA, 22 bp, Artificial Sequence
  chemically synthesized
ttttcctggtggagtgacccaa

SEQ ID NO: 31382 - DNA, 22 bp, Artificial Sequence
  chemically synthesized
tttcctggtggagtgacccaaa

SEQ ID NO: 31383 - DNA, 22 bp, Artificial Sequence
  chemically synthesized
ttcctggtggagtgacccaaac

SEQ ID NO: 31384 - DNA, 22 bp, Artificial Sequence
  chemically synthesized
tcctggtggagtgacccaaacc

SEQ ID NO: 31385 - DNA, 22 bp, Artificial Sequence
  chemically synthesized
cctggtggagtgacccaaacct

SEQ ID NO: 31386 - DNA, 22 bp, Artificial Sequence
  chemically synthesized
ctggtggagtgacccaaacctt

SEQ ID NO: 31387 - DNA, 22 bp, Artificial Sequence
  chemically synthesized
gtggagtgacccaaacctttat

SEQ ID NO: 31388 - DNA, 22 bp, Artificial Sequence
  chemically synthesized
tatttgtagtcctgcctggaat

SEQ ID NO: 31389 - DNA, 22 bp, Artificial Sequence
  chemically synthesized
atttgtagtcctgcctggaatg

SEQ ID NO: 31390 - DNA, 22 bp, Artificial Sequence
  chemically synthesized
tttgtagtcctgcctggaatgg

SEQ ID NO: 31391 - DNA, 22 bp, Artificial Sequence
  chemically synthesized
gtagtcctgcctggaatggcct

SEQ ID NO: 31392 - DNA, 22 bp, Artificial Sequence
  chemically synthesized
tagtcctgcctggaatggcctg

SEQ ID NO: 31393 - DNA, 22 bp, Artificial Sequence
  chemically synthesized
cctggaatggcctgtagtagtt

SEQ ID NO: 31394 - DNA, 22 bp, Artificial Sequence
  chemically synthesized
gaatggcctgtagtagtttccc

SEQ ID NO: 31395 - DNA, 22 bp, Artificial Sequence
  chemically synthesized
tagtagtttcccactgacctta

SEQ ID NO: 31396 - DNA, 22 bp, Artificial Sequence
  chemically synthesized
cccactgaccttaattccagga

SEQ ID NO: 31397 - DNA, 22 bp, Artificial Sequence
  chemically synthesized
ccactgaccttaattccaggac

SEQ ID NO: 31398 - DNA, 22 bp, Artificial Sequence
  chemically synthesized
accttaattccaggacatggta

SEQ ID NO: 31399 - DNA, 22 bp, Artificial Sequence
  chemically synthesized
aattccaggacatggtaaaact

SEQ ID NO: 31400 - DNA, 22 bp, Artificial Sequence
  chemically synthesized
attccaggacatggtaaaacta

SEQ ID NO: 31401 - DNA, 22 bp, Artificial Sequence
  chemically synthesized
caggacatggtaaaactaagag

SEQ ID NO: 31402 - DNA, 22 bp, Artificial Sequence
  chemically synthesized
agagacaccctaatggatctcc

SEQ ID NO: 31403 - DNA, 22 bp, Artificial Sequence
  chemically synthesized
atggatctcctatattccatgc

SEQ ID NO: 31404 - DNA, 22 bp, Artificial Sequence
  chemically synthesized
ctatattccatgcatacgcttc

SEQ ID NO: 31405 - DNA, 22 bp, Artificial Sequence
  chemically synthesized
tattccatgcatacgcttcctt

SEQ ID NO: 31406 - DNA, 22 bp, Artificial Sequence
  chemically synthesized
catgcatacgcttccttacctc

SEQ ID NO: 31407 - DNA, 22 bp, Artificial Sequence
  chemically synthesized
ccttacctccattgtggagttg

(The sequence listing continues in the following parts.)

What is claimed is:

1. One or more guide ribonucleic acids (gRNAs) for editing a SERPINA1 gene in a cell from a patient with alpha-1 antitrypsin deficiency (AATD), the one or more gRNAs comprising a spacer sequence selected from the group consisting of the RNA sequences corresponding to the full-length nucleic acid sequences in SEQ ID NOs: 55,559, 55,574, 55,575, 55,577, 55,578, 55,584, 55,586, 55,587, 55,600, 55,602, 55,605, 55,607, 55,616, 55,625, 55,627, 55,628, 55,633, 55,635, 55,639, 55,641, 55,642, 55,646, 55,669, 55,671, 55,672, 55,686, 55,688, 55,694, 55,696, 55,701, 55,704, 55,705, 55,708, 55,709, 55,716, 55,718, 55,721, 55,722, 55,724, 55,726, 55,727, 55,730, 55,732, 55,743, 55,744, 55,748, 55,749, 55,751, 55,754, 55,762, 55,764, 55,771, 55,778, 55,781-55,783, 60,476, 60,477, 60,480-60,482, 60,485, 60,487, 60,490, 60,494, 60,496, 60,497, 60,504, 60,506, 60,515, 60,517, 60,519, 60,527, 60,529, 60,539-60,541, 60,555, 60,557, 60,558, 60,564, 60,569-60,572, 60,575, 60,578, 60,581, 60,588, 60,591, 60,592, 60,599, 60,601, 60,605, 60,607, 60,618-60,620, 60,622, 60,630, 60,632, 60,633, 60,637, 60,639, 60,640, 60,642, 60,645, 60,648, 60,657, and 60,660, wherein said one or more gRNAs has a cutting efficiency of greater than 40%.

2. The one or more gRNAs of claim 1, wherein the one or more gRNAs are one or more single-molecule guide RNAs (sgRNAs).

3. The one or more gRNAs of claim 1, wherein the one or more gRNAs is one or more modified gRNAs.

4. A kit for editing a SERPINA1 gene in a human cell, the kit comprising:
   (a) a polynucleotide donor template comprising a nucleic acid sequence encoding at least a portion of the wild-type SERPINA1 gene;
   (b) at least one polypeptide comprising the amino acid sequence of a site-directed endonuclease or at least one polynucleotide comprising a nucleic acid sequence encoding said site-directed endonuclease; and
   (c) one or more guide ribonucleic acids (gRNAs) comprising a spacer sequence selected from the group consisting of the RNA sequences corresponding to the full-length nucleic acid sequences of SEQ ID NOs: 55,559, 55,574, 55,575, 55,577, 55,578, 55,584, 55,586, 55,587, 55,600, 55,602, 55,605, 55,607, 55,616, 55,625, 55,627, 55,628, 55,633, 55,635, 55,639, 55,641, 55,642, 55,646, 55,669, 55,671, 55,672, 55,686, 55,688, 55,694, 55,696, 55,701, 55,704, 55,705, 55,708, 55,709, 55,716, 55,718, 55,721, 55,722, 55,724, 55,726, 55,727, 55,730, 55,732, 55,743, 55,744, 55,748, 55,749, 55,751, 55,754, 55,762, 55,764, 55,771, 55,778, 55,781-55,783, 60,476, 60,477, 60,480-60,482, 60,485, 60,487, 60,490, 60,494, 60,496, 60,497, 60,504, 60,506, 60,515, 60,517, 60,519, 60,527, 60,529, 60,539-60,541, 60,555, 60,557, 60,558, 60,564, 60,569-60,572, 60,575, 60,578, 60,581, 60,588, 60,591, 60,592, 60,599, 60,601, 60,605, 60,607, 60,618-60,620, 60,622, 60,630, 60,632, 60,633, 60,637, 60,639, 60,640, 60,642, 60,645, 60,648, 60,657, and 60,660, wherein said one or more gRNAs has a cutting efficiency of greater than 40%.

5. The one or more sgRNAs of claim 2, wherein the one or more sgRNAs is one or more modified sgRNAs.

* * * * *